United States Patent 12,344,895 (LONG NON-CODING RNAS (LNCRNAS) FOR THE DIAGNOSIS AND THERAPEUTICS OF BRAIN DISORDERS, IN PARTICULAR COGNITIVE DISORDERS) - sequence listing, part 2

SEQ ID NO: 469 - DNA, 10138 bp, Homo Sapiens
ttctgtagctgagctgggtttgggctttactgttaatttagtaagattctgttcaccacagacttcatgtgatttgaaggccaaatcagaactctccttttcttgggctcaggtgcctgtgggctccatcttagctcccctgcctttccttgggtgtcgtctggctcctgacatctgcacctgggggaaccctccaccccctccccctccctgtggtaaacgccccctgctttctggggtgcctctggggcttcgctcggccttggtccctgcccttagactgcagcaggcttcgtgtgcctgcgcccgagaggtggggccctctgcttccctgtctctctgcaggcttcatgcgcctgcccccgagaggtgaggtccactgcttccctgactctctgcaggcttcatgcgcctgcgcctgagaggtggggccctctgcttccctgtctctctgcaggcctcagaagaaggcatggggtgtatgaagggctcgtcccccttcacgtatgtgcattgtagtactactcacaatagcaaagacatgcaatcaacttaaatacccatcaatgagagactggataaagaaaatgtggtacatataaaccatgaaatactatgcagccggaaatcaaatgtttcagaaataattaagcaaatcaaagcatggaactctctaaaatcattattatttataccatattttagtgagagcaggaaatgattgacgattccaaaattacacagaaacttttcttttatataattcttatctcatccttcaaaaatgtctttttgttatgtgatgtgtataacatagtaacagttcttgtacacaacttttaaatacgtgtgcatgctcattgggattcacgttccgaatttcaaaacgtagttcttgtttcaggaagttcagaggttactcttttggaagatccattcttggatgtgctggcaaaagcactgttgtagagatgcttttgggggaggctgcacatcattcatgaataagtcccaaaggcagcatttctaataatgcgttgtctaatatgtattagagctggcttggaggtgtccctggggagcccctctttccttcgcatccatcccggaagctcctcgagaggtgcctctgaaagggatgtggtgccgtcatccctctggagctttgaagccatgcagccggacttcagcaagaatggttgcatggactgttcaaacccgcacctgccggccagcggctgaagagcccgtgttgaccataagggacaggaaagggagcactctctgcacagcctcggggccctgctgtggcccttacctgggagggctggcctggcgcaggcacaggctgctgaggaccagctgctggccggccctgcccgaccaaggccacctgtgttttcattcccaaatttattttctggttatagggacaatgtccctataaccagagtggtattaatgtgtaggtggcacagttgtgtacttatgggtgtggtttggggaactctgtcttaaagagactgccggctccttgaggacaagaacttggagttgcttccatgtttcctgttgctaaaccaggttggcataaagtgggtgctcagcagatgtttactgagccgaatcccatgtacctacaggctccaaggttcccgctgtgatcattcaaacttatggatctcctttgagggacagctggaagttgtttacagaatcagacatggagactttctccttcagacggaatctaactggtcagttttaaagctgtggcattccctggcggggccactgtgctagttctccccatggcgggctttataggaaggccccctcttcacacagaagccgggaaggcgtgcctcggtaagggtatagccctgagtgtctgcaccccccaaaacccctgctccctgctcgtgtgtgacaatctgacttcagacagttaatctttctggctcaagcatttggaatggagatggactgaacccactgggcgttttagttgcatgtaagccgcactccgggctgagcttgccgagctgacttcactgtctgggctgcctgcctggggtgctgggagccaagtgcccatttccagaagctcgctgtgctcccccaggtcagctcctgtctgcctcacctcaccgtggtctccttttcctaatgcgtgatggagaccagcgtcgtgtggcatccatggaccccatcgaggaccttttgatcagtggtggggttgggatggggacaggaggtggtggggttgggatggggacaggaggtgagctgctcatggtgttgatttcttctcctcgcagacacaaggagattcagaggtcctgtttgtgcctctgtctgctttttcttcctggaaattttcttcctgggattcaggacctgaggaaggtctgggtgtggcctcagctttgggccatgaaacccatctggacagatcaggctgacctctgggaagcatctgtgtgtggtttagacagggagagaagctggatggaggggagtggtgctgaagtgggttgagccagtgggggtcaagcggctaagctccagaggggggtctgggctgcaggcgaggaggcttcctggggtcctcaggcggcccctgcacccccagctcagtgggcctggcgaggaggcttcctggggctgtcaggcggcccctgctccccctgcctcagtgggcctggctgtccccttagcacaacggcgagttccaacactggatccctgggagagcatcttttgtttgcttttgtttagtttaaaaatagatatattaggaatcaagatgagatgaggttagtccccaaagttaaattcctcttccttgcctttgagctgtgccattccgaacgcgtctcctttagtccccctaggatccggtctgggctgggcttgcggatgccaggcccccccgatccaccgtgtcagggccagctccatctgtcctgtgtcagtggggtcctcaaacaggatttattttaaatcatcactgcaggagataatctattttccataataatctgcaggtagctttactaatttcctctggagcggggatggaggctcgcctcgcttccgagaggctggggccgcgcctggctgcactgatgccttatcgcccgtgtcctcacgcaaggcttcactttggtgtcaggatctcgggggctcagaaatgcgggttcattgtgggtggagggtaagcccttcctcagcaggtcatgaccagaggtggtcggacggcaaggactgctctccaggcacgtccagcagggacagtgcggccgggccctcccctcggccgctggaggctgcagccctcaggtttctggcagtgacaggcgtcctccagggagggtctgagtcgcaccctccacattggctgaggacccagctcatgctgtgggagaggaggaagcttccatggctccaggactgtcttcctgaaggaagttcgtgggggtgggtggtggaagggggtccggccctaatggggctcccgttgtccctcagcacggcctctgctgggggtggtggcctgaaccctcactccaggggcccaagctccaggtagacgtgcccagcttagctgtgtggttgcccttgggaaccacagtgggtcgggaatcaggcgccccagggatgtctggctctacactgtccctccctcccacagcacaaggcctagtcccctccctgccctgcccagagcccccagttcctgcactcgcgacccaactcctttgtccccactgactcctttgtccccacctttacagactatccctgtccctctggcgaccccgcttgtgcctgctgcttcctgctgttatccctcccggtaccacattctaatcacttgcgattagatcggcactcaggcctctggacacccgagcatgacttctgggacaagctgtgtcttctcccccaacctttaaaaatgtgaaccatgattcaggtggtgaataaaagctggcacggaattaagcggtggatggatgcgacatctttatcgctgtgtcctgattgtggtgcaggacggtcctcgcggtgccgtggctgtttctgtggcggtcgtcggcgcactgtggtggtgactgtggctcacatgcacccttggaggccctcggaggtggcaccacatctgcggacacagcagccccggtggcctcaccctctcactgaggattcccgccatcacctggcgacatcccctgaagattctttttaagaagtctgtgccctacacggcaacattaggctgtaggcgtcacgctcctgtgattgtgaagtcaagcgaccgcggcgtcaggcggggctccgtgctgtgagtgtggccaggcttgcagctgtcagtgctggggagaagttcaggggtccgggcatctgggcggtccttctctgatgccacatcctgggaatggaactccctgaatggaggggcttctctccgttttctcggggcagttttgtgatcggcattggccttgtgttccttccttccctcactgatgtgcacccgacgcctgcatgtggactgacggcctggggtcaggacgctgctgggggtcaggggtgtgtggtgggctgtggcggggtgtggtgaagcctgcctggcctcgagcccggtggaggctctgggaagccccctgcttcctagtcctgacgggggccggtctccaccttcctttggtgttccagagacctgaagcggaggggccagtgtggctccaaggtggccggggctgtgcggtgggctccggagcccccgaagcactctttttctgcagaaccgcatctgggcctccggaaggaagctgcaaatgaaccggcagcagcttccccgatggccctgtcttggcagccctcatccgggcaaggactctgtgggagagcagggccactctctgtgatgccaccgccgggatggctgagctccagcgtggtgcccgtcctgggtctgagggcccggcagccgcccttccgtctgctgccaggagtgtgtgtgcccagcactggagagcagtgagaggcactggtttcccagcacacagtgtgcgcctgcccgctcactctcccggctccgtgtgtgcgcccctcatcagccaggtgctcgctttcccggctctgtgtgtggggccctcaccggccagtgtgtagctgcatggtgtttctggggggctgctggcctgccaggcatggcctctcagtggccagcatggggtctgggggtggtctgggatggccaggcgaggggctaggggctcgggggcagctgtcagcccttgggtgtcaccctgcacttcctgccctgtggccacatcctcccaccctcttctctgtacatcacgctgaagaacaaacaaaaaatctcaccaaacgcgtgttggaggtggccaggctggctccattccgggggccctggtgataggtttcaggatggcagcagcagggccgtgggatggggagagtggactcagctcctaccgccgtgaggatggggagggaggggacaggacgtgtaaccgtggacgaggaagggccagggatggaacaccgtgaacaggaagcatcagggtgaggggctccgacagatttgataggaccacggctgatggccggcagggctcccatgacgctgatgtgccggtattttcacccagtggagcggctccccctcacgaggacagagcgggaagccccaggtcaggcctcattgtccatggcaccagtcccctgccagcctcctgatgctctccaggcgggcaggggcctttcgggccaggggaagaaagtgacacccgcccttctgtgcctggctttgggtcacctgtccccgttccagggcagcgtggcacaggtctgagggctctgctggtcactcagcccctgaggcagccccgccagcccaggcccgagcacctcttccctccaggctgggcacagccagtccccacctcccaccttctgcctccgccagtcccgggacatggagtcacaccttggaggagattcacactgtgtcatcagctggcgcgcaggtgactccggagcgcggatcgtgccaatcggcccagggaggctccgcgccgtcaccatctctccccacgccctccgcccatccctgtccaccccctgacccacacaccctcggctctaacccgggatttcgggttttgctgccatttagaaatgacattcttacttgttgaattctaaaatggaagcaacacagctgtctagtaaatcaaatttagtgaataaacgagccgttcttgtttagtattgtctttaggtcttatttctcatgtctcctttcattagaggttttcattgtaatctcttcggctcaacaaagacaaccaaatctgccctgttaattttgtaattgaggtctatgcaaacatattgccatagccatggaaaatgtttactctttttcagctgaacacacagtacatttttagttgaataagatccaactgaaaggcataaatcaagcgtttaaaaatagaaagaggatcgcaaagcctagtatgtcaatatgctcgtcaagtgttaatgcagaaaggcagagttaggcggccccgggcgctggaaactgcgtttgacctcctccctgcccctctgcgtctacagttcagttctcacagaggcctctggcgggaggagccaccatttagaatacagatggccaaaggaaacaccatttttaaatagttactttaaaaaaatcctttcagatgaaaaaatctgctatggttgatctttctggtgttggtgaaaggaaagagaaatctccgtgtggggaggccctgggcagcgttcagggaccgagccctgtggagcggaaaggctcgagactggacctatcttgcaaaaacaaggctcctgttagcagaatcgaagtccattgaggagctggaagaagacaggtcccttctctaaagcactgtgattagctcaagctcgttggatttgcacttttggagaagatgtgttcagtgagggctgtggaaggctaggcaggctggacgcccggctagaggccaagcctgcagacggcagaaaggcgaatgcaccttccagatggccgcctttcctgaagaactgcctggggttgcatttgtggaagccagccatccttcatcaacaaagcaacaaatatcgattgttcaatttacacattttcattttcataattttatttgtacacatttgaacaccctgaggtttgtaaacatttagtaacttatccaaaggtcacaggactatccacgcttcaaatccgggcccctgtcctggacttgcaggggtgcaggatgaagaaaccccagcctgctgtgagggacctgaggctgctgggagagctgagaagtgtgtgcggttgcaatgacgaagcgtgcacggtggctgggagagctgggaggtgtgtgcggttgtgatgatgaagtgtgcacggtggctgggagagctgggaggtgtgtgcggttgtgatgatgaagtgtgcacggtggctgggagagctgggaggtgtgtgcggttgtgatgatgaagtgtgcacggtggctgggagagctgggaggtgtgtgcggttgtgatgatgaagtgtgcacggtggctgggagagctgggaggtgtgtgcggttgtgatgatgaagtgtgcacggtggctgggagagctgggaggtgtgtgcggttgtgatgaagtgtgcacggtggctgggagagctgggaggtgtgtgcggttgtgatgatgaagtgtgcacggtcgctgggagagctgggaggtgtgtgcagttgcgatgacgatgtgtgcacagtgacggcactgcaaaatgtgacggaggctccgagcaggggttcctaggggccggaggctgggtctaccctggttggggctggcccggtggaaggaacgagaaagacagtctcaggaacagtgacgtgtggagatgggaggatgagacacgcccccagtactgaaggagaccctggtggtggcaaaggcgggttgggacagaatgtgggaggctttgaacatcaagacacgagtctggactcatttatagtcagtatttttttatgagttaaacaaaaagacgtgtggcattttggggtctggacacttttaaatcaatgactcctaagtgtttacaaagcaggaaacaaggtttgaaccatgagcttcaggagcaggacgggctcctggagcctgaaaggagcccagtctccctctctgtgggcggccggatgctcctgacttgggtcaagagggagagtcgttctcctggtctctatgccgggctgtgaccactgcctgtcattcaagatgaccctttcggggtgttgaggactgaggcagctctggaatgtcaccctacctgtaacctaacctgcccagcttcatgggtgctgggaggagatatggggctctgaggtcagggagggaggacagcttgttacagcagtgacagtggctgtgaacccgcaggaccccatgtctactcagccccgtgaagggaccagtgctgccgcacacaccatgagtcagggtcataggagagcacccctgagtcttctgccacagaggaaggcactgcctttgccttccagggctgtatttgctttcaggcgtccttgaacaggtaggcctgaacaaaggggaggccagtgtctcgctacatggggtgtatggaaaatgtgccacccgcagagaattgccttccagtggtgaatcggtggcagctggcagacccagctgagctgtgctgtgggtaagccagtggtgggagaggcctcgcccctggaagcatggtgcccatgtgttgccgccacgtccctggggtctctgggctggagttccaaagtcgtcttcatcatgaagaagcacatccaggctatgggcagaactgtcttgaagccgtccagctgtttaaattctacattctgtggggcatgcacggggttggcttattcaaccttccttccattctccctgtggttggagaagacagagaacaaaacaactcatttccaagatgcttggcagctgggcagagtccaccaacgagaggcacccaaaggcaatccaaaagacaggcggaagaggagcgcatcttgttgccattgtgccatgtttgctggaaagcaccgttgttgagatgtgagtatttctgcgtgatgtccgttcttcaaaccccagacgcagttggatggcagcggatggcagccgtgaccccgcgggctcccggcttctgctcctggtccccagctggctcaggtgaatccatggtcaatggcagccccaggaatggcggcccccatgatgggtgggctttacattgtcctgcaagtagtttctgggagccacagccaagtgagaacttgcttcaactttccagtcactttcagagacaccagcattacctcctttcctgctgaagacacctggagtggcttcccttctctgcctcaaaccctgactggttcacattcttagttcataccttactgttgtttacaaatcacctgcaaactcttggccacagtgcagcgggggcggggctgagcactctgctcctagggtgtggccatcgtggctgagcactctgctcccagggggcggtcaggcaggggtccgggatggagagagggcggccccattaggggcgatgagatgctctcgaatctgatttgatcatccccactcctgctcctcagccccctggagccgcatgtctccttcaaggctgctgtgatgtggattttcacctggcgtccatggatagccacgtccagtggggaggggtgtgggagcaggagagcccctcgggggccccaccctcctcctgcgcacgttgctgctgctggaatggcaggacacaagctgctccagactcagtgagccctcattagtgagctttcttcatgggctcaggaagatctacggccctttgtctacttttgaataacaagttatcccaaatgcaatggcttaaagcacacattatggcacagtttatggggtcgggaatccagggcctgtagctgggcacctcctgcccagggcttctcctgaggacagcaagctgtggccaggcccaggtctcat

SEQ ID NO: 470 - DNA, 10865 bp, Homo Sapiens
gactcagggctgcggccggggtcctgcggggtaggagcgcgaggccggcctgagggaggaggcctagcgacccatccggcgcctcccgccccgggcacccgcccgcggccgcgcatcctgcgggccccaggaggcctccatctcaaaacaacgtgtttttaggtaatttcaaacttagggaaaagcttcaagaataataccgaaaatgtcagtgtccccagcacctagatcccccagttaaatccttttccatttcaccgcgctgccccccgccccctggacggttatgtggccgcgtggggttggctctgcccagggccgcggtcactgcacagaacgccctgcacgtaaggggctccgcctgggtaagaccccgcccagctgggcaggaggagggcgtgggcccaggacatggagaccagcctgggcaacatagcgagaccccatctctgcagaaataaaatattagccggacggtgcacggtggctcaggcctgtaatcccggcactttgggaggccgaggtgggaggatggcctgaggttagtgtctcacatgtctgtgtgaagagaccaccaaacaggctttgtgtgagcaacaaggctgtttatttcacccgggtgcagcccggctgagtcggaaaagagagtcagcaaagggcgatgggattatcattagttcttacaggttttgggatagacggtggagttaggagcaatgttttgcaggcaggtggtggatctcataaggtacattctcaagggtggggagaattacaaagaaccttcttaagggtagaggagattacaaagtacattgatcagttaggatggggcagaaacaaattacaagggtggaatgtcatcagttaaggctgttttcacttcttttgtggatcttcagttgcttcaggccatctggatgtatacatgcaggtcactggggatatgatggcttagcttgggctcagaggcctgacaggagttcaagaccagcctggtgaacatgacgaaaccctgtctctacaaaaataagaaatgaacgcagcatggtggcatgcacctgcagtcccagcctcttgggaggtggaggcataagtcagctgtgaatgcgccctgcactagagcctgggcagcagagcagacccttcctcaaacccaaaaagcgtcgtgccaaccagaccagatggtcgcctaatcaatagagaccatgcccaatcaggtaaggacagacacaaccaggcatgctttttcttgttttgttttttgtttgttgttttgagatggagtttcactcttgttgcccaggctggagtgcagtggtgtgatctcggctcaccggaaccaccacctcctgggttcaagcgattctcctgcctcagtctcccaagtagctgggattacaggcatgcaccaccaggcccggctaattttgtatttttagtagagacgggggtttctccatattggtcaggctggtctcaaactcccaacctcaggtgatctgcctgcctcggcctcccaaagtactggcattacaggcgtgagccactgcgcccagcttgttgtttttctttagacagtgtcttcctctgtggctcaggctgaagggcactgggatgatcacagctcactgcagcctccacctcccaggctcaagccatccttcttcctcaggctcctgagtagcgggagctacaggcatgcgccatcatgcctggctaatttttgtattttttgtagatacggggttttgctatgtagcccaggctggtcttgaactcctgacctcaggtgatccctctgcctcagcttcccaaagcgctgggattacagaacatgagccactgtgcccggcttattgtacagtctttactctcggttttcaccagagaactcaagggctgtgaaaagagcaggacctcaccagctgcacggcggtggtgactggctccatcttgctgtccctcccaatcacacaacatctccccttgaaggctctgcccaggcccggactcccacctttcaagatgtctggatcagtgcaggacctcctccttggccacatcgctctccttggactggttcgttaaccctgttttacccacattttctttttttttctttttctttttttttttttttctgagacagagtttcattcttgttgcccaggctggagtgcaatgactcggtctcggctcattgcaacctccgccttgcaggttcaagtgattctcccacctcagcctcccaagtaggattacaggtacacaccaccacgcacagctaattgttttgtattttaggaagagatggggtttcatcatgttagccaggctggtcaggtgatccatccgccttggcctccccaagtgctgggattacaggcgtgaggcactgtgcccggcctgccccccttttctcttgatgcacatgacagccttcttgcaatcaagaaactacgtgtggccaggatctcatccactatcacagtttcagctttccccaaactggaatgtgtctttgcagacgcccatccttattaaagggcaaagacttctcatacacctaggatggatcttatattcttggcgggactgcagagaaggtgccgtgtcctgagtcctcatgtcagggcacaggcttccagccagttctacctgggttatgtttatctcaattccctggtggtattggtgtctgctgggttttgccagaatgaagacaccgtgttttcatttgtcagttgattcgtattttccaggaagacattctgagattacagcattgtcttagtcaaggtgctgcagaaggacagaactaataggatatatgtacatatgaaagaaagtttatgaagaactggctcacaccatcacaaggcaaagtcccatgacaggccatctgcaagctgaggagcgaggaagccagcagtggctcagccggagtccaacagcctcaaacggaatccaacagttcaggcttcagtctgtggccaaatgcccagagaccccggaaagctactggtgttagtcccagagccggaaggccaaagaacctggagtgtgatgtccaagggcaggaggaatggacagaagcatccagcatggggtaaagacgaaagccagaagactcagcaagctagcttacctactttcttctgcctgccttgttctagccgcgctggcagccggttggagggtgcccacccccactgagggtggatcttcctctcctagtccactgactcaaatttcagtctctctgggagcaccatcacaccagaaacaataccagccatctagccacccttcagttcaccatcacaaccattgtcttattcatgaaacttctgcagacccaccttaacctccatcggtgacttctacctgaagccctctgattgttgcccagtggtgctttttaaaataatttccatagtttcttctacacctttagttggcattctactgtaaaggagagattttattttcttactcatttatttgttagtttatagtcaccaccatatggatgcagagttctgtctcattcactgggaagtattctattgcagtcatgatttattttgatgttcacatcccagagttggtgagtgagcgccccttcacgctggctcccgagtgctgacgtgtccccgtccttctctgcacttttccttacctcctggcctcagatattccagggtcatttgttctctccctgctccaaccctgcagtcagccatctccctagggacgttggttcctttatggaaggtggcatttagaagccaggatttgggctgagcactgtggctcatgcttgtaatcccagcacttggggaggccgaagtgggcggatcgctggaggccaagagtctgagaccagcctggctaacatggtgaaacccttccccgtctctactacaaataaaaaattagctgggtgtgttggcacgtgcctgtaatcccagttactcaggaggctgaagcaccagaatctcttgaacccaggaggccgaggttgcagtgagccaagattgcaccactgcactacagcttgggtgacagcgcgagacaccgtctcaaaaaggataataatttaaaaaacagcaggatttgggtgagcagtgcgctcattgcttctgggctctctcggtggacataggctaggaatgtaagatgtatgtgcctgtgtatatacacacgtctgtagctatgtctatgttgcatacatgtgtttttccaaaaaccaaatccataaccatgccttcagtttcagcccaacacctccgggctctttctagctttctacctttcatgattgtgaataccttctccagcagtgagaaacctggctcctttgtcctcagtggattttcttatttgctcaatttttttgttttttgttttgtttttgtttttgagacagagtcttgttctgtcacccaagctggagtgcagtggcataatctcggcttaccgcaacctctgcctcctgggttcaagcgatactcctgcgtcagcatcccgagtagctgggattacaggcatgtgccaccatgcctggctaatttttgtatttttagtagaaacggagtttcaccatgttggtcaggctggtctcgaactcctgacctcgtgatctgggtgccttggcctcccaaaatgctgggattacaggcgtgagccaccacactcggccaagtcagaattttaagtttcatcttttttgtaattaattgaacacctgcattcaaagaaacagagaagtaccaccacgcataagtaaggtggccatggcgtacctaggtttctcagcctatcaagcttaggggcttctttttacgtgaagtcctcctaagacagcctctgatagctgccttgtggtcagcagggaagaagggccttgtaatagcacgactctgcagggaggcgggcagctctcatggccttagtttgcagacctcgagatgtccactagaaaggaggagatcgtggctggctgcggtggctcacgcctgtaatcccaggattttgggaggccgaggcaggcggatcacgggatcaggagatcgagaccatcctggctaatgtggtgaaaccccgtctctactaaaaatacaaaaacttagccgggcgtggtggcgggcgcctgagtcccagccactcgggaggctgaggcaggagaatggcgtgaacccgggaggcagagcttgcagtgagccgagaattgcgccactgcactccagcctgggcgacagagcgagacttcgtctcaaaaaaaaaaaaaaaaaaaaaagaggaggtcgcagcgtctccagtaacacatcaactccgcaacaaggggccacaagtgttcctcgccaacgggtccctgctacgatccctattttaaataaggggaaactgaggcgtggagggggtaagaaacagagaagtcagaattcaaacctggacgacgcctgttagttttttgggattacaggggtaagccactgtgcccggccacacgtgttagttttttgggattacaggggtaagccactgtgcccggccatgcctgttagttttgtaactccagcattcctgtctctcctgcatttgtcaatagcactagtcctttgtggtgagttttttttttttttttttttttttttttggagacagggtcttcctctatcgcccaggagtgcaatggtgcgatcttggctcactgcaacttccatctcccaggttcaagcaattctcctgcctcagcctcccgagtagctggaattacaagcacccaccaccacgttcagctaatttttgtgtttttggtagagacagggttttgccattttggccaggctgggctcgaactcctggcctcaagagatccgaccacctcggcctcccaaagtgctggggttacaggtgtgacccactgcgcccagcctttttttttttttttttaatacagattgggtcttgctatgttgaccaggctggtctagaactcctggcctcaagcgattttcccaccttggcctcccaaggtgctgagattacaggcatgagccaccgtgcccggccaggaccacccctttggagtgatacctctccccaattttatgtggctctggtgggtcatccctcagtgtccacttaacagtgacagtgacgttatgtcctgcttttcccagaagagtcccaggttatgttaactgttctagcaaaattattcagagcaccccattttcagtctcagaaatgtctccattagtgtcatgtgaagtcaccctaaacgaggtcaagaaaatcatccaggctgggcgtggtggctcatgcctgtaatcccagcactgtgggaggctgaggcaggtggatcacttgaggtcaggagttcgaggccagcctgcccaacatggtgaaaccccgtctctactaaaaatacaaaaatcagtcaggcgtggtggtggcacctgtaatcccagctactcgggaggctgaggcacgagaatcacttgaacccgggaagcggaggttgcagtgagaccagatcgtgccacagcactccagcctgggcaagagtgagactgtctcaaaaacaaacaaaaaaactcctcttagttcatgcgtggattctgatgcaggcttgcagggagaccctcaggtgctgcccatgagtagctgcgttgacggtagctgcttcctggctaccccgaggggctgctctgcagtcaggggagaggggccggctctcagggaaaggcatcaagaaccacacttgagttcctggatccgggcacatctaaaatttaggagcccataaactcccgttttcacagaacctattttgagttgggttcttgccacatgcaatcagaagtcctggccgacacacaactttggcttcagcagtctccctgggtgtccccaccccatcccgttccctgtgttcaaaggcgcttggggccatcctccactgtgaaactcccagacacgccagcccagctgcttcaggtgtgcgctgggaaattttcactccctgaattccaaaaatgatggcagcctctgcctcaccctcataaacgcaacgtttacatttattgtccagttgtttcaggacgtggattttctttgttttgctttttttttttttttttttgagacaagagtttcacttttgtcccccaggctcgagtgcagtggcgcgatcttggctcaccacaacctccacctcccaggttcaagcgattctcctgcctcagcctcctgagtagctggaactacaggcgctgccaccacacctagctaatttttgtatttttagtaaagatggggtttcaccatgttggccagcctggtttggaactcctggcctcaggtgatccgcccgccttggcctcccaaagtgctgggattacaggtgtgagccaccgcgcccagcccttttttctgtctgagaacaagaagacagtaagctctggggaaaaaacaggacccaccttcatctttcttatctttgctgtgcacttcttacaaatatttgctgaggctgtgaattataattgcaaaagtagaatccactgtgtccaagcagaagagagggtgtcatggggagcgggcagtggggagtcacctgtctgccaggctggacgggtgaacacattcatcatctttaggcatgcgagcttctcctacctctatccatccttccttcagcccatttcccccgacttctgccaccacctccgggacgtcctgaaggcgaaccggcctcccacctgctaagtccaacagacacttcagcctggctctcaccagccatggcgggttgccctcctacctcttgacaacacgctcttcctcggctgcagagacacctcctctccgtattttcctcccacattagcaatgaccacactcaggctatgtcactcatggtatttttgcatcagaaatgccatccttgggccgggcgccatgcctcatgcctgtaatcccagcgctttgagaggccgagccgggtggatcccttgaggccaggagttcaaaaacggcctgggcaacatagcaagaccctgtctctacaaaaagaaacagtttttaagtcattcctgattttacaacgctactctgatctgagcccctgtggcctcgggatccccaggcgtctgttcccgagaacgcggggcagaaagcctagtcctgcacgcagtaccaacaatgcggagtcagcgggttgtttcgactttgttctgtttcctgaggggttctgaataagggccacccccttcctcctctgtgccgccatgttccctcccggccacgcccccttgcaacccctccaatctccgccctgcaccctggcagctccccctggcggcagcagcgggtcttcgtggagtcagcccctccgctgcttggccgctgggtttgtcccttattttaatggatgcgcgttggctaggactgcaacattgtttctttcttccacaaattttagtttgaaacagacaggaagttaatttcccgtctggctgccacacctgctggtggcgtggactgcggcccttaggctgttccttgctcgatttaaccctgggagacatcgaagccttcccacccaagctgtagggagctgttgaagacctggttcacacgagatcctttgcggggtgcagctggggaaagcatgatttcagcttgtaagctgcatggagaatgcaaatgtatgtgtgtgtgtatatatatatgtgtatatatatatatatatatatatatatatatatatatatacttttttttcttttctttttttttctttttttttttttggagacagagtgtccctctgttgccaggctggagtgcagtggcacgatctcggctcactgcaacctcctcctcccaggttcaagcgattctcctgcctcagcctcccaagtagctgggactagaggtgcacgccaccatgcccggctaatttttgtatttttagtagagacagactttcaccacattggccaggctggtctcgaactcctgacgatgtgatccatccgcctcagcctcccaaagtgctgggattacaagcgtgagccactgtgcccggccaatgtatatattttttcaagacagctcaacccaaagtagcaccagcatggacaggccgagtgacgaagacagtgctggaggcacacagaggctgtgggggcaagtatgcggccggctggacctgcggggaccctgcccgtggctggaaaggggaccagggggtccctgggaaacacagggctctgacctctgtgcagggtgaggaagggttttaccagcagagggagagctcagcccaggcccgaagtcagcacgacgagcagctgacccctgggatctttgaggaacctgaaagtgcttgatggtctttgtgaatctgaaatccgagcgaagcgtcagaccctcgagtttccccaggggaactccgttagtctcctgggatttgatgtattcacgctttgttccttctggaccagtcacgccccacgccaatctgagccgtcgggggttggcccttccaggatgctgtgattaggtctagggaattccacctggagggaagggtgggctgtgtcctagggaattccacctggagggaagggtgggctgcgtcctcgggagggagacagcaggtggcaggcttcggcctcccaggcagccctattgaaaagtgaagccacctggacttcctgggtcaagtggggactgggacaacttttctatctagcaagaggattgtaaaatgcaccaatcagcgctctgtaaaatgcaccaatcagcactctgtaaaatgcaccaatcagcactctgtaaaatgcaccaatcagtgctctgtaaaatgcaccaatcagcactctgtaaaaatgcaccaatcagcgctctgtaaaatgcaccaatcagcactctgtaaaatgcaccaatcagtgctctgtaaaatgcaccaatcagtgctctgtaaaatgcaccaatcagtgctctgtaaaatgcaccaatcagcaggattctaaaagtagtcaatcgcagagaggattgaaaaaagggcactctgataggacagaaatggaacatgggcggggccaataagggaataaaagctggctgccaccaaccacccccgccccccccccccacctctagccagcagtggcaacgtgttcgggtcctcgtctatgctgtgaaagctttatcctttctctcttcacaataaaccttgctactgttcactttttgggtccgtgccatctttaagagctgttaacactcaccgcgaaggtccctagctccattatcgaagtcagggagacaacgaacccaccagcaggaaccacctccggacacactatgtccctgcatccccgaagctcccgctactccctggaatattctttgaaaagggtccctgtgtccttttttgccagcaacagaaactctaaaaacagccaccattatagcaatcaattaccaaactcttctgctgaggccaggcagaaagcaaagcacaacggaccttaccaggaggccccgccgctcctgtccagcccctgcccactcactcaggtgctcatcacccccaggaggctccactgctcctgtccagcctctacccactctctcaggtgtccatcacttccaggaggctttgcgctcctgtccagcccctgcccactcactcaggtgctcatcacccccaggagggcccccctccctgcccagcttccccctactcactcaggtgctcatcacccccaggaggccccactgctcctgtccagcctctacccactctctcaggtgtccatcacctccaggaggctttg

SEQ ID NO: 471 - DNA, 2486 bp, Homo Sapiens
gtagtagtcggcgtcgtagtcgtcttcgtccttgtcgtcttcctcctcctctccgctgtcctcggagccctccggggagtgcggaggggcgtgagcgagcccatggctctggggggcggcctcctgcccgccgcgcggccgaggcccgagcgcccccaactgctccgggtgccctccggggacccgcgccccgggaccccacgcctcaggtgacggcgagggctgctgtaggctccgcccgtgtcccccggcgtgctcacgtgggagggtgtctgcggcaccccaggcgtctcccgcggctgccgaagaggccgccaccgcagctgcggctgccgcccggagccctagccccccggtgccgcggggaccccgccttccccggagcctggacagcgtcctcctcagagggtccgccatcccctctgccttagccgcgaggctcacccccgccagggggagaggtcggagccccgctggggagaaaaccgcgctcgcggaggcggaggcggaggcggcggcggctccccatgaccggcgctggccctcgccggctcctcacatacttggcataactctgccgcgggaaggcgtgggggagggcggtggcgccgcaacgcgcatgccccggagccccgggccgcgacggggcgcgcgggccgggggcggcagaggtgggttctcggggtgggcgagtggtgcaggtggaggcggagggcgcgggccggtaggttgagtagtaggtcggctgaagctgaccgacggaagcaggggtgggcgcacagagcgcgaagggtgcggggagagttgaggcaggggaaagaagaacgagcaggaacgtgagtttgggctggtggctgcaaagttttggttagggagcccgagaaagggaaagtgccctcctggctgtcaccccagcaccttcaccgccaccgctgcacgaggtgtgtcttaggcacagcaagtcctagcttgagagaaaacaaagattgttttgacggacaaagtacgagtgcaggtgtatctcggtgcatgtgttctagaaatgtatcaatcattttaatcgcccagagagctagctagctaaaagaaatttgcagcgattccttttctataagagttcttttatcaaaaacaaaacaaaacccacccaccgatgtctcttttaagtctgtttttccttctttatttcagttaatgcatgctaacaaaattattacatcagccaaaacttgtaaaatggagccacaaatattatgtccctcatcaccctacctacaagattatcatacaggtttgcagctttctaatataaaaaagttaacacttcattttaatttaaatagtgagttgagaagcaattgaattgaagttgagacacagtgtaatctagaaataccggctgtctcccaaaaacgttaaattccaggttctgggcagcagttgcaaactcaagtacccctcgttgccagagattaattgattcagtgactgataagaatcagtcgtgctatcatccctgatttgagttactttttttagtgtttacatagtagaaagggcctttttctgagttactcataaatatgctgacacctagcacagtgcgtgcacttagtagatactcaaatacttaagaaaatatttgttgaataaataaatgtttgcattactgaataaaatgaaataattttgccctaatttaccttatttgcaactgcagtatattttcctatgtcagttgttttcttgttgtccagtggctccaatctctgaatgtgctttgactatactacctttattagtacctagtctctgctttctggaataattgttacctgcatctgagatttgcagataagagagaatatttgcagaaatcttacccactctctaaaactctgctctaggccaggcggggtggctcatgcctgtaatcttagcactttgagaggctgagatgggcagattgcttgagcccaggagttcaagaccagcctggacaacatggcacaacctggtctctacgaggaacaaaaacaaacaaaaaaaaaaacacaaaaaaaattggctagatgtggtggtgtgcacctgtagtcctagctactctagaggccgcggtgggaggatcacttgagcctgtgaggctgaagctgcaatgaaccgagatcatgacacttcattccaacctggatgactgagggagattctgtctcaaaataataagaataaaataataaaactcagctcaactgccttcttgtttatgaagtcatctctgatctcccagacgggaactcaagttctaaacttcaatattactttattcccacccatagtatagttactgttttttgttttatacagtttgtatacatgtcctttctcctttacaagaaaattcataaactccctaagggcagaaactgtttataattgacctttatattctccacaggagtataactttagcatcttatatattgtgc

SEQ ID NO: 472 - DNA, 2564 bp, Homo Sapiens
ccgcttccgcctggcgtaggagctgaggcatggccttgttctccagctgagaggacgatcgtccttataggagaggccgagtctccgagggcaatttcagaggtctggtgcgaggtgggggaagcggcgcggcgtcgatgacgacttccttacatcgcccccgacccccgcgttctcttgttaacttctgtgcattgttgcctgtctgcactttccgtctccaaaacctttgctctcctcaccccgttttcccttgtaattataccccagcgatcactagtctgggttcgaagtgattgtgtgtctccataattgacctggttgcccccggttatcccagaagtcaaagatgacagagaaaaaaaggaagagcgaggggcttatctcgtgttctctacgtcagactcctcttcccctgtccttcctgggtgatctttatccttcccagcactgttctttcttaagttaagcaccaaggaagagggcaactgcttgggcgctgttggcactccgaagcagccgcagtggttcgagattgccagtcggactagccaagggagctgctgagtgagtggttttcgagaacgctctagattctggcaacagttaggccagattattggaagtggggttggaacagagttgtgggtagtcatacttgttctaatcctaaagcagaattgacaagaaggttctagaagtttggagccctttccttatcagctgcgggttagtctgacccttttgttcaagatatctacagtgccctcagtctctttgcaacatactttatatcttcataccaagcccgttgtgtcttcaggctgggtaatttgaggcggtgatgtagaattagttcatgagatctgaaatcaggattctgagatttttactatctaatgagttcgaaatataagaagtactcggacgcaatgaatagttatcaagcttgagggtggttaccacagccagatctcaagttcctgatctgctgggagctgaggggcctgacaaagtgtaataggcccctgggatatcagagaagccaggacaccagagtccagtctctgttcttaattttgagctttcatgttgttcctacttcttcctagatatttaaagctaagcatcatcaacccttatacatcattaaagagctgcacaatgggaaacaaaattcctcccagtgcagacggagcttaaattaattgtagagatttacttgtatttggaaagagttcagtggttctttatactgtaaatagggatttggccacaggttatttattttttattttttgagacggaatctcgctctgtcgcccaggctggagtgtagtggcgcgacctcagctcactgcaagctccgcctcctgagttcacaccattctcctgcctcagcctcaccagttgctgggactacacgtgcccaccaccacatccggctaattgttgttttttttttgtatttttagtagagatggggtttcaccctgttagccacgatggtctcgatctcctgacctcgtgatccgcccacctcggcctcccaaagtgctgggattacaggcgtgagctactgtgccgggctggccataggtaattttaaaaactcaccctactcattgtaaatctctgatgtagagtgtccctattttggacttcatttcatagcctcctatcttaagcaaatacatttcttcaatcacagccttagaggatagtctatcataaaattggagtaaatgaacctgaagacatataataaaataggttatgctgtaatgtgaccacatcacacaaaacatggtatttgatagcagtacaacaaaataaggtaaactaccttatttcatggaatttaagtgtcattaggctgggtgcagtagctcacacctgtaatcccagcactttgggaggccgaggcaggtgggtcagctgaggtcgggagtttgaaaccagcatggccaacatggcagaaccctgtctctactaaaaatacaaaaattagcggggcgtggtggcacacacatgtaatcccagttacacgggaggctgaggcaggagaatcgcttgaactcaggaggtggaggttgcagtgagctgagatcgggccattgcactccagcctgggtgacaaagtgagattccatctcaaaaaaaagtcattgattgcagaatgcaaattattttatctgtcactaagaaaatgtaactgtaaattaaacatgacaacatgcattattcctgtagttcaaatagtgacagaaaaaaattaattaaaaaaagaaaaaagactgggcgtggtggctcacacctgtaatcccagcactttgggaggccaaggcgggtggattacctgaggtcaggagttcgaaaccagcctgactaatacggtgaaaccccatctactaaaaatacaaaaattagccaggtggggtgatgctgtaatcccagctagtcaggaggctgaggcagaggttgtggtgaggggagatcatgccattgcactccagcctgggcaacaagagcaaaactccgtctcaaaaaaaaaaaaatcaatt

SEQ ID NO: 473 - DNA, 4258 bp, Homo Sapiens
gaatgctagttatttgtcagatacatgttttgcaaaccatttatctgtatttggtttctttttgttatcttagcagtgtatcctgaagaatagttttaaattttgatgtaatccaaaatatttcggttgtttgtgttctttgttatcctatttttgttgttgttgttttatagatatgggggtctcactacgttgcccaggctggtcttgatctcctgaactcaagtgatcctcccacctcagcctcccatccttgtctacctaattaggctttgtgtaactcagtgttgcaaagctttgacatctgtttgagttaatgtttatatatgttgttacttaagggtttcacattaaatttaaacatacttatattttataaccaaacaagtcatgttggggcatactcattaggattgagtgctttcttacaccaaaatacatgtatacaaagatttaaaacactttcggccgggcgcggtaatcccagcactttgggaggccgaggcgggtggatcacaaggctaggagatcaagaccatctggctaacacggtgaaaccctgtcgctactaaaaaaatacaaaaaattagccagacgtggtggcaggcgcctgtagtcccagctactcgggaggctgagacaggagaatggcatgaacccgggaggcagagcttgcagtgagccgagatcaccccactgcactccagcctgggcgacagagtgaaggctatgtctcaagaaaaaaaaaaaaaaacttttataataacaactgtaaatagttcaattgacagtcatttgtaagatgtttaagtaaactgtgaaacagtaagtaaatggatgaaaacacactgattaaaactgctgcttttatccaacaagatggatgaatttcccaggaaagaatacttgagttcaggcctgttcaagtcccaacctgtttgtggtttgaggttgctctctgcctcgtagagcaaagtggaaaatttatcttctgggaggacagagttttcttctctgaaaaagtttcctacatagttggctttggcatttgcaaggaatgaaaggtcagggattgaggcctcatgagtctggatttctagctgaggttgagagaaaaggtagtgattgtaaccagaaaatccagagtgggtgtatttacctccagaactcatcacttaaaaaaaaattttttttgaactgacatgcttgaggctttttcttttttttttttttgagatggggtcttgctctatcccccaggctggagtgcagttgtgcagtcatagctcactgtagccttatcctcctggcctaagcagtcctcctgcctcaacctccctagtagctgagaccacaggcgcatgccacctgtgagtttctagagatgaggtctccctatgttccccagcctggtcttgaactcctgggctcaagtgatcctcctgcctcagccttccaaagtgttggattacaggcgtgagccactgtgcctggccagagctcatcactgttaactcagcctgggtttttcacagcagtcatggaaatagattcattaataatagtaacaaatatatagtctccctctcaaagaaaccttgagtggcagtggcataccagatacacagtaggaaatactgtagaattatgttgttaagttcataaccaaacatcatacatgatgataaaagacaagataatggtcacatttatgcagtattaactgagagggcaaatttgtgcctgagaagctattgggaatgttctctctctttgcattactaggaattacatgggaaacacatgtagacagtcttcaggctattaagatttgtccacttaatctttacttatacatgaataaaaaatgggaaaacatgataaatataataaactaatacactcaaccctgccccttgattatataatagaacaaaatcagcatgcccggcatgagcctgccagattgccaattccatcctccaccttcagaggatgccgccatccagaattttgccttactcattttactttcttcatagttcgacaccttaaatgtatattactaatagtagctttgcatttttggctgatttaaaaattgatataaatgaaataatgctgtagagatgctttttggtattaagtggatatactgttattcttaaagatgtttgaaatgaatatacctttctaaatatctttttaaaataatacattaaatgatactgctttagaattcatgaactgcatctcatgagaatatgtagagatgacgtgggcaggtaaagtaaaacttcaggttgaatatcctatgataatttaaaaatgacaaaatagtgtggtgaataatagagcttgagcactttaaggcaccgtagggaccccttcaatgtaatgatgacagtgctgaggtgcagagaagttaggtaatcagcccaagccactactctaaggacagaccctatctacttttcctaatttgtcagaagactgcctatgatactactaataaaaagtcctatgaaattggtattgtcattattttacaaataaaataatcttcaatttttgtttcctctatgcatgggttacttagtattttgtaatttgaatttcaagcataattaaaaagaaatcaggtatctaggctgggcatgatggctcaagcctgtaatctcaacattttgggaggctgaggcaagaggatcacttgaggccaggagtttgaggtatcttttgttgatctctacactgattgtattctctcttttattctatgaaagttaaagattttttctgatactacatattgtcagttttttaaatactcagtttgtgctaaaagaaaacattcggcaactgatatctgctgttctgtatgtatctgtcagtccagatttgtccattatggtgtatgaatctaatagaacctcaccaatgttatacctgccttcttgaaatcattactgagatagctaatattaaaatatcctggtttgtctgtatatttaattctttactctcattatactaaatttttttaatgtaatttgaattgatggtaaaaattgtatacaggccgggtgcagtggctcactcctataatcccagcattttggaagtcctatgcaggaggattgccagaggccaggaatttgagatcagcctgggcaacatagtgaaactctcatctttataaaaagtaatattaaaatttttaaaagtgtataaactgtaaagtatattttactggtgttttcttccttattcctacttgtcagatgcaaatacacatttttgtgtgtttgtgtttagtaattataagtatacatatttcattcttctatttcatatatttctatgacattatatcttagatgtgtaatttatgaactactactggattattttaatccattagaaattactattcacgcattctgtattcaattcatgtgatagctaatatatttggttttaaatgcatcttattttgtggttttcttctaggctgttttttgtgctttcttttaaaaatatataggttttaataatcttaattttcttttagtttgaaatgtatatactcattttattcattagtctaagataagaattgtaacacttctctaacctattatagaattgttaatacctttacccttctcttgaacacatcaaaggatgtcattgagtgttggtattggagtatagcatatctattattctgctcaattagaagatattgttcatgttgtatagagataataagtaattgtattgatctgcagatgcatccatctcttggattctcattccttctaccactgcagaactttcacctgtaatcactttcctttggccttaaggataacttttagggttacttttctactaaatttccaatttttgaccagatataatcttatattgtgctcttcctgaaaaatactattgttgtggatagaaatctgggttggtagttatttcttcagcaatttgaccatgtcattccactgtgtccctggcctcctgtatactggatgtgaatggatacaattatatattgtgtttatagttttcctgtgctataggaacagtattcgaatctgatgcaaaggacaacacaccctagagattgtaacagtgagatgaaccaagtgattggatggggttttgagttgctggaataatggagttacagtgtacaatgcataagcaacataataaattatatatctggtgaacaaatgga

SEQ ID NO: 474 - DNA, 964 bp, Homo Sapiens
gagaaaaacttcttttatagctcttgcctttctcaaagggggaggactcatcctggagagaaaccccatggatgtattcaacatggtaaatctttttgatggagctctcacctagttgcacatcacaacttataccagatagaaaatttatgaatgtaatcaatgtggaaagtttttcagcctggtgctcccaccttgttagacgtatactgaagactctgggaacatcgggaacgtcagagagctttcagcaggagatctcatctaattgggcaatagaaaactcatactgaagaaaaacaattccatgtaatcaatgtgagaaatatttcagtgacatccttgattttaattggcatcagggaaagtgtaatagagagaagccttatgaatgtagtcaaggtaggaaatctttctatacagctctggccttgttgcacataaaataactcatactggaaagaagcttcgtgactgtaatcagtgttggaaatggttcagttagagttctcacttgttgctcatcagataaatcataccggtgagaaactgcgagtgtcctgagtgtaggaaatcagctggagctgattacttatatggcatcagagatttcacattagagagaaacctcatgaatgtcactggtgtggaaaatcccgcagcaagaattctcaccttattgaacagcaaataactcattctggagagaagcctataaatgtagtcaacgtggaaaaactttcagacagaattattattgtgtatgcaccaaaaaattcatatgggcaaaagccaacatgaatgtctaaatgtgaaaaagccttcaggagactatctgaccttatggaacaccagatcattcataatagagagaaactgtatgcatataatcagtgcagaaaggcctttcaggcagcattctaatcatgtcaggcaccagataactcattcttgagtcaaactg

SEQ ID NO: 475 - DNA, 2223 bp, Homo Sapiens
agctcagctggagtgcaagctgggaatgcagtcaaggcttcatccaccccaggcagctttcctgagccttgggagactggctctcaatgaatccaagctgcttttatcctttgctgcctatctagtcttgttaacaacaaagaagaggagaatggagattgagcaaccaggaagcagtctcagccacaccatcatatggagaagtgcctgtttcccattctgcccgattttaagtttcctgaggcacccccagccatgcagaactctctggtgcctggcccacaggaagttttcactaaatattgaaataaactgaacttagattaaactttggtgtctaacttaggaaaaacaacaagagttctacaaaactatttcttcacaggaaagtctgaagccaggcctgcttagcagaggtctccgtatagtagggatctcactctttcaagatgtaggatctcaactggttagccagccctctgagtgaagctggtcagttggggctgtgacaacatagcacactcaaaggggcagacccttctcagctccaacagattggtgtcattggaaaaggtggacccagtgtaggcagactttcctagagagtccagaagtgactgtgcaagcccaaagcaatccaaacaaatatttgtggaccaccaagaacctctggtatgaagtaaataataaaggcattgaacaataataacctgtctgtatatccaccaatgggaccgatgggccacagtgtgacatctatcctattcatgtcataagggagatgaattctactgtgggacagtctgtgtgactgctcgtaggagattatccaattccttttgctctaatttcatggtcaccaaatttctgcttgctaactttgttttacaacaaactttagaaaggaggtgatctgaataagaggatatatgtttttcagtctctggaaaggggtatttctttgtattgagaagccagaactcttgagtgtgttgagccttgtagagattgaaccactctgggtcagctgacaaaataagattctggtgctgaaaagctgagtatgtgaccatgatattaacagtgacctaagtttgtgtggcccccttcgttctccagaaaccaaccagtcagccttcattttgtaaatgtagcagacaccattttgctagtgaatgaggttaaatctttagccttgtcattggttcggctttgtaatttaaaactctcttattttaccctctgattttaaatccccagattttcctttctgtgtcctttgccccctgaagtttccatctgtctagcaactaagcactgtttgggtatctactgtcttccccaagttgcctttacttttcttctttacctttctcttgttttatttatttctttctttttttgaaatggagtcttgctctgtcacccaggcgggaatgcagtggcgcaatctcggctcattgcaacctccacctcccgggttcaagcagttctcctgcctcagcctaatgagtagctggaattacaggtgtgcacccccatacctgactaagttttgtattttcagtagagacggggtttcaccatgttggccgggctggacttgaactcctaacctcaggtgatccgccctccttggcctcccaaagtgctgggattacaggcatgagccaccacacacagcctctcttgttttacttctgtcattactttttgttcttttaatttggaaacccacctgcttcctcagtgtcattattaaaaacccacatgttacaggttcattaggactgaaacattccttcagagctgagctgaccaacatgttagccactagccacatgtgactattgcatacatgaaatgcaaaatgtggctggtctgaaatgatggtataggtatgaaattcacacaagatttagaatactgaagataaaaaagaatgtaaagtatctcattaatactttttttggtattgatcacctattgaaatggtaatatttggttatactggcttaagcaaatgtacattaaaattaatttcatctatttctttttacttctttaataccagaaaatgtaaaagtacctatctggcaagcaatataaaactattggtcagtgctacttgagagtcttaatgtctgtattttttatatctctgtaagcataaatgctgtattaaaaacccaatttgaataaacacccccaaattactcttcc

SEQ ID NO: 476 - DNA, 4320 bp, Homo Sapiens
atgcgagcggtaagagtgcggcgggacttggaaatcgaatctgtgctctgtgagagatcctaggaaaggaaactgggagcccgggagaactaaaattcccaattaaaagtgaatttaaatctgagctgttcttagacccagaatttcttgcctgaaggaggaatcaggtccccacaaggaaagaccctgcaactgtataaaaaaagaatctaaaaagatcatgactccttcagtcctttcccaaagagacctatggaaatttcctcaggagcacccacaacagaatagacattaaacagctgcataaacaaatgactcagccagttgatgtcagtcagcctgtgtcaacagccaccccaatgctggcacaaaaggcactagaacagaatagcctgatggcagagatgaagtgtgcatggctccagcagcacggactcctctcattaaggctgatctagctactgttgctgccccatgtctaacttgccagcaacggagaccaaagttgagccccggaatcagcaccattcctcatagagaccagctagtcactgggtggaagagggaccaagcaaaaccccagaagagttgatctcaaagcttattttatgaagaaaattgacctgagtgacacaaagggttggactgtagtagatgtcacgttttgctgcctagatctccatccagggatgaactcttatttcctcagcttctttgtctcctcagcttctgggagggttggcagctgatattctcacctgagtccctttctaggacttgcccttgcctgaagagagctgtgctgcccaacatgatgcctcctccaaggtacaatccacacccagtgactaataaacaggggttacaaaggcatgcctgcttgccccagtttgggacaactttaccaggccaacccagcctcaaggctctccacaggaacagggaccctgaaagctgtgtctatgaagttattacaagatattggctactgtggtgcatggagcttctaggccagggtgattctcacacctgcctgatgtggatcttgttgcttcacacctgaaacatcatttgagaagcccgggaagtggtgtggctgctgcatggctgctccaagaactactcccatgggagaggagctcccaacagtgccttgccatcaagctttgatttctaccttacatacctctgaataaactgttgccaatgaggctgatggaagtcttgtgagtttgaatgccaggttgaacttaagaggattccctggtgagcattgcaagatggtatactcaatgttattaatttgtggggagtttaataaaagtattgtttatattgatgtgggaagggtatagggaaattacaaggtatggtgcagtgtcccaagaatagtaacatggggcactgaaaagatagagaaaggaaaagaatgagtgaccagaacctggtgacagagccacaggggagggctgtctggctggagctgtgacttaccattgaaggactcaggaagttcttttttttctttagacagggtctcgctccgtcatctaggctgtcatgcagtggtgtgatcatgactcactgcaccctcagcacacaccaccatactgggctaatttctgtatttttatagacaggttctcaccaggttgcccagtctgatctcaaaatcctgggctcaagcaatcttcctgccttggcctcccaaagtgctgggattataggcataagccactgcacccagccctcaggcagtttttattaattctgcaggaagggagctgggagaataaaaatcccgacctcattttctttccttcttttgttctcttgcttgagcttcccatggatgaactggaagaattcagaaattgaatgatataaataacaaagttaaattaatagacatgtattgaacttagtttttagagtatgtataattttcccaattttctgtggaattattgcaaaatttgatcacaaactataaggctacaatttaaaaatataacaaattcctaactgtaaaaattttctaggttaaattctttgatcacaaagcaggcaagaaatgaatggtggaacaaactaaaatactagctccatgaatgaaaagacctacatggatatgagagtaattaagaaggagttagcagcgatgggactttgtgattgactggatatagacaatgaggaatatagtgaaggaaagatgatttcctgatttctggcatgggcagctgagtagatggttatgctataaactaagaaaagagagaaggataggaagagatgggcctggaagagtatggagtttgagatgagaagagaaaatggaaactctgaggagcacagaaaattaaggcccaagtgaagaaagatgagcttgcagggaagactgggtgatgacaagcggtgtaggagagaatccgggtactctgttttgctgaaatgagaaagacggacatacagatgcatataaaggcatatagaggcagatatatttatatttgaggaagtctggacattgagtaagttagtgctgataacttctagtttcttagttaagaaagagatgaggttatctatacggagtaaggaggaacgtggtggtgccgttgctactacggtgtaatacgtcactactattactattaattatggtgtaatacctaaaacgtagtggcttgaaataacaataattatcttttatctctcacagtttctctgggtcagaaatttgaggataaggtggtgaatgattctggctcaaggtctcccatattgttgtgatcagtggctggagccagaacagcagagggcttagagaatctagggattggtcagatgtcgctttcgttttatctggctttgagacctctccaatgtgagctaatttaggcttcctcatagcgtggtaacctcaaggtatgtgaaccgtgtagcggttgacgcttccaagaacaagtattctagcaggcaaggttcatcttttatgctttaggcatggaaattacatagcgtcactttccctaaaatgagaaaggatatagcatgtttggacagtacgaaccagtatcacctaattgacattaatagaccatcctatccagcaatggcagaatacatatttcaagtgtagatggaacattcaccaaggcagatcatattctgggccatgtacaaaaaaaactgagaaatttaaaaggattaaaattacagaaagcatgctctctgaccacagtggaattaagctagaaatagaaaacaaaaaattatatagaaaatccccaaatatttggaaattttttatttttgattttttaaaattgtgttttttaaccaatgaaaaataattgtattatctgtggagtacatagtgttgtttcaatacatataaagtatagtgatcagatcatggatattagcatatcagtcattccagacatctataatttttgtgtagggaaccttcaatattatcttccagctatttgaaactacataatatattatggttaattacagtttttctattgtggtatagaaattagataatatactcttttaaagtccatgggacacaatgaaaaataattagaaaaattagaacatactttgaactgattgaaaattaaaacacaacatatcaaaatttgtgagatgcagctaaagcagtacctactgaaaaatgtatgggattagatacttaaaaagtagatgttaaaccaatgtcctaagcttctgcctcaagaaacttaaaaaaagagcaagcaaagtaaatccaaaacaagtaagggaacaataaagataagattagaaatcaatatagtagaaaaaagggaattatagatacaaccaaagaaacaaaaaaactggtgatttgaaaatagcaataatattgatataggcctctgatcagactcatcaagaacaaaagaaataatatacacactaccaacatcaggaatgaatttgtaggaacattcctacaaatcctacagacactaaaatacaataagaaaatattataaacaatttatgcttataaatttcattacctaggtgaaaagtacaaattttttcaatgattcaaactgtcaaaggtcactcaagatgaaatagataacctgaatagccctgtatctattagagtaattgcattcatagtttaagatctcctttcaaataaattccagactagatggcttctctggtgaattttaccagacatttaagaaagaaacaatgtggccgggcccagtggctcacatctgcaattccagcattttgggaggctgaggcggatggatcgcc

SEQ ID NO: 477 - DNA, 11704 bp, Homo Sapiens
agacggccatcccccaggcccagccttgcccacaagattcccagatttcacaactggggctggcgctgaatcatgtacagtaagtccggggagagaaactcccggctgcctggcgtccccgggacaggacagctgccaagcctgccctccctcccaggggcccaccggcagccagggatcatcccctctgggcccctgaccagctagggggtgatgggcgagacacacaacctcccttggctgtgccagggatcaagggaccgtgtggtttccagggaaccttcaggctctggagggataggggcaggccagggtggtgggagaggggtcgaagtggccttgtattcaaccacggcctgccaccaaatcactggtgacctggagcagtccctaactgtaactctaagttacggtttccttatctggaaagtggggataatcacagccctgacctcacaggtggctggaaggactctgagaagatctgtgtacagtgcttaccgcaggaagcgcccaataaatattattattattgttgtgacgtcgagctggtcatgacacgctttaagaccctggagaaatcatccagttctttggaggacgtctcccctgaaacacccacccctcccgctgtgatacaaattacatcttatcttttcaaaacttcttcagtacatcagcaaacatttattgagcaccactgtgttccgtgcctgctaccaggtcctggagatacagcagtggacaaaacagaaagacatttaaaagccctctgttctcgtggagcctgtattctagctgaggagaatcagacatttgaggtcatttcagtaagtgagcagggctccaaaggaaataaagcagaaggtgcgatggagagagcctgggaggtcccctctgatggggtgacatttgaacagaagccccaacaaagaggagaagcccacgtgcaaaggcagggggtgggaaacggtgctccaggcagagggaaccgcaggtgctaaggccaggctgtgggatcctcttgttgaaggctcagcaagggcagtgtggctggagcagagggagtgagtgaggggcagaggggtgggaggtgagcttagtggggcccccaccctggagcagctctcctaatgccaggctcttcctgaaagtggccacctggtgcctgacttctacctgtaggggcagccacctgacaagggcccagcttcttcccatccggggtcccaaggccccggagctgcctgctcacagtagaaagcctcattcccaggaaccccacggagggccaggctccccgcccctgccctttgctcaggctgccgctgggactcccctgcccctcccggaggatgtgaccctccctgcctctcagccgctcagagtgtgggcatctgcatctcggagtctcagtgtgcccacctgtgagatgggcaccatgttgcctcagggagggagtaaaaggaggaagggagctctggccttagtatctgtcccctgaaccctggaagaaggaaaacatcggggctcactggggaccaggctgtgcgttcatagctggacggagagctcaggcgtgtgtatgtgcgtgtgtgcatgtgtgtgcatctgcgtgtgtgtgcatgtgtgtgtgtgcacgtatggggtgggggagacgggggtggcatcaagacccaggagccacaagagtgaggaagagggaaggggtgggcttccagggacagggggcagtcagagcctggttctggcgcccaagtggggattggggcagggggaataagaggcctgccctccctcctgggggcccagcggcagccagggatgatttcctgggatgttttaaaaatcatttatttctagaaaagtctttcatcatttcccttcaggtcacggaggctgagatggctgacggggtaggtggctgtggcctgatgtgtcacttttggcctcaaactgaggcaatggggacgaagtggctgcgaggcgcagtatctggcatatgtgtgagaaacaaccacagtgccctggggaggggccacgtcctcaccccgcaccgccagggtctcagcgtgtctcccaaaggtcatgtgggcctttaagaggtggttgggtcctgagagctctgcccttatgaatggattagtatcattattgcaggagtggcttcatgatggagagagtggatttgtcatgaaagtgagttcggccattccttgctgtctcacgtgccacctcttgccatgggatgccctcgccatgggatgacagcaagaaggcccttgcttgagtgagcccctccatcttcggctctccggcctccaggactgttagaaatacatctctgttctttgtaaattacccaggctgtagtactctgttatagcaacacaaaacagactaagacactactatgtagatgaagaaacaggcccaagaggtgaggagtgttgtccaggtcttctggccagaggagcggcagagatgggatttcaaccctgggactgtgtggcttgtgaccactcctagcttcagccctgcccggtgctgaggggtttggggccagaacgatggccagatgtttgggcacactgggccctacccacctggaaagaggctggcctggggttgaatgagaaccagaagtgactcaggctaggacccctctgcaccctccctcaggccgtgggtaattacctgcccaggttaatagcgcccacttcccgccacctttcatcaaggctcctggagctgccaggcagtaattaaccctcacagcacccttctgaagtcagcactggaggcagacgtgtgatgaaacacgtttattacaggaagcaccagttagcccagatgcttctcatctttggagttgagctgcaggctggagacctggaaggccctcgcagcgcctgctcccatcctctcacctcacgaaagcgcaggaatgtgggtttggagccaatgaaaagtactggaatctggctctgctctgtgaccctggacaagtcactgcccctctctgggcttcagtttcctccttggtaacacagaatgattatacctaccccttgggtttgttgacctgaatctacccctcagtcattgcctttccttcttgctgcagccacactggccccttgacagttccttgaacacaacaagccctttcccacctcagggcctttgcatgtgcagtgccagatgcctggaatgtccttccttccaatctccccatggccggctcattctcatctttcttggctcaaatgttacctccccaacctagacagcaccgctgccacctcttcaccccgtcttactcttcttcaagcacttctggaggtatcttgctatttatcttgtttatatctttttcagctccatgagggcaggggattttgtctgtttcattcacaatgtgttcccagagctcagcacagtgtcaggcacacactaggtgagtaagaaacaattgcttcctctacctcttcccctgctagccccaagttcagctaactggctgtgtgaccctggggattgcttttcacctctctggtcccttattctcccttgtggacaaaggatggcctgggcatgagtttcttcaaggactcgggtagcagtgaaatccctgggaccctagcctcagtacctccccaggcaatggggtagagagcaagaaggcagggttggccatgatttgtgaaggagatgccattttccattggatggacagtgagcaagtgaacgcttagagaagaagaggacaaaacaagggaaaagcctgcctgacaggaagcagcacagagctggacaggctttgaactcctggatcccactgtacctgaaattaggcaccttcaactttctagttatgtgagccactgtctttcccatttttggctgaaaacagttgggactggctttctgtcccttgcatacagaaggtgctgactgacccctgccccatggaagaagatactccaggcagaggaaatagtgtgtatagacacccctaagcgaatgccaagcggggcactcatgtaccaagaagaaggaggaggaggcacctgggagctgagcttaagagttagtcgggtggtcaaggtgggagaagggggtatctttagcagagggaacaaccattgcaaaagcttggaggggtgactagttagtgaagatcaactgtgtgctgagctcgtgttgggtggcaagggacacagacgaaaagggcacggtggaacccagctacttctcacctgctccagcgcagtgcaggcttgtctgcttttggagccgagcctggacacctccgtgtccttcccccggcagagtgctgccagcacgctgtctcagactctccagcatctcctggttgatgtgcatcatggggaccacacaagattattttataggctgcacaggcaaagcataaaatcacctcgggtcacatagcgagagttattctctctgcaaattctttacagtctttcctttatatccagaagagtctctgtgtggtgctaacttgcctcgaagaccaaataattgctagtctccctttgtgaaaaggagagcaggtgtcaggctcattcatgtctcaggcacacaattgtatctagctagacttttcaaaatgtcctatagagctgcagcacatatgaatgaggtgtccagctggtcccaaacctgtaatcggcaccccagtgagcagactggacatccccacccccacagctgccctttctcccctccactcatgttccctctagggccaccacgatcccgacttgtatcaccacagatgagtttcacatgtttttgaattttacatcttatctgttttctgttcctatacaagtttgccttttttgaattccatataagtgggattctacaatgtgttatctcaatttgagtctgttttttttttcctgctcagcatgatgtttttgagatgcatatatgcggttttgtgtatctgtagatggttcttttttattgcagaataatgttccagggtatggatgtaccaaagcttgttcatccattcaccagctgagggatatttggactgtttccagttttcagccattataaataaagccactagaaacatttgcaaacaggtttttatgtgaacataaatttttgtttatcttgggtaaatttctaggagtggaattgctgggccaggtggccaagtgtatgtttcactttatcagaaaccgctgagctgttttccaaggtgtctgtaccatttttcatccctaccagcaatgtatgaaagtgtcagttgcttcgtattctcaccagcacttggtggtgttagttttttgtgtgtgtacatgtgttttacttttagtcattcaaataggtgataatagtatctcattgtggtgttagtttgcatttccctaatgactaatgatgttgaacatctttgtatgtgtttctttgccatccgtatattttctttggtgtagtatctgttcaaactttatgtcagttaaaaaaaaagacccaattgttttcttcttaatagatttggagagttctttatatatattctggatactagtcaagcctttgtgaaatatgtgatttgcaaatattttctcctgttctgtggcttgtctttttattctttcaataggtagactttaataacatcgttttgttttctttttaagtatttttctggttatctttgatttgtggcatgtattctttggtttttcaattttagtgataacaccaaatgttttcttttaaaatgaatttatttaagtaaaaacgtcagtaaatttgaagaaacacattaaataaggaatagtagaagtggacagtagacagcataaaaatcgtgaaggcagtttccaatttgcataaccaaagtgtgggcagctccgattcgttcgtcaacaaatactgatggagcccccactgtccaccaggctctgagccaggtgctggggacacagcaccaagcgagatagttgtttgctcttttaatgctggtttttctccagtgagtctctcttcatctttcaaaagccaatttgaatgacccttccttcatccagaccttccctggaatgtttgtcacactctactgcaaatttctatttctgtatctcccaggcaaggggcatgtcgggcagcctctggtagggttgtagagagcttggtgcatagatatctcaataaatagcctctcacatagtacaagctatgatgaggtgctgaagaccagttgctgattcaattggttgaaactagccaggcctgatgaaggggcctgaggaccttccctgctgcagtctggctgaccccaagcaaaccaaagtctctccccttggcctcccctcccacataaagataccaagagaaaaagcctcccaaacccactgccttcagcctctgctatttgcttcccatccagtgcccatggatgcctttcctgcaagacacagtattcacacagacacttaccaggcatctttgttctgacctgccccaggaccaccactttcaccttggcctcttaccaccattcccctgttcctccactccagcacaccagccagtgtttgcccctccaacatgcccagctcattcccacccctgggcctttgcactagctcttccctagttctttgccttctctagctctccacattcagttctgaacttcactgaccctcctcagaggctctctaggctatgctaccaaagccctctctcctctttttttttttttttttttttttttttttgagacagggtcttactctgtcacctaggctggagtgcagtggtataatcatagctcactgcagcctccatctcccaggctcaagtgatcctcctgcctcagcctcctgaatagctgagactacaggtgtgtgccatcatgcccagctatatacatatatttttaaagtagggatatactcactcactgagctcagtatgtagctcaggctggtctcaaactcctgagctcaaacaatcctcccacctcggccctccaagtgctaggattacaggcgtgagccactgtgctcagacaccccatgtatttttgatcccttcattctgtttctgtcctttgtagcatggaatgctctcatttccgagtttatttgtgtgtttgtttgtttctcgccgtgtcccctgttggagtggcagttccatgagggatttgggtctgtccttctctctatctccccagtgcctagcacagtgttcagcacacagtcggtactcaatcagaatttgttgaatctatgagtgaatgaatgaatgagctcatgagctctcccttctccagatgcactcacggcaaagttgaacccatctatctgcccatgcgtcaggctagttgtcctgtgggcccctcctgggtgggtactgagggatgcccactgggtccagccaggcctgtgtcttgtcagctgcccaggctaagggactttccattgtccttggagttggcctgtggaaagttgttctcaggacctcgtgagcctggggccatggatggggctaaaggtaactgcaaggtatagggacccggcgtgaaattccatcagttaacactgtaagtgaggctttccagctccctttcgtcctccctgtgatgccaaggggagggagaaactccacgtggggcttgtgtgtcttgagcaccttcctaccacctgctttttcttcggaagaaacagagcagatcccaagtacaagccgtcatcggcaatagtagctggctttgtttcacttttttgtatatttcaccaattgtcttccatttgcagcaagtgccttagattgggtgcctgcaagcagaccttaacagaataaactgaaggcaagtagcctatttgggagatgcctccagaaagcactggtagggaagtgagatcagggaggaagggctgccaatctcaagagcgctaccaagccagtaaccacttaggcagctggggctcggtcctgctgtggcacgctgggagcccatgtagtaacggagttagccccccaggggcggagatcgggtggtcagggagctggggaagggacatgtcagctcctgcctatcattgcttgacagctgccgcttggagtgttagttcccagcacatccagcctgccccatgagcaaagctcacaggtgaaggggacaggtgctgcaggtggaatcctgtctgtgttcaccggagaaaagggagaggaggtatgggcagggcacagacaacaaaggcctcacagtcaacactggttcctcatttaaagccaggataaaatgagttcatttaaaattaagttttcgcaaacatttaaaaagcgaattgatggaaagagtaggtaatacctgcaggtgaaatgtgaacatggcaaatgctgctatttttcaaggcgtccaaagcctttaataggcaaacagtgttcttcacgacccacaagaatggcgtgtttggggcggtgaaaacactctccctttcctcccagcatgccaggctcatgctcactcctaacactgcccaggacccctgggagtcctggaaatgggccatgaggcttggaggcagaagccctgtgtgacttggggtttgtcccttaacatctctgggcctgtctgttaaaaggggatgttctcaagtcacataaaagagtaaatgtgcaaaaatagtcaaagcaatgctgaaagaagaactaagagagaggacttgtccgtccagacattagaatatatgacaaaggcatagaaataaaacagtttggtattggcatctaagtggacaaatacatcacgggaacagaatagcatccaggaattaacccggctatcacctggcctacctccactcatagatgtgaaaggatttagaaaagggaagagattggcaggcatgggattctctggattatgttatgtctgggctggtgaagaagcttccaacaggctccccatctgcagccctcccctctaacctaccagccatggcaccagggacactcactgtcatgagctgcactcacccccgctctgctctggaaatatcagagcctcccacgcaagatgggttagaccacagttgtcaccattcctccttttgcacttctctttgattcttctgattaacccaaggagaaagtctcaggcgggcgcggctggacttgaatacctctcccacgtttgctcgtctccctttatgaggcagagctggccttaagctcagggccttcagcaggcaggagaatggagcaagaatttggtaacgttcttttgtgattgttgttttaaggttactttctctttacagaaatgaaaagttgtttcctccttctgatagtaacacaaattttccttttaaaataattttttctaatccatattacaatgagaatgaacctccaaaacatgatgctaagtgaaaaaagccagacacagaggtctttttttttttttttttttttttttgagacaggttcttgctctgttgcccaggctggagtgcagtggtgtgatctcggctcattgcaacatctgcctcccaggctcaatgattctctcacctcagcctccccagtagctggtactacaggtgcgtgccaccacacctggctaatttttgtattttttgtagaggcagggtctccctattttgcacaggctggtctcaaactcctgggctgaagaaatccttccgcctcagtctcccaaagtgctgggactacaggcgtgggccaccatgcctggccagaaggtcacatattgtatgattccctttccaggaaatctccaaaataggtacatccattgagaccagtgaagaatggtggttgttaggggaatggggagcggctgctttatggtcacagggtctccttttggggtgatgaaaatgttttgtgattagctagaggtgatggttgcagaacacaatgcaaaaatgccaccgaaatgttcactttaaaatgcttaatatgatgctatgtgaacttcgtctcagtaagttatttttttaaaaaaccagtggagtaaaccaaaaaatcaatttacttaagaaaaggtatgaatggctttaaagatggcttttaagtgacgtgtgggagacagtggctaaggggatgattctcacccatcgtgagcctgggaccatggatggggccagaggtagctgcaaggtacagggacccggcgtgaaattccatcagttaacactgtaggtgaggctttccagctccctttcgtcctccctgtgatgccaaggggagggagaaactccacgtggggcttgtgtgtcttgaacacacattggcttataccttgctcaggcctggaaggccctctgctcactgacggaatcctatgcatccctgggaacccagctcaagcctcacctctacgggaagcccttcctgattacacaggtggtcaggcggggtcagtcctgcagcccttcagacccggttgtgaatcccagtcttgccacttactagtgggaggagtctcttaacttagacatattgtttgactaagagggcctcagtttccttatctggaaaatgggggcttatgatagctcttatctcactaggttgagctcctacatagaaagttttaggacagaacctggggagatgtagctgcccttcattcacacttcagtctgacactgatcacatcacagttgcattccttttcctcctgtctcctacactgtgggcaagggctcagcctttgtgatctctgtatcatgttgctgtacagaactcacacacagtaggcacccaagaagggcgggttggctgacgtgcagaggaactcccagaattccacctcttctctcacctccacggtccccaccctggtccagaccctgcatggcttacctggactattgtggtctcctcctccctggtttcctggcttctgtcctgaatcctccacctccaatccattccccacatgcagccagagagatcccgtgagaatctaagtcagatctcgtcccttctctgcctggaaacttcccacagctctcaccttgcttagaggaaaagccaaagtccttcccgtggctcatccactgtgggacatgccccaggtcctctctgctctctgttcctcctccccaaggcctcatccctacgacagtctccttgttgttgctccgacactccaggctccacctcagaacctcgcatctgccgttctggtttcctggagcacccattaccccacacggcccgctgctcacttcctcacctcctccaggcctctgctcaaatagcacctgctagggaagcttccccctgcttcccaggttttgctggactccaaagctcttttcttcccagaggcaaagcccttggctggggtcctgggcccagcccggtgactcaggcggagaagatgctcccaggcctcccgctggatttggggcccagggtcagccatgggggtaggcggtacctaggctgtacctggcgcagaggcctctgcctgcccctgccgtgggaggcagccctgccctgcacacacgggcttccaggctgcgggtgggaaagccccacatcctcctctgcttacctgactccagctgactcagacccccagccctggccagaggggagccgcagctgctccgccccttgatgggaagcagagctgtggctgtgagggcctggc

SEQ ID NO: 478 - DNA, 31758 bp, Homo Sapiens
gctccggcttccctccaggcggcagcggaaggtgggagcgacgactgcaaaacggcagcgatgggctcccgcaacctccggagcttgtgcgcgtacttcagggaccggcaccacgtcaccgtcacctcctgagtagtgagttcccctctgatgaaaccactggtgtgtttactcaccatccccaccatttttttttccccaacctgatggaaggaagtacataatggagagcaagtttttaaagcacggtcgtgtcgtgtgaacttgctctagccaaattaggtttatagcactttttttggctctcattacctccagtccccacataaacaagagtgaccagctgggtcatccgcaagaccgtttgaaattattgtggcttgggtggaaacttaaaggagtgaagtatctgctttccagaaaaatcgttgtcattcaaagtgaaattaaacttgttttctttgcaataattcgcctttatttccttgtatatctgtaaactcttcacttttttgtaattactagacaattcggacttaaaaagagcctcagcatgtgtattttggaattgtgtagcttcataatgtgaaaattattcttttctatttgagtaaagtacagttaatttgaagtaaataaaatttctatttccattggttgtttcttttaaaaagtcaccttttacttacaaaagaatcactgtaatccagtttacatttatcattgaaggtcaaaagcaagaaataggaagaaacacaagcatactataaaataaaaggtaactgtcatgtttttgaaggtaaggtgttttgacatatcagcagacattgtgtgaatttatttcaactcctagtggtactggtgtaggtagaaaatgttttgcttggttattcatttcatcaaacactctacttcactgtttttttttcacttcaggaaaattcgaggaggaacaacacatactagtgtctttcctttctttctccccgtcttctgcaaatagtcccttcctcttcctgctttctcctccttctcatgttaacatcttcaaccataagatggtgtgttaaaagattgaatatacctctatggaatgacttccagagggtgtaagtctgatatgagagttttattaccttgagtattttactggaagagatagaacaacaaacattttcataataaatgtgtgggttaggagtgttaggagaaaatacactgatactattactttcaatatttgatactacttactttgactctcactgaacacctatttgtttaggatgaattcactttaagccgggttgaagaacaagcctttaattgtcctattatttgtgccaaatctattataaatttgttaaaaaatttttaatacctaccttagagggtactctaggtatttaatgagctagcatttgttaaaggcttgtatagtaagaattcttatagtaagagttcttaccaatagatggtatattttttaaattgtcctgttgcatcaaaaagttcatctttattggtaatgttgattaagtttgcccatttggtagtttggtttcttttaactatcttactagattttcttacttttacctgaaaagtagtccttactaataggcacatgttttgtatatttccaaaatatgtattatgttaaattctctgtacactttatttaaaaattacagacgttgagggaaaaaaaataccctattaagggaagaatgagtttgtgtataacttgtagaagaaggaggccacccatttttagaaaaatatggatggtattgaaaattttgccatggcaagggataaaaaggacaggcttctctaatgtgtctgaaacaacatttgaatcccctttgttcattccctaaatctgctgctcctttagaattcctgattttcataaatagtaccaccattcacttatttgctcaggcataaaacttggaattttctgattcttcacactcatacaactcatcagacagtaccatcagttcttcctgacaaatacattctgaatttagctacttatcacttccactggtacaacccttgggagccaccatcatctgttgctggaccacagcaataaccacactagttgctatcactttctatctgtaccctcatgaatattttcccatttaaaccattctctatataccaaccaaagcaatcacttaaaaaatgttattaggttatgtcactcccttgtttaaaaccctccaatagcttccttatgcacacagaatgaaatcggaattccttaccatagccttcaagactgcataatctggctcctgcccacttctccatcttcccaggaagcagcacaggaagttgttctcacccttcttactgcctcctttctgtcgtgggctgtgctttttctagtctgtagcagagtctgttagttgtccccaaaaattcctccatttttttcatagtaatagacatggatacatggctacccagaacaaagactatattttgcagccttccttgtagccatgtaatagtgctggctgatgggatgtaagcagtatatcatgtggcacacttgtaaaaccatccttaaaagatagttggtgcacaccttcaatgcggcttttcctttatcctgtaccgtggaatatagatgtgatggcttagaactgtagctgccaatttgtgcctcatgcaagttctctcattctagggatggcaaaactaaactggtggaaaccagggtctgtgagaactttatggatcagagcaccatgctagccctgcagtcgtaaatgtctatattattaaagccactattttggagtctcttgttctcaactgaatttaatcttacctgatactctgtctcagggcctttgcacttgctttttattttttatttatttattttttttctgcctgggatgtggtcttctgtcttggatatggctgactcattctcttccttcaggttaacccaaatatctctgacaggccttccctggccaccgtatctaaaatagctcacgttcccatttattctctgtcaatcacgtgcccctctattttcttaatagcatttataatttatcattatcttgtttattcactgtttattttctacctcccttcaccctacaaaaatataaactacacctgtttttttccactactttatccttcacacatggtaggcattagataaatgctgttaaattagtgagtgaatgaatcaacaaaattcttatccaagattagctagactttttaaataataaatgagtaaatgtcaacagatatccttaacacaaaatttgtaaaatccaatctaggaaacaggaaaaacagtactaaactaataggatattcctgacctccaacttaataaagaagatgtctacctttttctgggaaatctgtaaggctagtacaagttaaaaaaaaaaagactgcactgcagtatatccagggctaaaattcacactaaaaggggtctgaattataatttactagacctcagtttcttcatcttaaatatgtgtaagctttgaatggtaatactataacagttaaaagtttaatagtaagcccaacttatgagtgacaaaacatgttaaacattaatttagtcttcaggcactattttaacaagtggttatttcttgataatactggcaaggattcagagaaacagggctgcttatattgctgagagtgtatgttggcagcacttttctagagtgcagtttggcaatatgtatcaaaagccttgagccatgtgcatttgacccagcgattcttttagaaatgtgtcataagcaggctgggtgcagtggctcatgcctgtaatcccagcactttgggaggccaaggcgggtggatcacctgaggccaggagtttgagaccagcctggccaacatggtgaaaccccgtctctactaaatacaaacaaattagctaggtgtggtggtgcacgcctgtagtcccagctacttggaggctgaggcaggagaatcgcttgaacccggaaggcggaggttgcggtgagctgagatcatgccactgcactccagcttgggtgacagagcaagactctgtccaaaagaaaaggccaggcacggtggctcagagagccacctgtaatgccagcactttgggagtctgaggtggggttggatcacctgagggcacaagttgaagaccagcctggccaacatggtgagaccccatctctactaaaaatacaaaaattagctgggcatgctggcgggtgcctgtagtttcagctattgggaaggctgagatgggagaatcacttgagcccaggaggcagaggttgtagtgagccgagattgtgccactgcattccagcctaggtgacagagcgagactccgtctcaaaaaaaaaaaaaaaaaagagaaatgtattataagcaaataagggtgtgtttaacaagttaattgcaagagtattctttactgcatcatttattaggagattggttaagcaacatccatacagtgaacagtattcagccatttgaaatgatgtggaggaaattttattgacatgatacattgttaagagcaaaagaaaaagttttaaaatacaaatgtttaatttgtaagtctcacaaacatcatctaacgaaatatacacgaggtgttaagtcagccttgcaaacgtaactattttttcattatttttatatcagttactgttattggagcattttatattgactgaggatctttattaaaacttcttcagccttctgtgaaatcttgttatgatggctatagtgacactatataaaacacataaccagaatatgtttatgctcaaatatttcaagcaatatttgatgcttaaaataccaaagtgacaatgaaaatgaaagaaatttggatagttccttagagttatttgtttgtgtttcagatatgaacataaagtatgtttttaatattaccagttttgagaataatagaataaatgccttctcaccttaataagatgttctgttctgactcagtattcatttgccatttatttttcaaatgtagctgaaatctcagtcatgttccaggcactatgttttgtctctgagagaggaaaaaccaaactttttccctgttctcaaatactactcaatacaatacttctgcaacaagatggggtgggatagcggtcccccctcacccccgcccacatcaaaccatcaattttctagcagacatcagctgggtgtctcaattctattcagttctgacactatctacctggaggcagcatcagatcgaacagattgagggctcggttctgcaagactgcccccaccacttccagtaccagccacaagtagtaggttgtcaccgatactcctgaccaagctgtaaatcaggattcccatgatcccttcctcaggttcaattagttcactagagtggctcacagaagtcggagaaacactttactagcatttacccatttattataaaggatattacaaagcatacaggtgaacagctggatggaagaggaatctgcacaccttttctcccataccttgccctatgtataggtagggagaagaggtgtggcaattccatgccttctccaggcaggccagcttccaggaacctcctagtgttcagctatcaggaagctctctgaaccctgcctgtccttttgggcttttatggatacttcattatgtaggcatgattgattacattattggtcactggtgagcaaataacctttaaccccctctcccctccctggaggtgaggagccaggttaaagttccaactccctaatcacatggttggcttccctggcaaccagctcccatcctgaggctacccaggagcccatcaagagttacctcattagaacaaaagattctcctatcgtccaggaaattccaaggggcttaggagctctgtcaggaaccaagggtcaaagactgaatagaataagattctcctagtgccctttatctagaagttttaggacctctgggctaggaaacagagacgaaaactaaaacgtgcatacagaagatagatctatatatataatattataaatcacatcaccttgtcatttagttctcaagaaaactatgtgatgtcagaataatagtataattttttccattttcttgtatgctacatgtatgtagcagatatcatttaaattggtgaaccacatttccccccctttaaatatccttgtccatatattgaatctctctaatactcatcacctttggaattgatcatggcagtattaaaggcacttctattctgaactgaacattaaagatgctattacccctccagtgcttttgtgggtcactatcatctataaaaaatatcctaaaaggagaagccaaataaatgaggtaatcagtggaaagaatataagatccttggaatctaaaaaatggctgtaaccaatcagcataataaaacctctaacaatagaaaaatagttaaccacttagtttagcatctgctaaatggcaagcaccataattacatgatttcactcaatctgtgtaacatttctgtgtgataggtggtatttgcattttacagatgaggaaatggaggctttaagagaggttgctagatatatctagaaaaccccattgtctcagcccaaaatctccttaagctgataggcaacttgcgcaaagtctcaggatacaagatcaatgtgcaaaaatcacaagcattcttatacaccaataacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatacgtaggaagaatcaatatcgtgaaaatggccatactgcccaaggtaacttatagattcagtgccatccccatcaagctaccaatgactttcttcacagaattggaaaaaactactttaaagttcatatggaaccaaaaaaagagcccacatcgccaagtcaatcctaagccaaaagaacaaagctggaggcatcaagctacctgacttcaaactatgctacaaggctacagtaaccaaaacagcatggtactggtaccaaaacagagatgtagaccaatggaacagaacagagccctcagaaataatgctgcatatctacaaccatctgatctttgacaaacctgacaaaaacaagcaatggggaaaggattccctatttaataaatggtgctgggaaaactggctagccatatgttgaaagctgaaactggatcacttccttacaccttatacaaaaattaattcaagatagattaaagacttaaacgttagacctaaaaccataaaaaccctagaagaaaaccgaggcaatactattcaggacataggcatgggcaaggacttcatgtctaaaacaccaaaagcaatggcaacaaaagccaaaattgacaaatgggatctaattaaagagcttctgcacagcaaaagaaactaccatcagagtgaaaaggcaaccgacagaataggagaaaatctactgcaatctactcatctgacaaagggctacaatgaactacaatgtagatccagaatctacaatgaactcaaacaaatttacaagaaaaaaacaaccccatcaaaaagtgggcaaaggatatgaacagacacttctcaaaagaagacatttatgcagccaaaagacacgtgaaaaaatgcttatcatcactggccatcagagaaatgcaaatcaaaaccacaatgagataccatctcataccagttagaatggtgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgagccagccatcccattactgggtatatacccaaagtattataaatcatgctgctgtaaagacacatgcacacgtatgtttattgcggtactattcacgatagcaaagacttggaaccaacccaaatgtccaaccatgatagactggattaagaaaatgtggcacatatacaccatggaatactatgtagccataaaaaaggatgagttcatgtcctttgtagggatatggatgaaactggaagccatcattctcagcaaactatcgcaaggacaaaaatccagacactgcatgttctcactcataggtgggaattgaacaatgagaacacatggacacaggaagggtaacatcacactctggggactgttgtggggtggggggaggggggagggatagcattaggagatatacctaatgttacatgatgagttaatgggtgcagcacaccaacatggcacatgtatacatatgtaactaacctgcacgttgtgcacatgtaccctaagacttaaagtataatttaaaaaaaaacgaggctgctttagattacaaagattataaagagagaggattggaattcaggttttgtaactacagaacctattctttcttttttaaatgtatgtaatttttaaaatgttgtgtgtaatatttttgtatatccgttttcttgggagaggatccatagatgtcacaagattctcgaaggggtccttactgaaaaaaaaaatgtctaagaaccactaaaactccctactatgaatttagtgcacttaataatggggaagaaagtaactctgacatagtttggccacagaatatattttttaattgttactaatcaatcaaatgaataaatatggagaacctaggtagatgcttaaaattctgattcaactaactattgaattgctattatgcactggcctcacagattatacactactgtttctcagtcttgagtactataggagcaccttttatgaatttttgtggatacccagtgtgataaactatttttcttataaagttaccctaatatgtacaaatagaaaactaggagtaaacttaggtttttagctctattttaactattaaactagaaaaaaattaggaatgaaataaaactaaaatattttaagttaacattaatgtgtaagttttttgttaagcctaaatcatcactggaaatagagcacagatttatttgaatttgagatacctatgttgctatgtgataactcaattttcctaacagttttctcttacgatttttttgaaacctttataccagaagcaagcaattacagtatttgacctttacctggcataaatggatcattaattaacttactctttactgtagtccagggcaattttaagttagatagtctggctccaactccattataagcaaacaaaaacatgggcactcaagtcgaagtatttatttatataatggtgtttttttaatccaaaacagagttatgttaacttttagattacctttgaaataaagctacaaaactaaagattttttgtgagaactcacaaatactaaagaatatgttagtgggccactagggatttaagaagcaagattatgagcgtaagggttttgaatagctaagatctgcaattttatctaaccgaaacacatgcaagcttcagtgccctttgaaaaaaatgcagtattttaaaaattacttctacaaacctcagttttgctgcctaaaattcgagcataaaaatatgactatgcctttcaggattgtcataaaaattttatcggatgggccaggcgcggtggctcacgcctgtaatctcagcactttgggaggtcggggcgagcagatcacgaggtcaggagatcgagaccatcctggctaatacggtgaaaccccatctctactaaaaatacaaaaaacttagcccggcgtggtggtgggcgcctgtagtcccagctactcgaggctaaggcaggagaatggcatgaacccgggaggtggagcttgcggtgagccgagattgcgccactgcactccagcatggatgacagagcgagactccatctcaaaaaaaaaaaaaaatttcatcagacgacatatgcaaatgcttagtatagtgtatggaatgaaccaaccactcaaatagttgcgatgatgatgataatagttttatgtggaaaaccacacgtaatctaagaatttttaataaaattactaatgaggcacctgaaaaggaaaatgcaagaaaataatagactatatagacagccatgtaaaaaaacaacaacagaaatataaatgtgctagctagttgagttaaatattttctgttgagaactaaaatcaggtaaggtggggacgtaaaacatatccctaaatgattacattttatagcgtcaactagtgatcatgttttattttcctgccataaaaatatgtttttaagtcactttaaaaaataaacatgttaactaatcttgagtttatgtaatggcatccctttcacaattactaagagggttttaaaagacgcaccactttttaaagacattgtttagaagaagatagttaccagatatttacaacagttcttaaacaaccttacatttttaatatgatgtccaactctgaagtagttagaattgatagtgttaattaagatttttaaaaacactgcctaatgtagaggtaaacaccatattttataaaacacttattgtacttcctcagtaagagtaagattagtttccattagattctagattataaaagttgctacagctgccataactttggtgaaggtgattctggaggaatattatcccaaaacctcttcttttccttctaatgaagcagcctgcaattaggaaacaactcttcataagcataacccatataagcgagcatgtaatagttaaatggcaaaatccagagaaacagccaattgatcttttacaaactcagcagctgccactgaagaaacaggtgataatgtagcacaaaaagataccgtaaaacacaggacttctaaatacttagtaaggaagacctttttgaaagccttatcctgaaaacatctcttcttgctaaaagctagggaatcttagaatcttattaaaaacaacaccacttacaatagagcagagggaagagaaaatctgttttgaatgaaccaacaacaacagacatatttattatacttttttttaatttataagaaaaaaagatttaattggatcacagttctgcaggctgtacaggaagcatggtaccagaatctgcctgacttctaatgagggcttcaggaagcttacaatcatggtggaaggtgaagggtgagcaggcatctcaacatggtggagtgggagcaaaagagagctattacacttctttaattaagttaaagaatttacttggctttgcctagttccttatagaaacaaaaattacaaaaagggaatgaaggagggagagaggaaggaaaaaggaaggaagaaaaaaaggaaaagggaaaggaaaaaggaaaggaaaaagtaaaaggaaaggaaggttctaaactagattcctcagtacactagttccataagatactggtaagtattctgttaaaaagcaaaggatttcattgtaatgctctgaattaagaggtttcattattgccaaatttgtttgttacttttttttcttcttctttttttttttttccccgtatgtttttgagacagggtctcactctgtcacccaggctagagtacagtgtggcgcaatcagagctcactgcagtctccaactcctgggctcaagtgatccactcacctcagccttcagagcagatgggactagaggcatgcatcaccacatccagctaacttttaataatttttttgtagagacaaggtctccctatattgcccaggctgttctcaaactcctgggtttgagactcctcccaccttggcctcccaaagtactgagattacaggtgtgagccactgtgcccagcccattggtatgttaaggtgttaatatatgtgtacctaagtaccttagttcttttttattgaagattttaattaatatcttacaaaaccacaagctatctaactacatttgatggagatactgtacttgaaaggctgaattttgggttcctgtacatagggattgagaattctctaccacagctttgttataagaaattgacacaaggccaggcgtggctgctcacgcctctaatcccagcacgtagggaggcctaggcaggaggatcacttgagtgcaggagtttgagaccagcctgggcaatctagtgagacctcctctctgaaaaagttgacacatgatgtgaattgggtatcacagaagatgtttttaacaggaccaaataagatatttctcttacccttttaggactgaggttttgccaatacattaggcaaggactggctaacacttgatatcataatactataggtacaacagaatctttcttttttgttgatgcatttataatataatattgagtgggagttttcccattgccccgtaattatgattatgccccaaaactgagaataaaattattaaatacttcacattctaagttaaaataactgaataatcccatagtattagccaagtagtgtcacaagcatacctatcaccaccaccactacctcaccaccaccactcctactcacccttcattaaaaaaatggtaggcctgagagaaaataaggaggccttttggagaatcagtttgtggacaggactgttcccaatatataattggagtcggggttgcatgaagagaattatatccaaagattgggattaccaaaataagaggcatatttcttttctctgttgggtgtttgctgggacagaggacttgctgagctcctggagctatatgagtagaggaaagagaatttgcaagagatgatagactaacagaggccaggacagcaagaaagtggtcttcatgcccatcatttagtgtgtcaagaataacggagattcccatggatggtatgaacaccagggaaagtaggtgagcttcagccattttgtcagtatgcgcgctgacctcagcaagagggaatctctgcagcaagagaaattaaagtggttcagtaaactggatccagatgaccaacatcaggaaactacataatgggaagcccctgcaggctccctcaaagaagcctcattatagatctagcttttggatactgtcacacagaggttatcaaaatccagttaatgaggactgcatccttacccagtcaagtaagaaaataatcgcccttttctctgtacttggggtcgggggagagtagaggggaatagtgtaaagagctttgaattgagctggagattgaagctttaaagttaacaacatgattctttaatatattgtgattgttctaataactttaaataactgaaaaatcagagaatctatgtaggatataattaaaggagtcatccctctttttttctatttgattttaaaacttaagtaaagccagggctgggcgtggtggctcatgcctgtaatcccagcactttgggaggccgaggcgggcagatcacctgagatcagaagttcgagaccagcctggccaacatggtgaaaccccgtctctactaaaaaagtacaaaaattagccttgtgtggtgataggtgcctgtaatctcagctactcaggaggctgaggcaggagaatcgcttgaaccagggagttggaggttgcagtgagccgagattgcgcccctgcactccaggtgacaagagcaagactccatctaaaaaaaaaaaacaaacaaaaaaaaccttaagccaatgctaaagtggtagttcagactcagttgctctctaatcctacttttctgtttaaaatctggactggctgacaatatccagattgaatgattttgctgcctatgggtaacaatatcaggattgaatgacatagctgcctgtctttgtaatgggtagcaaatgcaaaaagaagcaggacttttagtaaaccagatagatatttaataacatgtatgcttacattatatagttcatttcaaaatgtgctttcagtctttatcaacttctttggtgaactttataaagttctgcaattgaaaacattctgggcagaattttaaagatatctacaattaacagtttgagtgaagattctggtgttcagacagagcagactaggtaagcaacatcctttgcagaatgttattcttaaaaatcttgctcctctttgcatttgccacccattacaaagacagacagctatgtcattcaatccagatattgtcactcagtcttatattttaaacagaaaagtgggatgaaagagcaactgagtctgaactactgctttacttttagcattcaccttgctgaagttttaaaattaaacagaatttcacagaattttagatcagtatcttcacttctaatcaattaaatgaatataatttaaccccagaaaaaaacagagtaaatctaaaacttgtatttaatatgattgaagatttaatcttccaggtgaatattgaatttcattgatatttggtgcaataacatctagcatgtatctagtcaagccttttaaccatcgcagtctatatggtgtgaagcatgaagaactgttcttcgtttgtttgttttattggtgagggaataatacaagtgattgctttccaacttcagatctggatacaaacaattagatcattcttttatatgaaggacaacatgggtccatgcaaattcccagtgcattcatgctggtatttactgtgtaccaggcactcatccaaatacagggaaagtagagcagtaaggaaggcagataaggttcctgtttttatggaggagataaacaataaatattcaatataatatgcagtgattagaactatcaaggaaataacagctagagaatgataaggggatggtgtgctcttttagataaagtcagtgaagacatctctgagcaggtaacagaagcaaaagatctgcaggaaatgaggttgcatcaagtgcatgttgatgtacatatgatttaggtgtcagactatgaatttaatatttcttaaggacagtattttttgtatattctgaacaaccccatccgagaaatacaattaacttgcctttacaaaaaaatagcatattgttatgtacagtaatatcttcataaaatctggttgttgcttctggtcttactcatttcattttgattcaacagatctttattgagtaattgctgtacttcaaggctttattctaggtttttgctatataccattgaataaaataatgaaccctggctacctggagattgcattctagcaggaaaatgcagacaataagcaataaacataataaattatatactgtgttagaaggtgatttgtgctgtaatggggtatgtaggccagagaaagggaggtactaattacttggagaagaacagcttccattagtaagtatgctagcagagtggccctcaattaggttagacctgagcaaacaacagggacctgagggagttagccaagtgcctgtctgagaaaacagctctccttgactcatacatatctacatacgcttttgcctccaagaaagttactatcttttttccaactcttactatttttttagcaaaaaaaaaatagagtagctatgatacaccatcactgtatataatttacttgaatacgtgattttattttttatttacataggtagccactactatacacacatgcacacatacatatatacatatatgatttatatatatgacatatatatgattttaaatttttatcatctgaaagtgtgaagaactacctttttttttttttttttttttttgagatggagtcttgcttcgtcacccagtctggagtgcagtggcgcgatctcagctcactgcaacctccatctcccgggttcaagcgattctcctgcctcaacctcccccagtagctggaattacaggcgtgcgccaccatgctcagctaatttttttgtatttttagtagagacggagtttcaccttgttggccagactgctcttgagctcttgacctctagtgatccgcccaccttagcctcccaaagtgctgggattacatgcgtgagccaccacacccagccaagaactactatttttaaaggcactgaaaaataacttatgattagaaaacatatatttttatatactggcatgtgtaggtcacactacaaatatactttatgctttccagttaaaaggtaatggtgttcttgaagatatgttagaaatccaaaataataatttaagataagttggaagacatggtagattactcactgcatgctataaattgagtgcagagctaacaagtgtggtatgttggtatgtgtagttagaaaaattgacttttatgagtttattcaataaaattagaatactttcaattcttttatttttgcttcattccatctgccttccagatatcactgactttattacaaaggtgtttaaagttaacattattaatctacatatacttgttattctgcagagtaaaatcttctaatctttatgtttctaaaagcatgacttttaaaaaaagtaaccacacagttacaaccaggcatctaggtattgtaactgtatttcctttccattttcaaattgtgttctgtttttatttttgaatcaatgttaaataacaggtaactgtttgtaactttagatacaatattttactaaaaagatcataaatgttccataagcttatatactttttgtacttcttttactaacctggaagtaatagatttgatttgctttaaaaaataactttttttcttcataaaacccttcctttcaaatcctgtctacagtgtctccttctgtcttctgaatttactttcgtattacctatgtgacacttattagtttggtgcaaaaggaattgcagtttttgcaattacttttttaatggcaaaaaccaacctaatagtatgtgttgtcttgtgtctgttttagcttccaaaaatagaccatacattttccaaggacaaagatccaattcttatcagttagcataatgattgtttcccaaagtaattcttccactatacttgtaaaactcaaagttatattttatctagatatctacctatctatatctaaatatagatatagtatagtatacaaaattatgctatactaaaattgaaatctttttaaaattgaaagggtttatttagtctacctccttgagatagagaaaaaaaggctttccatcatccctcctctgtctttggtggttaaggttctattacctgaaaaattgtgtagccaaagcgccaataaccagcttgtacgtataaaaagttgatcctaagtagtactatatagaaataaatttaaacctaaaatgtttttgttttatattgacaccaaaatattttgcttttatatctgtacagtctgaaaattcaaaagagaagcaatttaaaggacttccatttacttctttcccctctaatctgcacaaaaggttaaatgtagcagtgcagcagttctggccatcaaaatatgattattgtactttaaaagcagccatgagaactctgctctttgatagacttcaacttgcaacaactaaggtaacatattatctggttctacccaaaaatacatatcctcatcctacttatcttagatcatgtgtaagattcagttatgtttaagctgtccttcggaaaaactcacaggttaatctttagcacccactctctactcactttaggtccttatccctgatgactactttatttcttgcaggaataatccagttccagaggagattaggagttgggtgagaggatagactctaatcttagagaaataaggtattgtacaagttatcaaggcctagcaatccaactactttgaccagaattattacagaaagttggaaaaagattaacttgatgcagagttatctgagctgtggacactgcgcttcttcagtttttcctaacaagtttgaacaggtcagtgttgtcacttgttaggaaaaactaaccatgattgaagtgtcacctttgggcagagctgaaatttacttgtttgatacatgatcttctcaaagtccagtgatcgctactttgaaaaggataccaagcagttaatctaataatataaccaaacatggtgccctgtgctacttactgcacaggttgcatgcctatgaagcagatcctctaaataagaagtgcaagcaaataatgaaaatcttaaaagtctattactttaactaacagaacttctagttttgtctcctatgagaactcttaagagtatgtatgcttattaaggttttacttggaaaattatttgatatcgtaatcataaagagttattagctgttttctcctaatgcaagttaaaatgtatagctatgttaaaaattcatatattagtcctagttaaaccatatttttaatatttttctaaataacaaaaattcagactctctaaggagaaaaaattatcagtttttggtcttattttctatgtgaatggcatcaggttgaagttatcatagttttagtagaacattattttggcctcactaataaaaaaaaatatgctttactgagggaacccagtgttatgccaaggacttgcttcattgtcctgatcattaataatcattagacaaagaactagggaaaaaacaccacatttcacatttgtcagacaagcttatgactttaaaacctaaaaagtatagcaactaaattgcagtgtggttaatcgagcttattcagtttacatattgttataatgtggaaagtggaatttgaccaagaacctttcaacccaatctattataacagatttaattgcccttctgtccttaaaaactttatgacagttaagaaagctaagctaaagtttttttaaatttctgattttgacttttaggttagctacctaactagtggatgaaattgataaataggcatgatgattttcactgtgacagtttgttgtgaaataaatttaaaatgcagaacttaagtttcagccttcctaaattgctcccttggactttacaacttactgttgcccttgagaaactggatcgctgaatgaaatctcttttcacactaccttctctctagcaatccactgtttaacagatggagataccctaacccttgcctcagagggcttcaaccctagagagagtgaggcaggcaatagaaaaatcacaagtaaaattttggtatgttagatgtggttaggtactatgggagaaagataaagcaaagaaggaatgtaaggagtctgggtagaggtaggagcatggaggattataatactaaatccgataaaaagaaagtctgaaaagacaactacatagaaacctggaggaagaaaagtacaagccattgaatatccagggaggagcatttcaggcaaagggagctgcacatgcaaaaccccagtgtgttcaaggtccagcatgaagaccaatgaggctggaaagtagtgtgcaaagtggaagctcactaggagacgaagtaaaagatgtaatgaggtgagagtagaaggagtccaatgaagaagagtagagagttccaatcataagtcactctaagctattttggtaattttgatttttactctaagtgaaataagcctttggaggacttgaagtagagaggtgacatgatctattttattaagaagagctaactgaattggggcaagaagcagaagcaggaggaaggccaggtaggatactataggaatattccaggtaaaaggagataatgacttgaaacagagcagtaacagaggtggtggtgagaagcagtcagcttctgaatgtagaataaagagccattaaatccatttagcttatcattgactgaagtactgtttttataattatttgtgatatatactttcatagtaaaatgtttgaaaatataggtaggtgaaaaagtaaaaatcactcagaacctcactctaaacatttgatggatagtctttcactttttctaaatgtatgtgtgtatgtagcttatatttattcaaatgtgatcatacaaaaatcattttattacccattatatgtatttttatatattgtgataatttcctatttctttaaatattttctcacaccatagtattagtggctgaataatgtagtttggatatagcataatttagccattttatagatagaacagtttatttatccagtattctattgttggccatttatacattttccagtttttctgtattataaataccacttaaatgaacatctgcattgctatatctttgaaaatgtggtcactgtattacttaggaatctctgcctatttaaacaatttttttcatcatatttattttttcattgtgtttatttttaatcaaagaattacttttttcttttttttattatttcagtagtttttatggaacaggtggtgtttggttatgtggataggttttttggaatactactcagccataaaacggaacaaaataatggaattcccagcaacctggatggagtcggagaccattattctaagtgaagtaactcagtgagaacaaatatcgtatgttctcacttataagtgggagctcttaaaagtgggagctaagctatgaggacacaaaggagtaagaatgatacaatggactttggggactagtggggaagggtgggggctggatgaaggataaaagtctacacattgggtacagtgtacattgggttttttcccatctataaccgtagaaagaaaagattatatcagatgcatattgatagattttaaagggtgccaaaaatatttgaatatgaactatatataaattcctactgaagactaaataaacattcatgtattttggaatttgttttctatttctgatagacttagttattaccaggaacagatgaccagttgcaagaactgtcactattttaacattctccatcagctgtggccatgttggatttctggcacctgagcattcacatccatctgtttatagggcattatgcccactcatgaggtttattccagtttcaaaaagtcatgtgtaaaccaagattggaaatatatattccttgaggtataaataatctattatttgaactttttgaattatgtttttagaaagaactttagccacttaccaatttgagataactttcaattaggcatatatggaaagcaacattatcagcaaaattttaactttactaactaataaatagaataatagacttcttcaacatgagaaagttgaaattaggaaaatgctataacatatccttgaaaaatattttgaaaccaacatttatttgataactgctgtgtgtgaggtgcttttgtataatttgtgcatataattgtcataatctgtgaaatagatattatccttactttgcaagcaaagaaactaagagaagtgatttacttagtatcacaagtaggaagtgacaaagataatttcaagcccagttctttctgacttcaaagcccatactcttttaaccatactgtgctgcttaagagattgggatccaagcattagagcagtttgacacatctgtaatgttgattgtaagcagttatagtagttaaaatgtaaacaacaacaacaacaaaacaaccaaccaaccaccatcaaccacatgactgctttacttttaaaacactaaatagcccaaggtaagtataaggatataaattagctctcattatcaggaagacagtgctatatagtaattaactgttttaactgtaagagaatatctacttagacaaaatatttaagagaagaaaatctggtgagatgtttgcttgttgtctttacattagtgattttcaaagttgaaaaaaaaagttatttttcccccacagaaagctacataaaacaagtgaaaatggttgaagtgggggtacaagtgaaagatgggggggatgtagctctatttgctccctacccagttctctcctctaattctccatgtaacatcggaagaaaaatttacaaattccagaattcagaatgtcatttaataggccatgttgtggctggaacacttggttgattggcttactttttaaatattcaactgatttattttggttatctaaaaaatgtgatttgggctgggcatggtggctcacacctgtaatcccagcactttgggaggccaaggtgggcggatcacgaggtcaggagtttgagaccagcctggccaacaaaaattagctgggcatggtggtgcgcacctgtagtcccagctactcgggaggctgaggcaggagaatcgcttgaacccaggaggtggaagccgcagcgagctgagatcgcacccctgcacaccagcctgggtgacagtgcgagactccatgtcaaaaaaaaaaaaaaagtgatttgaaagggggaaacagtttctggggcaatggctcacttttatgttatactgaattatctttccttgtttctcccagccagaatcaataaatttattctatcaaatgatttttgaacttcaagtaaatgccaggcactatactgattcctaccttcaagaagtctagaatctgtctggaagagacagataataaagaagtgaaaaaaaaatcaatttgtgctataaagaaaatctgtttttttgtttgtttgtttgtttgttttgagacagagcctcgctctgtccctcaggctggagtgcaaaggcacaatcttggctcactgcaacctccgcctcccgggttcaagcgattcttctgcctcagcctccctagtagctgggattacaggcgcccaccactatgcccagctaatttttgtacttttagtagagacggggtttcaccatgttagtcaggctggtctcgaactcctgacctcaggtgatccacctgcctcggcctcccaaagtgctgagattacaggcgtgagctaccacatccggccgaaaatctgtatttttgataaacaatacttacagtttgttagggaactactttattttggtctttttggcaaaagttacttgtattggattgaataatgttccctcaaaattcttgttcacccagaacctcagaatgtggctttattagaagtggggtctttgccaatataattagttaagaggaggtcatattgggttaggattggccctaatccagtgattggtatccttataaaaacagaaatagagacacagacacacaagggagagtgccatatgaaaatggaggcagaatggagtgatgcatctacaagccaaggaacaccaaaaattgccagcaactactagaagctagaagaggcaagaaaggactttctagagcctttggaaagcatgattctgccacatcttgattttggacttccagcctctagaactgtgagagagtaagtttccattgttttaaaccacccaatttgtattaatttgttatagaagccctgggaaacaaataaactactttagatcagttaggaaggcttcttgaactatatgacatttaaacagagacataaatgatgagactgtcccagccaagttaaaaatatcactgggaatcaaactcactggtgttattccagctcagtggtaaatgttctactggtattttaaataattctaaaataaagtcattatttttctttgcactccaaagtccttctttgcaaaaactatatgaagtaggcattaatattcagacttactatatagaggctaaggaacttagacctagtaagtagcagagcctagattcaagctcaggtaacctagcttcaggagcctgtaatttaaaccatcaggttatactgactctattctcaaccttatgcagtgtgctttcattcttcccacaagcttccaaggtgtccttttttgtgatatcccatggaatccagtctcatatgtgaaatttagcttttcttttttgtctcctacttttcctcttttcctttataatgatagtagtacagattgctaaatgtattgagcactaagtgtgccagctcttttaattcaaacaacaaccatatgaggtagatactattatcatcctcatattccagaggatatttctatggcttagagaggttaagtgacatatgtgggatcataatactaataaatggcagaccctgggttggttggatctgtctgacttcaaagcttctacttttaaaaaaattcgatgtaaaaccaaggtataacttacatgatttaagatgcacaactcctaaatatttagtatgatgaactctgatatgttctatacctgtgtaattatcatcacccagaacattccctgatggaaagactccttaatcaccccccttaacagtagataatcctccaaagataaacaacattctgttatatatcaccatgaattaactttatttttgaactttctagaagtagaatcatatagtatattttcttcagtgtctcatttctttccagagtccttatttttaatgaccatgttatactttgtccaacaaaactgccaagtcctctgtcctattttcctaggctcttgctaagtaacctatgttgatgatgtaatatgctaattcttgctaaaatattagtgggtgaaaattgtttaagttacttttttggggggataacttattagtatcataactgaccttaagctgagaagaatgactattatgaaaattctaagtagagtctgagagacttttaggcaaaaggggcctagctagttccagttttatatggtttgttaactttaggaaagatgctcataaatgaatgcatagaaggaaagcaaaagctgaaaaaaagggggaaactgaaagtatgtaaatacttctgggcaaagaaaggctgtatgagttttatggtattgggagaggggagtgtcctggtccatttctcctgctgtaactaaatacctgagacttagtaatttataaacaatagacatttatttctcttagttctggaggctcagaagtcacagatcaaggcaccagcaagtctgatgactggtaaagccccattttccatagatggtgccatctaggtgtccttacatggtagaagggcaaaaagggaacaaatgttttttcctcacatggcaaaagagcagaaaggcaagagagagctcccttcaacctttgagcccttttataagggtgctaatcccatttatgaggtcagagccctcatgacttaatcatctctctcttagtactcttgcattggggattgagtttcaacatgaattttggaggggacacaaatattcaaatcatagcactggtacactaattgtggacctttaaaatttatttctaaaatgtaaatgttgtatctataactgaaattgaaataccacagaagaaatcttagatgtataaaaagaaatgttaatgtcatatagaaaaatgaacattgaagttgtcaaaagttttgggttctagtcactgctctgcagcttaccagctaattacctcgcttaaatcacctaatctttctgagtcaacttcagtatatgcataaaaacatttaccctgcctgacaggattggtgtgaagattaaatatgaaataagctagtttatattaatgtgctttataaagtctcatatatgaagctttatatatatacacatatcactgtcataaaatagttaatacaatattagatatatgaaaaattgaatactgtaaccacctgatgcaatagaaagtcttaatgacattgtttttgaagaacttctaatttaataacccaggcttccagtcactcagttcaagtttgtcagaactctaaatgaatggatttggaaaaatacaagagcaattttctttcccatttccttttgcttttacatttcacctcttctcagtgataaattttgttggaaagcaagacataatttttttacttttacccttttccttagagtttcttgcatgtcacacgtgaatttgcctagggattctcctgtaacaagaattatttaattgtcaggtaagagtgtgaagaatttattagaaaaatgtgaaagacttcatactgataaccaattattattattattattattttgagaccgagtttcgctcttgttgcccaggctgtagtacagtggcgcaatcttggcttactgcaacctccccctcccgggttcaagtgattctcctgcctcagccttcctgagtagctgggattacaagcatgcgccaccatgcccggctaattttgtatttttagtagatatgggatttctccatgttggtcaggctggtctcgaactcccgacctcagatgatctgcctgcctcggcctccctaagtgctgggattacaggcgtgagccaccgtgccctgctgataaccacttactaatttatagccaatttaaaaaaattggcgtggggtggggaggcacgctgggtaggaggatgggtagtaataatatgttccgctttactttggactgccatctactggtaaattaagtcagacaatgtttgacaaacaaaacaattatgttcagagattagaacaaggaacttgttgaagaatgacatcagcaaaatagtggaacagaagttcctagtactcatctcacagaaacataaatttaaacatctatccacactaaaaaaatacctttacaagaactaagaaattcaagtgagggattatagcacctggatgtagcatggaaataagaaaacatgtattcatgacgacaggaaagacagttttacattacctgtgtgctatggtttgaatgtgtcctctccaaacttcatgtgctgaaacttaatgaccaatatgatggtattaagagatggggcctttaagaggtcatgagctctccttctctcatgattaaggcctttataaaaggggctttgtgtagtgttcacctcattgcctttccaccttttgccatgtgaagacctagtattactcccctccagaagatgcaacaataagatgccatcttgaaagcagagagcatccctcaccaaacaaccaaacctatcagggccttgattttggacttcttagcctccagaatgatgagaaaataaatttgctatttataaattatccagtctctcagatattttgttatagcagcacaaaacagactaaagacaccatgtcactgttttcacaagcctgggcaacacatcatgcagataaatacccttcatgtgggaaaagcagtgtgaagtgagctctcaccttcacttcagaccctggcagcaggcctaccccagtaagcccagactctaggaccaccccagcaccaggagtctccaggccaactgtcccagtctccagaccagctcatgtggtcacaggctccaggcccaaccgagagacaggcttgaccttgcagccttaggttctaggccagccccttggacacaagctccaggcctccaaaggtaaacaacattctgctatctctcactatggattaactttgtttatttttgaacttcctagaagtggaattatatagtatattcgctttggtgtctcatttctttccagagtccttatttttgatgaccatgttatactttgtccaacaaacctgccaagtcttctgtcctattgccctaggctcttgctaaataacctatgttgatgatgtaatgtgttaattcttgttaaaatattagtgggtgaaaatgccctaccactgcaccaacccaccccctgcagactcaggctctagtcccatcctagcaccaagccagctcccatggtcccaggctccagactgccccctgtggccctatgctccagaatatctaggttccaggcccaccccagtagaatttgatactagtccagccctcaaagacccaagctccagactggaccccatcaacccaagaccaaagcctgcccgcatggactcagcctccaggcccactaccatggacccaggtgccagggcaccccactgaaccctggtgctaggtcagctcctgtaaactcaggaccaggcccatctccatggacccaggcaccaggcctcccctagcaacaggttttccctcatggactcgggctttaggctggcccctgtagacacaggtttcagcctacctatgcatgcctacccatgcaggcccaatctctaggcccaacccagtggagtccagcactaggctggcctctgtgaacccaagatccaagcctaaccacctagattcgggttcaacgcctgccccactggacccatgagccagactcagccaagtggacctagccaccagaccagcctgcctgaggattccaacagcaagcttgcaagcagaccccactaaatggctcaccaagaatctctggatggtctgactggtaaaggactttccctgccaaagccagtctgtaaagatgggaaaagctgcctgcttctttttaaaaattatattttattttttagagacagagtcttactatgttgccaggctggagtatagtggatattcataggcacaatcatagcacactgctgccccaaactcctgggctcaggtgatcctcctgccttagcctcctgagtagctgggacttctgtgcctggttaagaggttcctacttctccaaatagacaaacaccaacacaacaccacaaggattacaaataaaactgcctgacaaagaattgaaaataattgtcttcaagaaacttagtaagctcccagagaacacagctagacaactaaacaattatcaggaaaacaatacataaggaaatgagttcaacaaagagaaggcatttaaaaattctggagctgaagaacacaatgcttgaactgaaaaattccatagatagatttaacaacagatttgatcagtcagaagaaagaaccagtgagactgaaaacaggtcatttgaaattagagcagaggaaaaagaatgataaagagtgaagaaagcctatgggacttagagaacaccatcatgtaaaacaatatttgtgtgtaagttttctggaaggagtagaaaaagaaaaggggagaaagcttattttaagaaatagtagcagaaaacttcccaaatctggagagggaaatgaatgtccagattcatgaagctcgaagaaccccaaatatattaaatataaagagatctaccccaagacacattataatcaaattctcaaaagccaaagacaaagattattttgaaagcagcgaggaaagacacgtcacatgcaatggaacccatatgagatggtcagtgaatttctcagcagaaaccttgcagatcttgagagagtggaatgacatatttaaagtgctgaaagaaaaaaaaaaacctgaaaaccaagaatgctacccctggtaaatctttccttcagaaatgaaggagcgataaagactttctcagacaaacaaaagctgtgggagttcatcaccactagacataccttacaaaaactgtaaagggagttcaagttgaaacaaaatgacactaactttctagaagctgaagctgtgaaaaatttttaaaaatgacataatataaaaacatagaagtataaaactgtaaaggtaagaatacagtcaaattcagaatactctaatactaatgatggtaatgatagtacataaataactctagtaaaaagttaaaagtcgtgagtgttaaaaataaatatggcaacaataatttgttagtggatacacattatataaaacatgcaaattgtgacaccagtacataaaatgtgagaggaggagaagttaaaagtgtagagttttgtatgtggttgaagttaagttgttattagatccaaatagactgttataagatgttttatgtaagccttatggtaaccacacacaagaaaagtctgtagtaaataaaagataaagaagacgaaatcaaagcacaccactacaaaaataaatcattaggctgggcacagtggctcacgcctgtaatcccagcattttgggaggccgaggcgggcagatcatgaggtcaggatatcgaaaccatcctggctaacatggtgaaaccccgtctctactaaaaatacaaaaaattagctgggcatggtggcggacgcctgtagtcccagctactcgggaggctgaggcaggagaatggcatgaacctgggaggcagagcttgcagtgagccgagatcgcaccactgcactccagcctgggcaacagagcgagactccatctcaaaaaaagaataaaaataaaaataaaaataaataaatccttaaatcacaaaagaagtcagcaagagagaaagaaaggaacaaaggaactacaaaacagatttaaatgattaacaaaatggcaatattaagttcttcctatcaataattaattgtaagtggattcagttcttcaacaatagagtggctgaatggataaaaggaaaacaagattcaattatatgctacctaccagatactcacttaagctttagggacacacataggctgaaagtgaagggatagaaaaagaagatattccatgcaaatggtaaccaagggtgaacagcagtggttatacttatattggacaaaatatactttaagtcaaaaactttcacaaggacaaagaagctaattatatcatagtaaagagatcagtctatcaagaggatataacaattatgaatactatgcactcaacattggtgtacctacatatttagcaaatattaactgaacagagaaatagaaagcaatataataatagtagagtacttcaatacctcactttcaaaaatggatagatatagatcatccagacagaatattgataaggaaacagtggacttgaaatacagtataatataaaccaaatggatctaacagatacgtacaggacattccatccaacagcaacagaatacacattcttttcaagtgtacgtgaaactttctcaaggatagatcatatgttaggctgtaaaacaagtcttaacaaatttaaaaagattgaaataattatcaatatctttttcaacgacaatgttatgaaatgctgtaaaatgttaggaaaacaacaggaagaaaattagaaaatacacaaatttgtgtaaattagaccacatacactcgaataaccaataggtcaaagaagtcttcaaaagaaaaataaaaggccaggtgcctgtaatcccagcactttgggaggctgaggtgggtggatcacctgaggtcaggagttcgagaccagcctggccaacatgatgaaattccgtctctacgaaaaatacaaaaattggccaagcatggaggcaggcacctgtaatcccagctactcgggaggctgaggcaggagaatcacttgaacccaggaggcagaggttgcagtgagccaagatcgcgctaccacactccagcctggacaacaagagtgaaactccatctcaaaaaaaaaaaaaaaagagaaatgaaaaatatcttgagacaaatgaaaacaaaaccacaatataacaaaacttactggatgcaacaaaagcagtcctaagagggaagtttataacaataaatgcctacttaagaaaaaagaaagatctcaaataaaca

SEQ ID NO: 479 - DNA, 1480 bp, Homo Sapiens
ggggcatttccttcagcgccaccatgccagagagagcggcaacttcccacaggttgcaaatgagtccgcgtgatggggacgtgagttaattagtgcacttgggtttgagaggtgggtaacaagctgccgctctgcatttggtggttccttttccgaacaggtggcaactgactgacgggctttctctgaagtggagaaggacatctgtgttttccatattgcggaacaccggatctttccaagtcacacatttgggaagacagctgaattgccttcaagttcctcctgttatggtacaaatacccacctggtgtgcaaacatgagagacgcagctttacactagaaccaatgaaagcaaatttgagaaaacccaactctttaggaatggagactacagatgtatgaggggatcttaataattaaaagaagaaaatatgtaaacaggaaaaatatccaactgtcacaaaactctacactaaatcaaactgcaaagttttgtctttttaaaaatatagtcatgtgccacatgacaacgtttcaatcaaggaggggctgcatacacgacaatggtcctgtaagattacaatggcgctgaaaatttcctatggcccagtcacatcatagctaccaaaacatcactgtgcaaggcactactcatgtgtctgtgatgttgctggtaccaacaaatttactgcactgccagtcatataaaagtataacacatacaattatatacagtacttaatacttgataatggtaatagtgactatgttactgatttacgtatttactataacttgtgtcattattttagagtgtgctccctgtacttacaaaataaaaaatttaactgtacaacagccccaggcaagtcctttaggaggaattccagaagaaagcattgttatcataggagatgacagctccatgcgtgttattgcccctgaagaccttccagtgggagaagatgtgcagctatagaataaacagtggctggaggatgatacaccaaagaaggaaagaaacaagtgaactcaaatcaaagaattcacatcagcttttttgaaaggggaaaaccaaaaacgtcaattgcaagcctcaacccccttcttcttccccaaactgtttttccttttggtttatttctgcatcagagtctacctaggtttcaaaaccaattttccattttcctagaaccagccaaatatggagtgtgtgcaaaaacatggtagcttaaaagaagaagaagtagacaattatcaaagggaagagggaggaaggaaagagaagggaaataaagagagatgacacaagggaactggaccagataaagacaaagcaatgcacttaacccacctggagagcacatcggaccagcaaggcgctctcagccaatcgcctgggtctgcggctgggaggagagtccgcatgggttcatttggctgaggagtgtgtttcataaaccttacggtgcagct

SEQ ID NO: 480 - DNA, 12969 bp, Homo Sapiens
ttatttaaaaagtttatggaaactgcctaaaaagtgatcagaaattgaatctcaaattttaaacattgatgtaatgtaggtcatatattctaaaactccaataaaattaagttagatgttagtttaaacagtgagaaaaaaaacccttacatgtagaaattatgaaaaaaaccccgacacttctaaacatcttatgggccaaagttattgtaacaataatcagaaaacacataaaactgaataaaatataaatattacatatcaaaactaacgaacacctaaataaaacattatttaactttaattgattatattctaaaaaggaaagactgaaagtgaacgagccaataaccaaacttaagactcaagaacttgaaaaattaacataatacagaatacaaacaaaactgtatattatcatcagaaattatttatatataataaatctgaaatagaagaaaaagcaaaagataatttttgaagagataaaactgacaaatctttagtgagactaatacgggaaaaaaacacataaatacacattgttaagaatacaggcttggtgtggttgctcacacctatactcccagcattttgggaagccaaggcgggaggatcacttgaagcatggagttccagactagcctctgaaacatagagagaccctgtctctacaataataattataaaaaattagctaggcatggtggcacatgcctatagtcccagctactcaggaggcttatatgagcccagagttcaaggctgcaactagccatgattgtggcattgcactgcagactgcgtgacagagcaagagtccatctctacaaaaaaataataataataataacataaatgcaggaagaaagtgcagagactagaaacatgagtatcaaagttggacacataaaaatatgtatacatttaattatataaatataaaaattacaatatatatcatacaacacatctctatttgcatctctatctctatgtccttatatttatagctaaaatataattacacatacctatagtttattcttattatttacagtatttctgttttataagtccccacagacactgaattagccaatagtgaactcagacaaaaatacagttagatttgtgaccctttgttcacattattttgttaatccatcaacacgcacctttgttttatatgtctccatttaaagacaacttatttaatgtattttgttgattcattaacattgaactcatagccaacagcactgcaactcatgcctagacacagcttatctaacacacataattttaccttaagtctcattaccaccttttgcacttaggaacattacatagcactttaagcactacatttgggggccattttaaacagtgaaattttcaacaaaaagcacaagaatgtgaaaaacacagctctaaataaagcacagaaaggacatttgcttgcagtaagtgagctgaaacagaaaggcaaagtgtcactgtgtttgatctcacttgggaatgtatgcattgtgcaacttgtatttttggctctctgcagatatccatgaatgaccatgaaagtacagcaagtgattttcaagctgcaaacaaattttagcaagtaagtgcatttgccaataagcaatacatgaatatgagaatcaaaagcatatataccataatatgccataagtttatacaccataaaatatatctacatatttatatctatatctatatcaatctatatgtatatcataaaaacaacaattatcaacaatgcaatgaatttaagaatacattggaaatgggaatagaatagatgaattcatagaatagtcctattgataaacaactctaatatagtacaaattattctaccgtatgaaaaaaagaatactagttcaatcattttctgaagctagagtaacttaaatacaaaaatgtgacaaggatagtcttagaatgtagaacacacttataaacatagatttttgtgcagtattaaatagaaaatagttggtcaatacaaacaaaaaggccaagtgtggtggcttacacttgtaatcccaaaatgttgagaggccaagacaggaagatcacttgaagccaggagtgggagaccagccggggcaacatagtgagacccccatctctaatatatatatatataaaagctgggcatggtggcacatgcctatagtcccagctactctggagactaagagaggaagatccctttagcccaggagttcatggcttcagtgagctatgatcgtgttactgcactccaccgtggcccacagagtgaaaccttgtctctaaaacaaaatccaaacaccaaaacccaaaataaagacatttatttattaaattttatgtagcatcagaatcttcagctaagctaggcatgcttcacaatgtaacaccctttaaagcaagaagaatcttgaatctacttctcaactattttgcatatatcttctccaattcttttcacattccccgttatgtcagttcctattcacctcttttttagtcatctccatttatttttagcagctcatattatcacctagacaaaaggtcaaagactttatcagcccctgttgtgttctgtttgggtttttgtttgtaatgtcctgtctattttccttttaaaatggcaaaatgataattctatattataaggcataataaccttgagattgcccaattgttgttgagtggataatttaaaaataattgtagagttttcgtcaagaaagtgaaaataaacacaagccagcatcagttccatttaaagcaatactacatagataagccacttcacctttttaatatagcattgacattggcaacaaatgttaaggatgtcatatacaccatgaatttgaataaattaaatgcagaaactagttgacaagtctattttttcataaaattaatgttaaaaattgagtttaagcttgagtgtcctactgtattattattattacataacaaatgagttagttatattgaaaatgtaggaaaagcaaacttttcccaacccccctcgcatcaaagatggtgtctctcaactgcattagaaaatgctgattcaggtaatcccaccctaaccccagatgctgtctaatagtgtattaggaaacccctagtagcttggaaagtattaacctagtatttctgtttatattgccttgattattagtgtaattaaacatttgatttcatcttttgtaatacataggtgtatgtctcttaaaaatattttaccaattgcttacttgattattagtgtaattgaacatttgatttcatcttttgtgatacataggtgtatgtctcttaaaaatattttagcaattgcttattttttcttgtagatttttcttctctgaatcttttttattgaaaattttattcctgagtgaatctcataagttgcaaacattgaatgaagtaggatttttaactttattttgttcacatgtgttgtcaagtgtttaaatgccatcaataaatttgtatatattaaattccttatacgatttgttaccacagtccttattatagctagtttttcagtttgttccattatatcaccatttaattgctttataattaatagcatttttgaaagagtcttcataagtcttcagtgattttcttaaattatttttattttgcagttaaataattttccaaacaaatgaactaatttaaagtgataatttttactgttattactttaatttacataataatttggcaagaaatgaattccagtagatatagcaatgcattgtattccctctgctgtagtggaaagcgccagtgttacaactagaaataaaaatctcaggtatggtagtgtagaaaaattgaaggtctggtagctgtctcatatgaatccaagtagttctgttcagtgctggaaatagcttacgatgtcatggttccaggttctctcttgttactctgtcatgttcagcaaaccatccttgcagctgtttttgctttcatcatcccattctcattgcaggcaaatggaagaagaaagaggagagtggtggtgtgtgctttccctttaatggcagaacccaacagtcgtacacaccacttctaccctcttaagatgggtcagaatccaggcccaattccatgtatacatggaagagaggcttattaaagtagccttcagttgctggacagagttccatccaaaactacagttaataggtaagtcgagaacttacattaagtgataaatggcagtctctgccaaggaaaatattcttatccatgctcatggataagaagaatcaatatcatgaaaatggccatactgccaaaagtaatttatagattcaatgctattcccatcaagctaccattgactttcttcacagaattagaaaaaactactttaaatttcatatggaaccaaaaaagagcctgcatagccaagacaatcctcagcaaaaagaacaaagctggaggcagcatgctacctgacttcaaactacactacaaagctacagtaaccaaaacagcttggtgctggtaccaaaacagatacatagaccaagggaacagaacagaggcctaagaaataacaccacacatctacaaccattgaaactttgactaaccagacaaaaacaagccatggggaaaggattccctatttaatacatgctgatggaaaaactagctagccgtctgcagaaaactgaaactggaccttatacaaaaattaacttacatcttatacaaaaattaactcaagatagatcaaagatttaagtgtaagacctaaaaccaaaaaaccctagaagaaaacctaggcaataccattcaggacataggcattgccaaaaaccttatgatgaaaataccaaaaggaatggcaacaaaagccaaaattgacaaatgggatctaattaaactaaagagcttctgcacagcaaaagaaactaccatcagagtgaacaggcaacctacagaatgggagaaaaattttgaaatctatctttctgacaaagggctaatatccagaatctataaggaacttaaacaaatttacaagaaaaaaacaaacaactccatcagaaattgggcaaaggatatgaacagacacatctcaaaagaagacatttatgcagccaccaaacacatgagaaaaagctcatcatcactggtcattagagaaatgcaaatcaaaaccacaatgagacaccatctcacatcagttagaatggcgatcattaaaaagtcaggaaacaacagattctggagagaatgtggagaaatagaaatggttttacactgttggtgggagtgtaaattagttcaaccattgtggaagacagtgtggtgattcctcaaaaatctagaactagaaataacatttgaccctgaaatcacattactgggtatatacccaaagattataaatcattctactataaagacacatgcacacgtatctttattgcagcactattcacaatagcaaagatttagaaccaacccaagtgcccatcaatgatagactggactaagaaaatgtggcatatgtacaccatgggatactatgcagccataaaaagaatgagtttatgtcctttgcagggacatggatgaagctggaaaccatcattctcagcaaactaacacaggaacagaaaaccaaacaccgcatgttgtcactcataagtgggagttgaacaatgagaatatatgggcacagggaggggaacatcacacactggggcctgtctgggggttgggggcaatggaaaggatagcattaggtgaaatacgtaatgtagatggtgggttgatgggtgcagaaaaccaccatggcacatgtacacctatgtaacaaatctgcatgttctgcacatgtatcttagaacttaagcataacaaaaaaatatatttctgggcagaggaaaaatactttgaaatttacatttaatccagtaaaatttcagtgcattaaattaaagcttgtaatataataatgataataacagacagcatttaaagagcacctcttgtggataatcaagttattgagaaattatgtgtgttatctctgggataaagattgctgcatccttatattcttgtgtataaacagaccctgtatatgtaaaaaaaggaaagagaaaagtatttttaaatgcactaatttgtaattaccacataaactattactcatggaagattagttatttgttgtcagtactttttttttccctttcaaaaatgtattcagattttactatggcctaatatgtaataaatgtatatttcctgtgtgtcccattggggctttcaaagaaaacatatctcttttagaaaacatttttcacatagagatattatgcatcatattcaaaacctttgtagatatctttcttgaattattttatgagtcaaagtttatatttcagaaatatttctttattttttccagtaaaggagaaatcattaataaagaggcaaatttattaacactattacctgaattttttagaatgataacaaataaatttagtaaatattgctgatttattagcagataaagtcattctgctccaagagcatgacagctaaacttccactagctcatttatactctgtggaaatatgatttactgccatatgagagaaattaaattctattattttaattctgtattttgtatcataaaagagaaaccagatatggaatacagaatatgcatatatggaataaaacaatggggaataaataagatttagttcaagaaataaagagatcatgtattcaaacacaccagtgagttctttaaaaaggaaatcttttatgttctaattaaagtagcaaacttcacaacttgagtttttcagctcatttgtttcctgacttctttattccaagttaaatactcctaaggtgggtcatataattcagtgacctttaaagtaaaattgaaatatttaattttactacttttctttatctctttttctctcaccacatgcagcttataaatgccaatagaattaattgcctaattataaggaataaaaacattgccttttgaaggatttcaaatttatgtatcctgctgtggagattttgcttgactacctgacctatacagtctgtgcttcttaaggaaagaaaataagtggactactttcgaacacattttgaacttggtaatgaatgctacaatactgctctgctctataatcttaggttattttatattttaagggcttcacctggagccattttactgttaaccataactattatatatactctttaataagctccattatatttttttttacttttttccttatacaatttagtaatatggcagaaaagcaggtaataaggaaaatactaatcatcattagtttacaacacattgacacacattttccagcaagaaaattcgattaacaggtagcacgaaaaaaagctgcctacctggataactcatataacactttacactatatctctcagaaaaaaattaccatattcaatatgcttcatatttattttcttaataaccacatttttaataacctcattttctctgggaattttgggtttcaggtacatatagcatcttcatgccaattttataaggtcataccttaatcactagttgcaaaagtagggatataaaggcaagaattctagattagaaagtgatatatgtgattttacaggaagacagaagaaagggagaatttgtgaatactatgtgaaagaagaataaacccatgagccaaacttaatttggatattaaagctgattatatcacacatacaccaagagagtatgaaaagatttatttctcacataatgagactttctggacagatcatggcaagctcaaaaacagttctgaaaatggcctaagataatatggagggatgagtagcttgcctgttattttacttggagttgggagttgtgcatctgggatgaagtttacatggtttgaactttccactggcactgaggtaaagatctaagatatataactggcttgccaagatgtagaacaaaacagaagggcgggtggtaaagcataaaaactattaacaataaggcaataaaaatcaatccagactctttattataactcactccaatgtttgactgaggagtaaaatgtgctatgatttatttaattgcatttgaagttgttatagtaagccattatggttacctatgaggctcacagcatgagaacggtaaggaaataaaacttccattgaataccttcgtcagcagatgtgatggttaattttatttgtcaatttaattggttgatgggatgttccagtgtttgcttaaacactattctgggtgtttccatgagggtatttgggatgcaattaacatttatatcagtagactgagtagagcagattttctgccgtattgtagttggaacttacctaatcagttggaaatctaaataaaacaaaaagtctgaatcaccctaaagtaagagagaatcttgctacctgacactttttgaactgtgacattggcttcttttcctgacttcagactcaaactgaaagatcagctttttctgatttttaagcctgccagcctttggactggaactacttcatttgttctcctgagtctccagttttgtgacttgccctgtaaaccttgggacctgctagcctccatgaacttccatgatattactaatttccttaataaatctcattcattctctctctctctctctctccctctcttagttctgttttttttgttgttttgatttgttttgttttgttttttcctggaaaactctaactagtacatgagcccagcattgtgtattttgtgaagtaaaatgtgttccttgctcacaattgctcacaatcaattgctcactattattaatgtgtagaaccgtgaaggggtaaggaataatttggtaaagatttgtattgtggcatcattatgtaaaaagacttgcaaccctggttatatagtgggtacttgtaattcacaaaatttcagagttattttttccaaacaggaggatgttggacatgaaaattttgttgctagcattggcctgcccaaatggccagaccattgtccacagataaatattccgcaaaattatgcagatatggctgattcttggacagagcatttattgttaagattactgcatgatgtttggccagttgcactgagccttgggtctcattcttgatcagggacattctgttgaagcaacagaaagtggctgttatgcagtgggctctattatgtgtaatggcagtgcttccatccatcatggtatattaatggactcacagttccacatggctggggaggtctcacaatcacggtggaaatcaaaggaggagcaaaggcacgtcttacatggtggcaggcaagagagagtgtgcaggggagctgcactttataaaatgatcagatctagtgagacttattcactatcacaagaataccatgggaaaaacccacctccatgattcaattatctcccaccagtacccccatgaaacgtggggattatgggaactacaattcaagaaaagaagtggatggggacacagcctaaccatatcacatgggtagtctggaacctctaaaagacataagaagaggttgccaaagcttctacagtgaacaatctttggggggcactaacttaagtctctgttgtattgcaatactgatagattctagagtcttttgttgtagggtgacccattcagggtaagtcaatttgtgagcaacaacataaatgagcttaaataaatgtaaataaggaatatgtttctttcagaatccaaaaggtcgaaaagatgttgaatttgttttaacattgtgggtgatgacagaatgaacaactgtttctttataatgtcaggaacggagcaccctctagttaaatgatagtgagaaattttactgaggtagtgaggccttttgctttgtgtgagtaagtagtccactaattttgatgagctctgttgtgactgtttggttgtcctgaatgaatgtgtaaatagactctcctaggaggatgacatcaatataatgtcatacatatgttcctagaaaaattttaatgtgattaaggtcttacctacaaaggctgtgtgcaacagtaaatctgttgcgatgcccctgggttgctgcataaggatgtattgtctttttgaaggtgaagaaaaactgcagctaagaagctgttgaaataggcaatgaaaggaatttactagctaaatctgtgactgcaaagtacttacccgtttctgattggattgaatggagtcagtaatttaagtaatatcgggtatagaagacttaatgggtgagattatgacattaaggttgcaataatccatcattaagtgttattcattatttccagttttaagaatagaccaaatacagttattaaataaagagaaactgtgggggataattacctcttctccaaatagttcttgtataatgtgttttgatcttcgaaggctctgtttaactttgtatgtggccacattaagtattttgaccagaggggaaaacccatgaggtccaattctgtgaagctgattgtaagtgccaaacatttgattttattttaatgtattatttatggggtcacatcatccatgcacactatggaatattttagtgcaaagcaggagcttataagtaggtctgtctcattctcttgatattggttgttggcaaatgcagatccaaattcaggcctgcatgtgcgaaccctcactctgattcctctccctaactataagaaaagtcaagccgctggctgcacccccatcccaacctgcgctatctcaaactgttttcttcctgcttaagaactagccatgttcatcccacaaagcctcattatgcgagtaataaactgcttcataccctcttgatgtctgtgtatggtattatcagcttcgacaacttgactaaatgtttggttgggtgtacattcttattgcacagatcaaccacaaaaagaaaccattttcgtctgatgtagtcatgaaaatttttacagaataatttaaatttgaaggagactgacaggtaaaaggatttgcataagctcaaatgagaaatgggaaaattcagtgcaggttatgtggaccatcatatatactggtttgtcaagttgaaaaatatttaatgtgcactagattctggtacattaattgatgttggagtatatttttacttattcattgttttctcatgtatttcttttctttgtgtttctctcctttcccatagacaacaaatagggttattctatgttcattacttcaaggatgatcacagaaatattttttcccctggagctctaagagtagatatccttaaggaaataaacaagtttaaacaaatggtttgctaacatatggtttgattaggtttggccttcccttccccaaataaaaagaaaagaaacataatatatagatacagatatagaagtatagatatttctagggcaggagaagagaacagaaggaatgacaagtttaaatttatcgaatcatatacggaggaaaaatatatgctgcttctagtcttggcttgagtgaaatggtagtactcaaaagaaatttgcaaaattggagagaagaagaaccctgaacagttcaggaagtctaataaagaaaggctgtatattcgatcgaagcagacacatatttaaacaaacttcagtgactctcatgctttagtgagacattggacctgcagttcacacactaaaatgaggcacggagattgccactggaccagaagggtacatcttcttgggaatcagggttatcttagcagcaatatacatagactaataactgagactcaagaagaaaaatcgaaatatctttgttgaaaaatgcaatcagatatctgagactgtgggcttgtccacattgatgccttggcagtaaatacgccacctagaactaattccaactcaaggacagatgctggcaacatggaattgcaaacctactccgagtgttctgacactcacatagaataaaaacttgagttaggaaaaaatagagaaaattatattgtttcactttttaaaaattactatgtcaattaaaatttatatactatatttagatgaaataaggttgacagtaatgtggaaccctagctatgaaggactcatatcagattacagcaattagtctttattttctacagaagattttgagtttgggattttgttataaaatcagtccttaaggaaaattaatctagttttttgcactttgcaataagaggacatttagaaaatataaattacagttaatttctctaatgcagttatgagataaaaattgccccagattatgttgttggatacacatgatagacaggaacataaaaacaaaatgacaaaatattaaaacttgattataaatttactataaaggccaataagaagaaaggaagtacttgaagttgtagttctggtgactggaaagacagaaccaatggattacagaatcaaatcaagaggtttgattgagaaaacaagacaatgccaatttggattatacaagtttctatgttatctagaaggcaaactgaaaagtagttgaaaatatacaaatagaatgcacaagttatcttgagatggatttaggcttttctaatagagattaagaaaggcccaataagcagtgcatcaaaatgcttcaaacataaaaagatgccaatttggaaaggttttaccttctcatttgtaggcagcatattaatggcaaataaatagaaagtaagggggagaaaaatggaagcaagatgcttggaaggaaaagggattaaagtatatgaacagaatgctctttgaaaaccaagcagg

SEQ ID NO: 481 - DNA, 5678 bp, Homo Sapiens
gagaccgcagcctaagcagataccttggttgcagccatgtgagacaacctgaaacagagggcacagctaagcctcagccaggttcatgaccctctgaggaaactgtgagaaagcaaatgtcattttaagctatttaattttggaggtagtttattacacaacaataaataactattataattatcttgaggatttatttcctggggagaatacatggaattgcatatataggtcctcatatgcagaatactggtaccctagagatgttcaccccagagatgttttaggaacctgtgaatatgttacattaaatggcaaagttttcctggatggtttaagtttaagatggaaaagttttactggattatccagtgggtccaatctagtaacatgagtccttaaaaatggagaatattttttggccatgatcagagagacatgtgatgatggaaaaagtgtcagagatgcaatgtgaggggactaaaactgctgttgctgactttaaagatggagagaggggaacccgagtcaaggaatgcaaatggcctctggaagctggaaaaagcaagaaatggattctcctttagagcctgtggaataaaatgcagtcatgctgacaccttgattttacctcagtgagaccaatactggagtatgaccttcggagctgaataaaattatacgtacacatcttaatttcttgggatttgattacttcttctgctttgaaattagaccaagtttagcctgcctttgctattttggcgtatctccaattcttcatgattttctcatcgcaaaggccacataaggacagtgagaaggcagccacctgcaagccaggaagaaaggtctcaccagataccaaccctgccagcatgttgatcttggacttccagcctccaaaactggccttctgctcacatgggcttccgtgcacctgcttcaggagacagcaacacttgcgcccgcaccgcggcaggctcccatcacctggtggatatgccgcgccgagtctcatcacaccttagtgaaggaacacatggacccatatgttagcggatgtatttacatcgttttatacagaaaggggaagaaaactgcatacctcagaaaggggttgctcctcactctgagtactagactaaagataaaaagactagataaaagtactagactaaagacagagctgacccatgacagatggagtcttgctctgtcacacatgctagagtccagtggtatgacctcagctcactgcaatctctgcctcccgggttcaaatgattcttctgccttgacctccctggcagctgggactacaggcctgcaccaccacgcctggcaaattttttaattttttttagtagagatggggtttcaccatgttggccaggctagtctcgaactcctgacctcaaatgatctgcccgctttggccttccaaagttctgggattataggagtgagccaccatgcccagcctgttcttaagtctcctagaacagggattctgaaacacaaaactcatctgtttacgcactgagagcatctaaagaatttgaatgaggagcaaagctttttcaaaggttggattaaactacaattgtcctctccaaagaatgttcagctatcctttatgtactctgttgcaagtatttcaagaaggaggtgagaatatatgaggttcacgtagcagcaaaggaactacatggtagaagagggcaccttttttccaacatctctttatgctaatgttgtacatctgcaagatgcaagaagaggacaagagcctatttttgtagcattcttgagtcaagagcttccatgaaaagctttaagtagcaacaagcctgccattgaaaaagaaatatttggtttggaatttgagattgttaaaaatcattatagaatgcatgttctactgtgaaataaactgataaatgaatagtatgttggggcagcccctgaaaggtcatttacactacctagatgctttatagttaaggaaagtaggtccagagaggggaaatgatctgaccatggtttcaaagttatttagtaagaaatagaatgaggagtagttctcctgacatttagataataggaccaccatagaaaggtggttttatgattccattaagatttggatcatttttttcaaggctttgaaagtgagtggtaaaatttctattttcattatctctggagcagtatactagagtataccagatatataaaaaagcctttcatctaaaaggtaaatgaacaaattccccccaaaccaatgaataatatataaaatgaaacttcagaatacaccatcaaagtggcaagaaaataagaaatcttaagaggaataaaaaacttaaaaagttaaagcaagaatctaggaaattaagctagtataattttaaggcaaaaatgaaagaaaattataaaggatggtatactatttatttatgctgatcactgaatagtctcaactctctgacttcttggcccatagtaagattgtactgcctggattcccatgtgaccaattctggccagtgtcttgtgagagaaactaatgtgtctctctggctttgggctaagcatttaattgtcagtgagatcctccagtgcttgttttctctctagtaggatgattgacaatattccacatagcattttcttccacattttctggtatatcataccacgtgtgatatgatttggctgtgtcccaacccaaatatcatcttaaattcccacctgttgtgggagggatctgttggggggtaattgaatcatgggggcatgactttcctgtgctgttcttatgatagtgaataagtgtcataagatctgatggttttataagggggagtttctttgtacaagctctcttcccttgtctgccaccatgtgagatgtgccttttaccttctgccatgattgtaaggcctccccagccatgtgggacagtaagtcattaaatctctttcttttgtaaattgcccagtcttgggtatgtttttatcagcagtgtgaaagtggactaatacaacatgggaattatgggagctacaagatgagatttgggtgggtacacagagccaaaccatataaataatcttctcagtagatgtgaaataaatactattattatttccacttcatgaaaaaactgaagaagcgcaaaagctttaagtaatttgcttcaaggtcacaaagttactaaattacagaactagcattattgtcagtaagaaggaaaattacccctattgtaaagtctaatatgcaatggcatgacatatgaagatactaatatatatgaggatatacctaaatttcagaatgacgacacaaaactaccaaataataatgattagagaagttatgaaaatgaaatagaactaaaaccctcagcaaaaatagtatatagtttggaaaaggatggagattagatgttcaagtgttgtaagcttctcccagtgttcaaaagtagagcaaatatataaatttttattttattttgttttatttcattttaagacagcatcacagtggtgcaatcatggattagtgcagcctcaacttcccaggctcaagcaatcctcctgcctcagcctccttcgataattttaaactttgtaaaatatttggcaaaatatttataagtggccactacaaagtcagctaaaaagtgtatactctccaactggagaagattagagaattaataatagagaaaagactgaatcaatttaaagggagacaagaacgtgggaaaaaatggaaaaagcaagacaaataaaaattaggtggtagaaagtagaattagtaatttccattgatgtaagtggacttactctttatttacaacacagaaattttgaatgagtaacttgatatcaaaattaaaaatagtggaagtaataagaaatacatattatttctattcatgttaaaatttttaacatggtattagcaaaaataaatgaacaatctaaaaatgtataatacattatgaatgtttagattctccaggactgcaaggtaggtttaatattaaaaaaccaattagtataaattaattttattagcatatgattacaaaagaaaaatgcatgaccttctcaacgggtataaaagaagcattcactgacattcaatatccatgcttgataaaatttacggtaaactagaatcagaagtgatatttaataagtacatgttgaaatacatagaagatgccatgtcctgaatgtttgtgtcttcccaaaattctatgttgaaaacatagtcacctgtatgattgtgtaagaaggtgggttcttttgagaggtgattaggtcatgagggtagaatcctcatggaaaagactagtgccattataaaagaggccccagagacctgcctttcccctttcaccatctgaagacacagttagaaggcatcttctatgacccagaaaattggtcttcatgagacattgactctgctggcaccttgatcttggactctccagcctccagaactgggagaaataaatttctgttgtttacatgctacccagtatatagttttttgttatagtagcctgaatggactaagacaaaagacaaaaatgctcaccataactacttattttcaataattttctggaagtccaaagcaagaagaagatataaaagttagaaatacttttatagaagatagaaaagttagaaaaggacagcataatgttgctgttattattcacatatacattgtttccatataaaatgtaaagcatgtactgataaactactagacttgaacaggaaactttgcaatgttgatcaaaacaatagctctatataaaattcaatttgcattcccatgcctaatcaatgagaattagaaaatttaatgcaaaaatgatattatttacaataacagcaaaaatacaatgtattcacctctccattcacatgtatacttataagaagaaataaaagaaagatttttatgacataaagaaaaattataaaacttaataacattaaaagagatttaaaccaatgggaaggtaaggtataccacgttcataaacagaaagagtccagtagtttaaagctaccaagttctctcttaaaacttaagtcaaaaacttaccaagacttttgtacaacttgacaaattaattctaaaattctaaattgattctaaaatttttgtgaaggaggaagagctaacaacagccaaaacacccctgaaggaatgggaggagaaagcagaaaacatgtcctattggatgtcaagatctttgcataaagcactttagttagaaatgcaattttgacttaaagatagaaaaataaatcaattaaatcagaagagaattagcaaaaacagacccacaaatatatggaaatgatatataataaaacttacagtacaaataattgtgtaaaggaaagacaacttaatgatactagaaaaatagttatttatataaaaaattaaattagatttctctctgtgtataaaaatctattccagttaaagtcttaaatttgaaagtgagtcattttagattttattttaattttagaagacaatataggagaatatctatatgacctttgggtggaagaaaattttataaccaagacacagaagtgctttcataacataaatttgta

SEQ ID NO: 482 - DNA, 2398 bp, Homo Sapiens
gacccctcagggcttaaagacttgagaatgacagatgatcaagtgaggagaaagaacagctgtttaccatcttcccagagtcaaattgaacacactggaacagagagattgcattcttacccaaatactcttcgtgattgcctgctttgcggctttggggtaagtcccagttttccacaaccttaagaaaaaaatgcataacataaaagatgccagaaagacttatgtgtcctgatagtcggggtctgtgaaatatacatgggtttgttacgggggtgggaggcataatgaaataaagaaaagcgatttgtttctgcaaggatcaaaagtgtgcgaaagtgtgcatatgcaaacgaggctcccatcaggaaagccacctctggaatgtaaatgacaaagcttggaacacacacaatcaattattttcaccagcatttaaaatatagaaaacaaaatctgctttgggaattgactgaatattttatttagctttttttattgagacatcctttgaaaaatggcataatataaatagttttacaaagcaacaatataatcaatctctaaactagaatataaatcaaggatttcattaactgctggtagccagtttaaattgtagtcttgtccataatgtctatctatctatgtatgtccaagttatattaaaaacctttaaatggctttgtaatatcagctacatctagctattataataattaatggtactgttttataaatcaatacatgtattcttgataaattcatatccagttaatggtgtaatttaaataaaaaattaatgtaataaaggacatacagaagcgggcaggaaatctttaaaggttaagagccaaatttgtctaaattcatttttaacctgttttggaaaagtttatatttaaaatcagctgagacttaccttgtttctgtaaaactaatcttgccatttctggtggtatctagtattaaatttgtaaggtgttttctgacgttgttttaattacgtagttacaatactgtggaatattttactgtcgttgcactattttgtgactattgcatattctttagtaaaatagaacaaaacaaactaaaaacatcacaccagcaatttatttttaatacacaaatgcatgtaaatgatttattttttgaaaatctccaaaactatacacacattttatttaaggggaaaaatgactgactagttcaataaatttgcatgtggaagagccgagcattttcactgcttccgctgagtgaacattccaagaattttagaaagaaaagaaaaatgcatgaaagagtctgaaatgtattttaacgctgcacccgggtacaggaacattctaccaaaagatgagtgtattacagttctaatgtaaagaatacataccaaagacatatttaaaaaataacaagatttagaaaaacaactgaaggttgtatgttatcaaatacaatatcaaatctttccaaataaaatttcatttggttcataagagtacgcgttttacaaaaaatatctttcaaaattatgcagaccagtctgccctgccatcctccttgacatgatgcagaaatgttcctttaatccactgagctttttctgacatttttcttaacattgctgagccttatttagagcaccaaaggaggcgtgtgcagttttctttgacactgatgggtatttcaaaatgttacagagagaggggggaaaaaaaagaaagaaaagatttgctgccagtcacttcatcaatagagctacagaagcaattactatttgttaaaagtttacatttcaaatgaagctaaattttaaagaagtctcatccttttagaaggactggtgcttggaagagagaggaagagaatgcacattagtgattacatgttaaagtgcactcaagtactggaaccatttaaaatgtattgtgtttttagttgaaacctgcagcaaaaccactcctaagaggcttaatttaggttttataggaggaacataaaaaagaccaggttacagcaacatgctgaaatatggggtacattttaaatatcttcatttaaaaacgtatgtttatttcccctcctgggatcactaacgtgtgtctccacagagaaagcaaggacatgcattcttaaaaattatctgttaaagggatcacattccaagacaggtttgagcatttttattactacagataacctcttaattgtgtcactgccttccacttgttaatcagggacattcaacatagttaaccatgcagtggttgtctttagaagaatacattatcattaaggattagaaacacattttattcctataatcatattgcatgtatggttttagcactgctaaaaccctatttacctgctttaaatacataacacc

SEQ ID NO: 483 - DNA, 7787 bp, Homo Sapiens
attttacttcgacaaaggttgaagtatgtagcaggcgagcgtcagggacaagtgcagctatctctttgatcacatcgctttaaacatttttcagctttaagcttgtcttacaagtcagctctatcagtctattaattgtttcactgtacctaatatcttacacgaaggcaccttgaaaaacagcaggagaaagcacatttgtttaagtcctgcgatggctagcacggcagctaatctccttgcaaattataatcatagttgtagttcatccattaggctggaaaagacaagattcccaagtggccttggtgccttttccagttcccgggagacccaccaaccctcggcgtgtgttgcctgcgcacccggagcgttcttgctaatcagtgaggagctcaacataacagggaaaaggagcacaggatgcagctacttagagggtgttgattgaaaacttcgatctccccaccccatcacggttgatttgacggatttctcacctcgttcacagagaaaatttcaattaaggcacatggagacggacctctacctgcaatgccccccttgcacttggacagaaccatgtgactatttataagctatgacacatgagcagacatgacatgacgggattgatggagcaatgacctcatcttttctcctgccaaatattatgaaagaggactcaagtcactcacctgagggacactgggtgaaagtcagtaatgaagctgaaaggtcgctaaatgctggcaagtgagatggattatagtgtctagactttttcctgaggtcattctatatccagcagatatctttcagtatatagtctattcagaacaatgtgctagtgactattgagtgtggttacattcttttttttttttttttttgagatggagtctcactctgtcccctaggctggagtgcagtggcacaatcttggctcactgcaacctctgcctcctgggttcaagcaattctcctgagtcagcctcctgagtagctgagactacaggcacccaccatcacggccaactaatttttgtatttttagtagagatggggtttcaccatattggccaggctggtcttaaactcctgaccttgtaatctgcccaccttggcttcccaaagtgctgggattacaggagtgagccaccaagcccagccagttacattctttaaacaaggagtggacgtaccctgaaacaagagattagtcaaagagattttgctattcatgggacctaaaaggtggctgtacttccctttactgcttttccatacacagcaatgcacgctgtatgggttcttataggtcagagagtgaaagagaaccaggacctataaaagaatacaagtctctaaaatcagaaagtttattatttaaaaaaatagttacgtgccagtctgcttataatttatttttatgactgagagtgcctttcataagcacattctggcaaactataaaacaaataaattgaaattgaataaaacctttagacattagaagtgtagcaccagatttagtacataactgcaaaacttaaacatgcaattttacatctgcaagcacattaaattgaaagaaactttaacttaatttagatacattaattgatacaaacttttctggtatatagcacttcttggcgcattgagtattcttaatctttaaggcacatgaatataataccttaggaaagatctgttctccacacatttcctctataaagtgccaaaaaaaaaaataacgaagagccagtttgtcttccgcatcagtgtgatttagcatacataaataagtatcttttcacacaaaataaaaggttcagaacccaaagtgtctgatttttatagtgctttttctttccttttaaaaagatagcaagatgagggtaagaggtaatttaagagaagtaatcatcttctaacagccagcttgcagaaactaaaacaaatatcaatgatgtaaaaatgttgttttgacactttggtaaatgaaagtgtgagatgagtaagaatatattataggtgcttgtatatcaaaggcctgtgaaaatggctgattataaaggagaaagttaatgatctctaattgtgttgtaatgtaaatgcagtatcaccgtaatgaagagaacagatttgcatgttaacaaaagaaatattagaggagtgagtgtaggatgtttgggataattaattccatcctccactcctacatacatatgcatatacaaactcaattcaattttaaagagaacccgaagaaccaaaaatagactgaacacacttgatgttgtatgggagcttaaattactatttttgttgttctctgtgactatctcatttagtttctattgtgtttgcagtttcttccaaggtgatttttaatggattgagtaatgcataaaaatttgcagaagtatgcagaaagtttgtatgcagggccatgtagagcttttatcctacagtaaatcctagtagtttgctggtgctgtgtgattttttttgtttgtttagggtttttgtgtgtgtgtgtgtgtgtgtgtgtgtgtgtgtgtgtgtgtgaagcttatttattccatttccgcggtgaggaaggacgctttctaacgggccacattttgctgtgtagacccaaaactcgcctctgaggccccgcgttcaggagcggggtcaggtggccccagggcggcggcggcttgccggagactcgcgagctccgcacccgacgccctctcccaacgcggcctcctgctcgcgccgcggaaccccttcgtcgggtgttttacccaccggaggggtcgtgccggttgaggttgtcaccgggtgcgtggcatagctcgtgatagctcatgggtgaggttttgtgcaaacttggatgcagggaaagttgcctgttagagcctccacctgcgacctgcttcagtcgttgtgtgtgtgtgcgcacctgtgtgagtgtgagtgtgtatgtgtcctgctcagcgttgcaggggggtttatgtagccgtttggacaggatttcccgggttaccctgctggcccaggagctagttcccgcgatgaagccctgtccatcctccgcccagctctctcacgcggggtggtgccacctgggcctgcccaatggctctgtgcctccaataagggcctaagaaaaagtcccacaggctgcccctggcaatatacaaaaatcagtagcatttctatacacaaacaaaaacctagctgaaaaagagatcaagaaggcaatcctatttccaatagcaacaaataatataaaatacctagggataaatttaacaaaagaggtgaaagacctctacaaggaaaactacaaaaaactgacgcaagaaactgaagaggatatgaacaaatgagaagacatctcatgctcaaggattggaagaactaatattgttaaaacgactgtgctacccaaggtaatctacacatttaaggcaatgcctatcaaaataccaatggcattctttttagaaaaagaaataatattaaaatttgtatggaaccacaaaagaccccaaacagccaaagccatcctgaacaaaaagaacaaagctggaggcatcacactcccagactcaaaatacactacaaagctacagtaaccaaaacagcatggaactggcataaaaacagacacacagaccaatggaacagaacagagggcccagaaattaatccgctttctacagccgactgatttccaacaaaggtgctaagcacactcactgtggaaaggacagattcttcaataaatggtgctgggcagtggcttacacctattacagctacttgagaggtgggaggattgcttgtgcccaggagttcaagaccagcctgggcaacacagcaagaccccgtctctacaaaaagtttaaaaattagccaagtgtagtggtgtgtgcctgtagtttcagttacttgggaggctgaggtgggaggattgcccgagctcaggagtttgaggctgcagtgagctatgagccactgccctccagcctggatgacggtgcgagaccctgtctctaaaaaaaaatttctactctagtgcttacagcagaccaattcatagtgactgaaaatggggacatcctaccgcctatcgactgcccatcagcatctgggtggctagcccagctgtggtgcattcacaccaaggaatgccacttggcaattaaaaggaactactgttatgtggaacaatgatgagtttcacaaacactgtgccaagtaaaagaagccagatacaaaagactgagtgattccatccatgtaaatttctagaacagatgcatccacaatgacagaaaacagtctggctgcaaaggggcaagaaggaagttttggtttttgtttggagtcagggtctgactgtcacccaggctggagtgcagtggtgagattgtggcttactgcagcctccacctcccaggctcaagcaatcctcttacctcagcctcccaagtagctgggatcacaggcatgtaccaccatgcccagctaatttcttctatttttgtagagatggggcatcactatgttgcccaggctggtcttgaactcctgggctcaagtaatcctctcgccttgacctcccaaagtgctgggattacaggcatgagctacagcacctggctgtttttaagtaatggaaatgttctatatctccgttgtaacaggatttgcatgggtgaagacatttgtcaaaactcatagaattgcacacttagaatgggttttctttatataaattattcatcagaaaattaaaagggaaaaaaggctaggggtaacaacaaaaatacccttttagatgaatataaaataatccttagagaaccatcgtctccttatccttggcaagcatcccctcagggagagctgctgttctctttccacccctctgatgtcagccccagttcctgggagcccagatccacagcgttgtcagcctaagagagaggttctctagaagaatagatgttagcttgagaacagaacattacaaggagagtacacacgccatagtaaaccatatgcctattcagggaggtcaaggaagacaaaggtctttaaaggaaaagcgagcaggatcacagtggttttgagataattctccttggctacaaacatcaataacaaaggtcattccagtctgtggtagcctgtgtcagaatctccttcctgttaagggctgagcgacgttccattgtgtgaatagaccacagtgcgcgtacccattcgtccatggatggagaagggctgagcgacgttccattgtgtgaatagaccacagtgcgcgtacccattcgtccatggatggagaagggctgagcgacgttccgttgtgtgaatagaccacagtgcgcgtacccattcgtccatggatggagaagggctgagcgacgttccgttgtgtgaatagaccacagtgcgcgtacccattcgtccatggatggagaagggctgagcgacgttccgttgtgtgaatagaccacagtgcgcgtacccattcgtccatggatggagaagggctgagcgacgtgtacccattcttccattgatggagaagggctgagtgatggtccattgtgttaatagaacatgatgcgtgtacccattcttccactgatggagaagggctgagcaatattccattttgtgaataggccacgatgcatgtacctggccccagactctctgtgtgcctctccttctgggttggtgctgtgtgatctagcacagccaccgggatccagaggtcagcgtggggccctgacgggaggtccggatcagacacacataaggctggtctcttcagtcggggtccaggtgcctctggcagggctgccgctggtgtttcatgcatcgtggaggccacgtggtcactgacctcatttccttgatggaggccctgctgcaggctaatcctttctcttggagtgaatgctgacttctgtgtctctgtcactgggtgttgacgtgaggcaccgcccttgttattccagtgggggtgctggtgttggatccgacagatggtccataataggccaccgactgtgttcacgtggctcctgccacagatggtctttgtggtggtggggcccactcagctgaccacgctctcctttctggcaggagacgttctagacccagtgtcttcagtggaaacagagcacaggctgtctgcagtctcaggcttcctagcagccctgataagagaagtagagcaatgcaggtgacattaatccttgcaggtttcatttcacctctatatccaacattttatctcaacatgtagtctgtagaaaacgttaatttgagctttatgggtttttttcatattaagtcttcaaaatgcacatgggatgggatgtaaagaacgctgaagtgggggcatttcagaggtgtctgctgctttttgcctgtgcctgctgggaagttgcagtgctctgtgtggcttgcgtgttgcgaggttgcggtctgcgtggctcacgtgttgggaggtcgtggtctgcgtggctcacgtgttgggaagttgcagtggtctgtatggcttgcgtgttgggaggttgcagtctgtgtggcccgtgtgttgggaggttgtggtctgcgtggcttgtgtgttgggaggttgtggttcacgtggcttgcatgttgggaagttgctgtggtctgcgtggcttatgtgttgggaggttgtggtttgtgtggcttgtgtgttgggaggttgcagtctgcgtggctcgtgtgttgggaagttgctgtggtctctggcttatgtgttgggaagttgctgtggtttgcgtggctcgtgtgttgggaggttgcagtttgcgtggcttgcgtgttgggaagttgctgtggtctgtgtggcttatgtgttgggaggttgtgggtttgtgtggctcaagtgttgggaggttgtggtctgcgtggctcacgtgtggggcggttgcttggctcgcctgttgggagtttgtggtttgcatggcttgtgtgttggaaagttgctgtggtctgtgtggcttatctgttgggaggttgtggtttttgtggcttgcgtgttggggggttgtggtctgtgtggctcacgtgttgggaggttgtggtctgcgtggctcacgtgttgggcagttgtctgcttggctcacgtgttgggaagttgtggtctgcgtggctcatgtgttgggaagttgtttatgtggcttgtgtgctggaggttgtggcctgcgtggctcacgtgttgggcggttgtctgcttggctcatgtgttgggaagttgtggtctgcgtggcttgtgtgttgggaagttgtttatgtggcttgtgtgctggaggttgtggtctacgtggcttgcactgtagttcttttggacagccttgttctgcagtctgtgtttcagccctggaattgccacattctccaagaagccctggtttcttgactagagagccttgtgtagaagccaggacctgggttctgggtgaagccctctgcagatagagctgggagatgcctgttgtgtgtgtctgcaccacatacatggacactgtgcagagggattctgttggcacctgtgtttacatgggttgaaaactgtttttacacggaaacttccagttccctcgtgccccgtgggttccgcccacttcttccctttcagttttgtatctgcgccgtgaggacttgtctcctaatcttcgtatcaactccgtgtcccattgagctgaccttccgcctctcccccaggg

SEQ ID NO: 484 - DNA, 6032 bp, Homo Sapiens
agagatggagtgcatctgccccaagtggaggcagcagcagcagcaggagggaggtgtcggggcagtggggccgcagggccagtcctcaggaaagaaaactggctcagagaggctgagtaacctgctcaagatgacacagcttgtgggtggctgagttggccttccaacccagattcctgtcatgttcctcaagccgacaggttcagcttggttgtgacctctgctagaagccctccctggcctccctgtgcactgagctggtggttcctcctttgcgccccaggtacatgctcagatctgtgtaccctacactttgtcctccagcttcgtgtttggatgttcacaactcccatgagaagggcccccgagagctggcacagtgcatgtgtttcctctccagacttctacaaacctggcacataattgtttgctgaaagatggcatgttcctaaaacagaggaagtagaaccgaataaagcgaaatccaacttcccactccctgctctcacttcctctgggacaggccttgagcaagagagacaaaaagaacaagagatgatctttccctttaatgggatttcagtctgatcagggagatagtaacagaaagactagactagactagtgtatgattaaatgacatttgccatccccagaagagggagagacctgcatggaacagggtggtcaaggcaggcttcctggaggaggcaaagacttagatttaacagtaccagagctccaggatagatcctcctctgactgaactccctatttctttctcccaccccaaccttcccgggtccccagctgaagggatacgtgtgtgtgtgtgtgtacatgtgcctgcacacatgtacacatgtggttagaaagggggtattagtatctctctcctaggatggagtctcaaggacaggcccatcatctcctcagtttgcccctctctctcccacttcacctagggaatggaataagaatgggataagtataacacaatgagacgaatgcagaaccaactagatgtacacccaacaatgtggatgaaccttaaaacagtgctgcctgaagaaggcaagaaacagaatgaaatctgcagcacatcattcatataaactaaaaatacatgcacagagaaaggccacttttttttttttggagacaaagtttcgctcttgtcactcaggctggagtgcaatggcacgatctcggctcactgcaacgtccacctctagggttcaagcgactgtcctgcctcagcttctagagtagctgggattataggagcccaccaccatggccggctaatttttgtctttttagtagagacggggtttcaccatgttgcccaggctggtctcaaactcctgacctcaggtgatccacgtgcctcggcctccgaaagtgctgggattacaggcgtgagccaccgcacccagtcagcaacgtatgttttgtagagacacagacaaagatgtgatgtcaaacacactaatgtggttgcctcatttatggatgggggactgggctggtgaatgaggattaaaggaataaataaataaaacaagagagggcctctgtacagaacggtgatgacagcgtgccgtcgaggagaatgatgaactcaaacttttgcacctgagagccaaacaaaagctcaaaaccaaaatctctcttagaaatgatgccactgactttaggatggcactcatatctgtgtgagtgggagagagaagggtttggggcagggatttgactgtagctgtaatgttttattcctttaaaaaagataagataatctgaaacaaaatgttaatatctgttgaatctggggagaggctatgagggtttctgttaaaccattttgtgtacattttaaatacagtcatgcatgagttaatgatggggaataagttcttagagatacgttgttaagcagttttgttattgtgtgaacattatcgagtgtacttacacaaacttaggatggaatagctgactatataacttagactatatggtctagcctattgcttgaaggctgcaaacccatactccatgttactgtactgaataatgaagacaagtgtaatacgatggcaagtatttgtgtatctaaacatagaaaaggtacagtagaaatgtggtatcgtagtcttatgagagtactgttgtatatgcaatgctttgttgactgaaacatcattatgtggttcatgactgtatatcataattttaaaaaatattttaagaggttgccaatcaagacactacaaactaattttgtggcttttgtcaaaattcatttctttctttcttttttttttttttgttttgagacagggatcactcaagcaatccttctgccttagcctcccaagttggtgggactacagtcttgtatgccaccacgcttggctaattttttttttttttaaattattgaatagagatggggtcttgctatgttgcccaggctgatctcaaacttctggactcaagtgatcctcccttcttgttctccctaagtgggattacagatgtgagccactgtgcctggccctggctaaattttaaattatttttgtagtgacagggttttgctatgttgcccagactgtcttgaactcctggcctcatgtaatcctcctgccttggcctcccaaagtagaattcatttctgttgctaggttggcctctgaacagttttacagagctgaatgctctagtcttctgtgacacagtctttttcttttttttttttttttttttgagacggagtctcactctgtcacccaggctggagtgcattcggctcaatctcggcttactgcaacctctgcctcctgggttcaaggaattctcttgcctcagcctcccgagtagctgggattacaggcatgcaccaccatgcccggctaatttttgtagttttagtagagacggagtttcatcatgtggccaagtggtcttgaactcctgacctcaagtgatccacccacctcagcctcccaaagtgctgggattacaggcatgagccaccatacccgatgacacagtcttaataaggagaagaatatgaagaatttgactttttattgatgctaaaagcattaataaataagatctttggaaaaatgtggaaaatggaaaatgtcactgcctgctgtctgtagggtgaaatgaaatggctaaagagctataggagcattttgttctcacttgttgggtcagatcaacttcccaggactttttgggaagatcacaaatcctagacaatcgtactgcactgctctaggaattcttggagggctggaagtctcacaattagggctttttctctgggcaccaacctgacacgcatggcaagggggctgagcagttgtctatggtatagatgctatattctatgactcctgttggccctagccatagctgattggtatagagggtcaaagctgggccaatcagattatctgtctcaagattctggaattctgaactggggcagagacagggagctgtgggaatgtggttgctttaatgggaatgttctggtgaggagatgcattgactccagatgcttacatcctttcctgaggctcaattgttcaaccttttcttgaaatttagggccaaacaaaaggtcaaaaccaaaatcactcttagaaatgatgccaccgactttaggatggcactcatatctgtgtgagtgggagagagaagggcttggggcagggatttgactgtagttgtaatgttttattcattattgtgaattttgtcatattattgtgatttgtcagggttgatttctattacttgtcctatggagtaggttactatatttttgtcttctcaccttcccctggtgctgctgttaatacatatggtatctttattgagttagaaaaagatgcctgactctgggtggacaagcaagaaaaagctgttctttccttcaggcggacacagcctctaacgagggtggaaggtttggccagtggagcacgggctgggtttcaggccatactctgctcacttccttggcccagcccttttgtgcattgcacagatgacatccccatttatggcggccttacacctgtccaccatgtgcttttgggatgatctgtcttctgcagctaggcattgttcagaatatgaagggctattccagacaagattcacgggacatggactatcatgcaagtcctattctggactttaaggctcatgacaaagatgttaaaagtcaaacctgctcaaagtcaagacttaaaggaaatgtagaaaaactctctggcctgataaagtccacagaagcctcatcttctgatgaatgatcttcaggcttgaaaggatgccttcctccaaacaggctggcagacattcttgaaatgtcaaaggataggccaggggtggtggctcacgcctgtaatcctagcactttgggaggccaatgtgggcagattgcctgagctcaggagttcaagaccagcctgggtaatgtggtgaaaccccatctctactaaaatacaaagaattagctggacatggtggtgcgcgcctgcagtcccagctactcgggaggctgaggcaggagaatcacttgagcccaggaggcggaggttgctgtgagccaagattgcaccactgcactccagcctgggtgacagagcaagactccatttcaaaaaaaaaagaaaaaaaagaaagaaagaaagaaatgccaaagggtactcttccatccccctgtgaaaaaaactaaaaaactagtggtgagaagttaagagcaagatcacaggaacagatgacaaggaggtgtctgaaggccacaatgagagtgacatggaaaccagtcaaggcactgatggccatgggaagaaaatgatctcaaggaagagataattccttgagaggaggctgctccagctctgatttgttcattcattttacagtcaggaagccactccaccccagaagaaggtaatatgagtcctactacctttctgaaaggaaggtgagtacagaaaagcaagacagtaactttcccaagccagggaacccctgtctccccaacttctgcatcatgtagaccatttgtgtctacaacttacaggaggcagtgtagactagcagttgagaatgtgagtctagaatcagaatgcctgggttcaaacctcaactctgtcactttccagctatttggccttggacatattacttaaacatttgtgtgttttaaaacgtgtacacaatcctttgactctctttccatcaagaagtggagcctatgtcccctccctttgaacctgggtggaaatgtgggagtgcctagacaaatagaatgtggcaaaagtgacactgtgtgatttccaaggctaggttagaaaagaccctgcagcttctgatgattcctttagggacactcatgtcgggaggcttcagctgctgtgaaagaaactcagctaccctgaggctgccttgtagagggactgcatttaaagtgagagattcctgaggagttccagccatccagccccaagcagtgtgaacctcctagtctagaccccagcatttgagctgacctcagccccagccaccaattgactgcaaactcatgagacaccctgagtgagaactgcctagcttagtctctgtcaaccctcaaatttcaggaacaaaataaatgattgttgttgtcttaagaccactgtttggggatggtttcttatcatgcaatagatagctgatgcagacttttctataacctagaaacggaatgctgccatcacagaacctaagtcatgtggctttaggactgggagatgggtagagattgtaaggactttgaggatattgttgatggaagtctgatagttctcaaggaagttgctggtgagggcttaaaggaaagtgagaaatttttattagaagcaggaggaaaggggacaaacccttattacgtggtggaagaaagttagtaacattgtcacttgaagctatgtgagcaatagaaaatgtgccta

SEQ ID NO: 485 - DNA, 2931 bp, Homo Sapiens
tttaagacagagtttcactctcgttgcccaggctggagttcaatggcacgatctcggctcactgcaacctctgcagtgtggtagaacgcagatgtggtagaaatagccaccgcatcggcccacatcaaagttttaaacaaagatatgctaagctgtgtctgttggatgtgccaaggacctgcaattttggttacctgcaaaatgctttcctactgtggccttgtgctaccagccaacgtgacaggatgccagaagcacaggccctttgaaactgttgtacttatgctgaggatgctgcccttcattgaaagagcataagagaatgtcttccgctttagcaccagaaagagttacaattcttctaagaaagtggctgcttcggtatcacagacactctgactcacattactaatcatggtcctctccctgcataggctgctgggaagctcagaaccagacctgaggccgtgctcctggctgcttactgtcctgccttctaaccacccttttgcttggaaacctcatcccaggacttattttggttttcctattcttattttcctgatttttcttacttaacacacccacaaacaattctgatctgtggttaaaaatatatcgaaattcagaataaaattaaatgcaacttgttttcaaataaactatgggagtataaactatatactgagagacatgatagggttctaaaatttcttactgagaatttggaacaacaatgttaaatgatggtaaggttcacagggcagtccaagtaaatttaatttaaccatgctgcagcaaaatgacagtgttaagagaagtcactcccagcgtaattctatactcatgttaaaaaagaaattcttattagaggatttgtgtttaaagagacatcattgattatctgaatttgtataggcactggatatattaagtcaactaacaaatcataagcatttaaataggagtaagtccaggggccttgtaaataacccatagtttattcagtcagttgacttgttcttttttccttacataaacaagtaacagggtgatttaattcagtgagagtggtgaagtgaatacagatctgtgaagaacaataaaatgttaattttatgatcctgtttattttgctgaagtttctacatgataggaaacaaatgcaaattttgacccagggtcagtccttactatttccagcagcagaaaatgaatctactaggatacctgaattttataagcaaatccaacctatttcatataaacataataaggtcttggacacagttattcatagtccgagactattaactgggctctcattcagcatttatgcatttgaaatctacctagtcaaattttcttgacaaaatgttagcctctaaaggaagaattctgcttctgataacccattatgctacttttacacgcatgtgttaagcaagcagcagaatcagatttggaatttagaaagatattctttccggtggcaataggcaggatgcctggcagagcaaagaacaggaggtagatagacccggagggggctgtacaaaatgcagacagaaactgatgaaccaacaaaaagcaatcaactcgtgagacataaagaaggtccggcaagggaaataagtgagagaacctgctgggcataaggacctactgactacggtaaagtaaggggagaaagtgaagtgacttccagcttgcacaaggaaatactgggatgatgagaggcaatgctggagtgttgagtttgcctgaaggattaggttggggatgggttagggatgatgtggagttttagtttagatacgaggtgttggtagcataaccagaaaatgcccaggaggcccctggaaaggacaaatggaggggaatcactagagcacacaaggttggagccatgagttgtgggcatctagggagggtgtgggaaggtcaagatggagtgcaaggggcctccaatgtcaagcggagccaagagaggagcagacaaggagaaggtggtgtcccgcacgctagggaaggaagaaagaagctggagactggttaattgggccaaagatacaatgaaggaaagtgacaagaaggaaggtggcaggccagactgcagcagagtgaggagtgagggcagctgacagccgggagagtgcacagaccattcccaccagctgcaggctgtcagggtatcactgacttcctaatcggcacaggccacattggtcttttcccaaggctcttccagacctgcagaatctgggtttctgctctatgagggtccctgagcataggcccttaaaaacattctcaccacccccatagggaacagtacctggccatggcgcagaacaagtgcatgagaggacagagagagaagggaagctgatgcccccggcagggatgctcatgctgcctgccgcagccaatcaggtggaacccagggcctgtggtctaggatctttccttccattaaggtaaacagggcaaaataagactcaaaacaccacaggcttcgaagacatcacctttcagtactccacctagctctgccaaacctagcctcagctgtatcctattgctgaaaactctccttacagtacatccaacctttccaggccttctctacgtctgcttgttccctgactcactctggtaaaatctcacctcctatctttcctttctcttcattttttctgccatccattattactactctgcagaagtatttacattaacactactccccctcctctgctgacactttggaatatggcatgtacccaagttaatttattttcaatgtataaaactgtaccctttgtgataatattaccttaggatactcaaacacaatacaaaaatatttacttaagaaatctaaaacaatagcagctgggagaaatatctattaaaataccaactgtg

SEQ ID NO: 486 - DNA, 2609 bp, Homo Sapiens
ggtaagatcctggcccaagctggcccaaagcaccactcactggctactgggactggttgagggagtggaaacctgaccaaggccctaccccaggccattccagatggagttgaaagagaaaacagttttcctccaagtggcaagactgaaaggggcatgtgtgccctgtcaccggccccgtccccagcatctcctcctgccctgtccccctcacagctctggcactccaagtgtcatctcagtggaagggtttcctgactcctcccctggtgggggctgtccctcttctgtgctcctccatcacccttgctataacacatgataggtgttcaatcaacattttctgcagggagagggaggggagcagggctgatacatttatttttcaaggacttgcatactaataagaataaaggtaataccacagatgccagttcagaacaaagaaattatctggtcacactaggcagcttgtctctcttctgaatatagagatatgtatatcatcttctgaaatcaactcctttttgcagaaatgacttatttgcattaaaaatgacttatcccacatcgttccacatcatgttgcacttggttacctgcatacagcagtgaagtacaacagaaccccaattttttattactttaaaacaatttttttagagacaggggtctcactatgttgcccaggctagagtgcagtggattaccacgactgagcagactctgtgggcgccctcataccacatgctgcaggcaaccacagctaggatcttccttttcctttctcccttaccgctggcacccaggaccacaaaattcattaaagaaatgtttctcactgcttgtgaatttgttttcctttcaggcaatgtgatgacaggctaggttcttatgctttaacagcccatcatgggaatttttaacttaagcaattataaaataaaaatgtactgacgctaaagattcatttataaacctgtcgctttaatctttcttcatgacttgttggtgtaattaggcagctatatagtcacataaaatttcacggaaaaattatatgcttactagttgttggtcatgaaacaacttataacattggacttcacgtttattctcagactaaaaatctaaatgatagcgaaatttaataaaacttcttggaaggcttacagataatttttactttgtaaagcatgtgcatgctttgtaaagctttctcatgcttcagtaaatcagaagtaatgatgggggtacacattttcttacttaaaacttaatactgggaacaagagaactagcacgttgctacagtctcatcaacaactctgaaaaggcaacaagccaatacaaacaaatacagttttccaaaaatacctgataatacttctaaattaagagctgacttcaagggagtggggaataaggggagatttcttaaagaatataaaattatagctagacagacacattaaattctagtgttctgtggagtgctctatagtttatcatattaagtatttctcaattagctagaaaagaggtttttaaatgttcctaacacaaacatacaataaatgtctgaggtgacagatatgctaattactctgatttgatcactacacattgtttcaaaacattactatgtactccataaaaatgtgtcaattttttaaaatcttgttaaaaaactgatttcaactttattttaaaataatttagaagcatagtaatttctggacgtctatttaatgaaatgtaaagaaagaataccaaatatctaaccattcaaagtcaaaaaataacatagatcctacagattgagtctatttgaataggagtaatttctaaaaacaatcattagtttactacttattcctttgcattcatatagtagcttcctaatactcaggttgaaaacaagcttgataagatctactaattaaaatggtaaaactggaacactgtccagtttttaatgttaaaatttaaaatcccacaaactcaaaataaaattacaaaaaactaaggctgggtatacatttcttcatttgctgctctgacattcatcataattagatacagataggaaatttttcagtctctgtagtacatacaccaaatagacatgcaacttgttgttgttgttcaagtctgaaattctcttttcagttaatatatttactgacctcttctgggactctcatgattgaagagaatgccgttcactgcaaagagattatacgcctcacggaagttcaccacaatccaataggcatagagttttgctgcccctgttggaataattttttttaagcaatgaagtttgttgtaaaagacagtgattctcaccatcttcaacagtaacatcttggccgaaataataacttgtaatgcatccaaatacaaaaaagtatcaaaacccaaagacgaaataaaggttattacacctgtcaatcatgttcaccaggaaatattttaagaatttcttacttttgtaatgccaacagtgcattatttgacaatcgaattgattgaatctttcttagatctttttctctctcattctctctctctaacttttgaggaattagaatggaaaaaaatga

SEQ ID NO: 487 - DNA, 42664 bp, Homo Sapiens
ctggccgtgttaggcttcgctggcgtaaagtccccgggagctttgcccctcacggagaacgttagttgaccctgatggggacccgtagggtaaaggttttgtttttgtttttttttacggaaaaggttgtggttaggccccttggaaagttgcgacaaaactcgagttagacaaggaaggtcggaactaagtggccacagcaacaatgcaccagcaagcagggagcgtgataggaagagctaaagaggaatcgggaaaccctggagatgggtttcaccatgtttcccagccttgtctcaaactcctgacctcaagtgatccgccgtcttgggtcttcgaaagtgctgggacagcaggagtgagccaccgcatctggcccggaaagtgttttggagcgtagaaaaatgcaaattatagggctgccttcaaggatcccgaaggacccacagatttgccgcatcaggctcctatgcacgccggtaatttgatgtgttgagatgcactgcccagtgcgttgtttttactggaggagcttgtgtgcggagctccttgctagtgtatgtgttgggatgggagagaagtgcgggagaactatgagataatgccccctgatcctcagggtcttaggaggtatggtcggagaggctaagctaaagtatgaaagccgtgtgtaggcccttctgtgtagtgcagaaaaggtagaggtatgtgatttgaaagagtagggatgacatggaggatgcgactcctggttggatctataaactaatgtctttggaacgaaagcacatgcaaccttttgaaaatggatgggtgataatgaaagaccattccagagaagaaacaccatggtgcaaaggctcaagaggcatactggaagtacaatgaagagagcaatctaactgaaatgggaaaaaaagaaacaaagagtaaaaagtaagatttgatgagaaagatggaatcgatttttaaatttttttatctacacaacaaaatttattatcttaaccatttttgagtgaataattcgttagtattaagtatatttacctcgtgcggccagtctccagaattcttttcatcttgcaaaacaaaccccgaacccattaaacaatttctcattcgccattttccagctagccttggtaacctccattctagttctgtctctgtgaatttgactgtgtaccccgtgtaagtggtatcatacagtatttgtatttttgtgactggcatatttcacatagcataatctccttgtggtttatccatcttgtagcatgtgtcagaatttccttcccttttaagactaaataatattccattgtgtgtatataccacttgtgttatttccaccttttggttattgtgaataatactgcttcaaacatgagtgtacagataactcttcaagatccttttagggtaatacagagatagtaagttatcttgattgttcactgccagttacagaccaaactccttgttctccttgtgctccacttctcaaccactgcacttggctagtcttaaacaaaaaaagaaaaaccctaattttaatagcttgtggggacagacgcagtggctcacgcctataatcccaacactttgggaggccgaggtgggtggatcacttgaggtcaaaagttcgagaccagcctggccaatatggtaaaaccctgtctctactaaaaatacaaaaattagccgggtacggtggcacacacctgtaatcccagccactcaggagactgaggcaggagaaatgcttgaacccaggaagtggaggttgtggtgaacggaaattgcgccgccgcactcaagctgggcgacagcgagactccgtctcaaaaattagtattaatagaatgtgggagattttgaaaccaagtatagaaattcatactttatattgtttaaggtccgtgactaggcatagtaacatgatgaaagaactgttttgggtttgtttggtttttttccgagacagagtctcactctgttgcccaggctggcgtgcagtggtgcgatctcggctcactgcaacctctgcctccctggttgaagcgattctctttcctcagcctcctgagtagctgggactacaggcacatgccaccacgcccagctaatcgttgtatttttagtagaggcggggtttcaccatgttggccaggatggtctcgatctcttgacctcgtgatccagcctcccaaagtgctgggattacaggcaggagccaccacgcccagctagaaagatctgtttcagaaagcaactctggcagtggaagctgaatacatactccatttctataaagcatttatggaggcctctagatgtgccaggcattgtactactgctttatgtaaattattgatgggtccgcgaatccattaatataaatgtgagccagttgttgtgcaccccaatttacaggcaagaaaatcaaggttctgagttgcagatgggctgagaaaaggctcaccaaccacatgtacgcacaagagattaggaaagaaaactgccattggagccaggctccagtaagcactgagtattcattggtttggatgaggatactgaaagaaaaaaatgacatgtaagagtgacttttctcaggagaaagaataggctgacatcaagagtctttgctgtcacattagtggtatgtataagggcacaacacaacagaagtacatttttcaaggttcgtaaaagaaccctggggtttgcttttaggtttgtttattacctttaacaaatataaaatgccaggtaaatatatctttgtatgtagtagagaaattaataagacatacccttccctactcaacatttcatctttgattttatattctcaaaaatattgtgaggtcttttaaggaaatgatctccttttggcagatgaggaaattgagggccagagaggaaaaattatcttcccaatgccacatgcctaattggtctcaaagctttgactggaacctgagcctccagaattgctgctatgctttcatctcccttagagagatagataacagtagtcagagtgagtggacaattcttctattcagtcagtctgatcttcctcagggatgcatatccagactcccatgcagctagtgatagttaaacaaagaggcagagaatatagtgcattataaatagcattcatacactcaaaaatattgtgtgccgatactgtgccaaacacttagcaaagcagggaaaaatccctgtcctcatagcagagactaaaaatattaataagtaaaatatatactaagacaggtaggataagtgttggcaagaaaaagtgaagcagtgagaggggaatagggtgagccgagagtagggagggaggtttttgtttataccagaggcagaggagccccactgagaaggcaaactgtacaaagatctaaaggaggcaaaggaacaagaaatgtgccttgggtggacagggaacattctgggtggaataacaagtgcagaaatcattaaggcagaaagatgcctactacattctgagaacagaaagcagtccagagtgatagaagcagagtacaggagggtaaaagtaggaaatgaagtcagagaggtaagaggaattcaaattgggcatggacttacaggccattgtaaggactttggctttttctgagggagatgggaagccatcgttgagtagaaaaatagtgaaattctacttatatatttaaagaatcacattgacttctagtttgacactagattattgaggagcaagggggaccacttaggaagctattgtaatactccaggtgagagataagtggcatagaaaaggtgcaagcagtggagggatgaggtatctggatatattcagggtggcacacaggatttgatgacaatttatataggatatgagaaaatgaagggagtccaaggtgactacgatttttggcctgagcattttgaagaatggtgttgtcatttactgaactgggaaagatggaggagcaggttggggatgggaagagataaattccattttgggccaggcagggtggctcacacctgtaatcccagtactttgggaggccaaggcaggcagatcgcttgagctcaggagttcaaaaccagcctgggtaacatggtaaaaccccatctctacaaaaattagccaggtatggtggcagatgcccatagtctcagctgcttgggaggatcacttgagccctggaggtggaggttgcagtgagccaaaatggcaccactgcactccagcctgggtgacagaatgagaccccgtctcaaaaagacaaacaaaaattctgttttggagcttaaatttgagatgcctgttagaatgccacatgaaaatattaagaagagagttagatatgtaggagtctggaatttagaaatgtccagactggagatgtaaatttgggagagagcatgtagagagtatttgaagccatgaaataatctacatataaagtgtagacagatgtttgagaaaggtatcttaggcactgaaacaggaggaaaccaggaaaagaatcccagttgaactgggtggggaggatggctcaaggaagaacaaccatgtcaattgctgggttctaactggccactgcttatgatagtggagtagtaaggataaaagcctgattggaatggatttagaatagtgggaacggaattggagagagggagaatagataatttgggtatggagttggttgtaaggatagcgggtagaaaagtgataactgcaaggggtcaagacagtggttttaaaattacttcacaaattttttagtatttctaaaagaattctttttttaataaatataacttcagaccgctattgttcctttgtatcaactaccctgttattcaaattaacccaactgtcttataaaattttttgctaccagctttattgagatataattcatataccatactattcactcatttaaagtatacaattcaacaactttagtgcattcaaagagttgtgcagggtgggcgcggcagcacatgcctgtaattccagcacattgggaagccaagacgaggatcatttgagccaaggagttcgagctcagcctgggcaacatgcaaaaccacttctctacaaaaattagctaggcgtggtggtgtgcgcatgtagtcccagctacctgggaggctgaggtgggaggattacttgagcccaggaggcagacattgcagtgagcgccactgcactccagcctgggcaacaaagtgagaccctgtctcaaaaaaaaaaacaaaagttgtgcaaccaccattacaatttgttttaggacattttcagcaccccaaaaagaaacattactatgcacttagggtgataatgatgtgtcagtgtaggttcatcaattgtaaccactccggtgagggatgttgataatggggtgactgattttgatttgctgtgtgtgtgtgtgtgtgtgtgtgtgtgtgtgtgtgtgagagagagagagacagggtctcactctgtcacccaggctagcatgcagtagcacaattacagctcaccacagcttcaacctcccatcgcagcctcctgagtagctgggacaacaaacgcgcaccaccatgcctagctaatttttgtgttttctgtagagacaggctttcaccatgttgcccagactcgtctcgaagtcagctcaagtgaacccctgccctggcctcccagagtgctgagattacaggcctgagccaccatgcctggccaatttgctttttttttttttttttttttgagacaggtctcgctctgttgcccaggctggtgtgtgtgcaggctggcacaatattggctcactgcagcctccacctcctgggctcaagcgatcctcccacctcagccttctaagtagctaggactacagacatgtgccaccatgcctagctaatttttttaatttttttgtagagacgggatttagccatgtcactcaggctggtctcaaactactgggctcaagtgatcctctcaccttggcctcccaaagtgttgggattacaggtgtgagccactgcacccagtagatcatgtgttttttattctttgttaatatgggccattacattgcttttatgaattcccagagcaaatctcacttgattatgatgtataatcctttttatatgtcactgaaattgatttgatagtattttgttgaagacttttgcatctttgttaataagagctattgaggcagggcatggtgatgaatgcctgtaatcccaacactttggaaggccaagacgggaggattgcttgagctcaggagttgaagacaagcccaggcaacacattgaaaccctgtctctacaaaaaatacagacattagctgggcatgatgatatatgcctgtagttccagctacttgggaggctgaggcggaagggtcacttgagccctggaggtcaaggctgcagtgtgccaaaattgcaccactgcattccagcctgggcaacagaatgagaccctgtctcaaaaaataaataagtaaataagagatatttgtctctaattttcttgtgatgtctgattttggtatcaagataatactggccatataaaatgagttgggaaatgttccctcctcatctattttttcaagaatttgtgaagttttgcattcattattattacttttcttttttgagacagagtctcactctgtcacccaggctagagtgcagtggcaccatcttggctcactgcaaccacctctgagttcaagcgattctcgtgcctcagcctgccgggtagctgggactataggtgtgcgccaccaggcccagctaatttttgtattttatgtatttatttatttatttattgagatggagtcccactctattgctcaggctcctaggctggagtgcaatggcgtgatcttggctcactgcaaccttcacctcccaggttcaagcaattctcctgcctcagcctcctgagtagctgggattacaggtgcgtgtcgccacgcctggctaatttttgtatttttagtagagacggggtttcaccgtgttggacaggctggtctcgaactcctgacctcgtgatccacctaccttggcctccccaaagtgctgggattacagatgtgagctaccatgcctagctattttttttttattttaagtggaaacagggtttcgttatgttggccaggctggtctcaaactcctggcctcaagtgatccacccacctcggcctcccaaagtgctgggattacaggtgtgagccaccatgcccagcctgcgttctgtgtttgtttgtttgtttgtttgtttttgagacagactcttgctctgtcacccaggctggagtgcagtgttgcgatcttggctcactgcagcctctgcctcctgggttcaagtgattctcctgcctcagcctcctgagtagctgggattacaggcacctgccaccaagcccagctaatttttgttttttgtatttttagtagagacagggtttcaccatgttgggcagggaatggtctcgagctcctgacctcataatccacctgcctcagcctcccaaagtgctgggattataggcgtgagccaccacacctggccatcgttgattattttttaaatgtttggtagaatttaccagtgaagccatttgggcctaggcttttttttgtgggtagtttttctttctttctttcttcttattaattcaatctctttattataagtctattcagactttctattccttctcaagtcagtttcagtagtttatgtcattctaggaatttgtccattttatgtaagttatctattttgttggcatttagctattcatagtattcttttttgattctctttatttctgtaaggtcagtattaatgtacctgtctcataatactgtttttttccagtgtgttcaaatcaggccaaataattctgatacacaatattcgatttatttgtctctgtggtctcttgtaatatatagatttccttccatctcattttttcttgatatatatttattgaagaaatgaaattacttgtatatttctcacattctatatttttctgattgtattcttggaagtcattaacatgttcttctatcccctagctagttgataggtagttctttattatgatttaggtttgatttttttatggcaaactatttcttttttttccaccagttgtcaaatgatcctttactgaaatattttcctttgtgcttcttaactagctgggcattccacagcaccactgttgatgtcatctatgatttcatgagggtggtggctgtcaacattacaacccaaagactgggcagtccccaggatctctttaatgtttccagagagttctctggatctctccagattggtgccacatctgttgagcaatgttgatgatctcatcaaaagtgatattcccactgtgtttaatgtttttctgtttatttctgtcttgatggttcctcgagggctttgatgatcagggcagaggcagaaggcaccacctcaatctgggcctgtctgttctgaatggtcagttttcactgtaatcctcaggcccttccagtcacccgttgtcttggcaatgtcgtcaccaaccttttttggagacagacccagggggccaatctgggggccagcgcagacgtggcaccaacttcacccccagtgcacctcaggtatacgactttgatctctttggggttgaactttggcagcatggtggaggcggctggtgtcagatgaacccggattcgggactaccaaagaaagttgcaccttggcctcctccgagctcagatccgaaagcagcaaaactatttatacatcgattatcaggcacatagtttccaattttatctcttttcgtgaagttggcagtcattgatgaccactgcctaggttcattattacaattgaaatagttcaatagaaggcagagtatgggcatcaatcagtccagactataagaacttttgggaggtgacttttgatgattatgagtactacattctatactattcttagaaccttggcatcagggctgggcgcagtggctcaggcctgtaatcccagcactttgggaggcccaggcaggcggatcacctgaggtcaggagtttgagaccagcattaccaatatggtgaaatcctgtctctactaaaaatacaaaaattagacaggcatggtggcttgtgcctgtagtcccagctactcaggaggctgagacaggagaattgcgtggatccgggaggtggaggtatcgtgccactgcacaccagcctgggcaacagagcgagactccatctcaaaaataaataaataaataacctcggagtcaggagatgggatctactcccaactctgccaccaactagctgagcatcctctttggcacctgttttcttatctgtagaatgggggaataaactaatacaatgtctaggacttttggctattctaacattctctgactaaacaagtagaggacttaatctttcccaaagatgatttgggtgagttaaaaaggaactgctgaccttgtgttattattcccatttcataccaaaaatgtttatttcaaagccaacatttatcagtcattaaatccagtaaagtatataacagagtccattaaaagtattatgaggcaaggtatggtggctcacttctgtaaccccagcactttgggagaccgaggcgggcagattgcttgagtccaggagttcacgaccagcctggcccacatggcaagaccccatctctacaaaaaatacaaaatttagccgggcacaatggtgcatgcctgtagtcccagctacttggtggggctgagctgggaggatcgcttgagcccaggaggtcaaggctgcagtgagccatgagtgtgccactccactctagcctggatgacatagtgagaccctgtctcaaaacaaacaaacaaaaaaagtgaaaagtatcaggagagcaggaagccaaggccaaaagcgttgttttctggattctagttctggctctgcagctaatcaacatgcactctcagtgtcctgtccatagggtaaaagattgcatgagtagctctaaaggcctgtaagctttatgattttatgcctattcttgatttttctcacagttttgaggatgctatttttgttaatatctttttttttatacttttaagttttaggatacatgtgcacaatgtgcaggtttgttacatatgtatacatgtgccatgttggtgtgctgcacccattaactcgttatttaacattaggtatatctcctaatgctatccctcccccctcccccaccctatttttgttaatatctttagcgctacttgtttttatctgcattctgattatgctttactcagcaactaactggcataggcctgccccaggtgtcagttcgtatagcaaattcagcttgagcataaagaactttctggaagcaaagacaccaaaatattagcaatttattatttctaggtggtaagattattggcgtgcaccaccacgcccaactaaggcatatttttataatattttaaaagttattcttaaggcatttgatagcatatttttgattgcatgccccagcaaagaggaatcactaaactttaggtcagtagatttctttctcttcctataattcagtttggcagcatcttccattctaagttaacctaaatactttagtaataaagacttacatgtatctaattagatagtcagctttacttaatcttcttaatcatctagattagatgttaagtgaaaaaatattttgtgcctacagaaattaagattcggaaagaacagtagcacatacatgctatcaacatctgtgtcataactcatatggaatctggatttgcgctacttggggaacaggtagtgtctgctagagaagtggtgtgacagaaacatgggcaaaggcagggtgtgtcttttgtaaatgatgaaaacagaagattaaaaacaagtttgctaaatcatgttcataaccactccctggagagcaattactctgattactcgacttacctggtaagtaccacccactgtaggagaaaatacagatgtttggttcactgttatgggtttccccatgtgcaaaggtgttatgctgctgctatgctcgtctttaaacactgtagtagcagttactgaagaatggtagagtaaggggtgccctcacagctgtcaactcactgtgtgatccagacgagtaacgtagcctggtcgcaagctccaaggttacttatctttagtggaggggatagttctagtttccagtgttatcacgactagtaaaattgatattataaaatccacttctcagtaaggaaggcagtttgaaagcgttcttgttgtgagaagcatgacaaatacaggcagttctatggacagtgtttatgtaaaacaaattattgaatagccatttgaacattaactgttgcccagtgtgttataatgtgtacctgctcaggcattttgaagactcttcttacacctagtgaggaccaagggcaaatagcaaaaagtaacctgacatagagttttagtttggagattttcttttgaattgccctcagggagatttctcaagcaacactggtccatgccaatttgcaaatggactcttgtgccagtggctcaatcaacccatccaaatgcagagaaccatttggaggcattcaaaaccaaatgaggggcaattttctttcatttatatgctgtctgttaacctctctttcaccaaaaattaacctgattctgggtatgcatacctgaaaaaacacaatttttacactcaaggaagtttcattttttcataggaaaaaatcaactattactaaactatacagttactacagtgatggagatgtgtgcaggctgctgtaggaacataaaagggagcgcctaacaggtgtgggtgagtcaaagagagctggggaggaatgaaggcaacattcttgagctaaaccaaataaacaaaacattgcaactcacaattatgacctatttcaaactcttagaactacagtaatgatttagactagttctcatttggacagggtttatttactcttacggtttcaagcaccccttaatctttccattttaacaagggtatatggagcttcacagataatatctccaaaaatgggcatattttgacttgtagaccatcacctgcacacacacttcaaggtcactttcatacagcaaagtgaggaaagagtttattagctagatgagaatgtgtaaatgaggccgggtgtggtggctcacgcctgtaatcccagcacttcgggaggctgagatgggtggatctcctttggtcaggagttagagaccagccgggccaacatggtgaaaccctgtctctactaaaaatacaaaaattagctggcatggtggcgggcgcctgtagtcccagctactcaggaggctgaggcaggacaatcccttgaacccaggaggtggaggttgcagtgagccaagatcacgccactgcacttcagactggtgacagagcaagactgtctcaaaaaaacaatgtgtaaatgaaactgccctactatttctgctttagtaaaaacaacagattctggtcagtatttgttcacttatattgggcataagataattcctgctgtttgttgcagatcttggcatactgcctgattgtcctgcatgggaatcttggactgctactacagcaatttcatgactgtgtttcttctatttttgtttttaccacgttagttatatcatgcagtacttgaaacgaaggtggagtctgtcactctgtcagcctgcagtttaaaaagttagatgatgcattaaaaaatcaacaaattttgccaggaaggcagtgtgtgcctgtggtcctaacttctcggaagactgagtcaggaggattgcttgagcctagcagtttgaatccagtctgggcaacatagtgagaccctttgtcttaaaaaaaatcaacacattttaaaagtatttcaagatttgtatttgccatatttccaagctagtattatttatttagagtttcctattgcgggtgaaattctcttgtcttttgctgtttgcagtaacttgagtcttttttcatctcttcagataatctacttatattcatgccaagttttctagttttcctattgcttcctctaattttcaaatagagtatatacaatattgagcatagtttctcattagtctgttcacagtcactaaactaatcctcaaatgtatttgattctatcactttccaaaatttgcctttgctggttcataatatagttacctaacttccccagctctgccctcgctcatgaactgtatttctctacattacccccacactgcattggcattctgagtcatcggggattaggtatccttcctgctattaactacataatatttaaacttccccacttgcccatctcctttatttcgtattcaaacaccacatgaattaaactaacgttggttgcttttaacctgtaattcctgactgcaacaggtagttagttgccacctcttgaaatgaacagatttgactagaagctgacacttcttactcccgctgaacttagtattttacatttatataaattcaaaaagcaaaatcatacctttcttatcaatgggccctctttgtccattgataacataatattgcaatataaacaaaaagtatttgtaccatacctcagaaaacaaattagattactattagtgcaaaacaggggaaaagtagaaaaatgttattgtaaagagactatcacccacttcaagggatttatcaggtaactgcctgtgtaagttacaaagacaatgctaatctataactagtgtatacctagatgagccgccaggacatttgtctaatggcagatggggtaattggactccacatcttcaacttaggcacatggaaaacagcatccctaaaagttgcctggggatgaccagtactgagccaaccagcttagtggaactgttacgagagagaaacttcagagccaaggaatttcttggcagagcctcacattctgccttagaatcatgaaaagttagatctagaaggtaacagagatcatttaatccactgcccttattttacggtgaaaaactgaaggccagagaagttaaggagtttgcctaaggtctcacactcgtagttagtgacagattcagagctagaactagatcatcctgactgcatttcagtagtcttagagctggccgacaaatctgacaactcacattgaacccatgttccaaaaggtattttatattgagcttatgaacaccgctttttaaatttatgttatttatttatttatttatttattatattttaagatctgggatacatgtgcagaacatgcaggtttgttacataggtatacatgtgccatggtggcttgctgcacccatcaatctgccatcctgttttaagccccacattcattaggtatttgtcctaatgctctccctcctgttgccccccatcccttgacaggcccccgtgtgtgatgttcccctctctgcgtccatgtgttctcattgttcacctcccacttttgagtgagaacatgcggtgtttggttttctgtatgaacacccctttcacagaaaattaggcaaacaggttggaatatttagaatagaaaacatttattataaagtcacaagaaatacctgtgtagacttgctgactggaagtatttggcttccgtaagacaaagaagagtcttagtcatctggttaaagttaaaaacgattgtgtcaccaggctgaaagcagacatgctgtggaagcagtaggctgaaattagaactgaatacaagagtttagagaaaattgaatttggagctatctcacaacactgggagttattctgtttttgtttgcttttaataggcacacaaaaaagaatagtgactacaatgaactccttgtgtagccccaccagaccccattttcttccctccccactgaatttggtgcttatatttccatacctattcatgtggttttcctataggtaaatgtatccctaagtgatgtttagcattattttcatattttaagctacataaatgctatcatattgtatatatgtgtctacaacttgcatttttttttttgcttaatactacatttttgagatttatcctattgataaataggatttctctaactaatttattttattttttggagatgaggtcccgctatgttacccaggctggaatgcagtggcagttcacaggcacaatcatagcacaatgtggccttgaactcctggacacaagtgacctcttgcctcaggctcctgagtagctggggactacaggccccagccactgcaccaggccagctaattcattttaactgctttatggtgttccattgtatgaatgtttcaacatttagctaatctcctattgattgacatctagtgagtttccagttttttgatttgctttgtttcatttgctgttttattttaatgttgctactgtaaacatgtttataaaactggtgcatgtgtgaaagagtttgtctagtaacatttacaaggtctcagtgtgtgtgtgcaaatcttgaatttagcaagaagatctcaaaatagcaggttatgagactaacacaaggactgtgtatttttagagttttaattttttgtgaatctgaagagtgtaaaatactgttgccttctggttttaatttctctgattccttgtggggctgagtacctttccatgtgttcacagacaatttggatctcctcttctccctagctcacttttcagatgagctgctgaactttttattgttcattctgaaaaatgttctatagtcattatgtaaatccttattatatgcattgccaatatcttctcctaatctggagcttgacttttcacttttataatgatatattttcatgaacatatttatcaatcttttattttttatttatacttattatttctttaaaacatcattttttcactctaaggtcataagatattccccaatatttttctttagtttttttaaagttttatttttttacaatcttcaagtcttttatgtgccaggaattaacttgtgtgtagtgtgaggtcaggagctagttttatttttttctacatcgacaagcaattgtttagaaaccattaattgaatattacatttcttccccacagttgggtaatggcactttcatcatatatcctggactctctatcagtcaggttattattcctgtgccttattataccatattaactactatatctttatggtaagtctcaatatctggaaagcccctatttgtcaagtggatgcaatgggagctagatggatttgcactatccttcttgaataccatccaagaggtatgaatactgtggggaaggaaacccagaaggatgttatcttagcccttttgtgttgctataaaggaatacttgaggctgtgtaatttataaagaaaagaggattatttggctcacagttctgcaggccttataagaagcatgatccagcctgaccaacatggtgaaaccctgtctctactaaaaatacaaaaattagccgggcatggtggtgcgcctgtagtcccagctactcaggaggctgtggcaagagaactgcttgaacctgggaggtggaatttgctgaaccaaaatcatgccactgcactccagcctgggtgacagaatctcagggaaaaaaaaaaaaaaaagcatgatgccagcatctgcttctggcaagggcttctggctgtttccaccagtggcagaagggtaaggggaactggcagattcagagatcatatggtgagaggggtggcaagaagtgggaggaggttccaggctgtttttagtgaccagctttcctgggaactaatagagtgagaactcagtaccacaaggacagcaccaagccattcatgaggcacctgccccatgactgagcaaaacaccttccattaggccccacctctaacatgggggaccacattttaacatgaggtttagggggacatgaaaactatatcggagactatggggtcagtcattgttgcagtagctgagtggggaaatgggaatcctggaactggagatcagtgtcccacatcaaggaactgtgctctgtggagacctgtgggccctctaagaactcacatgtgtgtctcctgagagacatccaggccttggatacctgaccacaaagggcctcttgtggtccttcagtgttattaagtagaacaacagcaaccagcagaggactccagttgcttccagtgaagtaaaaagtcactttctctgaaagtggagttaagaacacaattctccttacaatggctggacgtgctggctcatgcttgtaatcctagcactttgggaaactgagatgggcagataacttgcggccaggagttcgagaccagcctggccaacatggtgaaaccttgtctctactaaaatacaaaaattagcagggtgtggtggcacatgcctgtggtcccagctacttgggggactgaggcatgagaatcccttgaacctggcaggtggaggttgcagtgagctgagatcacaccacacacttcagcctgggcaacagagcgagactccatgacagaaagagagagagagagagaaagaaagaaagaaaattcttcttacaataacagcaaaaagaataaaacaggaatagatttagcaaaagaagtacaagacttgtacactgaaaactgttgaaagaagttaaagaagaccaaacaaaatcccagccagcttctttgtacaaattgacaaactaatcctacaattaatatggaaatgcaagagaccaagaaaagccaaactattttggaaaaaaaaaataacaaagttcctggaggactcacactttctaatttcaaagctacaataatcaaaacttactacaaacccaaaataatcaaaacggcatggtattggcctacatatagacatattgaccaatggaatagaattaagagtttataaataaacccatacatctgtgttgaattgattttcaaccagggtgccaattcggtgagaaacaaacatcctttcaacaaatggctctaggacaactggatagctacatgcaaaagaatgaagttagaccccttgcctcacaccatatgtagaaatctacatgaaactaaaactgctttaaaaaatagtctatttatttagaaacagggtcttgctctgtcacccaggctggagtactctgacacaacaatagctcactgcagcttcaaactcctgggctcaagtgatgctcctgcctcagcctcctgatagctaggattacagacatatgccaccatgcccagctattatttaattttttgtacagaccaagactgggtcttgccatgttgcccaggctggtctcaaactgctgggctcaagtgatcctcccacctcggcctcacagcacactgctgcaaattccatgagatgggtgaaaaactatgagttcccaacatgtgagaagggggaaacctgcctctgaacacacatctccactggggaacctcaaaacccagattatggaagaaggatttaaccttgcctagagctgaaatggatttagtataaaatataaaagtagaaatagtagcaggaagagccttgtaggcgctcccattctccagcttgggccagggaagccatccctgactgtatctcaccgaggccattgaggaagacagttggcagaatttgggcagggtcgcagggtgaaataagcttccaactgaactgtgtaataattttgactgggcgcaaactctgtcgagcagaaatcgggggtgaaagtgaactgctgcagaaaggagcataggagccacagctgacagtgtgggcagacagggaggggcaaggcctgaaagccatgcttgctttcttagtggggaaacttataccctggggctaggtctgagtcctgcacaccagctgcctggagataaactgtgctgttagcggggcacagtgggagtgaaactggccttgccaactgtgtggtagctgggtgagccctgtggctacttactttcccccacttccctggtgacagaggcgccataatccacactggaacataaccccatttgcctgagaatcagccccctatcccccacagtggctgtggcaaaaagagtctgagctcagacctgcctaatcctgccccaacctgatggtatttccctacccatcccagtgcccagtcacaaaagacaaactcttgggagctttatggccctacttatcacatgagaaacctgaacacttatcctgaccaacttagggcaagcttatatcccccttctactatcacagctggtgctctcctgaacataccacctcctggctggaggccaaccaactcaagatatgacagcaactcatgacaaaataacactgctccaaggaaggaaaaaacagctaactccactatctgcaacatcctggctaaacagaggtcctgtccatgtggcaacatcactgctatcataaccagcatttgagaaagccagcacactaaacatctacaaccaaggcttctcatagagtctatgtcactaccctgccacctcccccagaggaggtgctggtatccatagctgggagacctgaagatggattacatcacaacactctttgcagacactccccagcatgatcctggagcttggaagccccactggatgcctagacccagaaaagcaataacaatcaccacagtctggctctcagaaagccccatccctaaggaaagggggagtgcaccacatcacgggatcaccctgtgagacaaaagaatctgaacagcagcccttgagttccagatttttccactaaaatagtctacccaataagaagaaatcaaaaacataattcaggtaatatgacaaaacaaggttctataacacccacaaaagaccacactagcttcctagcaatggatccaaacccagaaggaatctctgaattgccacataaagaagtcagaaggttgattattaagctactgaaggagatactagagaaaggtgaaaaccaacttaaagaaatgtaaaaatcaagccaggtgcggtggctcacgcttgtaatccgagcacttcgggaagccaaggcaggtcacttgaggccaggagtttgagaccagcctggccaacatggcaaaaccctgtctgtactaaaacaaaaacaaaaattagcctggcttggtggtacatccctttggtcccagctactcaggatgctgaggtggaaggatcacttgaacataggaggtagaggttgcagtgagccaagatcatgcaactgcccaccaacctgggtgacaagcaagaccctctctcaaaacaaaacaaaaagttaaaaaaaaatacaggacatggatgaaaaattccccagaggtatagatatcataaagaaaaaacaattgggccgggcgtggtggctcatgcctgtaatcccagcattttgggaggccaaggcgggcagatcacctgaggtcaggagttcgtgaccagcctgaccaaaatggagaaatgctgtctctactaaaaatacaaaattagctgggcgtggtggtgcatgcctgtaatcccagctacttgggaggctgaggcaggagaatcgcttgaacccaggaggcagaggttgtggtgagccaagatcatgccattgcactccagcctgggcaacaaaagtgaaactcttgtctcaaaaaaaagaaaaaaagaaacaatcacaacttctggaaatgaaagacacacttagagacatacaaaatgcactggaaagtgtcaacaatagactagaacaagtagaagaaaaaacttcagagcttgacaaggcttttgaattaacccaatcagacaaagacaaagaaaaaggaattttacaaaatgaagaaagccaccaagaaattggggattatgttaaatagacaaaactaaaaataattggtattcctgaggaagaagagaaatctaaaagtttggaaaacttatttgagggaataatcaaggaaaacttctctggccttgctagagatctaaacatccaaatagaagaagctcaaagaacacctgggaaaatcattgcaaaaagatcacctaggcacacagtcatcaggttatctaaagccaaaacaaaggaaagaatcttgagagctgcaaggcaaaagcctcagacaacctataaaggaaaacctatcagattaacagcagatttctcagcagaaactctacaagccagaagtgattgaggtcctatctttagcatcttcagacaaaataattgctagacaagaattctgtatccagcaaaactaaccttcatatatgaaaaagagagaaattatttttcagacaaacaaatgctgagagaatttgtcactactaagccagcactacaagaaatgctaaaaggatttctaaatcttgaaacaaaacttcaaaatataccaaaatagaaactccttaaagcatacatttcacagggcctataaaacaatgaaaaacaaacaaggtattcaggcaacaactagcatgaagaataaaatagtacctcacatctcaataataaaatgaatataaatggcctaaatgctcctcttaaaagatgcagaatgggctgggtgtggtggctcacacctgtaatcccagcactttgggaggctaaggcaggcagatcacgaggtcaggagatcaagaccatcctggctaacacagtgaaaccccgtctctactaaaaatacaaaaaaataggccaggcatggcagcaggcacctgtagtcccagctaaccaggaggctgaggaaggagaatggtgtgaacccaggaggcggagcttgcagtgagccgagatcgtgcctctgcactccagcctgggcgacagagcgagactccgtctcaaaaaaaaaaaaaaaaaaaaaaaattgcagaatggcagaatggataaaaatctaccaaccacatatcttctgtcttcaagagactggcctaatgcataaggattcacataaacttaatgtaaaggagtgggaaaagatattccttgcaaatggaaaccaaaagtgaggaagagtagctattcttatatcagacaaaacagactttaaagcaacaagttaaaaaagacaaagagggacattatataataataaaaggatcatttcaacaagaaaatatcacaatcctaaatatatatgcacctaacactggaggtcccaaatttataaaacaattattactagacctaagaaatgagatagatggcaacacaataatagtcagggacagccgggtgcaatggctcacaactgtaatcccagcactttgggaggccaaagcaggtggatcacctgaggtcaggagtttgagaccagcctgaccaacatggcaaaaccctgtctctactaaaaatacaaaaagtagctgggtgtggtagcacatgcctgtattcccagctactcaggaggctgaggtaggagaatcgcttgaacccaggaggcagaggttgcagtgagctgagattgtgccactgccctccaacatgggagacagagcgagactccatttcaaaaaaataaaagaatagtagttggggacttcaatactccagtgacagcactagacaagtcatcaagccaaaaagtaaacaaagaaacaatggagctggacatggtggctcacacctgtaatctcagcactttgggaagccaaagtgggcagatcacctgaggtcaggagtttgagaccagcctagccaacgtggtgaaaccccgtccctactaaaaatacaaaaatttgctgggtgtggtggcacatacctgtaatcccagctaatcaggaggctgaggcaggaaaatcgcttggaccccagaggtggaggttgcagtgagccaagatcatgccactgcactccagcctgggtgacagagtgagactctgtgtcacaaaaggaaggagggaaggaaggaaggaaggaaggaaggaaggaaggaaaagaatttaaactataccatagaacaaatggtctcaacagatatttacagaacttctacctaacaactacagagtatacattctttttagcaacacatggaacattctccaagataaaacatggtgggccacaaaacatgtctcagtaaatttaagaaaactgaagtaatatcaagtactctttcagaccatactggaaaaaaactggaaattaactccaaaaagaaccctcaaaactatacaaatacagggaaacttaataaactgctcatgaatgatctttgggtcagcaatgaaatcaagatggaaattaaagaattatttgaactgaatgataatagtgacagaacttatcaaaacatctggcatatagcaaaagtggttctaagaggaaagttcatagcattaaatgcctatatcaaaaagtctgaaaaagcacaaatagccaatctaaggtcacacgtcaagtaactagagaaataagagcaaaccaaacccaaacccagcagagggaaaaaaaattacaaggatcagagcagaactaaatgaaattgcaatacaaaaatgtataaaatataaatgaaacaaaaagctagttctttcaaaaaaaatgatagactgttagtgagataaaccaaaaaaagaagggagaagatccaaataacttcacttagaaatgaaacgggagatattactactgatagcacagaaataaaaaatgatttaagactactgtgaacacctttacacacacaaactagaaaacctagaggagatggataaatttctggatatatacaagcctcctagattaaatcaggaagaaatagcaactctgaatagaccaataacaagtagtgagattgaaacagtaatgaaaaaaaaaatgccaacagcaaaaaaaaggtccaggactagatggattcacagatgaattctatcaggcatttgaagaagaattggtactgatcgtaatgaaattattccaaaagataaactggaaatcctccttaaataattctatgaaagccgggtgcaatggctcatacctataatcccagcactttgggaggctgaagcaggcagatcacttgaggtcaggagttcaagaccagcctggccaacgtggtgaaaccccatctctactaaaaattcaaaaattagctgggcgtagtggcaggcacctgtaatcccagctactcatgaggctgaagcaggagaattgcttgaacctgggaggcagagattgcagtaagccaagattgcaccactgcactccagcttgggcaacacgagcaaaacttcgtcaaaaaaaaaaaaaaaaaaaactctatgaagccagtatcactctaatacccaaaccaggaaaagacataacaacaacaacaaaaatgcagaccaatatccctgatgaacatagatgggaaaatcctcaacaaaatactggctaaccaaaaccaacagcatatcgaaaagatagcacatcatgataaagtgggttttatactagggatgcagggatggtttaacatatgcaagtcaataaatgtgatacatcacataaacagaattaaaagcaaaaatcatatgatcatctcaatagatgctgaaaaagcatttgacaaaatccagcatccctttatgattaaaaccctaagcaaaatcagcatagaagggacatacctcaaggtaataaccatctatgacaaaccctcaggcaacattatactgaacagggaaaggttgaaagcattccccctgagaactggaacaagacaaggatgcccatttttatcactgctattcaatatagtactggaaatcctagccagagcaatcagacaagagaaagaaataaagggcatccaaattggtaaagaggaagtcaaaccattgctgtttgccgatgatatgattgtatatctagaaaaccctaaagattcatccaaaaagctcctaaacctgataaatgaattcagtaaagtttcaggatataaaatcaatgtacacaaataagtagcactgctatacaccagcagtgaccaacctgagaatcaaatcaagaactcaacccttttaacaacagctgtaaaaaataatataaaatacgtagaaatatacctaaccaagaatgtgaaagatctctacaaggaaaactacaaaatactgctgaaataagtcatagatgacacaaacaaatgggaacacatctcatgctcatggatgggtagaatcaatattgtgaaaatgaccatacagtcaaaagcaatctacaaattcagtgcaattcctgtcaaaataccatcattatttttcacagaactataaaaataaaatcctaaaattaatatggaaccaaaaaagagcccacatagccaaagcgagactaagtgagaagaacaaatctggaggcatcacattacctgacttcaaactatactacaaggctatagttaccaaaacagcatggtactggtataaaaataggcgtgtacatcaatgcaacagaatagagtacccagaaataaagccaaatatttaaagccaactgatcttcgacaaagcaaacaaaaacataaagtggagaaggacaccctgttcaacaaaggctgcaccctaaccacaaatggtcaaatggtgctgggattgttggcaagtcacatgtagaagaatgaaacttaatcctcatgtctcaccctatacaaaaatcaactcaaaatggatcaaagacttgaatctaagacctgaaaccataaaaattctagaatataatattggaaaaactcttctagacattggctaaggtagagttaatgactaagaacccaaaagcaaatacaacaaaaacaaaaataaatagatgagaccgaattaaactaaaaagcttccgcagagagaaaaaaaaatcagcagacttggctgggcatggtggctcacgcctataatctcagcactttgggaggccaaggtgggtggatcacctaaggttaggagttcgagaccagcctggccaacatggcgaaaccccatctctactaaaaatacaaaaattatctgagcatggtggtgcatgcctgtaatcccagctacttgagacgctgaggcaggagaatcacttgaacctgggagacagaggttgcagttagccgagatcgcatcactgcactccagcctgggcgacagagcgagaccctgtctcaaaaataaaataaaataaaataaaataaggccaggcatggtggctcatgcctgtaatcccagcactttgggaggccaaggtgggtggatcacaaggtcaggagattgagaccatcctggctaacatggtgaaaccccatctctactaaaaaatacaaaaaattagccgggtgtggtggcaggcgcctgtagtcccagctactcgggaggctgaggcaggagaatggcatgaaccctggaggcagagcttgcagtgagctgagatcacgccactgcactccagcctgagcgagagtgcaagactctgtctcaaaaaaaataaacataaaaataaaataaaataaaaataatcagcagagtaaacagagaacccccagagtgggagaaaattttcacagactattcatccaacaaaggactaatacccagaatctaccaggaactcaaacaaatcagcaaaaaaaaaaaatcccatcaaaaagtgggctaaggacatgaatacacaattctcaaaagaagatatacaaatgtccaacaaacatgaaaaaaatgctcaacatcactaattatcagggaaatgcaaatcaaaaccacaatgcaataccaccttactcctgcaagaatggccataatttaaatatcaaaatataatagatgttgatgtggatgtggtgaaaaaggaacactttcacactgctggtgggaatgtagtacaaacactatggaaaacagtatggagaatcctttgagaactaaaagtagaattaccatttgatgcagcagtcccactaatgggtatctacccaaaggaaaagaagtcattgtatgaaacagacttacacacatatgtgcatagcaatacaatttgcaattgcaaaaataaggaaccagcctaaccctgatttccagtggaaatcctaggaagttatgatgttagttctgggcttgtaaaagaaaaacaacagcaaacaaacaaacaaaaaagaaaaaccttggaagcaagtaatttgagatggtttatgtcagtttttgtgatgaaaactattttctaatgtttagaaagatgtttccacaattttttgtttcttaacagaactaaatatttagcttttctgtatcatatagatgactcagacattttatgattagctattacccaggttgacataacatgactctaagttattgaaaaagattttttaaacaatgtaaagctcatttataaacttttatttattctcttttgcaagtaaaccttatggtaaataataaaaaacataaaaaagtaaataaagttttatttattcttaggaagtatgcttgagtagctcattaaacaaagttagctactgaaactgtctttgcagggctgagcagtggctcacgcctgtaatcccagctctttaggaggcccaggcaggtgcattacctgaggtcaggagttagagaccagcctggccaacatggtaaaactctttctctactaaaaatataaaaaattagccaggtgtggtggtgggtgcctgtaatcccagctacttgggaggctgaggcaggagaaccacttgaacccaggaggtggaggttgcagtgagctgagatcacatcattgcactccagcctgggcaacaagagcaagactccatctcaaaaaaaaaaaaaaaagaaaagaaaagaaaaaaagaaactgccttcgcaaaattataactgagacagtgaaagaaatctaacttaactgaccatcttgcctctagcatataagctgtctttgttcattccatcttgcctagggactagattgtctttgtaggactaacatttgacacaagattagaaattatgatttaggagtcatgcagctggaggctaaaagattatgaccctccctaaatttctctcaagatcagtgcttgagatattttgcagaccctgcacttgatggatcagctggctccacccagattgataaactggctcatctgatcttgtagcccctgcccatgaactgactcactgcaagaagacagcttcaactccctatgatttcatctctgacctgaccaatcagcactcctggctcactgggttctccccacccactaggttgtccttaaaaattctgctcccaaaatgctcggggagactgatttgagtaataaaactctggtttctgcacagctggctctgtgtgaattactccttctctattgcaattcccctgtcttgagaaatcagctctgtctaggcagtgggcaaggtgaacccattgggtgcttacaccatcatcttcagttttttctttgtaatcatgtttacattccacaaatgttaggaacttaacactttagccagaactctaaagttaaatacacgggtattttgttaatcagaggacacggttgttttcagtaaatcaacagtattaaactagtcttatttaccaacaatttacacaaatcatttgaactaaaaggcatttgagttagcttatatttttctcataaaatatataatttaagtgcttactttttctttaacccaattaattagagttttcgtgtattttggtaatgaaatatcacatccacatggcatatatgaacatatatacatacagacatacaaacaaaagcagagtctgtagcttgataaacttcttcatttgtcagggggtttttttgttttggttttggttttggttttctttttctttttttttttttttgagatggagtcttgctctgttgcccaggctagagtgcagtggtgtgatctaagctcactgcaacacccacttcctgggttcaagcgattctcctgcctcagcctcccgagtagctgggattacaggcgcctgccactgtgcctggctaatttttgtatttttagtagagatggggttttgccatgttggccagggtggtctcaaactcctaacctcatgatccgcccaccttggcctcccaaagtgctgggattacaggcgtgagccaccgcacccagaaaccatttgccagtttttaaatagtttctctcccctctttagactatggagccctaaacaactgttagcaacataacccttaatttgcacttccaaagacatgactcttaagtgaaaatttacatcccaaaggcacagcacttagatctaagcaccattctctgctgagatgaagaaggatatgggtaaagattcagtcgaagtgagattgccaggaaaagtatcttaaacaaaggcagggattgttatgtaaactttaaaccaatgtcttccccatcttaagagttttgtgggttttttgtttgtttttttttagacaaggtgtcattctgttacctggactggggtgcaatggtgcaattttggctcgctgcagtctccacttccctaaggccacaagatttgaagttaggataatacatgttacactgttaacttttagcaaactttacttttgttgaaaaccatgtaagtttgggatttttaattatcctttgctattactaagacctctttagtccaaatcaacttggaattagtatagatggttccttcctggttctgtaagtactttaaggcttggctgagtgcagagctcacacgtttgagcagactgattattaggcaattttcctaactctatttctacgagagtttccctatcaattactgaatactcgttgtgtctttttccctcaatcagccaggagaaaccatccatcatcctgtcctgaagggagttcctcctaggtctggtcggacctttgtatggtagttaattaagatttagatcccctgttaggaaacctgcagggttaagggaattatcagtggttaatgttaaatcatatttttctaacagaatggcctcatatgttaatattcttaagtcagtaagctgcctttttgcttttttgacttaggatagttctgacctggtgaggtgtgctcacaatgaggtttcctctaaaagttatttttgtactttcttcagttagcaaagcagttgctgctacagattgaatgcatttgggccatccccgggttactgggttaaggatttttgataggaaggctactggttgtcagtggcctccgtgcttttgggatatgcccttgtttacactgacaacaagatggaatagctacttgagggtaaatctaggacaggggcagttactaatagatgttttaacctttccacctgttggatttctggtaattgccaaatgaggagggggttttgcccatcttgcgtgagctttttgtataagggttttgtttttagggcataagaggctatccatagatgacagtatctgacttatcttaaagttttctaagttcttgtttggtctccggcagaggcaaggatatgatactttcagtccattcaagctcaatttgccatttacctttgctaattaaatgacttgttctaatatttgactaaataaatttgaagacttcgtaaacccttgaggtaagactgtctatctgtattgctattttcaatcagagtgagggtcttctcactcaaaggcaaataggtcctggctgtcttccgtgaacggacaaacccagaaggcatcttttaaatctattaccataacaacagggtgggtagtttggacttgattaatagctctaaggtcttgcactaactggtgtgacccgtctggcttctttacaggcagtattggagttttatagggtcacggagaagactttcaattataggttttacatttaccctggcttttaaaggaatagggtacattgctttctctttactacttctagctctctctctctctctctctctctctctgactctctgtctctttctctctctgactctcttaagtttttttttttttatccttctaatattttaacattagtcctgggggattattgggggaatattattgttgctagctttatttcttttatcctgtaccttacttggggtatttcccatttttggggtgaggctcaatttcccttaccagaaatatctcaccttttggagggaggctcaatttcccttactggcaatgtctcaccttttggggtgaggctcaatttccctcactggaaatgtcttgccttttagggtgaggctcaatttcccctactggaaatgtctcaccttttggggtgaggctcaatttccctcactggaaatgtctcaccttttggggcgaggctcgatttcccttaccggaaatatcttgcctctttttaatccccaagataccccgaccaaggaatacttcactgccccctgtggtttttctttccttagtcccggctaaggaatgctttaccacccctacggcttctttttccttggtatgtcccaaccaaggaatgtttcactgcccctgcagtttttctttccttagtccctaccaccaaaggaatactttaccagctcctccgctgtttccttctttggcttgtgcgtgatgttgtctggtccacgtggtatgtaaggatcctttaccccaggtcaccggccagtttctttccacattgctgagagtctgggtttattcatcacaccaggtaggtctcggttcctcacccctgaggctgccgaaatgaggcggcggggcacctccttacaagagaggactggagaccgcccagaggagagtgggtccctgcatgggccaccaaactgttagaaatgcaaaatgcttgttccctggtgctgcaaagaaatagcactcaaacatacatttaattttctcagcaaggcaatttttactttctgcagaaagggtgctcctcacagatggaacaatggtgagatcataccaggacaggggaggggcaggagttcttattcctgacgctagtagcccctactgctgtgttgttgccctaatggctaggattggaccgcacagtctaagctaattctgattggctatgttaaaaagagcaggagtatgagctggagtggtgaggtgagtagtttggtgggaagggcagttaggaacaggtaactaaaggtgacttaggtcagagcaggtgaccaccaagggaacagctgtgaactactgatttggactggcgggaaagttgtttactgaaactagaggcaaggagttgaagagaactaggaagttaaactttaaaatgaagaatcaaagaataagagagctggacatactgacatactgattctttgaagagaaacttagggttcactatatttaacaggaggccgagacaggaggatcgcgtgagcccaggagtttgagaccagcatgggcaaaatagtaaaaccccatcttattaaaaaaaatttttttttttgaaatggggtctctctctgttgcctgggctggagtgcattggtgctatctccactccctcaacctctcagccaatcctcccacctcagcttcatgagtagctgggactacaggcgtgcaccaccctgcccagctaattttcgtatttttttgtagagacaggttttcatcatgttgcccagcctggtctcgaactcctgagctcaggcaatcctctcacctcggcctcccaaagtgctgggattacaggcatgagccaccacacccgaccttaaaaaaaattttttttaatatgtggaaagcagacacgagtagaagccagcacaactagctaacttcccctagtgatagaggcaggagacaggcaaatgccatctatgtcattatatatagggagcttgcctaaacatgcccacagtggaaaattccatcccttaacacatgcacagtaagagaaataaatcaatgcagagtggccatttcctttattgccttctgaacatttacctttctagtgtcctttctttttgcatctcgcacattaatctctagcctcatccggctcttgaatccttgcctaacttgacttctttcacatctacatccacatccatgtcctctcacggtgctaatttttctttttatgagagctgttgctaacagattggcttttttttcttaagtctttaatttacttttttttttttttttttttttttctgagttctcctgctcctacggccagctggcggggctgggcaacggcacgggccttgcccccgcgcactgctgtctgtctctcctgttttcttctgattctctttttcacacttactcttagtgtttctttttcctttgctctttcccagttttgttccttggtcacagttaacatacaccttggtggccacttttatagactaggtggtattcatgcctgcagcttctgcttgatgttaccctgggcttgctttacaaataaaatattcagtgcatactgattttcagcagcctcagggttaagtggggtataaagccagaatgctttatagagtctcttataaaactgacttaggctcttgtcagctccttgaaggatttctgaaatcttttttatattacttgcttttttctaccaacttttagactctgcagaagtgcttctcagtacctctgcaaatgctgaagctgaattgcattctctgggtctttttttcccttttttctagagtttaacaggctcttttctttatacaattttttatgcacttggagggttaaacaggcatacccagagtcagtgtaaatgtttacaagtcttaccttcactgagttctaaggcccgaattaaagcaatgagctcagcttaacaacagtgtccagggttaccaccgcatattctgcacctctctctccttgggggttgatgaagctgttcccgtccacgtatagctcccagtctattgatgcccaaggctggtcctggaggttaggtctgctagagtaaatttgagtccaacacctctacacagttatgctcgacagggctttagctgccgggagcaaggtggtgggttcagggtgtttccagtttagtagatcaatggttgaaaagggctgatagatgaaagtctgttgtcccccccaaccccccggatgtgggcctggtcattataatagacaggtcctcgtgtctccctgagaggcatttgcatagcctctcagatctgagatggcccacttgactatcttgatttccttccttggtctctcgaagctccgatcctccccttcaaggtaaaacctggagcgtgttagctcctgaatctcatttctgagggggttgttggcctcagtaaagcggggtaggctgggatatatggagaaagaatttctgttatctctggcggctcccgcaaaactggcttctcttgctgtttctgggactccctttttaactctgtctgccggcgaagctgctcttttacttttggcttttttgcaataagctgttcaacagggctaaatttatgctggttttgcctatattatatttaaccatgagtcaatataaaggaatttgatctaggtacactggctgccctctgacccctgtcaccaccttaaatacatggccaatagttccctgtctatagttccttcggtgggccatctaacaccaaaagagggcaattctaattcacacagagttcttaacctctagggggttaacttaactctataatctcccacagaacctttcctaaggttctgtaacatgcattttaatagagtaagttttgatgctttgatgactttccttttatttttctttttgaaattttttaacatagttcctagcggagtgggcttactttgtgtctgacctatttttctcttgaaacaaaaaaaattcacactacaagaaggaaagggtaaaaggtcactcactcgtctaattcacactaaatcaaaatcaaaactaaaaccaaagtgttgttaaaggcacacctgttcgtcaagcaatttatgccaagtcaaaatcagaaccaaaaccaaagtaccaataaaggcatgcctgtttatcaagcaattcaagtcaagtcaaaatcaaggttaaaaccaaagtatcaagcaattcaagtcaagtcaaaaacaaaaaccaaagtgccagtacagacacgctgtgggtgatcaggccacgcttccactcaaacggagtgggcaagttccaaagaccagtcttaccaagtttcagatgtccggactccaagtgcctgttccttcccggtgttcagccactgcgttgatcctccaccggggcctgccacgcgctgctctggcaaggcgttccactggggcaaatgcctacccgggagcactctcaggatccgcattgctcaagccggagtcccccacagggatgctctacagagcatgcataagctgcctaaggggctacctcgaccgtcagttaatcacctcatttcccggtcagggaaccaagaaatgtagcaggacgagccacagacgaaactcctcagacaccgaattaaagaaggaagaggtttttattcggccgggagcatcagcagactcatgtcttaagagccgagctctccgaaaaagaaattcttggcctttttaaaggcttacaactttaaggggtccatgtgaaagggtcgtgataaatcgagcaagcgtgggaaatgtgactggaggctacatgcatcagctaacagaacaaaaagttttacagcgcttttttcatacagtgtctggaatttacagataacacaggtagtttaggtcaggggttgatgttactattattactttttttaactcctagggccaggtggtggtgccaaggttgtctggctatttatcttacttttgtttttttccaactttttgctttttatctcctcctgtcttgtgaactaggcaaggtggggggaggagggcagcaggagtagtagtggtctccttccttaagactaagggccagcatgcacactggaagaatggggtggagccaccaggaattcatgcctaatgctggagaggagccacgccttttcaacttgcatgtgatggccttgtattcaatttgtgaggtggatacctgcatataggaccctccttttgcttaataaattccgccctcctcacctttcttttcttttttttgagactgagtcctgctctgttgcccatgcaggagtgcaatggcatgctcttggctcactgcaaaactctgcctcccaggttcaagtgattctcctgcctcagcctcctgagtagctgggactacaggcatgtaccaccatgcctggctaattttttgtatttttagtagagatggggtttcactaatttgcccaggctggtcttaaactcctgacctcaagtatctgcccacctcagcctcccaaaatgctgagattacaagtgtgagccaccgcacctggcaccatcctcacctttcaatgtttctgcgtgcctaatttttctggatttagctgaaccaaggaacaaaaaattctgcatcattagttgtgctggcttccacttgtgcctgccagtatcccacatttacatttaatcttgggttcccaaagacaggaaccccatgagaccaggccacacagtgcttccacagcacacctttctgtaaagacattcccctgaggctagtgggcaacccaatgcaaatcagcccactctgtgatcagctcatcttccatcagagtcttaaccattggtagtgaatgttcccacaacctccaggtgttcaaacctgccttttaatctaagtgcgtaaagaacaaatagcccattgcaataataatcattcactacaaccctgtcagccactttccaggttttgccagtgactcgtcagccactgcacacgcaaaagtcaagttctctctcatagtaaaaagtaattcctggtaccccaaaagccaaagatcaggtactacttttaacagctcttggcctggcacagtggctcatgcctgtaatcccagcacattgagaggccgaggcgggcagatcacctaaggtcaggagttcaagaccagcctggccaacatgttgaaaccgtgtctctacaaaaatacaaaaattagccgggcatcatgatgggtgcctgtaatcccagctactcgggaggctgagacaggagaattgtttgaacccaggaggtggaggttgcagtgagccgagatcgcaccactgcactccagactgggtgactgagactccatctcaaaaaaaaacaacaacaaaaaacagctcttagaattcttcattagttacaattttgtttcctccgtggcaatatgaattgcaatttgtgaattaaaaacattagaatttgaaaaaattttggctggacatggtagcttatgcctgtaatccctagcactttgggacgccgagcgaggcaggcagatcacctgaggtctggagttcaagaccagcctgaccaacatggtgaaaccccttctctactaaaaaaatacaaaaattagcccagtgtggtggcgcatgcctgtggtcccagctactcaggaggctgaggcaggagaatcgcttgaacccgggaggcagaggttgcagtgagccaagatcatgccactgtactccagcctgggtgacagagtgagactcagtctcaaaaaataaataaataataataaataaaataaaataaaattcaaaattatctggacatctgaattttatctgacatgccctttcatcatattgctatatcctttgtctttcctcaattatattttatcaagaaggccttttccaaccattttatttagtatggctcccccacctccacttctctcataaattgttctggccctagcaccagcatacagcatagtttcctgtttatttgcttagtgtctgtctccttcagtatagaatgtaatcttgtggcggtcatggtggctaacacctgtaatcccagtactttgggaggctgaggcacgtggatcatttgaggtcaggaattcaataccagcctgaccaatgtggtgaaaccctatctccactaaaaatacaaaaaaattagtctggcatggtggcacaagcctgtagtcacagctactcaggagactgatgcaggagaattgctagaacccgggagacagaggttgcagtgagctgagatcgcaccactgcactccagcctgggcgacagagtgagactccatctcaaaaaaaataaagtaatcttgtgagggcaggattttgatgctatgttcaccactgactccaaaatggcacatagcgggctctcagtagatatctattgaacaaatggaagcataaataaacaagcaatgctacacttgctttctccagcaccatgggagcagatccagggagcagacagggaaagaaggctacagcccctgccccctggtggagctggaagaatcaataattttcatttatttattcatctaatgtgctttgcacgctccctatctgccaggatcagcttgttgccagggataccgggtaaacaatcccataaggttcctgtggtctggaggaagaaacagacattaacgcacaatagggagatggttacttaattatagtggtgaactgtcaatgaaggaaaagcaaaaaaaaaaaaaaggtctaacctggtataggggtcaggggagacttcctcaaggaagggatatggagttgaggcctgaggctgagcatgaattaactggaggcagagctctgtgggtggagatgtcattccaagcaggaagcccggttaatgcaggtaccttgatagaaggaaggccagggtgaggaaaaaggccgggttacaggcagttactaggaaccttgtggcctgacttgttgctgaggaggaagcaatagccagctcagagggccttgtagttcaggtgatgccccatttctgtgttagtctatttttgcgttgctataaagaaatacctgaggctgggtaatttatacagaaaagaggtttaatttggctcacagtttagtaggcgccaggaagcatggcgctggcatctgctcctggtgaaggctcagggagctttcaatcatggcggaaggtgaaggaggagcaggtgtgtcacatggtaagagtgggacagagagacagagacagggagagagagagtgcaagagagagcaaaggagggaggaggagccagccttccttaaacagccagctctcatgtgaactaacagagtaagtactcactcatcaccacggggaggacaccaagccattcatgagggatccgcccccaagacccagacacctcccaccaggccccacctccaacactgggaatcgcatttctttttctttgttttttaattttgtactttaagttctgggatacatgtgcagaacatgcaggtttgttacataggtatacatgtgccatggtggtctgctgcacctatcaacctgtcatctaggttttaagccccacatgcattaggtatttgccctaaagctctccctccccttactcctcccccatagaccctggtgcgtgacattcctgtccctgtgtccatgtgttctcattgttcaactcccacttatgagtgagaacatgtggtgtttggttttctgttcctgtgttagtttgctgaggataatggcttccagtttcatccatatccctgcaaaggacatgaactcattcttttttatggctgcatagtattccatgttgtatatttgccacattttctttattcagtctattattgatggacatttgagttggttccaagtctttgctattgtaaatactgctgcaataaacatacatgtgcatttgtctttttttttgagtcagagtctcgctctgtcgcccaggctggagtgcagtggcaagatctcagctcactgcaaactccgcctcccaggttcaagcaattctcctgcctcagcctcccgagtagctgggattacaagcgcacgccaccatactcggctaattttttgtatttttagtagagaaggggttttgccatgttgtccaggctggtctcaaactcccagcctcatgatctgcctgcctcagcctcccaaagtgctgggattacaggtgtgagccacaatgcctagccatgtgtctttatagtagaatgatttatattcctttgagtatatgccccatgggagggaatcacatttcaacatgagatttggaggggacacacatctgaaccacatcacacagcatattcccaactccagctccctcctctccacaagaatgtaggatacccatcactcccaggatcagcttccttgagcccaatcctctgtaactcactgagatgctatgaagtgcctggtaggtgccacactgtgccacagtcatgctccaagacagtgtggagtgagggccagagggccaggaggcaggattggtttggagacattgcctttcttcaaacctcagtttcctcttaaatcaaataaatgattgcagaagataagctcatattaattccatttctaggaaaaatctgtgttccaaacagtagcactgactaatggaaagtacaactggctgtttcccttgaacagtgggtttattgttgtttttccaattataaaagtaataagattatttgtaaactatagaacagtagaaaaagtttcttgaatgagatttggttttcaatcagggcaaataaagacttttctgggattaagagggctgtttcttctccattactttatacggacccgtactggggacttgtcagctgttcaagtacaacgcacccagttttggttctgtaccaggattaggcctacaatatttcagaattcatatacaaaccccaataaagtgttaaaggagatgactgccctataacctatgttttgctgaatgtttactatgaggttttttttttaccatcctcatgagtatggtattgtaactgaaactctccaggaaaattcctctgcttaaaactaaaaatcaagtgtatctcaggaaactctactgtcccatctgaaatgcctctgttgtgtgttgtctgcaaaggtggagtctccctgttttgttcaggctggtctcgaactcctgggttcaaggaaatctctctcctcaccctcctgtgtagcggggactgtaggcacctggctgtggtggatactattaagccaaattccagtcagcatcctcttttcaatgaagttgaaaggagagatgatgaaactggcagtgttactgaatgggaaataaaggtgggaatacacattgtgagtgaagacacggaagtaacttctgcaatacaaccttgtaagagtcttaatgctacactcctttgtttatcaaatgatgtacctttatcgtaagggaagaacctgggccattccctctggtgttgagaggcaatttggaaactctgccatttcttaggactgagtatttaatatactattttgtggaaatctgagaggcagaaatgggatttaatgatctcaactgtcatccatctaaaaaacctaatttgcaattttaaataaaatggcatgttgccttctactattctctttttgttttttgagacggagtcttgctctgtcacccaggctggagtgcagtggcacaatctcagctcactgcaaccactgcctcctgggttcaagcgattctcctgcctcaacctcccgggtagctgggattacaggcacacgccactattctaggctaatttttttattttttgagacggagtctcgctctttgcccaggctggagtgcagtggtacaatctcagctcactgcaacctctgcctcctgggtttaagcgattctcctgcctcagcctcctgagtagtgggattacaggtgcgcaccaccacgcctggctaatttttgtatttttagcagagacggggtttcaccatgttggccaggctggtctcaaactcctgacctcaggtgatctgcctgcctcagcctcagcctcccaaagtgctggcgtgagccacggctcccagcctactattccccttttaaaacaggaaccaaccctgcatttaattttatgaagtctgatttatttatttatttatttatttatttatttatttagagatggaatctcattctgtcacccaggctggagtgcggtggcgcaatctcggctcactgcaacctttgcctcctgggttcaagcgattctcctgcctcagcctcccgagtagctgggactaaaggtacctgccaccacgactggtgaatttttgtatttttagtagagatggggtttcacgatgctggtcaggctgttccactatgttggccaggctggtttcaaactcctgacctcaggtgatccgcctgcctcggcctcccaaagtgctgggattacagacgtgagtcactctgcccagccgaa

SEQ ID NO: 488 - DNA, 1103 bp, Homo Sapiens
cgtgagggaagtggggagaagctgtcaccccaacttgagttcaagaagactccttggaagaaaagaccaccaaattgagaatgaaaagtaagctgtagctattcttgggatggggcagtggccccatgctctggtccctggcctcagcagctgtcccagctcataaccccaagtgccggctttcccatcccgtctcaggatctgcactcgacgggcaccagggctttcttcagcgaatatctaaactctctcaagtttctccagagactttcatacatctacaaagatgacctcattctgtaacagcatggatttaacccgctcttcaatgtcactcccccacagaatgcactgttcatcgtcaccctatccactatcgtcagtcttactaaaagtcaaacatcaacattagtagtaactctggcattgtagcgatatctccaagagaaaattgttttgaacttttctgggaaaagttcacatatgttttcttaaaacgctagtttttacaatctcgctaccatgtggctttcctgaaggattaaatttctaatgtccttcaactagagagaggtaaaaatttttctagaacatgaattgcccactcccctcattccttctcagaaactaactgaattccagtgggtgtgcctggcaaacccaaaagcagtttctgttcaggatgctggtcttacctgtgaaggcgttcatgaacgtggagagggaccggttcaacattttgaagaaagggtctctgcacggatatttctgagacccacaaaggacggtatgctcaagaatgtgaggaacaccagtactgtccatgggagtagtacggaactgcacgctagggaaggagaatgaccagaacgcaaaaggttcagcttagtgctgcggacacagttcccagatgcatcatcacctcaggctactagaaatcatcattctgacaccacaatcctccagcacagggttttccaactataatgtaaatcattgactcagactgtaaaattgtattttgatgagattataagtcagtgtaaacttttccttatttttcaagatgctctgtcaataaaaatactagtgagatgatattt

SEQ ID NO: 489 - DNA, 16448 bp, Homo Sapiens
gtcccgggggcacaggcgttcttaaggctgcagagccctgggtcccccacccggccccggttcactttgagcggtcccaaggcctgagggcctactgtccagtccccaggttatcgtcctgagcaaagacagaccccgagccctgcggtcttggggctcaaacagtccctggatggccaaacaagcaaatattcgccatggcagtgggtgctggaagggtggctcacggagctgacgccctccgcagagaaccgtggtctagtcctgcggtcacgaggcctatctgggacagtggtgtttgagctgagactttaacgaatagagacaggtgaggttcctgcagcccagggcttcaggatttcatcaaatggtctgctgcactgtgctggaattttgaactccccagagtagtaaacaacatcttctcaagggtatacaagtcatcagatagagaaaacacccattatagagctgtggagcccttacgatatagtgctatgctgcaacaaattagacagaagagtatttgttgaataataaaagagtctcactctattgcccaggctggagtgcagtggcatgatctcggtacactgcaagctctgtctcctgagttcaagcgattctcatgcctcagcctcccgagtagctgggattacagttttccaataataacatagaaaaaaggaagaatttgagagtttctcagattaggcaattccttgaagaatctgagaacacagaagctcccctccctactttccatgattgaaatcagtgattcattggtttctttgtgtgggcttttgaaagatcattagaaaccaacctgaagatcatgagattcttgtggacacaggagcaatgagtggcaatacagtgctttctaatgcaacctactttaaaaggtaaacagataaaagaaaataccgaagactgaaaatgcagaaaattcaaccatgcagcccattccaaattaaatatgtcttcctctctaattcctctcttctagcagagaaggggagatgagctatgactccatgctcatgcttaacaaaattgtgttagattggtgcaaaagtaattgcagtttttgccatttaaaagtaattgcaatgttatctcctagaatttttatagtttcaggtcttaagtttaagtccttaatccatcttgagctgattttttgtatagggctggacgttcgcttaggcaaggatttcatgaccaacaacctgaaaggaaatgcaataaaaacaaagataaatagctggaacctagttaaactaaagagcttttgcatggcaaaaagaagagtcagcagagcaaacagataacaaacagagtgggagaaaaccttcataatctgtacatctgacaaagtgctaatatccagaatctacaatgaactcaaacaaatcagtaagaaaaaaacaattccatcagaaagtggctaaggatatgaataggcaattctcaaaagaagatatacaaatggccaacaaacataggaaaaaacgctcaacatcacaaatgatcagggaaatgcaaatcaaaaccacaatgcgataccacctcactcctgcaagaatggccataattaaaaaaaaaaatcaaaaaacagtagatgttagcatggatgcggtgaacagggaacacttctacactgctggtgggaatgtaaactagtaaagccactatggaaaacagtgtggagattccttgaagaattaaaagtagaactaccatttgatccagcaatcccactactgggtatctacccagaggaaaagaagtcactattcaaaaaagatacttgcacacacatgtttatagtggcacaattcaaaatagcaaaatcgtggaaccaacccaaatgcccatcaatcaacaagtggataaagaaactgtggtatgtatatataatggaatactatgcagccataaaaaggaatgaattaacagcatttgcagtgacctgaatgagattggaaacttattctaagtaaagtaactcaggaatggaaaaccaaacatcatatcttctcacagatatatgggaactaagttatgaggactcaaaggcataagaatgatacaatggactttggggacttggggggaagggtgagaagtgggtgaggtataaaacactacaaatatgctgcggtgtatactgcgcaggtgatgggtgcacgaaaatctcacaaatcatccctaaagaacttactcatgtaaccaaataccatctatacctcaataacttatggggaaaaaagtaattgcaaaaactgcaattacctttgcatgaaccaaaggcctactttggagagtcagaggaattcttaaccataattcaaccaagacatacggtatgtgccttctctttggtggaacagtgaatatacaggctactagcctgtactgagtgtttcagccaaaacacattcttttaaaagtcacagttttaagtgacaatatcccaatgaaaatacaaattaaaaaatgcattggcatatctatattccctcccaaaataacacacatttggaatatataaagaactcttaaaagtcaatgagaaaaaaagcaatagctcagtagaaaagtgggaagaagacttggacacttcagaaaagagaatatattaaaatagtccataaacagaaataaaaggtgctcaactttatgagtcatctgggatatgtagattaaaaccacagtgcaatattataccacccctaccagaataactaaaaagagtaagttggaaaatactcagtgctgatgagaaagtggggtaattgaaactcttatacatcattctaggaacatccacttaggaaaacaacttggcagtgtctaataaagtccagtatatgcattccctataacccagaatttttactctcaggtgtatacccaacagaaatgcaggtgtgtgttcaccagaaatcatgttcaagaatgttcatggtatcactagtcatgaggcacaaaaactggaaatgttcatcaacaatgagtaggataaataagttgtgttaatatttatacaattgaaaattatacagcagaaagaataaataatctaaacctacacacaacagcatgaagaaatctcatgagtggaatgttagatcataacctaaataaacttacctggagcaggtgccactgaagccataaaatggtaggatgaattgctggaggctgactatggactagcttgacagtaaaaaatttggggaggtccattctgaaggaggcccctcacactttcttggattttatcttcaggaagcccaccagattttcatggtgaagatcttagaaaacatctctcatatcttggtcagttgggggaaagtagcattttgaaataatcctagagcattctccatagccaaggtttactcctcaacggaaacaactttaccagagccttagttgaccatggagaagggcagttagccccctacatccctctctagctttcttgtgttacttagtggaaggaaaaaaaggataagaaacacttctgaagtccaattcagggacttgagcccactaaaagactgaaatatacttacctcctccacaccttaccaccacatcaacacagctccagaataatcacaatgggttacaatggaaagagctgcaaaacatagactctatttaagaaggaattcttagggaaatccaatgtggagaaaacaaagacactgaggaaactaaagtctctggcatctatagctatggaaaacatgaagcacaacccatctgctaggcagattgacataaaacctcatactaaagacctattttcctcagttctcattacctgatacatcatgtttgacttttaacaaaaaatcataaggaaggctatacaaaaagaaaaggaaaaacacagtcagaagagacaaagtaagcatctgaactagactttgacatgaaacaaagtttggaataatcaaatagataattaaaaataactatgattagttatgttaaggactgtaatagaaaaagtataagcatgcaagagcagatgaataatataagcagaataatgaaaactctaagaaagaatcagaagaaaatgacagaaatgaaaaacactgcaacagaaatgaagaatgcctttgataagctcattactaaactgaacataaacaaggaaataatcaataatttaaagatatatcaaaggagacattgcaaattgaaatactaagagaaaaaggactacaacctccattccaatatccaagaacaattacaaaaatataacatatgcataattgaagtactagaagaagaagaaaggagcagaggaagtgcagaggaagtacagtagttccctcttatccatggtggatacattcaaagacccccagtggatgcctgaaaatgcagatagtaccaaaccctacctatacattctatgttttttcctatatgtacatatctatgataaggtttaacttataaattaggcataaaaagagtttaacagtataataaaatagaaaaattataacaatactcagaaccaagcacaactgaaaacttgtgaaatgtttatttctgggcatggtggctcatgcctgtaatcccaacactttgcaaagccaaggcagatggattgcttgagctcaggagtttaagaccagtgtgggaagcatggtgaaacctcatctctacaaaaaatacaaaaaattatctaggtgtagtggcacatgcccatagttccagctactcggggtggtgggagggtgtgtggtggggggcagtgtggggtggaagggagctgaaatgggataatcgcttgagaccaggaagtcaaggctgtactgagccttgactgggccactgcactccagcctgggtgacagaatgagaccctgtctcaaaaaaaaaaaaaaaggaaaattattaaggataaagatgggcattaaataatgagaaaggggcaattatccaaaaaacataataattcttaagttatgcaggtaacacagcatctaaatacatgagacaaaaatttataaaactgcaagaagaaataatcaaatttaatattatttaataatatttttggagatctcaacatccctatattaataacagctaatttcaacaagcagaaatcaggaaaatgttcaactgaatagcactaacaatgaacaggatctaactgttcaagtagcagcagaataattaatcaagtaacagcagaatacatattcctctcaagtttatatgggactttatgcaaaatagaccacattctggggctgaaaaagatgccctcacaaatttaaaagaatagaaggtttactgcatgtgttcttagactataatgaaatttaactggaaatcagtgccagaaaaaaactcagaagtccccaaatagtttgagattaaataacatacttttatataacacataggtcaaagaagaagtctcaaaggaaatttaaaaatatttcgaactaaacaaaatgaaatgtacatcaaaatttatgggatgctcaggaaaaatagctagtggatgcttggcttcatacctaggtgatgggttgatctgtgcagcaaagcaccatggcacacgtttacctatgtaacaaacctgcacatcctgcacatgtaccctggaactgaaaataaaaattgattaaaaaagaaagagaaaggataattcctttcacccacagtttcctgtctcctaatagtccttctgttgtgtctttaaataaatgtgtctcaaatcttaagatattcataaaatctgggattgcagatgtattttgcattacaagtcctatttttattttttaatggaatgctgtaaaagcagttcttagaggcaaatttatagcagcaaatgcatatattagaaaagaagaaaaatctaaaatcactaatagaaatgtgccttaggaaagtaaagagaggagagcaatttaagcctcaagtaagcagaagaaaagacataaaactttgagcagaaatcaataaaattgaaaacatgaggtcaacagagaaagtcaataaacccaaaaggcaatgcctttaaaagatcaataaaatcgataaatccatagccaggctaaccaagtgaaaaagggagaagacacaaattataaatattgattccatagacattaaaaagataataaaagaacattacaaacaaatgtatactgacacttttggtaatttagatgaaatgaatcaattccttgaaagacataaaccatcaaaacttatggaaaagaaatacattacctaaatagatctatatttatttaaaaaatagataaatcattaataatctttcgaaaaagaaagcgtctcgcccagattctttcactaatgaattccaccaagcatttaaggaagaaataatgtcagttctctataatcacttttagaaaatagaagtaagaggtatacctcctaactcattcaaggaggcaggcattatcttaatatcaaaaccggggaaatacactacaagaaatgaaacctacagctcaatatattttatgaatatagatggaaaaattttcaataaaatattagctaattgaatccaaaaatatataaaaatagtaatacatcacagtaagtgcaatttattttaggcataccagactgatctgacatttattaactggctaaagaactattttatgattctgtcaattgatgcagagaaagcatttgacaaactccaacatctatttatgagaaaaagtcttagaaaactaggaataaaaaacatcctcaacttaatctggaacatctaaaaaatgggacttcacgctattttatggtgagaaatgatatgcttttcttctatattgggaacaagacaaggttctttttttgccactcttattcaccatcctactggatgtcctaattagtgcaacaaggcaagaaaaaatatatatacagattagaaagaaaaaaagaaaactacctctgttcaagatgacataattacttatttagtaaaactgaaagaattgactcctggaattaatatgtgattatagcaaggttgcaggatgcgaggttaatagaagtcaattgtgtttccatgtaccaccagtgaacaagtgaaaattgaagttgaaaacaaaatacaatttcattccttcccccagcaaaaatgaaatataaacaacaaaatatgtatacaacgtatattatgtatatggaaaattttaagtctgatgaaagaaataaaggaagatctaaataaatggagatgtaccactttcatggataagtagattcaataatgttgagatataaattcttcacgaattggtgtatacatttaatacaattctaataaattctcagcaagttattttgtggttattgacaaatttattctattttttagcttcatctcaaaagatgattttaaaatttatatggaaatgcaagagacccagaatagtctacataatactgaccaaaggactaagttggagaactgacactactcatagtactacaaagctacagtaattatgacagtgaggtatttgtacaagaatagacaaatggattaatagaaaagaggagagagcctcttttagaccctcaactgatccttgacagagcaaaataaattcaattgagaaaggacagtcttttcaacaaataatcatcaaaaattgtgcatatacatgcaaaaatgaatctagacatataccttatgcttttcacaaaaattaatttaaaatggaccttagttctaaatgtaaaacaaaaactagaaaacttctatgagatagcataggagaaaatctaggtgaccttgggtttgattaaatcatgatccatgaaagaaaaaaattaaaaaaaaattgaacttaattaaatttaaaaattgttatgtgaaatatattgttaagtaaatgagaagacaagccacagaatgagagaaaatattttaaaaacatatccagtaaaggagttaaatccaaatgacaccaaggtatttaaataattctatgtaatgatcaaaagatctgaacattcaactcaccaaataagatgtacagatggcatataagcatatgaaaagatgctcaacatcttatgttattagagaatagtaaattaaaacaacaatgagaaaccactacacctattagaatggctgaaatccaaattactgacaacaaccaatgctgttgagaatgcaatgcaagagaaactctagttcatccaattttcaaatgtgactgtaaaaggctgcagccactttagaagacattttgtctgtttcttacaaagctaagcatagccttgcattataatctgcagttgtgttcctctgtatatacccaattacactgaaacattatgtctacaaaaaaatcctgaaaacaaatgtttatagcaggtttattgttacttggtagttaccaaaaatggaaaacaatcaagatgtctttcaatagatgagtgaataaactataagatatccataaaatggaatattattcagcagtaaaaagaaatgagctttcaaatcatgaaaagacatggaggaaactcaaatgcatactgttacatgaaagcagccagtgtgaaaaggctacatgctatataatttcaattagatgacattttggaaagaagcaaaactgtaaagaaaaagatcagtttttgcctggcgttcagggaaagggaagaataagttaagcacaggagacttggggagctgtgaaatgattctgtgcaatattggtggaattttggcaacattatgcatttgccaaaggcaatagaagtttttgacacaaagagttaccataatgcaggcaaattttagaaaattatttagaaggtcagaggatcccagaagcaatgtggactttacagaagaaattcactgcattacaaagcatcagataaccttagtaaggtggagagagaaaatggtcttaacataaatatctttaaaaatgaatggaatctgtcagactataggcaagatgagctgcacaaaagcactgtactctagctgataaaattatttctcattggcttctggttaacagttctgatactgctatacatatatatgggaattgaataattaagcctataaatggcaaacattgggagttatatttctcacggtgtggaaatttacagatcaactaggggaacagtcttgaataatcaatgtgatgatcattacagttggagacatcaaggagaactaatgtttaacttaatatagatatgggtggttatatatagaaatattcaaagatgtttatgtaaatacacaaaagcacaaccatgacacatctaaaataaataacaccctggtaaccatgggcacacttagtactcaaatgctggagtgcaatggcgtgatcttggctcactgcaacctctgccccctgggtttaagcaattctccagcctcagccaccagagtagcagtgattacaggcactcaccaccacacctggctaatttttgtatttttagtagagacagggtttcaccatgttggccaggcttatctcgaactcctgaccttgtgatctgccctccttggcctcccaaggtgctgggattacaggcatgagctaccaggcctggcctgttgattttttcttttttttttttttattatactttaagttctgggatacatgtgcagaatgtgcaggtttggaacatagatatacacgtgccatagtggtttgctgcacccatcaatcggtcatctatattagatatttctcctaatgttatccctcccctagttccctacccaccaaagggcccagtgtgtgatgttcccctccctgtgtccatgtgttctcttttttcaactcccacttatgagtgagaacatgcagtgtttggttttctgttcctgtgttagcttgctgagaatgatggtttccagcttcatccatgtccctgcaaaggacatgagctcatccttttttatggctgcatagtattccatggtgtatatgtgccacattttctttatccagtctatcactgatgagcatttgggttgattccaagtctttgttgttgtgaacagtgttgcagtaaatgggtgtgtgtctttgtagaatgatttataatcctttgggtatatacccagtgatgggattgctggatcaaatggtatttctggttctagatccttgaggaattgccacactgtcttccacaatgggtgatctaatttacactcccaccaacagtgtaaaagccttcctatttgtccacatcctctccagcatctgttgtttcctgactttttaatgatcgccattttaactggcgtgagatggtatctcactgtggttttgatttgcatttctctaatgaccagtgatgatgagctttttttcatatgtttgttggccacataaatgtcttcttttgagaagtgtctgtttatatcctttgcccactttttgatggggttgtttgtttttttttctcgtaaatttgtttaggttctttgtagattctggatattagcccttcggcagatgagtagattgcaaaaaggttctcccattctgtaggttgtctgttcactctgatgatagtttcttttgctgtttagaaactctttagtttaattagatcccatttgtcaattttgacatttgttgccattgcttttggtgttttagtcatgaagtctttgcccatgcctatgtcctgaatggtatagcctaggttttcttctggggttttcatagttagaggttttatgtttaagtctttaatccatcttgagttcgtttttgtacaaggtctgaggaagggttcagtatcagttttctgcatatagctagccagttttcccaacaccatttattaaatagggaatacatcccccattgcttgtatttgtcgggttcgtcaaagatcagatggttgtagatgtgtggcattatttctgaggcctctgttctgtttcattggtctatatatctgttttggtaccagtaccatgctgttttggttactgtagcattgtagtagagtttgaagtcaggtagcgtaatacctccagctttgttctttttgcttagaattgtcttgactatgcgggctcttttttggttccatatgaaatttaaagtagttttttctagttctgtgaagaaagtcaatggttgcttgatggggatagcactgaatctataacttactttgggcagtatggccattttgatgatattgattcttcctatccgtgggcatgatatgtttttccatttgtttgtgtcgtctcttatttccttgagcagtggtttgtagttctccttgaagaggtccttcacataccatgtaagttttattcctgggtactttattctctttgtagcaattgtgaatggaagttcactcatgatttggctctctgtttgcctattattggtgtatacaaatgcttgtgatttttgcacactgcttttgtatcctgagattttgctgaagttgcttatcaacttgagattttgggccgaaatggtggggtattctaaatacacaatcatatcatctgcaagcagagacaatttgacttcctgtcttcctatttgaaaactctttatttcgttctcctgcctgatgaccctggctagaacttccaatatatggtgaataggagtggtgagagagggcatccttttcttgtgccagttttcaaagggaatgcttccagttcttgcccatttagtatgatatcggctgtgagtttcttgtaaataactattattattttgagatatgttccatcaatacctagtttactgacagtttttagcatgaagctgtgttgaattttatcaaaggcgttttctgcgtctattgagataatcatgtgatttttgtcatcagttttgtttatgtgatggattatgtttattgatttgcatatgttgaaccagccttgcatcccagggattaagctgacttgattgtggaggataaactttttgatgtgctgctggattcggtttgccagtattttattgaggatttttgcatcgatgttcatcagggatattggcctgaaattttccttttttgttgtgtctcttccaggttttggtatcagaatgatgctggcctcataaaatgagttagggaggagtccctctttttctattgtttggaatcatttcaggaggaatggtaccagctcctctttttacctctggtagaatttggctgtgaatccatctggtcctgggctttttttggctggtaggctattaattactgcctcaatttcagaacttgttattggtctattcaagaatttgacttcttcctagtttagtcttgggagggtgtatgtgttgaggaatttatccatttctgctagattttctagtttattttcatagaggtgtttatagtattctctgatggtagtttgtatttctgtgggatcagtagtcatcttccctttatcatttcttattgtgtctatttgattcttctctcttttcttctttattagtctggctaacagtctatctattttgttaatcttttcaaaaaaccagctcatggatgcatttacgttttcgaagggtttttcatgtccctgtcttcttcaattctgctctgatcttagttatttcttatcttctgctagcttttgaatttgtttgctcttgcttctctagttcttttaattgtgatgttaaggtgtcaattttagatctttcccactttctactgtgggcatttaatgctataaatttccctctaaaaactgctttagctatgtcccagagattctggtacattgtatctttgttctcattggtttcaaagaactcatttatttctgccttaattttgttttttacccagtagtcattcagaagaaggttgttcagtttccatgcagttgtgctgttttgagggagtttcttaatcatgagttctaatttgattgcactgtggtttgagagatggtttgttgtgatttctgctcttttggatttttctgaggagtgttttatttctaattgtgtggtcaattttataataagcacaatgtggtactgagaagaatgtatattctgctgattaggggtggagagttctatagatgtctattaggtctgcttggtccagagctgagttcaagtcctgaatatccttgttaattttctgtctcattgatctgtctaatattgacagtggggtgttaaagtctcccactattattgtgtgggagtccaagtctctctgtagatctctaagaacttgctttatgaatctggatgcccttgtattgggtgcatatatatttagaatagttagaccttcttgttgcattgatccctttaccattatgtaatgcccttctttgtctcttttgatctttgttggcttaaagtctgttttatctgagactaggattgcaacccctgggttttgtttgtttgtttgttttctttatatttgcttggtaaatcttccctcatccctttattttgagcctatgttgtgtctttggacgtgagatgagtctcctgaatacagcacactgatgaatcttgactctttatcccatttgccagtctgtgtcttttaactggggcatttagcccatttacatttaaggttaatattgttatgtgtgaatttgatcctgtcattatgatcctagctggttgttttgcctgttagttggtgcagtatcttcataatgtcgatggtctttacaatttgatatgtttttgcagtggctggtaccagtttttcctttccatatttagtgcgatgatcttacaatttggtatgtttttgcactggctgatactggtttttcctttccatatcttgtgcttctttcaatagctcttgtaaggcaggcctgctggtgacaaaatgtctcagcatttgcttctctgtgaaggattttatttttccttcgcttacgaagcttagttttgctggatatgaaattctgggttgaaaattcttttctttaagaatgttgaatattggccctcctctgttctggcttgtagggtttctgcagagagatccgctgttagtctgatgggcttccctttgtgggtaacctgacctttctccctggcttccgttaacattttttccttcatttcaaccttggtgaatctgatgattatgtgtcttggagttgctcttcttgaggagtgtctttgtagtgttctctgtatttcctgaatttgaatgttggcctgtcttgctacattggggaagttttccaggataatatcctgaaaagtgttttccaacttggttccattctccccgtcactttcaggtacaccaatccaatgtaggtttggtcttttcacatagtcccatatttcttggaggctttgctcagagaggaggaactcagagaggcagtctggctatagcagatttgctgagctgttgtgggctctgcccagttcaaaatttttggcagctcctttactcaagcctcagtaatgttggatgccccacccccaaccacgcttgagcatcccagggcaacttcagactgttgtgcctgcagtgagaatttcaagcccgtgaatcttagcttgctaggctccatgggggtgggatctgctgagctagaccacttggctccctggcttcatccccctttccaggcgagtgaaaagttctgtctcactggcattcctggcaccactggggtatgaaaaaaaaactcctgcagctagcttcctgtctgaccaaaccgttgcccagttttgtgcttgaaacccagggccctggtggcataggcacctgagagaatctcctggtctgtgagttgcaaagatcgtgggaaaagcatagtatctgggccagagtgcacagttcctcaaggcacattctgtcgtggcttcccttggctaggggagggtgttccctgaccccttgcacttcccaggtgaagtgacaccccaccctgctttggctcaccctccatgggctgcacccactgtctaaccagtcccgatgagatgagccagatacctcagttggaaatgcagaaatcacccgtcttctgcattgatctcaccgggagctgtagaccacagctattcctatttggcctttttttcttttgagacagggtttcactcttgtcacccaggctggagtgcaatggtgcaatcttggctcactgcaacctctgcctcccaggttcaagtgattctcctgcctaagcctcccaagtagctggcattataggcactcaccaccatacccagctaatttttgtatcttttgtagagatggggtttcaccatgttggctaggctggttttgaactcctaacctcaggtgacccacctgcctcggcctcccaaagtgttgggattacaggcatgagccactgcacctggccaaatgttgatttttttaataccattttataataaaaggaacaaggactccctggagaaacagctgatactaaggcaggagtagaaaatatacaagataatcctggaaaatcttgtagggccagaaagtaaacaagtgcattaaaaataagtcacattggtaataatatgtcaaaggaacaagggagtctactgaaagagctcccaaaggccaaagctggaagaagtagagcaagaaagtaaactagctttgaattataacccaaaatataaagtaaatatccataagtctctactgatataaagcacaattgaataataactgggagagggagggagaataaataagttctacgtaaaagaatttcttataaattttgtagatatgactttctaaacaaattctcattcttaagaattcatagtgacttccttccaaaaattacaatatggaaaactgataaaaaatgagtaactctacagtggaggaatctgacacatactacatcagccaggttattgaggtcaacatcaacagccataaatcatgtgaacagtatgtacacttggtatgatgtaacgaatagcacttcacttctgtggtctttctccccaggctcattatctcagtataatcatgaaaaaaaaaaaaaaaaaaaaacccagcaaagtccaatagaggaatattctacaaaatacctcactatactctttaaaagagttaaggtcattaaaatggagtcggagacaatgtcctcaacatgaggagtctaaagagacaggccaactaaatttagtatggtatactggatgaattcctggaacagaaaaaaggttattaggtaacaactcaggaaatctgaataaagaaagaaatcagttaataacaatgtatcagtattgctttattaattatgacaaaagtaccatactagtgaaagatgaataatcggagtaactgtgtgcaaagactgggtagagggg

SEQ ID NO: 490 - DNA, 16730 bp, Homo Sapiens
gtcccgggggcacaggcgttcttaaggctgcagagccctgggtcccccacccggccccggttcactttgagcggtcccaaggcctgagggcctactgtccagtccccaggttatcgtcctgagcaaagacagaccccgagccctgcggtcttggggctcaaacagtccctggatggccaaacaagcaaatattcgccatggcagtgggtgctggaagggtggctcacggagctgacgccctccgcagagaaccgtggtctagtcctgcggtcacgaggcctatctgggacagtggtgtttgagctgagactttaacgaatagagacaggtgaggttcctgcagcccagggcttcaggcactgtgctaagcagttttcctggaagtgtctacctcatttcgttctctgaatagctctaagagcgtgaacaaccccagaaggaaaaagagtgctgttgttaaaggtatctggcatcatggacccaaccatcaccaggagtttctcacttcatctctgtgtgataaattttgacatatgtatacatccatgaagccggcaccacaatcaagataatgaacatctcgcttaccccagaagtttcctgtgccctgtcactcctccgtattcctccatcctcaggatttcatcaaatggtctgctgcactgtgctggaattttgaactccccagagtagtaaacaacatcttctcaagggtatacaagtcatcagatagagaaaacacccattatagagctgtggagcccttacgatatagtgctatgctgcaacaaattagacagaagagtatttgttgaataataaaagagtctcactctattgcccaggctggagtgcagtggcatgatctcggtacactgcaagctctgtctcctgagttcaagcgattctcatgcctcagcctcccgagtagctgggattacagttttccaataataacatagaaaaaaggaagaatttgagagtttctcagattaggcaattccttgaagaatctgagaacacagaagctcccctccctactttccatgattgaaatcagtgattcattggtttctttgtgtgggcttttgaaagatcattagaaaccaacctgaagatcatgagattcttgtggacacaggagcaatgagtggcaatacagtgctttctaatgcaacctactttaaaaggtaaacagataaaagaaaataccgaagactgaaaatgcagaaaattcaaccatgcagcccattccaaattaaatatgtcttcctctctaattcctctcttctagcagagaaggggagatgagctatgactccatgctcatgcttaacaaaattgtgttagattggtgcaaaagtaattgcagtttttgccatttaaaagtaattgcaatgttatctcctagaatttttatagtttcaggtcttaagtttaagtccttaatccatcttgagctgattttttgtatagggctggacgttcgcttaggcaaggatttcatgaccaacaacctgaaaggaaatgcaataaaaacaaagataaatagctggaacctagttaaactaaagagcttttgcatggcaaaaagaagagtcagcagagcaaacagataacaaacagagtgggagaaaaccttcataatctgtacatctgacaaagtgctaatatccagaatctacaatgaactcaaacaaatcagtaagaaaaaaacaattccatcagaaagtggctaaggatatgaataggcaattctcaaaagaagatatacaaatggccaacaaacataggaaaaaacgctcaacatcacaaatgatcagggaaatgcaaatcaaaaccacaatgcgataccacctcactcctgcaagaatggccataattaaaaaaaaaaatcaaaaaacagtagatgttagcatggatgcggtgaacagggaacacttctacactgctggtgggaatgtaaactagtaaagccactatggaaaacagtgtggagattccttgaagaattaaaagtagaactaccatttgatccagcaatcccactactgggtatctacccagaggaaaagaagtcactattcaaaaaagatacttgcacacacatgtttatagtggcacaattcaaaatagcaaaatcgtggaaccaacccaaatgcccatcaatcaacaagtggataaagaaactgtggtatgtatatataatggaatactatgcagccataaaaaggaatgaattaacagcatttgcagtgacctgaatgagattggaaacttattctaagtaaagtaactcaggaatggaaaaccaaacatcatatcttctcacagatatatgggaactaagttatgaggactcaaaggcataagaatgatacaatggactttggggacttggggggaagggtgagaagtgggtgaggtataaaacactacaaatatgctgcggtgtatactgcgcaggtgatgggtgcacgaaaatctcacaaatcatccctaaagaacttactcatgtaaccaaataccatctatacctcaataacttatggggaaaaaagtaattgcaaaaactgcaattacctttgcatgaaccaaaggcctactttggagagtcagaggaattcttaaccataattcaaccaagacatacggtatgtgccttctctttggtggaacagtgaatatacaggctactagcctgtactgagtgtttcagccaaaacacattcttttaaaagtcacagttttaagtgacaatatcccaatgaaaatacaaattaaaaaatgcattggcatatctatattccctcccaaaataacacacatttggaatatataaagaactcttaaaagtcaatgagaaaaaaagcaatagctcagtagaaaagtgggaagaagacttggacacttcagaaaagagaatatattaaaatagtccataaacagaaataaaaggtgctcaactttatgagtcatctgggatatgtagattaaaaccacagtgcaatattataccacccctaccagaataactaaaaagagtaagttggaaaatactcagtgctgatgagaaagtggggtaattgaaactcttatacatcattctaggaacatccacttaggaaaacaacttggcagtgtctaataaagtccagtatatgcattccctataacccagaatttttactctcaggtgtatacccaacagaaatgcaggtgtgtgttcaccagaaatcatgttcaagaatgttcatggtatcactagtcatgaggcacaaaaactggaaatgttcatcaacaatgagtaggataaataagttgtgttaatatttatacaattgaaaattatacagcagaaagaataaataatctaaacctacacacaacagcatgaagaaatctcatgagtggaatgttagatcataacctaaataaacttacctggagcaggtgccactgaagccataaaatggtaggatgaattgctggaggctgactatggactagcttgacagtaaaaaatttggggaggtccattctgaaggaggcccctcacactttcttggattttatcttcaggaagcccaccagattttcatggtgaagatcttagaaaacatctctcatatcttggtcagttgggggaaagtagcattttgaaataatcctagagcattctccatagccaaggtttactcctcaacggaaacaactttaccagagccttagttgaccatggagaagggcagttagccccctacatccctctctagctttcttgtgttacttagtggaaggaaaaaaaggataagaaacacttctgaagtccaattcagggacttgagcccactaaaagactgaaatatacttacctcctccacaccttaccaccacatcaacacagctccagaataatcacaatgggttacaatggaaagagctgcaaaacatagactctatttaagaaggaattcttagggaaatccaatgtggagaaaacaaagacactgaggaaactaaagtctctggcatctatagctatggaaaacatgaagcacaacccatctgctaggcagattgacataaaacctcatactaaagacctattttcctcagttctcattacctgatacatcatgtttgacttttaacaaaaaatcataaggaaggctatacaaaaagaaaaggaaaaacacagtcagaagagacaaagtaagcatctgaactagactttgacatgaaacaaagtttggaataatcaaatagataattaaaaataactatgattagttatgttaaggactgtaatagaaaaagtataagcatgcaagagcagatgaataatataagcagaataatgaaaactctaagaaagaatcagaagaaaatgacagaaatgaaaaacactgcaacagaaatgaagaatgcctttgataagctcattactaaactgaacataaacaaggaaataatcaataatttaaagatatatcaaaggagacattgcaaattgaaatactaagagaaaaaggactacaacctccattccaatatccaagaacaattacaaaaatataacatatgcataattgaagtactagaagaagaagaaaggagcagaggaagtgcagaggaagtacagtagttccctcttatccatggtggatacattcaaagacccccagtggatgcctgaaaatgcagatagtaccaaaccctacctatacattctatgttttttcctatatgtacatatctatgataaggtttaacttataaattaggcataaaaagagtttaacagtataataaaatagaaaaattataacaatactcagaaccaagcacaactgaaaacttgtgaaatgtttatttctgggcatggtggctcatgcctgtaatcccaacactttgcaaagccaaggcagatggattgcttgagctcaggagtttaagaccagtgtgggaagcatggtgaaacctcatctctacaaaaaatacaaaaaattatctaggtgtagtggcacatgcccatagttccagctactcggggtggtgggagggtgtgtggtggggggcagtgtggggtggaagggagctgaaatgggataatcgcttgagaccaggaagtcaaggctgtactgagccttgactgggccactgcactccagcctgggtgacagaatgagaccctgtctcaaaaaaaaaaaaaaaggaaaattattaaggataaagatgggcattaaataatgagaaaggggcaattatccaaaaaacataataattcttaagttatgcaggtaacacagcatctaaatacatgagacaaaaatttataaaactgcaagaagaaataatcaaatttaatattatttaataatatttttggagatctcaacatccctatattaataacagctaatttcaacaagcagaaatcaggaaaatgttcaactgaatagcactaacaatgaacaggatctaactgttcaagtagcagcagaataattaatcaagtaacagcagaatacatattcctctcaagtttatatgggactttatgcaaaatagaccacattctggggctgaaaaagatgccctcacaaatttaaaagaatagaaggtttactgcatgtgttcttagactataatgaaatttaactggaaatcagtgccagaaaaaaactcagaagtccccaaatagtttgagattaaataacatacttttatataacacataggtcaaagaagaagtctcaaaggaaatttaaaaatatttcgaactaaacaaaatgaaatgtacatcaaaatttatgggatgctcaggaaaaatagctagtggatgcttggcttcatacctaggtgatgggttgatctgtgcagcaaagcaccatggcacacgtttacctatgtaacaaacctgcacatcctgcacatgtaccctggaactgaaaataaaaattgattaaaaaagaaagagaaaggataattcctttcacccacagtttcctgtctcctaatagtccttctgttgtgtctttaaataaatgtgtctcaaatcttaagatattcataaaatctgggattgcagatgtattttgcattacaagtcctatttttattttttaatggaatgctgtaaaagcagttcttagaggcaaatttatagcagcaaatgcatatattagaaaagaagaaaaatctaaaatcactaatagaaatgtgccttaggaaagtaaagagaggagagcaatttaagcctcaagtaagcagaagaaaagacataaaactttgagcagaaatcaataaaattgaaaacatgaggtcaacagagaaagtcaataaacccaaaaggcaatgcctttaaaagatcaataaaatcgataaatccatagccaggctaaccaagtgaaaaagggagaagacacaaattataaatattgattccatagacattaaaaagataataaaagaacattacaaacaaatgtatactgacacttttggtaatttagatgaaatgaatcaattccttgaaagacataaaccatcaaaacttatggaaaagaaatacattacctaaatagatctatatttatttaaaaaatagataaatcattaataatctttcgaaaaagaaagcgtctcgcccagattctttcactaatgaattccaccaagcatttaaggaagaaataatgtcagttctctataatcacttttagaaaatagaagtaagaggtatacctcctaactcattcaaggaggcaggcattatcttaatatcaaaaccggggaaatacactacaagaaatgaaacctacagctcaatatattttatgaatatagatggaaaaattttcaataaaatattagctaattgaatccaaaaatatataaaaatagtaatacatcacagtaagtgcaatttattttaggcataccagactgatctgacatttattaactggctaaagaactattttatgattctgtcaattgatgcagagaaagcatttgacaaactccaacatctatttatgagaaaaagtcttagaaaactaggaataaaaaacatcctcaacttaatctggaacatctaaaaaatgggacttcacgctattttatggtgagaaatgatatgcttttcttctatattgggaacaagacaaggttctttttttgccactcttattcaccatcctactggatgtcctaattagtgcaacaaggcaagaaaaaatatatatacagattagaaagaaaaaaagaaaactacctctgttcaagatgacataattacttatttagtaaaactgaaagaattgactcctggaattaatatgtgattatagcaaggttgcaggatgcgaggttaatagaagtcaattgtgtttccatgtaccaccagtgaacaagtgaaaattgaagttgaaaacaaaatacaatttcattccttcccccagcaaaaatgaaatataaacaacaaaatatgtatacaacgtatattatgtatatggaaaattttaagtctgatgaaagaaataaaggaagatctaaataaatggagatgtaccactttcatggataagtagattcaataatgttgagatataaattcttcacgaattggtgtatacatttaatacaattctaataaattctcagcaagttattttgtggttattgacaaatttattctattttttagcttcatctcaaaagatgattttaaaatttatatggaaatgcaagagacccagaatagtctacataatactgaccaaaggactaagttggagaactgacactactcatagtactacaaagctacagtaattatgacagtgaggtatttgtacaagaatagacaaatggattaatagaaaagaggagagagcctcttttagaccctcaactgatccttgacagagcaaaataaattcaattgagaaaggacagtcttttcaacaaataatcatcaaaaattgtgcatatacatgcaaaaatgaatctagacatataccttatgcttttcacaaaaattaatttaaaatggaccttagttctaaatgtaaaacaaaaactagaaaacttctatgagatagcataggagaaaatctaggtgaccttgggtttgattaaatcatgatccatgaaagaaaaaaattaaaaaaaaattgaacttaattaaatttaaaaattgttatgtgaaatatattgttaagtaaatgagaagacaagccacagaatgagagaaaatattttaaaaacatatccagtaaaggagttaaatccaaatgacaccaaggtatttaaataattctatgtaatgatcaaaagatctgaacattcaactcaccaaataagatgtacagatggcatataagcatatgaaaagatgctcaacatcttatgttattagagaatagtaaattaaaacaacaatgagaaaccactacacctattagaatggctgaaatccaaattactgacaacaaccaatgctgttgagaatgcaatgcaagagaaactctagttcatccaattttcaaatgtgactgtaaaaggctgcagccactttagaagacattttgtctgtttcttacaaagctaagcatagccttgcattataatctgcagttgtgttcctctgtatatacccaattacactgaaacattatgtctacaaaaaaatcctgaaaacaaatgtttatagcaggtttattgttacttggtagttaccaaaaatggaaaacaatcaagatgtctttcaatagatgagtgaataaactataagatatccataaaatggaatattattcagcagtaaaaagaaatgagctttcaaatcatgaaaagacatggaggaaactcaaatgcatactgttacatgaaagcagccagtgtgaaaaggctacatgctatataatttcaattagatgacattttggaaagaagcaaaactgtaaagaaaaagatcagtttttgcctggcgttcagggaaagggaagaataagttaagcacaggagacttggggagctgtgaaatgattctgtgcaatattggtggaattttggcaacattatgcatttgccaaaggcaatagaagtttttgacacaaagagttaccataatgcaggcaaattttagaaaattatttagaaggtcagaggatcccagaagcaatgtggactttacagaagaaattcactgcattacaaagcatcagataaccttagtaaggtggagagagaaaatggtcttaacataaatatctttaaaaatgaatggaatctgtcagactataggcaagatgagctgcacaaaagcactgtactctagctgataaaattatttctcattggcttctggttaacagttctgatactgctatacatatatatgggaattgaataattaagcctataaatggcaaacattgggagttatatttctcacggtgtggaaatttacagatcaactaggggaacagtcttgaataatcaatgtgatgatcattacagttggagacatcaaggagaactaatgtttaacttaatatagatatgggtggttatatatagaaatattcaaagatgtttatgtaaatacacaaaagcacaaccatgacacatctaaaataaataacaccctggtaaccatgggcacacttagtactcaaatgctggagtgcaatggcgtgatcttggctcactgcaacctctgccccctgggtttaagcaattctccagcctcagccaccagagtagcagtgattacaggcactcaccaccacacctggctaatttttgtatttttagtagagacagggtttcaccatgttggccaggcttatctcgaactcctgaccttgtgatctgccctccttggcctcccaaggtgctgggattacaggcatgagctaccaggcctggcctgttgattttttcttttttttttttttattatactttaagttctgggatacatgtgcagaatgtgcaggtttggaacatagatatacacgtgccatagtggtttgctgcacccatcaatcggtcatctatattagatatttctcctaatgttatccctcccctagttccctacccaccaaagggcccagtgtgtgatgttcccctccctgtgtccatgtgttctcttttttcaactcccacttatgagtgagaacatgcagtgtttggttttctgttcctgtgttagcttgctgagaatgatggtttccagcttcatccatgtccctgcaaaggacatgagctcatccttttttatggctgcatagtattccatggtgtatatgtgccacattttctttatccagtctatcactgatgagcatttgggttgattccaagtctttgttgttgtgaacagtgttgcagtaaatgggtgtgtgtctttgtagaatgatttataatcctttgggtatatacccagtgatgggattgctggatcaaatggtatttctggttctagatccttgaggaattgccacactgtcttccacaatgggtgatctaatttacactcccaccaacagtgtaaaagccttcctatttgtccacatcctctccagcatctgttgtttcctgactttttaatgatcgccattttaactggcgtgagatggtatctcactgtggttttgatttgcatttctctaatgaccagtgatgatgagctttttttcatatgtttgttggccacataaatgtcttcttttgagaagtgtctgtttatatcctttgcccactttttgatggggttgtttgtttttttttctcgtaaatttgtttaggttctttgtagattctggatattagcccttcggcagatgagtagattgcaaaaaggttctcccattctgtaggttgtctgttcactctgatgatagtttcttttgctgtttagaaactctttagtttaattagatcccatttgtcaattttgacatttgttgccattgcttttggtgttttagtcatgaagtctttgcccatgcctatgtcctgaatggtatagcctaggttttcttctggggttttcatagttagaggttttatgtttaagtctttaatccatcttgagttcgtttttgtacaaggtctgaggaagggttcagtatcagttttctgcatatagctagccagttttcccaacaccatttattaaatagggaatacatcccccattgcttgtatttgtcgggttcgtcaaagatcagatggttgtagatgtgtggcattatttctgaggcctctgttctgtttcattggtctatatatctgttttggtaccagtaccatgctgttttggttactgtagcattgtagtagagtttgaagtcaggtagcgtaatacctccagctttgttctttttgcttagaattgtcttgactatgcgggctcttttttggttccatatgaaatttaaagtagttttttctagttctgtgaagaaagtcaatggttgcttgatggggatagcactgaatctataacttactttgggcagtatggccattttgatgatattgattcttcctatccgtgggcatgatatgtttttccatttgtttgtgtcgtctcttatttccttgagcagtggtttgtagttctccttgaagaggtccttcacataccatgtaagttttattcctgggtactttattctctttgtagcaattgtgaatggaagttcactcatgatttggctctctgtttgcctattattggtgtatacaaatgcttgtgatttttgcacactgcttttgtatcctgagattttgctgaagttgcttatcaacttgagattttgggccgaaatggtggggtattctaaatacacaatcatatcatctgcaagcagagacaatttgacttcctgtcttcctatttgaaaactctttatttcgttctcctgcctgatgaccctggctagaacttccaatatatggtgaataggagtggtgagagagggcatccttttcttgtgccagttttcaaagggaatgcttccagttcttgcccatttagtatgatatcggctgtgagtttcttgtaaataactattattattttgagatatgttccatcaatacctagtttactgacagtttttagcatgaagctgtgttgaattttatcaaaggcgttttctgcgtctattgagataatcatgtgatttttgtcatcagttttgtttatgtgatggattatgtttattgatttgcatatgttgaaccagccttgcatcccagggattaagctgacttgattgtggaggataaactttttgatgtgctgctggattcggtttgccagtattttattgaggatttttgcatcgatgttcatcagggatattggcctgaaattttccttttttgttgtgtctcttccaggttttggtatcagaatgatgctggcctcataaaatgagttagggaggagtccctctttttctattgtttggaatcatttcaggaggaatggtaccagctcctctttttacctctggtagaatttggctgtgaatccatctggtcctgggctttttttggctggtaggctattaattactgcctcaatttcagaacttgttattggtctattcaagaatttgacttcttcctagtttagtcttgggagggtgtatgtgttgaggaatttatccatttctgctagattttctagtttattttcatagaggtgtttatagtattctctgatggtagtttgtatttctgtgggatcagtagtcatcttccctttatcatttcttattgtgtctatttgattcttctctcttttcttctttattagtctggctaacagtctatctattttgttaatcttttcaaaaaaccagctcatggatgcatttacgttttcgaagggtttttcatgtccctgtcttcttcaattctgctctgatcttagttatttcttatcttctgctagcttttgaatttgtttgctcttgcttctctagttcttttaattgtgatgttaaggtgtcaattttagatctttcccactttctactgtgggcatttaatgctataaatttccctctaaaaactgctttagctatgtcccagagattctggtacattgtatctttgttctcattggtttcaaagaactcatttatttctgccttaattttgttttttacccagtagtcattcagaagaaggttgttcagtttccatgcagttgtgctgttttgagggagtttcttaatcatgagttctaatttgattgcactgtggtttgagagatggtttgttgtgatttctgctcttttggatttttctgaggagtgttttatttctaattgtgtggtcaattttataataagcacaatgtggtactgagaagaatgtatattctgctgattaggggtggagagttctatagatgtctattaggtctgcttggtccagagctgagttcaagtcctgaatatccttgttaattttctgtctcattgatctgtctaatattgacagtggggtgttaaagtctcccactattattgtgtgggagtccaagtctctctgtagatctctaagaacttgctttatgaatctggatgcccttgtattgggtgcatatatatttagaatagttagaccttcttgttgcattgatccctttaccattatgtaatgcccttctttgtctcttttgatctttgttggcttaaagtctgttttatctgagactaggattgcaacccctgggttttgtttgtttgtttgttttctttatatttgcttggtaaatcttccctcatccctttattttgagcctatgttgtgtctttggacgtgagatgagtctcctgaatacagcacactgatgaatcttgactctttatcccatttgccagtctgtgtcttttaactggggcatttagcccatttacatttaaggttaatattgttatgtgtgaatttgatcctgtcattatgatcctagctggttgttttgcctgttagttggtgcagtatcttcataatgtcgatggtctttacaatttgatatgtttttgcagtggctggtaccagtttttcctttccatatttagtgcgatgatcttacaatttggtatgtttttgcactggctgatactggtttttcctttccatatcttgtgcttctttcaatagctcttgtaaggcaggcctgctggtgacaaaatgtctcagcatttgcttctctgtgaaggattttatttttccttcgcttacgaagcttagttttgctggatatgaaattctgggttgaaaattcttttctttaagaatgttgaatattggccctcctctgttctggcttgtagggtttctgcagagagatccgctgttagtctgatgggcttccctttgtgggtaacctgacctttctccctggcttccgttaacattttttccttcatttcaaccttggtgaatctgatgattatgtgtcttggagttgctcttcttgaggagtgtctttgtagtgttctctgtatttcctgaatttgaatgttggcctgtcttgctacattggggaagttttccaggataatatcctgaaaagtgttttccaacttggttccattctccccgtcactttcaggtacaccaatccaatgtaggtttggtcttttcacatagtcccatatttcttggaggctttgctcagagaggaggaactcagagaggcagtctggctatagcagatttgctgagctgttgtgggctctgcccagttcaaaatttttggcagctcctttactcaagcctcagtaatgttggatgccccacccccaaccacgcttgagcatcccagggcaacttcagactgttgtgcctgcagtgagaatttcaagcccgtgaatcttagcttgctaggctccatgggggtgggatctgctgagctagaccacttggctccctggcttcatccccctttccaggcgagtgaaaagttctgtctcactggcattcctggcaccactggggtatgaaaaaaaaactcctgcagctagcttcctgtctgaccaaaccgttgcccagttttgtgcttgaaacccagggccctggtggcataggcacctgagagaatctcctggtctgtgagttgcaaagatcgtgggaaaagcatagtatctgggccagagtgcacagttcctcaaggcacattctgtcgtggcttcccttggctaggggagggtgttccctgaccccttgcacttcccaggtgaagtgacaccccaccctgctttggctcaccctccatgggctgcacccactgtctaaccagtcccgatgagatgagccagatacctcagttggaaatgcagaaatcacccgtcttctgcattgatctcaccgggagctgtagaccacagctattcctatttggcctttttttcttttgagacagggtttcactcttgtcacccaggctggagtgcaatggtgcaatcttggctcactgcaacctctgcctcccaggttcaagtgattctcctgcctaagcctcccaagtagctggcattataggcactcaccaccatacccagctaatttttgtatcttttgtagagatggggtttcaccatgttggctaggctggttttgaactcctaacctcaggtgacccacctgcctcggcctcccaaagtgttgggattacaggcatgagccactgcacctggccaaatgttgatttttttaataccattttataataaaaggaacaaggactccctggagaaacagctgatactaaggcaggagtagaaaatatacaagataatcctggaaaatcttgtagggccagaaagtaaacaagtgcattaaaaataagtcacattggtaataatatgtcaaaggaacaagggagtctactgaaagagctcccaaaggccaaagctggaagaagtagagcaagaaagtaaactagctttgaattataacccaaaatataaagtaaatatccataagtctctactgatataaagcacaattgaataataactgggagagggagggagaataaataagttctacgtaaaagaatttcttataaattttgtagatatgactttctaaacaaattctcattcttaagaattcatagtgacttccttccaaaaattacaatatggaaaactgataaaaaatgagtaactctacagtggaggaatctgacacatactacatcagccaggttattgaggtcaacatcaacagccataaatcatgtgaacagtatgtacacttggtatgatgtaacgaatagcacttcacttctgtggtctttctccccaggctcattatctcagtataatcatgaaaaaaaaaaaaaaaaaaaaacccagcaaagtccaatagaggaatattctacaaaatacctcactatactctttaaaagagttaaggtcattaaaatggagtcggagacaatgtcctcaacatgaggagtctaaagagacaggccaactaaatttagtatggtatactggatgaattcctggaacagaaaaaaggttattaggtaacaactcaggaaatctgaataaagaaagaaatcagttaataacaatgtatcagtattgctttattaattatgacaaaagtaccatactagtgaaagatgaataatcggagtaactgtgtgcaaagactgggtagagggg

SEQ ID NO: 491 - DNA, 16589 bp, Homo Sapiens
gcgtccggacgcgcgacagcttccacccgcctcaggcagtatcagccgcgccgcagtcggaggaaatagacgcggggcctgaggctcctggacttgaggtattaggctggtgcagaagtaattgcggcggccgggtgcgggggctcaggcctgcaatcccagcactttgggaggccgaggcgggcggatcacctgagtcaggaagagttcaagaccatcctggccgacatggtgaaaccccatctctactgaaaatacaaaaattagccgggcgtggtggcgcgtgcctgtaaccccagctgctctggaggctgaggcagaataatctattgaacccaggaggccgaggttgcagtgagccgagatcgcgccactgcactccagcctggcgacagagcgagactgcgtctcaaaaaaagaaaaaaaaaaaaaaaggaaggaaggaaagagacttaggctgcattccccgcttttaaaaatatatatttatttttatttttttaaacgaagtctcgctctgtcactcaggctggagtgcagaggcgcgatctcggctcactgcaacctccacctcccaggttcaagcaattctgcctcagcctcccaagcagcagggattacaggcgcgccccaccacgaccggctaattttttttgtatttttattagagacggggtttcaccatattggccaggctggtctccaactcctgacctcaggtgatcgcccacctcggtctcccgaagtgctgggatgacaggcgtgagccatcgtactctgccgcattccctgcttataagcaccagtccctggtcctgttttagaaggctgttgtatcttggcctctgctagcttcaaaaactaaggcccgatgaggtagctcgtgcctgtaatccctgtttacaggagaggctgaaagggcagggattcctttttttttttttcccacttgagacagggtcttgctctgtttctcaggctggagtgcagtggcacactcaccgctcacttcagcctcgacctcttggactcaagcagtcctcccacctcagcctctggagtacctggaactacaggcgaatgccaccgcgcgtggctaatctttttaatttttgtagagataggatctggctatgctgcccaggctactattgaactcttgggctcaagtgattatcccacctcagccttccgaagtgctgggactacaggcatgagccatcacagccagctgggatattgtttttcgaatcgctgtcatgttctgtactatatgcagttcctgaaagaatggaggcaagaaggagtcagctaaccactgtgaactgtcttagtgccaaggacccacccttctctccttggggtcctgctgacccatcagaatagggctgagccaggatggggcttgtggagatgatgtgtatgagtgtgcatgcacttgtgtgtgcatgcctaacatccaaaactagatataaattctttaaacttttcattagttggccaggcacggtgactcgcacctgtgatcccagcactttgggaggccgaggcgggcggatcatgaggttaggagatcaagaccatcctggctaacattgtgaaacccggtctctactaaaaatacaaaaattagctgggtgtggtggcatgtgcctgtaatcccagctacttgggaggctgaggcaggagaattgcttgaaccagggagtcggagcttgcagtgagccgagatcacaccactgcactccagcatgagactctgtatcaaaaaaaaaaaaaaaaaaaaaaattctgcgtgagttgtgtggaggtgtcagtacctttccccagcaagagaagcttctccatatcaggcatatcctagccatgaccctgaaactaaccagccaagagggaaatgtgagacaagcccaggcaagcttcctggatgttgtatgcaggaataggatgtgctctctggacttggagacttcctgcctgctcaagaggctgtgcctccttgtgtctcccacaggcctctgtgtccaccttccccaccctggcaggcctgctaggccagcagccctggagaggaaagggtgaggtggtgtttgaagggacctgcctcctacgagctctgctggttggactgtcggatgacagaaccgtgcctctgagcctgggagagggaggcacccctgtgttctggaagcccccagtgcttcagcaactcctcactgaggcagaatagtggaggaatcaagctgggatccaggggactgaggaggggatagagcagcacctgggccccacattcccttccaacagagcctggggtgctgtgtttccgggagggttttttttgttttttgttttcccgagacagaatctcgctctgacccccagcctggagtgcagtggcatgatctcggctcactgcaacctccgcctctcgggttcaagcaattctcctgcctcagcctcccgagtagctgggattacaggtgcacaccaccacacctggctaatttttgtattttttatagagacggggtttcaccatgttggctaggctggtcgtgaacttctgacctcatgatctgcctgcctcagactcctaaagtgctgggattacaggtgtgagccactgcacccggcctctttttttttttttttttttttttttgtgagacagagtctctgtcccccaggctggagttcagtggtgcaatctcggctcactgcaacctctgtctcctggtttcaagcaattctcctgcttcagcctctgaatagctgggattaccgacatgcaccaccacgcccatataatttttgtattttttgtagagctgaagtttcactatgttggccaggctggtctcaaactcctgacttctggtgatccacccaccgtggcctcccaaagtgctgggattgcaggtgtgagccaccgtgcccggccagagcctggggttctcaaactcgtttctggggaccgcccaccacttttcttgccagtgcccatcttccaggttcctcccaggctgcttctgcctgccttgtcctcttcctgcctgtcacaccacactctcccaccagcatcttcctcattccgctctgactctcctcaccacccagcccgacctgactgaaaaccccgcagtgggagagcaggaggcccctgcttctaggtgccgtgtgagaagcagctgtgaggtcgggttgggtggctcacgcctgtaatcccagcactttgggaggccgaggtgggcgggtcacaaggtcaggagttcaagaccagcctggccaatatggtgaaaacccatctctactaaaagtacaaaaaaaatagccaggtgtggtggcgggtgcctgtaatcccagccactcaggaggctgaagcaggagaatcgcttgaacttgggaggcagagggtgcagtgagccgagatcatgccactgcactccagcctgggcaacagagcgagactccataaaaaagaaaaagagatttaattggctcacagttctgcaggggttacaggaagcatagcacccacatcactcagcttctggggaggcctcagagagcttttactcatggcagcaggtgaagagggagcaggcgagtcacatagtgagagcaggagcaggcgagagagaggccagaggtgccacacgcttctaaatgaccagatctcgcgggaacccactatcacaaagacagctctgagccgtgagggatccgcctcatgatccacacaccttctgccaggccccacctctagcactggggatcacaattcaacatgagatttgggtgaggacagatatccaaactgtgtggacagaggtgatgctcctctacttgttgaactcttgaacactagtgaagagaatgctggtgtattagtctgccaggctgctgttgcagaataccatgaactgggcacttaagcaactgaaatagattttctcacagtgctggaggctagaagtccaagatccaggtgccagcaggtttggtatctcctgaggcctcgcccctgcgcttgcagacagccgccttctcactgggtccttacagggcctttttctttgagccagtgtagagagctctgttctttcttcctctttttataagcacaccagtcctatttaattagggtcccaccctatggcctcatttaatcatttgttgttgtgttttttttttttgagacgaggtctcactgtgttgcccaggttagtctcaaacccctggtcacaagtgatcttcccacattggcctcccaaagtgctcagattacaggtgtgagccattgcgcccagtctcatttaaccttaattactaatttaaaggtgccatcatggccaggcgcggtggctcacacctgtaatcccagcacttttggaggccaaggtgggcggatcacttgcagccaggagttcgagaccagcctggccaacatggtgaaacccccgtctctactaaaaatacaaaaattagctgggtgtggtggcacatgcctgtaatcccagctactcaggaggctgaggcaggagaatcacttgaacctgggaggtggaggttgcagtgagccgagatcacgccactgcactccagcctgggtgacagagcgagactgtctcaaaaaaaaaaaaaaaaagtgccaccaccaaagactgtcatattgggggttagggcttcaacctacagatttggaggaaacactatttagtccacaataactggagaagttgaatttagaagatgggggttggggccaggcacagtgactcatgcctgtaatccagcgctttgggagaccaaggtgggaggatcacttgaggtcaggagttcaagaccagactgggcaatatagcgagactccctctctacagaaaatttaaaaattagccaggtgtagtggtgtgtgcctgtagtcccagctactcggaggctaaggcaggaggatcgcttgagtgcatgggttgtaggttacagtaagctatgattgtgccactgtactccagacaggggaacagagcaagaccctgtctcagcaacaacaaaacaacagggagatagggggtcaggtgctgacttcaccttaacttcactgtgtgcttttacagcaagcctgttaccctctgtgagcctcaacttctctatgtgtaacaaatggccaactttatgggattgtcaagaagctgaaatgagaccctggctggaggatattttatggactataaattcctaaacaattataataacttagttatttatcctatccatggatcacctggaagtttacaatgtgatttaaaatgcattctatcattccaccgacctgcagtgaattttgttgtcattattactccagggatacctaaaggggaagtttgtttataattcgtacccactccttgtagaaaggattcaagacagccgatgatgaaaacacccatgcttgcaagtgaaggttctgcctgtcacttctcgcagaggctgcagaaaaggcccaggaggctgttgatgacatgaacgaccaccaggagaagctggagcaggctgatgcacagaagggcggagaagagggacacgtgccagacaacagctgcagagggctccaggcagacggagttccagagcgaacggtcatacagataattcctatcccaaaaaataaggagaccaggggtcaggcgataagtaaggaaagccaaacaggcaaccccagtagaaaactggggtctcccctgaccgggtcatgggactgggctcatgagggtgaccgttactgctccatttgcaattttctgagtatcagaggagcaagatgctaggatgtgtgacccaaaggagcttgtagttcgtctgtgtgtctttttgtctctctctctctctctgtctgaaaagaccaagcccaagcctccacccatttacctactatgcaggtctttgaatgggtaaccatatttccaagcttgtgtctgattgaaggatgaaacatcaaacatgcaaaaaggaccatctttcagagcaactccagaagtgacaaagcaaatcagggctccaagtaaagccaggccacctgacaacagagcaccattcagcctctgagctaaagaagaagctaccacaggcccaccactgactcttctaaggaaaagctgcattttcaaaagttccaggttcccaactctgattcttctctatttcaaatcaaggataaaaaaaaggaagggagggaaggaaggaaagaaagaagcaggaaagaagggaaggagagaagtgggagggagggaaagaagggagagaaacagcgagagagaagctgcagccaagctctgaaatgactccacttctgtcgctgtgtttctccagctgagagctttcttggccatcagtctgtgctcccactgccctcccagaaaataactgggtttccttccttgacaggtttctagcctgcttctacattggcttctttctcgttccttccttccttcccttccttccttctttctctctctctctttctttttgagacagagtctcactctgtcgcccaggctggagtgcagtggcacgatctcagctcactgcaacctctgcctctgagttcaagcgattctcctgcctcagcctcccaagtagctgggactacaagcatgcgccaccacacccagctaatttttgtatttttagtagaaatggggtttcactgtgttggtcatgccggtctcaatctcctgaccttgtgatccacctgcttcagcctcccaaagtgctgggattacaggcatgagccaccgtgcccggcccatattggattctttcttagggttctagatttttttctccctcccccaaaaatgcctattttaaaaatgtgaataacacctacatagcgtttttctgcagagtcatggagtcattctcccactgaggtcaagctggtttggagttggggagggatcagacaaaggtgcatagtaagttttgactctgagttaaaggagtcaagatgaatcagtaagcctagggcagtggttcccaaaatggggtccctgcccagccgcatcacatcacctgagaacctgttagaaatgcaaaacttccccgccatcctgaatcagaaactctggggagggagcccagcaatccgtgttccggcaaaagccctccaggtgattctcatgcacattcaagtgtcagaactacgtgccacggggaaaaccagaatgagaacagacagtgaatgaaatgtgcaagtgtttatttatttatctatgtacttatttatttatttattttgaaacggagtctcgctctgtcgcccaggctggagtgcagtggcgccatctcggctcactgcaagctccgcctcccgggttcaagagattttcctgcctcagcctcctgagttgctgggattacaggcgcccaccaccacgcccagctaatttttgtatttttggtagagacggggtttcaccatgttggccaggctggtctcaaactcctgacctcaggtgatccgcccatcttggcctcccaaagtgctgggattacaggcgtgagccaccgcgcctggcctatatttgattttttaacatgtaactgagtcagtgggcttcccaacatgtgggctgcagatatcagagcaggctgtggagttaccataaggccacagattcatgtctgagaacgagtgtgtgtgtgtgtgtgtgtgtgtgtttgttacacacacatatactgagatctttcaagtttatacagttgctgctgtaattaataaggtagaaatttattctgggcctcagtttatctgtaaaatggaggggttagattagaatctagtgattagatgatctctggaaaactttcctgttctaagaaaatattagttaaaataactaggaaaatttccatcaatgacacatgattacagtgtcataactcatgtccatattgtccaacaccctaagagagtaacagtttctcacactggtacagacgtctgggtcctcacactggtacagacgtctgggcttcactaagcactactcccttgacttgatcagctcccattttacagatgaaagcctgaaactggaaagatgaagcaacttgcccaagaacttagcgttactgagggtcacagtgaggacctgacttcaggccccaagaccaaaattgcctctttaccgccctgcctctagagtaatagaggtggagacattctgggtgttagaagagtggaatctggtgcttacgcttcgacagagcccactcttactgaagcagccgtatctccagcccatcaaggagatgaggatagctgcagtgagtacctgcaggagagagaagaatgttgagatggggaaatcgactttgccggctgtttctaggtgctgcccacagctgttagagtggctggcagctcacatgaacgcagtcctgttgactctgactctggggacccacatttgtatgacgagcctgatctaacgctgtggatgttaactttcacacccgacctgcctggtcccaagctaggcttcctgtctcttagagcttctacagacccaagatcagcttgttagaataaacttttctgcaaggaatcaaaacactcttcccatgccaccttcctgctccccgccggggtctctttgagagttcacgttcagggaaccccggacacttaccatgaggcctcctccccagagcccagttcccagcatggcatgcctgccaaggaggcccctcaacaggtaggtgacatcccagttaggaaggaggagtgccacgttggccccagcagcaaacagggctgcagtcccaaggctcagtcccaggatacgggagcaagtccgtgagcttgcctgcgtgcagggagaggacaccatcctggaacagatagaaagggagtcgcagcagctctgctgtggggggatggggaagggaactccagcagcatatcatgggtgagggaaacagactacagaaaccgccaccttccagggtcagaccaatgagagccaagcaacctgcttaaaaactctgctccttaggaatcttccccagtgactaggatttaattgtttccttttctgctaacccctgttcacacatacatagtttgcattccatcatattttgtttatgcctctattacagccagtgattatttctgacaaaaagaaatgtttaaaggtgtcttcatgatgtccattgtctccacttctattcaacgttgtactggtcctggccagtgcaatacgaaaataaaaggaagcaaaagccacacagataggaaagaaagaagtaatattgtcggccaggcatggtggctcaggcctgtaatcccagcactttgggaggctgaggcaggcggatcacgaggtcaggagttcaagaccagcctggccaacatggtgaaaccccgtctctactaaaaatacaaaaattagctgggcacggtggtgggtgcctgtaatcccagctactggggagactgaggcaggagaattgcttgaacccgggaggcagaggttgcagtgagctgagatcatgccactgcactccagcctgggtgacacagcaagactccatcttaaaaaaaaaaaaaagtaacattgttattattcacagataatgtgatcacattatgtagaaaatcctaaagtttattagaattaacaggtgagtttagcaacgtcatagaataaaagattaatatacaaaaattatattgtatttctatatacaagcaatgacaaattgaggattgaaattaaaatatatcatttacaatagcataaaaatataatacatatggatgaatttaacaaaatatttgcaagacctatatagtaagaattgcaaagcattgctgagaaaattaatggagacctaaataaatggagacatataccatgttcctgaaccagaagactcaaaatagttaacatgttctccctaaattgatgcaaagatttaaagcaatatcagtcaaaatcctaggagagttttgttatagaaattgacaaactgaatctaaatttatatggaaatgcaaagcaattgtgaagattagccaaagcaattctgaaaaacaaacaaagctggagaacttacgccatgtgatttcaagacttacaaagctacagtaattgaagacactgaagccacgcgtaaggaaacacatatggactactggaacaggctggagctcagaaacagacccggtccaggaaaaatgattttttttttttcttgagacggagtctcgctctgttgctcaggctggagtgcagtggcgcgatctcagctcactgcaacctctgcctcccaggttcaagcgattctcctgcctcagcctcccaagtagctgggattacaggtgcccgccaccatgcccggtaattttttgtatttttagtagagacggggtttcaccgtgttagccaggacggtcttgatctcctgacctcgtgatccgcctgtctcgggctcccaaagtgctgggattacaggcatgagccaccgcgcccggccaataaatgattttttaagaagatgacaattcagcgggaaaaagtctcttccacaaatggtgccggaacaatgcacatgcaaaacaaaactgccttcactattacttcacaacatattcaaaaattcacttgaaatggagcatgggtctaaaagctttataaaatttctagaataaaacaaaggagaaaaacactgggaccttgggttagataaaggtttcttactaaaatgcaaaaagtacaatccacaaaacatgattaatcagactgcttaaaaatttaaatgtcagctgggtgcttgcctataatcccagctactcggaggttgaggcaggaaaatcgcttgaacccaggaggcagaggctgcagtgagctgagatcgcgccactgcacttcagcctgggcgacaagagcaagcgactccatctaaaaaaaaaaaatcatgctaaaagaaataagccagacactaaaggacaaatattgtatgattccacttatatgaaatattcaaaataacaactttatagagaaagaaagtagactggaggttatcagggactgtggggagggaggagagaatggggagttattgtttaatggttacagaggttttcaggttttgttttgtgttgttttgttttttttttttgagacagagtcttgctctgtcagccaggctggagtgcagtggcgcaatctcagctcactgcaacctctgcctcctgggctcaagcaattctcctgcctcagcctcccaagtagctgggactacaggcatgtgccaccacgcctggctaatttttgtatttttagtagagacagggtttcactatgttggccaggctggtcttgaactcctgacctcaggtgatctgcccgcctcggcctcccaccgcgcgcggtggttttggggtttttttagagatgcagtctcactatgttaccccagctggtcttcaactcctggactcaaatgatcctccagcccgtgcctccagagtagctatgaccagatctgggccactgcccacggtttaagggttacagactttctgtttggggtgaagaaaagttttggaaatagataatggtaatggttgcacatcattgcaaatgtaattaatgtcactgaattatacactttaaaatggttaaaatgacaaatctgatgttactttaccacaataaaaaatcaattaaaaaatttgtgattactcaaatccttatcagtaatcaataggtgaatcaagacaaattgtgttatccatacaaatgagttctattaggtaataaaatgcgtaaatttctgctacatataacatggatgaatctcaaaagcattgtgttaagtggaagaagccagaaacaaaagactactcacatgtttctatatatacgaaattctagaaaaggcaaaacttttaacggagagcagatgagcggttgccatgggctgagaatgggaaagaggattagtatggggcatgggaagctttctgaaggggtggaagcattctgtgtctagattctggtggtgaatacataactgtacatattgacaaaactcattaaactttgcacttaaaataggtgaattttattgaattttaactatatatcaataaagctaattacaattaaaatgtcatatctagataaattataaaatgcctcttccactccttatgttcctctcttttatattttcattgatatgtgaacttcttgttttttagaaaaatatgaattaaggccgggcacggtgacttacacctgtaatcccagcactttgggaggccaaggcaggtggatcgcctgatgtcaggagtttgagataagcctggtcaacatggtgaaaccgtgtctctattaaaaaatacaaaaaaattgctggacgtggtggcaggcacctgtaatcccagctactcgggtggctgaggcagcagaatcgcttgagcccaggaggcagaagttgcagtgagcagagatcgtgccattgcactccagcccaggaaacaagagtgaagctctatctaaaaaaaaaatatatatatatacatatatatatgaattaaaataggactagtaatatttgggcagactcatgtcaatgtggatctgaaaaaagtcagcgtcatgacatccccaggaagtggcctgttcccactgtgcagttcagttacacgtctgtctccccttaaggctcgctatttatttatttatttaatttatttatttattttttattgaaaaaaatttatttttagccgggtgcagtggctcacgcctgtaatcccagcactttgggaggccaaagccggcagatcacctgaggtcaggagttcaagaccagcctggccatcatgacgaaaccccatctctactaaaaatacaaaactagccgggcgtggtggcgcatgcctgtaatcccagctactcggaaggctgaggcaggagaatcacttgaacccgggaggtggaggttgcagtgagccgagattacgccactgcactccagcctggacaacaagagtgaaactccgtctcagaagaaaaaaaaatgtaatagaggtgaggtctccttatgtggcccaggctggtctcaaactccttggctcaagggccctcccacttcagacacctaaagtgctaggatgacaggcgtgagccactgcacttggccacttgaggctcttgacacgcctataacacactgctttgcacctaatcagaaaatatgtgtatagaggccaggcacggtggctcacgcctgtaaccccagcactttgggaggctgaggtgggtggatcacgaggtcaggagtttccgaccaacctggccaacatggtgaaaccccgtctctactaaaaatacaaaaaaattagctgggcatggtggcgggtgcctgtggtcccagctactcgggaggctgaggcagtagaatggcgtgaacctggggggctgagatcacgccagtgcactccagcctgggcaagagagtgagattcggtctcaaaaaaaaaaaattaactgcgtggtggtgtgcgcctgtaatccaagctactcaggagcttgaggcaggagaatcgcttgagcccgagaggcagaggtggcagtgagcccagatcacgccactgcactccagcctgggtgacagagcaaaagagagagagagagaggagggagagagggagggagggagggaggaaggaagaaaggaaaggaaggaaggaaagaggaaggggaaggggaagggaagaaaaaaaatatatatatatataaaagatatggatcagaggctctatatatatgcacacacacatatatatcatatacatataatgtataatgtgcgtatatatgtgtgtacgtacacacacacacacacacaatagtcccccatatctgcaggggatatgttccaagagctccagcggatacctgaaaccacagatcataccaaactctgtatattcagatgcttctccacttatgatggggtcgaactcctataaacccgttgtaagtcaaaatatcctaagttcaaaaggcatttaatgctggcaacacagtagactgtccctgactcacaatggttcaacttacaattttttttttttttttttttttgagacagggtcttgctctgtcacccaggctggagtgcagtagcacaatcattgttcactgcagccctgatctgggctcaagtgatcctcccacctcagtctctcggatagctgagaccgcaggcatgcgccaccatacctggctaatgttttagttctatagagacagggtctcactatgttgcccaagctgatctcaaactcctggcctcaagtgatcctctcacctccacctcccaaaatgttgggattacaggcgtaagccaccacgcccagtcccaatttacttttgactttgtgatggtgcaaaagcaatgagtattcagtagaaaccgtaatcccatcataaagggtaaggagttcactgatgatggagttaggtccctagaaacctgtcgtaaagttggaaacttagaagtcaaaccactataagtagaggactgtctgtactatgctttttcctatacatacatatctgtaataaagtttaatttataaatcaggcatagtaagaagttcgcaacaataataataaaatagaacagttataacaacatactgtaatgaaagttatgtgaatgtggtctttctcattgaaaatattttatgtaagttttttgaactgcagttgaccacagatagctaaaactttggaaagcaaagcttcagttaaggggggattactttacatcacacataaataatgaaatatttcacagcatgaagaattaaacattgggggagggccagggctgaaaaactatctgtaggtaccgcgctcactacctgagtgacgggaatcactcataccctaacctcaacatcacacaatagacacggaacaagcctgtatatgtatccccggatctaaaataaaagttgaaattatatttttaaaatttgcattaaaggccaggtgcagtagttcacgcctataatcccagcactgtgggaggccgaggcgggtggatcacttgaggtcaggagttcaagacagcctggccaacctggcgaaacctcatctctactaaaaatacaaaacttagctgggaatggtggtgtgcgcctgtaatcccagctactcaggaggctgaggcagaagaatcacttgaacctgggaggcagaggttgcagtgagccaagatcgcaccactgcactccagcctggaccacagatcgagactccgtctcaaaaaaaaaaaattgcattaaaaaagaattaaacataatgtgtaaaatatatttgtaacttgtgtgagataattaacacccatgtaaacacaaccaatatcaaacatacgtcattacccatcacatcactgacactcaggtgtgccctctccaatcctgccttctttctggattccttcctaggaactactatcctatatttcatcttcaacatatccttttaaaaacagttttacgacttaggaactcagaattgttttagaaacttgtttagtcgggtgttttccatttttcaagactgtagcttttcttttctttttctttttttttttgagatggagtcttgctctgtctcccaggctggagctcagaaacagacccggtccaggataaataatttttttttttcttgagacagagtctcactctgtcgctcaggctggagtgcagtggcgcgatctcagctcactgcaacctccgcctccccggttcaagcgattgttctgcctcagactccccagtagctgggactacagctgcacaccaccatgcccggctaatttttgtatttttagtaaagacagggtttcaccatgttggccaggctggtcttgaactcctggtctcaagtgatcctcctgcctcggtttcccaaagtgctggaattacaggtgtgagccaccaaacccggccagactgtagcttatggtaaagaagacaaggggaggggtgccctgggagggtgggggtaggagagaggaagggtgccctgagaaggtgggggttaggagaagggaggggtgcactgggagggtgggtgtaggagagggaagggtgccctgagaaggtgggggttaggagaagggaggggtgcactgggagggtgggtgtaggagagggaagggtgccctgagaaggtgggggttaggagaagggaggggtgcactgggagggtgggtgtaggagagggaagggatgccctgagaaggtgggggttaggagaagggaggggtgcactgggagggtgggggtaggagagggaagggatgccctgagaaggtgggggttggagaggggaggggtgctctgggagggtgggggtaggagaggggagaggtgccctgggagggtggccagaggacaggggaggagtgcacagggagagtgggggtaggagaggggagggatgcacggggagggtggaggtagcagaggg

SEQ ID NO: 492 - DNA, 4063 bp, Homo Sapiens
ctttccctgcctcgcgacacccagaccgagacctcgggaatgctccggccccctgccgccgtctcccggcccggttctctttcactaaaaataggcgattctggcagcgcccctcctatggggccttgggggcaattggggttttgtcttagagcccgtgtggacccggatggcgacggcagcccgaggagagggagggctgactgtatggttggctttccgacgaccagaccctgcaggattcggcctttccctttggagttttcctccatccccctccgtccctcccaggggatgcccgcaggccacagtggtcactgaaggtcaaccctgagccgaaggagaagtggcctcgaccctggggaccccttcaggtgcagcttgagggggaacggccgcctttcccgttgggcacccagctgtggctgtgccctgtcctcgcccagctcccggcataggcatgcgctctgggccggggccggggccccccgcctccccgggaggaatcgctgggttgactctgggtcagcaaagggagcccggccctttctagcggggggacgtcctgcagccgctggaggaggctgagtcacgcttttcccaccagaagtctacctgtgcctgcgcccgccggacctgccggcctcttccttctcatccagggggcctcttctccagcctcacggaggtgggaagcttgctggaggcccctacctgccttttggggaagaccccgaggctggcccacgccctgctggcaggacccttcctgactgggtccaccgttcttctgggtctcaccacttctcccagcccctgggctgcttcctctctcccgtgtctgggaccccagaggcaccacttccattccatacaaggagtccacaggacctgtacagttggaaccagcccctcaggcttccctgccagagcccttttctccaggagcagaggcatccatcccctcctgccagcattccagaccctggagggcttgcgcggtggcaggttttcccttgaatgctgaggcgaggctgagggaaaggtgcgtggccaggaccagagggcctgctgactgccagctaaaactctgtgcaggaggctttcccacgtactttacgtactttaagatgatgagcaaaatccttactgtctccctgcaaaatccgtgtggcttcctctggcgtgtcccatactcttgtgtttgtggccagactgggcctccgctcttcctccaaactcattagttctctcccacacagaacacacattgttctgcctggaaggcccatcacatccctccccaaccctctcggttcaatctaagctttcttggggtctcagcttaggttgcctgttcagggaagcctctgggaccctcaggtctaggtcacatttgtttcatgctttcacagcggtggtgtagtgtatactggttcttcttatccctcaggtgtctcctcacaaggactgctctgtttctgctaagtgttgcattctcaccacccagtggaggctttggcctgtggaagattctaattttggtggccagcctcatgggttgaaaagtaaaggtcaagtagttaaaggaagggcgttccaggcagagggatcagcgtaggtgcagaggtaaggtagggatagctttgagggctccttaggagggagtgaaacccctgagggtcaaggagccctagtttggaaggccttgctactaagggatctggattttgtcctgaagcctagagtagtttctttaagagtctgatctcggccaggcctagagtagtttctttaagagtctgatctcggccaggcctagagtagtttctttaagagtctgatctcggccaggcgcagtggctcacgcctgtaatcccagtacttcggaaggccaaggcaggcagatcacgaggtcaggagttccagaccatcctggctaacacggtgaaacccgtctctactaaaaatacaaaaaattagctgggcctggtggcacgtgcctgtagtcccagctactcgggaggctgaggcaggagaattgcttgaaccggggaggtggaggttgtagtgagcagagatcatgccactgcactgcagcctgggtgataagagtgagactccatctcaacaacaacaaaaaaagtctgatctcagcactgtcctgcctagactgcttctttttttaggacaagtttttattgctacctgctaaaaacgcacttattgtcacggtgcaggctaggttggaggagtaaaactagagacaagaagagttaagaagccactgcagtattcaagacaaatgagtcaagccaaaggctgagatgctgtacaggaaggtctctagggggaccctaaatttagctgggggtggtggtgcaagattcctacgaagtggcactaaaggagggactgagtacttactaaagaccttatgactaagaggtctctctcatccctacactacttccttcactccagtgtctagaattggcctctgtatataggagctctttggttgagcatggttcacacctgtaatcccagcagtttgggaggctgaggtgggaggatcacttgaactcaggtgttcaagaccaacacagtgagaccccatcgctataaaatttttaaaaattttagccaggcatggtggtgcacgcttgtagtcccagctacttaggaggctgatgcaggaggatcgcttgagcccagaagttggaggccgcagtgagctatgatcacatcactacactccagcctgggtgacagggtaagatcctgtctcaaaaagaaaaaaaaaaaattaagcacaaaaagtttggagaccaggaaacaggagtacaagtataggtgctgtcccactcttagtgaggtcggctgtgaaattaaatcagttcctggaacaaatcttacaaagagatcagagatcacttgcagtttttttttttttttttttttgagacagcgtctcactctgtcacccaggctggagtgcagtggtgccattttggctcacagcacccttcgcctcctgggttcagacaattctcccacctcagtctcccgagtagctgggactacatgcctggctaatttttgtcttttttggtagagacagggtgtcaccatgttggccagcctggtcattaactttttaaaaaaatgtttattttcctgataaagattcagcataaattttaggcagaagtctgacgtctagcagtcccccagaaagcattctgttgtctgttggggcttccttgggagatggactgtgggctaggcctgggtgctttggcagatacagagtcagaggctgtggaaaggggatggtccagacaggactataataaatgcatgagccaccgtgcctggccctcagggtacttttaataaagtgctagctaggcaagcctattcttcctctcaagagtaggtgttccacttttgaacacctatgccaggcaccggctatagtgcctacaagaggatgatatgtggacatgaccactttccctgactacatcagtggttctcaactggggatgattttgcaatgtctgcttatgggacatttggtaatgtctagagacatttgtggttgtcacaactagtggaggggtactacctgcatgtagtgggtagagtccagagatgctactaagtatcctataatgcataggacagctgcccacaacaaagaattatctcactcaaaatgtcaatagggtcgaggttgagaaatcctggtctaggctgggtgtggtggctcatgactgtaatcccagcattttgggaggccaaggcaggaggatcacttgagcccaccaggagttcaagaccagcctgggcaatgtagggagatctccacaaaaaataaaaataaattagctgcactatagtccttgttacacagaaggctgacgtgggagcatcacttgaacgtaggaagtgagtgagctgtgattgcactactgcactccagtctgggcaacagagtgagaccctggctcaaacaaaacaaaaacaaaagcattgaaagaaagaaagaggccgg

SEQ ID NO: 493 - DNA, 1012 bp, Homo Sapiens
cttttgatgggcgagtttagttcatttacattcaatatattattgataagtaaggacttactcctaccattttgttatttgttttctaattatttagtaatcttctcttccttccttctttccttcctgtcttcctctagtgaaggtgattttctctggtggtatgatttagtttttttgctttatattttttgtgtatccattctgtttactgctttgaggttaccatgaggcttgcaaatactatcctataacctattcttttaacctgataatgacactatttgcataaacaaacaagcaaaaataaaactaataaaaactctataccttaactttgtccccctgctttttagctttttgttatgtataattatatcttattatattatgtcttagataattgctgtagttattatttttgattggttcattgtttagtctacttagaataagagtagtttacacaccatggttacagtgttataatattctgtgtttttctgtgtacctaccattaccagtgagttttgtacctccaggtgattatttattgctcattaatgtccttttatttctgacctgtcctacaagaaataactttaacatttgtaggacaagtctagtattaatgaaatccctcagcttttgtttatctgggaaagtatttcgccttcatgtttgcagggtatttttactggacatactattctaggatgaattttttttccttcagctctttaaatatgtcatgtcactctctcctggcctgtaaggtttcccctgaaaagtctgctgccagacgtattggacctccattgtatgttatttgtttcttttctcttgctgtttttagaatcttttctttatccttgacctttgagaatttgattattaaattccttaaggtagtcttttttggggttaaatctgcttggtgttctataaccttcttgtactttgatatttatatctttctgtaggtttgggaagttctctgttattatccctt

SEQ ID NO: 494 - DNA, 2270 bp, Homo Sapiens
gtgcccaacttctgcgctgccctcaaccgcatgcggaagagcacacagtccgacgtggccttcttcaggttcccgcggtacccggccagatgccagaagtgggtagagaattgtaggagagcagatttagaaggtaaaacacatgatcagctaaataaacgttatcgattatgtgccaaacattttgcgacctctatgatttgtagaactagtccttataggacagttcttcgagataatgcaatatcaacaatatttgatcttaccagtcatttgaacaacccacgtagtagacacagaaaacaaataaaaaactgagtgaagacgaaatcaggacactgaaacagaaaaaaaaattgatgaaacttctgagcaggaacaaaaacagaaagaaaccaacaatagcaatgctcagaatcccagtgaagaagagggtgaagggcaagatgaggacattttgcctctaacccttgaagagaaggaaaacaaggaatacctaaaatctctatttgaaatcttgattctgatgggaaggcaaaacatacctctggatggacatgaagctgatgaaatcccagaaggtctctactccagataactttcaagcactgctggagtgcggaataaattctggtgaagaggttctgagaaagcggtttgagacaacagcagttaaaatgttgttttgttcaaaaacacagcagaggcagttctagagatctgtgagaactgtattggagaagaaactctcagggaagtgagagactcacacttcttttccattgtcattgacgacatagtggacatcagaggaagagcacctacctgtgttggtgaggtttgttgatgaatctcataacctatgagaggaatttgtaggcttcctgccttatgaagctgaagcagaaattatggctgtgaaatttcacactatgataactgagaagtggggattaaatatggagtattgtcgtgaccaggcttacattgtgtctagtggattttcttccaaaatgaaaattgttgcttccagacttttaaagaaatatccccaagctatccacacaatctactcttcctgtgccttaaatatgtggttggcaaaatcagtacctgttatgggagtatctgttgcattaggaacaattgaggaagtgtgttcttttttccatggatcaccacaactgcttttagaacttgacaatgtaatttctggttgttttttttttcagaatagtaaagaaaggggtaaagaactgaaggaaatctgccattctcagtggacaggcaggcctaatgcttttgaaattttagtggaactcctgcaagcacttgttttatgtttagatggtagaaatagtgacacaaatattaatggaataactgtataactggccaagcatttgtactctgcagtgcagtaacagattttgatttcattgttgctattgttgttcttaaaagtgtcctatcttttacaagagcctttcggaaaaacctccaggcgcaaacctctgatgtcttctttgcagccggtggcttgactgcagtattgcattcactcaacgaagtgatggaaaatattgaagtttatcatgaattttggtttgaggaagccacaaatttggcaaccaaacttgatattcaaatgaaactccctaggacattccgcagagctcaccagggtaacttggaatctcagctaacctctgagagttactataaagaaatcctaagtgtcccaacagtggagcacattattcaggaacttaaagacatattctcagaacagcacctcaaagctcttaaatgcttatctctggtaccctcagtcatgggacaactcaaagtcaatacgttggaggaacaccatgctgacctgtatagtagtgacttacccaatcccaacatggtctcagccgagcttcattgttggagaatcaaatggaaacacaggaggaaaaatatacagcttccatccaccatctatgaagccctccacatgcctgacatttttttcctaatgtgtatgcattgctgaaggtcctgtgatgaaggttgagaatgagcagtatgaaaacggatgaaagcgtcttaaggcctatttggggaacactttgacagaccaaaggtcgagtaacttggctttgcttaacataaattttgatataaaaaatgacctggatttaatggtggacacatacgttaaactctatacaagtaagtcagagcttcccacagataattcagaaactgtggaaaatacgtaa

SEQ ID NO: 495 - DNA, 5914 bp, Homo Sapiens
ctccagcctgggcaacaagagcaaaactccgtctcaaaaaaagaaaaaacgcagagccctcatgaatgggattagtgtccttatcaaagagactccagaaattccttacctcttccgccatgtgaggacacaatgagaagatggctgtctataaaccaggaatctggctctcactagacaccaaatcacaccttgatcttggacttcccagcctccagaatggtaagaaatagagctatattgtttattaactattcagtctatggtgttttgttacagcagcccaaacaacaagggcccacgtggcttagtattttgcttgcatatactttgagggaattattttgtaaaataaatgggccgggcatggtggctcacacctgtaatccaagcactttgggaggtcaaggtgggcagatcacttaaagtcaggagttaagaccagcctggccaacatggtgaaaccccacctctattaaaaatataaaaattagccgggcatggtggcaggcgcctgtaatccaagctactggggaggctgaggcaggagaatctcttgaacctgggaggcagaggtggcagtgagccaagattgcgccatcgcattccagcctgggcaacaagagcgaaactctgtctgaaaataaaataaaaactaggccaggcatggtggctcatgcttataattccagcactttgggaggctgaggtgggtggatcacctgcggtcagcagttccagaccagcctggctaacatggcaaaaccccatctctactaaaaatacaaaaattagctgggcatagtggtgcatgcctgtaatgctagctactcgggagactgaggcacaagaatctcttgaacctgggaggcagaggttgcagtgaaccaagatcgtgccactgcactccagcctagatgacagagactctgtctccaaaaaacaaaacatattaaaactagctgggcaagttaatcctgtaatcccagctattcaggaggctgagacaggagaatcatttgaacccgggaggcggaggttgcagttagccgaggttgcagtgagccgagattgcaccactgcactccaagctgagtgacagagcgagactctgtctcaaaaataaataaatgacagtgtgtagactatggtgcgatggtcacaaacccagtcttttcaggagcaggaaacttaaggcaggtggaatgaactggaaccgtttttgttgttgttctagctgattgttgctagatcttaagaattttttcaggagaagcaagaaaattaggtatttatatacatgtctgtgggccacatttaaacacagccctttaattctcactgtctggactagcaaaataaagatgggttttggcattagaccgaagtgtgaattttggcaccaggatgtcctagttgtgtgatgttgggtaggtaacttcattctcaaagtgtcagtgtcctctcctttgaaatgagggcagctctgcccacttggcaatggggttgtgataggtataggagggctgtctaccacacatgcagtgactagcacttaggaaactccagctgaggtcgtctgtctgccagcttctaagtgactccttccaatttgctagtcccattttccagagcttttgctaataaacatgactgtcctcaggagaagcctattgggcagatgtttgtagagtgtcatgctgcacaccaggtgtctgcacatgtgtttgcaccgctccatcccacatctggaagcaacagctccaggtgaaggagcaaagctgtcgatcacagaggtgtatgtggatcctccgaccaaactgtggctttgcttcctcagtgtcagccaccaggattggttttaggtgtgttaggccattcttgcattgctataaataaatagctgagactgggtaatttataagaaaagacatttggctaggcaaggtggctcacgcctgtaatcccagcactttgagagcccaaggccggtggattacttgaggtcagaagttcgagaccagcctgaccaacatggtgaaaccccgtctctactaaaaatacaaaaaaaaattagccaggcgtggtggtgggcacctgtaatcccagctactcaggaggctgaggcaggagaatcacttgaacctgggaggtggaggttgcagtgagcagagatcttgccactgcacttcagcctgggtgacagagtgagactctgtctcaaaaaaaaaaaaaaaaaaaagaaaagaaaagacgtttaattggctcacagttctgcaggctgtacaggaaacagtgctagcatctgcttctggggaggcctcaggaagctttactcatgatggaaggtgaagcgggagcaggcgtctcacatggtgaaagcaggagcaagagagagagtggaggcaggtgccacacaccttgaaatgaccagatattgtgaaaactatcacgaagacagtaccaatcatgagggatctgccccatgatccaaacacctcccacgaggcctcacctccagcatttaggattataattcaacttgagatttgggcagggacaaacatccaaactataagaaataaggatgaaaaagggaatcagttgtacattttaaggctttccttttttctgtttaaggaagaatgagtcttttgagaataagaacatttatattgcctccttccaaattctccttgaaagagatcctctggccacctttgggattgcacaagcctgtctcatgccctctttggggccagtgtgtttcagctgctgctgcaaaagtaagatgtgtcagtgcttgttaagtaggctctcagttccaggtaagagcagtcatacacctagatgccatcaatgtgccaggcattttgctctgcagccggggtacaaggataagggagagtcctcatgttgctcctgagtaaaggaggatggcaagtgacttcatagtgaaagagtgcagtgtgaggatgactgtgacaaaggtctaatacccaacctgggagaagggtgcagggttcttagtaaacaactggtgaaggggaaatattagtggctagcaagcaaaaagaattgggggtacatttggcaacagtttagagggaagggtatttacagtggagagacatcataatcaaaggctagaggtgagagcacagcatggctgggctagtggagtatgggggacgctggggatgaggctggaggtcacagcagggaggactctgagtgccttgcaaaggagaatagttttatcctgaccgctctgcacttcagtgattttgagagatgggtgctaagatgaagttacattttacaaagataactctttgctgtagcaaggagaacagactgcaggagcagggatggtggtgaggtgaccatagttgggggattactgtagtaacttcaagagaaatgatgaggcccaggcaatagaggcttgaggaaccacagtgaggggctgacttcagaaacaggcagagggcgaggtgagtgcagggagtggaagagggagtggttgaagatgactcccaggttgtcgtgttggtgacagaatggaacgctgtgccatggatcgtgaaatgggacccaggaagagaagctggtgttggggggccaggagatgtaggcaggggatgtgcccagtttcagaggttaagattttggcaggataagggcccatagtgggcatttacacggactggtttagtgctcaggagagagatgacattgagataaaaattttggagtcatcattaaagacatgggttagatgaaatcatctacagagaatgtgcagatagagaagaggagacactggtgaggagggaaccctggggaaatggagacttcaggagcgggtagaaaagcatagaaacgagagtgactgagagaccagaggaaaatcaggagaaagccaattaggagcttccaggagagagtaacgtaaagtataggggaggatcccttgaggccaggagtttgagaccaacctggcaacatagtgacaccccattgctacaaaaaaaaaaaatgaaaattagctgggtgtggtggcaagtatccacgggcgggggacaaggttattttggtaagcctagcaaactctggggcagagaagtggaggggtagaagcttgcctatcttgagctgaggagggaggaggaagtgagaaatggaggcagccagatgctctcctttgagaaggacctaattcctattctcattggtgtaacttaaaaacaaaacaaaagtgattaaatatttcaaacataaaagtaaaatgaagctgggcatggtgatatgtgcctgtaatccaagttacaggaagccaaggtgcaagggtcgtttgagcccaggaattcaagaccagcctgggcaacccagtgagaccctgtgtctttaaaaaaaaagaaaagaaaagaaaagaaacactcatgacccaattaacagtaaacattttgctgtctttgcgtcaggtttttactttttggacaaaacatgactagtgtttgaaaccccacatttaccctttcctgatcccatttccctccctccatgaggtaaccaccatcctgaatttgatgtttcattcccttgcgtggtttatacttttattacataagtttatatctataagcaataaatataattgttttgcaaatttttaaagtttattatagagatggatcatgctgaatatactgcctcttgcttttttcattatcagtactgttttggagatttatttatgttggcacatgtggctctagttatttcaactgctatatagtattcctttgtataaatataccacattatctctccattctcctgtggtggacatttagttggtttccaattttttgttcaaacaaggttgcaatgatcattcttctacatgtctcttgtacacatgtagggatatttctggaatatataactaaaagtggaacttgctaagccatggattacaggcaccttcaacttcactagatacagtgtcaaactttttcccaaagtgatggtaccagtttacatacaaaatagccatttatgacaattctagatgcttcacgtcctcaccaatatttcatttgttgaaaatttaatttcggccaatttgatgcagttatattctatagtttcctttagatttttacaaggccaccaataatgtagtgtagataccacacaactctaggaggtgctgttcacattttagtctttgtgaacggtgcattctagagttggtacaataacagtggtcttgagtgatgttaagaattttgtttattgacctgttaggttttctcttttgtaggaattacacaaaataattgattatatacatatgaaaaaatagattcctatattaattatacataaaataaattcaaggtaaattaaagagctaaatgccaggccgggcatggtagcttaagcctggccagcactttgtggggctgaggcaggaggattgcttaaacccacgaatttgaggctgcagtgagctatgaacatgccactgcactccagcctgggcagcagagcgagaccccatctctttaaaaaaataaaaactttacgatttttctatgttaataaatgagatctataatttcttttttctcttacactgtctttttgtttctgtgggttttgttttgctttggacacagggtttcactctgtcacccaggctggagtaaagtggcacgatcatcactcactgcaagcttaaactcctgggctcaattgatcctcccaccttggcctcccaaagtgttgggatgggattacaggcatgagccactgtgcatggcctcatgttgtctttataaagttttaacactgagatttggtaaaattgacaaatccactgttattgactgatattccaaat

SEQ ID NO: 496 - DNA, 4068 bp, Homo Sapiens
agctgccagtctcattgttgctcttttgtagataatgtgtcttttttcttctggctggtttttccatcttctctgtctttggttcagcagttttattgtgagttgcataattgtggttttctctatacttatcctgcttgagggtttgctgagcttcttaaccagtgggttaaatgtattttatctgctttagaaaattcccaaccattatccctttgaatattgcttctgctctatttctttctccttgccctctgaaacttcagttttacatggtagacctttcatacttgtcctgtatgtctcttacatttgtttcttattttttctctttctttttttcttccatgcttcactttgtatatttttcattgatatgtttccagttcacaagtcttgtattcaatagtgtccaacctattgttaaactcatatattgagtttttaaatttaattttgaaataatttactttgaaatatttttatcagaaaagttgcaagaacagtagaatgaactcccacattctcttcatccagattcctcagttaatagtttcatattttctccatctctttttgtaaagatgatagatagatagatagatagatagatagatagatagatagatagatgtgtattttcaaggatatgataccttttttgaatattttgagagcaagttaagcaagttgaaacctttatgtcctatcatctgtaaatattcctattactacttctcccaaagacactctcctacagagtaattgccaagcctttcaaatcagaaaatggacagcgataaataccagcattcaaaccacagttcattattatccaacgttccaggcttatcttgaaatttctctacctccatccttgaatcatccacttttacaaggagtccttgttgtttgttatggaaattggaacctacatacttgttattaattgctactggggtgtcattgcacctaggtcctctccatggtcagaattttgaaatatatgtatgtattcatggatatgtacacagacatattcacttgcattgataattttttttgtttctttcctcccttccctttcactctttccttctttccttccttttgctctttccttccttccttcttccttcttaccataacaatagcaatgagttatttttttcgcttccccttttcatatttgtaaatttgttttcccacagagagaaatccagcttccattagcttcaatatagatactttcttgatcaatcctcctttacataattaatttcctaaaaatgctaggtactgccatggccaactcatcactcctgatttcatctccaggcaagttgtcacttttgaactcttctccccaccaaaccctggtctgtttgatatgccactgcctccatgcccctgtctccaccttctggctgttagacacattgttaactgtgcaccccaacttactcttaccttcacctccctggtgcttcttctgctgagcatacaactgccaccatatgtaccccctatacatgcttccttggacaccaggcactctgctgcctccacatggctttcccattatgacttcttttgcccctatgcacatcactatctgtatgcccgccaccctactttcttggctgttggacacactgctatctctactgatcctttccactgcagttttctccatatattgatttcttaactgacgatagtatattttttcaaatttagaatgcctaaagaaatcttttttataggttagttttactgaaaattgtccatttcctcatcaattttgcactttattttcttaaacatattcataaaaattatttgtaaattctcatttgctgattacaatatcttgatcatctataattgtgtttctattgtgtgtgtttttttctcttgattattgggcaaatgaacttgatcttccacatctagtaatttaaaaaatgttagacattatgtataataaaaccataaagggtccagatgatattgccttccaccgaaagtgttccctttttcttctgttgggcaggtagaatagcctttgatcacctcaatcgagtcagagattattctgaatcagaagctggtttcagttttgctaagtgtacctccgattcacttctgttcttagggtgtagccctccagggctttcaattgagagcctggtggatctctgtcttccagccctaaaagataacagcaagttttcagtttagctctttaacctcctgctccataaagcttcaaaattcagcaactcgcttgaaaggaagactggcaatgtgtttgggacactctatagtcttctgtgaagaatagagatctcttttgttgttttctttgagggacagcctgtagctttgctcagaatctgtaaatattcccatcaaaaaaccacctgtaaattaccaatgtcaattccctactccctcttatgtttttatattttacttcttttgttttggggctcctcttttccatagcagttcgttgattctctagcaccatgacactgtgggggacttcactttgcatttcagaagtttggggactactgttttagcctccatacagtctcagaattcagttaatgtcttaatcatgtatttagggtttctcacaccttcagtgagtcaccaaagccccatataactgctaaaagttttgttagtttaacttttttccgcagctgcatctttctgcctggactcagcctcatccttagcctgcactccaacctggcaattttgccaagaggaaaaaattgtggacatcatcaagtcattactggaaagttctcacttctctggaattttaatccatttagttcttgtttttaaaaccctctgattcctttataaatatataatttacctaggtttttctcgttgttagtccaagtgttggcctgccacactgactatatcctttctggaaatagaaattctctctgttgcccttaatgaatttaaaaaaatattttataccactttattgtttattcttagtccaaaacatgttttctaccattgttggaagcagaagttctggaattggtttctatatattttcagatcccgtaaaaatgaattaaggtgaatttgattaatgtaaattagatttatgtgaataaaggataaatagttaagttcatcattgttgcaattagagaagtggtacaggttccccattctagcactgagtatttgaaatcatacctctgctaagatcctgcaaatatttcagctcactccctgtgtgcattgacacatattatcagccctctcttttcttatattaaacagggccacaagatgcaacacacgctttctcattgcttcacaattttttcttctttcactttcattcagtcacttcatatcagctatgtgttaagcataggagatttgtcagtgaaaaaagtatcaaactcctcatctttatggagattacattgtagtaggaagagacaaacaataaacaagagcaataacacgcttcatagtagacatataattccaagcatgtgtacctattagtcttaaatacaggagagacactcaagacagaaataaaatgtaataaaatccaaaccctacagtctgcaggggacttggacaagaccccaagattcttcaaggataggatagggggggacaacctgtaacaattaatgaaggtgtagtattcagctcttctatttctactgataaagttctttctccatacattataaaacttagattgttattgttttaaattgggaaggttgaaaatgttgtgatgtacaggaataaggaaaatgaattcttacggtctgtatatcttggtttaaaaaatgtatgccctggagttaagtttcaggtgccattttcccctctcctatgagtctatcccatacaaatgttgtaacatctccccagtttctactggttagatcagtatttgtttttgtttccagaattttctgatttcttgctgatccatgaaataggaacttcttcttaccttctgaaaatattaaaaggagacttacaccc

SEQ ID NO: 497 - DNA, 3620 bp, Homo Sapiens
ttaacatgaggatgtctgggaggactgattcctaagagatccagtggctctgattaggttttttcttcagaggaacataattagggtctaatctcacccaacaggtcagcccctcctgcgccttgagcccctgccacacagattcaggtagccacgacatgagtggaccaaactagttcagggagtaattgccctggaaagctaggtccacaagcagaacccattgggtctgacacactccttgaattggttaaattcaaaggaaaactctgaattctggggaacaaggcctctaagttggcttaagcctctgcagctgcagaacatgaagttctacccttagaaactcccgctgggtatatgcaaaatacttatggtaaatcattcaaatatttagtcaagtggatgttgagttctaattagggataagaagtcaggctggtgggagcaggagaaagcaagaacaaaaaccaaataagccataaatctgcctttttttcgtggtccaggacacacagccctactgcgcaaataagtcacaatcttcctgcacccagctgtcaccagacatcttaactaatcaaaaagaacacgtaagttagctcactgcaaccttgctgttatcagtattgcacacagccctcttcagcacacagcacaaagaccatcctataaaatcctcaggatgcctttgtctccttgcagttagctcctcttttgctgacttgcctgttgcttttttgaaacacatttccctactttgtctaataaatctgccttttaaaaatctgcaaccattttggtaagtattttttaccacccatgcaacatcagccccagatagtcaatacctgtgacagtggcccattataaccacagaggttctaacttaacagtggcctagatggggatcatctgagatgcccaaattagtgtacctgggaactaggatggaaaatgcatgcacaaaaactcaacagccagaatgggagagctactttcagtggtacctagagaggtagcaaaaagggggaagactgcctcacctccttacaggaggccaacaaacaacttagagatactaactgataactctctagtgctttatctctcttaaagaaatcttcagaattgcttacatcccccttggttcttcccccacctccaggtacatccccagcttactccgacctctctgaacttcctggaccagatctgtttcctctgcctgcatgctctagcctaccatcttcctctccttgtctgctactcactcaacagaaggcaacagggtggtctacttctacaactccgtctcctgatgatttcacaacagtctccctggcagcctttcatctggaagaagtggaaaagggggaacctgtaggaacatctctcatgatcacaccatatagggaatgaccagtaacaggtagggaaaccccagtgatggtctttcaaacctggtcaaaggctgagctaggaggcaaagttaaaaaatttcctgactcccataaagatttgcccaagaatttgagctcattgtcaggtcactcgtcatatggcccgtgtcattcagacccttaccagctgttccacatgttggttttggatgctaaagctaaggaatggctggaaaaagcacagtggtcagaccatttagcagagtcaatttccaaaggtccaataggatgacaacaagtccccaaaagttcagaagacaggctcaaagatgccaaggcatgagccactgctctgttaattataattccttcagcattccaaaggtttgtggattggaataaaatccagcaatgccaccagaacccaaaggaattagtttgagattatttttcatgttttgataaaactttgagacaatattatgggatgtcagctgattgccttgagaacaataaaaatggcgcttattaaatgcaaactttcaaaacagaccagatgatgatttagccactcttgtaaaacaccacataacaaattgggccatggtcagaactaaggaactagttaacttagctgaccaattatcctgtgctatgataaaggaaaaaaaaaacaaaagactgccagagttatgcatttatagttaaagcaattaacttctcaaacctgttagcctcagaataatgaaaagccctctcggtctgaggactcttccctcagcctgttactattgtaaaagaccaagacaccttaaacaggactgctttaggtggaagtggaagccacagcaggaggatacaactcaggaagactaggggtgctctgaggaagttaaagggtttcacctctcccagtattctaccttgacaaattgggaaagattaatataatcataacgtgagctctccattgccttacttgacataggagcaactatatctgtcataaatcccacctgctttagaaaccatgttcctcagagtaataaaaggactagcatgatgggtgtgtctaagaaaactatctcatgctttaaatccaaacctataccttaccgttttgtcaggtttagcaccccctcaatcaagggccctaaatacaacagtcagtcagtcccatgtgttcctaatatgctgggtaagtgtctgttttgtggaccagccttctctttgttcagtttccagagtcaagactaggagaaaatactagaaaagtcttttttggtcaaggcatcaagtcacattccctactcatcgtctaaaggtgagcctgccgcattatcacggatgctgtgatgggcaggtgtgttcgtagtcctctgaaaatagtggatttcttacgtgtgaggttccttggctgtgaccaacacatggcaggtgcaccttccatctggctgctctgttttgtgcagtgagacttggaaggagtgtgggggaccaaggagaatgaacatgcacatgaagcccatcctggctgctgtgccacgagaaagctgacctcaggtgatccacctgccttggcctcccgaagtgttgggattacaggtgtgagccacgatgccaggcctgtagagctcctctttagaaactgtgtgcagagggcagggcacagtggctcatgcctgttatcccagcactttgcaaggctgagatgagaggactgcttgaggccagcctgggcaacatagagagaccttaaaaatacaaaaaattagccaggcgtggtggcgggtgcctgtagtcccagctactctggaggctgaggcaggagaatggtgtgaacccgggaggcagagcttgtgagtagctgggattacaggcatgtgccaccacacctggctaatttttgtatttttagtcgagatggggttttaccatgttggccagactggtctcgaactcctgacctcaggtgatctgccaacctcagcctcccaaagtgctgggattacaggcatgagccaccacgcctggctctctttttttgagacaaggtttcactttgttgccaaggctggagtgcaatggagcaatctcggctcactgtaacctctgcctcctgggttcaagtgattctcctgccttagcctcctgagtagctgagacgagaggtgcacaccaccaagctcggctaattttgtatttttagtagagaca

SEQ ID NO: 498 - DNA, 6205 bp, Homo Sapiens
attcttccaaacagaactgatctggcatgaaggagagagaagaggtgtatgagtgaaattcatctgacaagaaaaagaaagcaagagtgccactgggttagggtctccccgaccgagctggtctcggcaagtggcgtccatcgtgggggctcgaatccaagtcaaaggattgctggagcgacggttggaatggaaaactagctggaggacacccgagtactcttaaagcaatccccgtggtgagtaagaaggggagctcagaagcgtcagggtaatgatgggacaggtatggtgtctggtttgtatcaccttggaactttttcacactgataatgaggaggaacaagagtatagcgaagtaacaaaagaggttacagagcatgtttatttaccagctaaagctaaagcggcaaaggaaggagaggttcatccctacccttctgcaccccctccttattattttgaagacaaagaccctccagatctttcttttctggaggacactgggcaaaaagtagttgccccagtgactgttcaagcagccccttgagcgacggctcttagttctattcaggcaggaattcagcaagctagacgagagggtgatttagaggcttggcagttccctgttagaatacaccccccagatcaacagggaaatattatagctacatttgagccttttccttttaaattcgggaaagcacattcagttgattatatcaaggcctgtgatggtatcggaggtaatctgcataaagctactttgttggcacaggcactggcaggactgagagtggataaaggaaatactccatttcctggagcttgttttaactgtgggaagcatggtcatactaaaaaagaatgtagaaaaaatcagcgagtcaggctgccagataggggaaaaaagaaaactgttgagcctgaaatatgtccaaaatgtaaaaaaggaaaacattgggctagtcagtgtcactctaagtttgataaagaaagaaacccaatttcaggaaatgccatgaggggcccatcccgggccctgttctaaaccagggcatttccagctcaggccattccctcacccctgtacaatgtctgttccctgccacagctagtagtgccacagtagatttatgctgcacaaaagctgtgagccttctgcctggggaacccctgcaaaaggtcccaacaggagtctgtggacccttgccagcagggacaataggattacttttaggaaggtctagtgtaagtttaaaaggagtacaaatacatacaggagtcatttatttagattacaatggggaaactcaaattgttgtgtctacttctgttccctggaaagcagagccaggagagtgcatagcacagctcctgattgtgccacatgtgggaatgggaaaaagtgaaattaaacaaacaggaggatttggaagcacaaataaacaaggcaaagcagcttattgggtaaatcaaattactgataaacgtcctacctgtgaaataactattcagggaaagaaatttaaaggtttgatagatacaggagtggacatttcaatcatttctctacagcactggccatccacatggccaattcaacctgctcaatttaacatagttggagttggtaaagctactgaagtatatcaaagtagttatattttgcattgtgaggggcctgatggacaacctgggactattcaaccaattataacttctgtacctataaatttatggggaagagacttattacaacaatggggaacacaagttctaattccagaacaattatatagccctcaaagtcaacatacaatgcatgaaatggggtatgtccctggtatgggactagaaaaaaatttgcaaggtttgaaaaaactgcttcaagcagaaaaacaaagttcccgccaaagattaggaaataatttttgatggtggccattgttaagcctccagaacctatacctttaaaatggttaacagataagccaatttggatagaacaatggccgctaagtaaagagaaactggaggctttagagaaattagttattgaacaattagaaaatgggcacatagctccaacattttccccttggaattctccagttttcataattaagaaaaaatcaggtaaatggagaatgttaactgacttaagagccatcagttcagttatacaaactatgggagcattacagccaggattgccttctcctgctataattccaaaaaattggactttaatagtcatagatttaaaagactgtttctttactatccctttagctgagcaagactgtgaatggtttgcatttacaattcctgcagtaaacatcctgcagcctgctaagcattatcactggaaagtgttgccacagggcatgtcaaacagcccaacaatttgccagacatatgtggggcaagcaactgaacctattcttaaaaaattttcatagtgttacattattcactatatggatgatatactttgtgctgccccaactccagaaatattactccaatgttatgatcacttgcaaaattcgatttctcatgctggtttaattatagctcctgacaaaattcacactactactgcttactcctacttggggaccttagtgaatgacactaccattgtgctacagaaagtaaccatacatagggatcaactaaaaacattaaatgactttcaaaaattactaggggatgttaattggatacgacctgctctaggcattcctacctatgccatgagcaatctgttttctatccttagaggaaatcctagtctcactaaccctcagcaattaacaaaggaggctgaggcagagttacaactgattgagaagcaagtccataaagctcagataaatagaatagatccagagaagactctagatttgctaatttttcaactcagcattcacctactgctgttattgtccaagaacaagacttagtagagtggctttttcttccacatactaattcacagactctaactccttatttagatcaaatcaccatgatagggattggagaactcgaattgttaaattacatggatatgatcctggaaaaattattgtccctctcacgaaggcacaaatacagcaagcttttataaatagtcttacttggcgaacccatttagctgactttgtgggtattctcaataatcattttcctaaaattaagctgtttcagtttttgaaattaactaattggattctccctaaaacaactaaatttaaaccaatttaaggtgctgagaatgtttttacaaatgggtctagtaatggtaaagcttcttattctggctcaaaaagtaaagttttccagacgtcctatacttcagctcaaaaagcggatcttgtagctgtaattgaggtattgactgcttttgatatgcctattaatgtgatttctgattcttcatacatggttcactccacacagctaattgaaaattctcagttatgatttcatacagatgaacaactgatgactttatttacccagttgcaaacagcagttaggagtagaatgcacctttttacatcactcacattggagctcgtatacctgttccaggacctttgactgaagggaatcaaatggctgattgcctagttgctaatgcaatatctaatgctagacactttcacaatttaacccatgttaatgcctctggtctcaaacgcagatacagcattacctggaaagaagctaaagctattatccagcaatgcccaacttgccaaatggtacattcctcatcttttacaggaggagttaatcctcgaggactggaacctaactctctttggcaaatggatgtcacacatgttccctcatttgggagactagcttatgtacatgtatgtgtggacaccttttctcactttgtctgggctacataccaatcaggagagtcttctgcctgtgttaaacgtcatcttttgcagtgttttgcggtgatgggcattccagcttctagtaaaacagataatgccccaggctatactggccaagctctagctacatttttctctatgtggaatagtaaacacattactggtatcccatacaattctcaagaacaagccatagtggaaagaatgaatctctccctaaaacagcagttgcaaaagcagaaaggaagagacagagaatatggaaccccacagatgcaactgaacctagcattattaactttaaattttttgagcctgcccaaaggccagatgttttcagcagctgaacagcatctacagaaaccagctgcaaagacaaaaacagaacaactgatttggtggagagatctgataacaaaaagttgggaaataggtaaaataataacttggggtagaggttatgcttatatttctccaggacaaaatcaacagccaatttggataccatcaagacacctgaaaccttatcatgagccagatgccgaggaagagactccaggaagatcccaaggacaccccagttgcagccatgtcgagactgatgctgaggaggaccccaactgtcacgagcaacacccgtcgaacacagccacccacctgtggacagatcaagaagctgtcacagatggcggaagaaaacctgaggaaagcgggacaaacagtcacaatgaataatttaatcgtagctatgatagcggttatcaccactgccatgagtaatccttcaataaggactggcaataatgcctggatgcaatcactctatgacacagttacacatactttctgatctcagtatttaccataataaatctgctcctatcattgaggcataccaccctcaaaaaactatttgtaaacaggattggacccagttagaaaaaatgaatgtacttgtttaggaagattgctttgcagaacaggcagaggtgctgcacaatgattcctatggaatcattattaattggtcccctaaggggatgtttagcttgatttgcacctctcagtctgcatgccatggtcacactatgttcagatgatctgaacaaaatggtcagatggtagaaatgataagaagtacggcaaaagttcctgttatctgtaaccatgatggtatagtggcacctcaacctcaaatgatatggcccgctctaggagctaaacataaggatttgtggaaactattaaatgcaaactttgggaaagaataaaaaagcatctagaaggacactctacaaacttgtttttggatatagcaaaattaaagaacaaatgtttaaagcatcccagggacacctgaccttaatgccaagaactggagtgcttaaaggagctgcagacaaattagcagctagtaacccattaaaatggataaaaacacttggaagctctgtgatttcaatgatgactatgcttttaatatgtgttgtttttgtatagtctgcagatgcagatcccgactcctgcgagaagtagctcaccatgacaaagctgcccttgcttttatcgatttgcacatcagagaagggggacatgttgggagcaagccccccaaaatctggccataaactggccccaagactggccataaacaaaatctctgcagcactgtaacatgttcgtaatggccctaacacccacgtgcaaagttgtgggtttacgggaatgagggcaagaacacctggcccgcccaaggcagaaaactgcttaaaggcattcttaagccacaaacaatagttgcagtgatctgtgccttaaaggcatgttcctgctgcagttaactagcccaacctattcctttaattcggcccatcccttcgtttcccataagggatacttttagttaatttaatatctatagaaacaatgctaatgactggtttgctgttaataaacacgtgggtaaatctctgttcagggcttacggctctgaaggctgtgagacccctgatttcccacttcacacctctatattttggtgtgtgtgtctgtaattcctctagcaccactgggttaggatctccccagccgagctggtctcagcaaatataggcctggggaaattgggcttgaactagtgaaagcacttgcccaatataaagctggcagattgtagggctatttagcattctctaaggaagtactttccattgataatgagctgcaggctcctgattattgatagatggtacagtaaaagcaaattttttgcaacc

SEQ ID NO: 499 - DNA, 2379 bp, Homo Sapiens
caaccagtcaatgcgggagccttctcagctggacccagggccacacctctgcccaccggctcacacctgggccatgcaaggcggggtggatgcacctgcctggcccttgagcgcgtgggggagccaccgttgcccacttgggaggctcagttctgaggtcgggattccaggcactcccttctcccccattccgaaacctcctgactggaagaactctctcggcacagccttttctttcagggtcccaaagtgcctgtgagcaggcagctcctgatctcctctgtgacacccacagactcaaagacacccatatgctcactcatgcagacaggcgctctcgcctgtggctctgaggctgagccggctttgccttggtgaaggacaaggccctggcgacccagattctctcgtgggtggctggggacagaagggcggtggcgcgctgggctggctggagggctcaggctccggcgcgagtcctgcaaggatgctgcctccaagtgtgcttgtgggtggcggatcccagggcctgccgggagagtgtccactcctcaggaggcctggctgctcagcggcgcccctctgtggcgagactcgcccaggcccatgtccggcccatctcgccccagccaggctcccctgggcagcctcaggacagagaaccctgaattcagagggaggctggaggtgtggggcctctaggcacttgcagggtggagctaccccacacccagggctcaccctcagacctacccaggcgtctccagcctcacgctcccagaggtaaggaaggggcttcaggaaggtgggggctacctccccgcccagtaccgtcaggctctgaattcgtacctgggaactctgccttggctgacttggggaccccttcactgctcagccttcccctctcttcctgccgggcggtccacctaagctccctgactcttcccacgcggccctgggtcccctccccacaggctgttccctgcacccgcgggtgggactggacctttccctgcacgtccagtctgtttcccgcggtcttcctccgtctgaccctggcagcccgctcctctggccccgggctgtgtggggaccgctttcccccaggcccgtcgtcagtgtcctgagctccgccgactcccgcccattggcgtcgcaggcctggtgacaagctgtcgctggcatctagggctcctgggactcaggcacatggagctccctcggggccaaatttgtgtcacgcgcagggacaccggaggcgcgtgcacagtccgtgtaacggctttgcttggcgcgtctccgtttctcttctgaggggctgagagtcgcggagtttcctagttggaggctgtggcggacgcgatttgcttcctcatatagggttccggaggcggcgaaaagtccagcgggtctccgaagccggtagacggagccatgaagaagacgtcgggcttcaggagggggaagggcgggctgccctggggctcggtcagcagccccgggaaggtgggcgcgggcgccgggagtgagagtgcggaccacgcctcctcccagcccaggcgccacgacccggacaaggggttcgacaggctccgcagagctgccggccgacaccggacagagacgatgcggcggatcctttctctgccgaagagtggcgtggatgacagagacgagaagaacaggctgtccaacgaacagagttctggtgactcatggctttcaatagatgatgaactctttgattctggtaccaagactacctttgagaatgttccacagaaatatgatagtcacttaactggagctgatgatggtcaaagaggaaaaattacaataaaggaacaagaaggaccacactctcagtagcaagggtatagctgtgccttcagagaaatctcgaagaagagcccttggatcaccactcaagacataacaggatcaagggaaagcatgattttccctttatttctgagcgtgtctctggccagaggggaaggagaaagagatgaagaaacagaaatcatcattggaagatactactgctaaatgaagagaagagaagtcatgggaatagtccatcaaaaggcggcagaaaggtcagaatcaggacaacagatctagagactacttttgcaaaggaagagggattgtgagtggaggaggagggaggaaagaaagaagttggctagttaattttggagttgataatagggaaacttgagagctgtcacttctagtgactgcaatatattggcactcaaacagaagattaggtgattgctgttccaggaattactggaaggagggagtgctagaatgggggtaaaccacaggaactaatttcttctctctgtaactatcagacatcaaaga

SEQ ID NO: 500 - DNA, 719 bp, Homo Sapiens
taaggcgggcctgatggtcagagggaggaggaggatgggcagagggaggagagtctgatgccagagggaagaggttgatggtcaaagggcgcacagtgatgatcagagggaggaggatgatggccagagggggaagggtctgataattcgagggaggggtctcgaggctccatgtgaagtaggtctgatgaccagcgctcaaagttcataagtcagtctaataacctaaagaactatggacagtagaaagaatacagcgacatacaagagggctattacatactggacattataatctgtgcttcaagatattgttgccaattattacagcaaattgctaaagtgagtattattatgacttctattacccacatgaagaaacacaagctcacagagactaggaaacaggctcaaagtcactcagctagtaagtgatagggaatttaactcccatctctttctagtaacttaggtttattttatataatagatgggaggtatgcttgttaaaataagtcatttcaagatcatatcacaggtttgtaggccacttcttctttccttgactatatttggttctctttccagtgtgatttttaactggatcctcagtacccgaaattctttacatttccacgtcaccactgctgcccctccacaccacgccaccaccacctctgatcattctggccatgctacagtcctcgctcagaaacacg

SEQ ID NO: 501 - DNA, 1644 bp, Homo Sapiens
gatggattagaggaagagaaaggcagaagtagagagaactatttaggaggtgagggcagttgtttaggcaagaagtagtggaggtttggactacagcagtgttgtggtgggagtggagagaaatttaagagcagtgtcaaaacttaaaggcactgttttgtttttttctttttaaatctaggtcattttataatttctgggccagagaatgggcagtaaggggaagaaaacctaagagaaaatatctaaatgtagacatggcttttacttactaaatttgtgaaggcattcatctataatacagttccaatttttttgaatttccttttctaaggatgcctattttttcctttgaaaatgaattatataacatagacaataattaaaaggccccagggtcaaaagctcttcccacaaataactgtccacacactattagttcatttcctatacactctcctggcaaggcccaacaaaagctaaaagaagatggatggactttgtagggtgacctgagggtcaactgattcagggagctgaactcatcaatacagacagcaaattccatcacagaattccatccactattagtagcatgtattaggttggtaaaaaagtaactgtggcttttgccattacttttaatggcaaaaatctataattacttttgcaccaaccaatacaaacctttcctgttgcaagcatccaactgtgcctcgaaaagtcaagtatagcatatttctcacaaagctgccccaaagtcaaggcccagccctttcttgccacagtggttttacaaatagcacatttagaacacaaatacctaatgcatgtggggcttcaaacctaaatgataggttgatgggtgcagcaaaccatcatggcacatgtatacctatgtaacaaacctgcatattctacacatgtatcccagaacttaaagtacaataaatctaaaaaaaaaaggaatataaaactgcatatgctttattaacaaaactattatggtggattaaatggtaccctttcaaaagatatgtctgcctctaaatgtgaccttatttggaaaaaggatctttgcagatgtaattacgaatcttaagatgagctcattctgggctagggtaggcctaaatccattgataggtccttataagagaagggaagggaaacagaatacacagggagaatggcatgtgatgatgcaggcagagacggaagtgatgcatccacaagccaagaacaccaaggattgccagcagccactggaggctcggagagaggcacagaacagtctccctcagagcctccagagggaaccaaccctaatgacaccttgattttggacttctagcctccacaaaaacagactagaaggaaatcacagactagtgctaagtgtactggtgattggcttataaagttgtgcttgttttttgcgtaaatcgctggactttgctgcattttccaaattgtctaaactgcatatttatcatccaacaatttgatcaaaattattttagaataagaagtacacctgccttaaaaatgtttttatcaaggagatacagaggactactagagggtagagaagaaaaaggagggcaaaggctgaaaaactacctattggatactatgcccact

SEQ ID NO: 502 - DNA, 2941 bp, Homo Sapiens
gtggggctgcgctgcgggaaaggtgctgacgaggcgggcgcgcgagctcggcggggaggggtgcggccggtcggcggctggccggtccccgacttcccggcaccctgggcgaccgctccctcgtgcgagcgggaccacgcctggaccggggcccgcaggttttacagggcagcgggggggatttggggcacgtggggtcgggccgcaccccgacctcgagacggcgcggcgctgcgagcaaagagccgtcgcgcccggagccaggccccgccctacctgggatcccgtcgccctcccgtccccgggcctacacccgccccacctgggatccagtagccctcccgcccccgggcctacacccgccccggtcagctccggccaggtcggggaggaggagggcacgcgccgggaggaccgcgactggccgcctggagcccgtggctcaggctttcccagccgctgttttcccctttgtacatcgggatccgcttcgcacacttagtttctgcctagcacatgctgggtgttgtgtccagatacactaattctttttccccttcttccccgccagtcactagagccggtctggaagggcactaacgcctgggtagtccttcaaacaaaaagcgttgtgtgtcttgcttactggccgttaatagaagtttccccttgagagtggctttggttaggaaaaaggtggcaaagggcccatccctgaactgattagttgagcctgggacctgatcagaattgaggggaggagtgttaccagaattttctctgtgccccgcacttgcataagtgcttatggctaggagccctgtgtagggcacacattaccttggggcgcccttcgcttctttctcctcttgctgccccttcccggaatctctcacctcatgacgtgactatggtcaagtcatcgtttctgggatggcctgacccctggggacacgccagcctccaggagcttatatgaggctggtttaccagagtagacagtgtaaggccctgtcctggaaggaggaacatgaatatgtcctgaagtgcttgtgtcatgtgtcaggggttgtgctaggcttttcacatgagtgatctcatttgattcccacagcggtcctgtgagctagggggaatcatcatccctctatgtagttgaggaaactggttccgccggtttaagcaacttacctcacatttcacagtagggaggtgatggttgtagggctttggcaagaaagtgtcagtacctggtcaggcccctagggtgtgagacgctcagggccatcctggagggtatgggtgaaagcatgtaacaccgtgggtttccccccctctgtcaccccattctcttggccaccgctaccatttatatcaaggcaaaaccaggttaggtggcagatggatagtgttcgaggcagaagaagccccagagggcaaagacagggcaattccttctacccctcaccccacacacactttgctttggtcatggatgggttaatggaaggactcctgtgtatcagacttgggtcttttttagcaccatctggcagaagtcacctctcctcacacttgctgcttctacaaaacattgttcacttggcagtcagcagtgcaaaaggcagaagtgtggtgcgtgtgtgatttggattcagtggaccccagagacaattgtgttgtttgcattatgttgcgattgacagcccatagacactgctgtgttgtatgtggaaccacaaaagacgagaaaggcaacaaaagcagacgttccctctccttttaaaattatcttgtcgctgggcacggtgtctcatgcctgtaatcccagcactttgggaggccgaggcagacggatcacgaggtcaagatcgagaccatcctggcaaacataatgaaaccccgtctctactgaaaatacaaaaatcagctggacgtggtggcgcgtgcctgtagtcccagctattcaggaggctgaggcaggagaatcgcttgaaccagggaggcggagattacagtgagccgagattgcgccactgcactgcagcctggcaacagagcgagactctgtctccaaaaaaaaaaaaacaacttgcctgcaggattggatagagaaattcccaggagaaagcaaacaaataagggtgcaggcatttgtccttcaaaacaggcgggcagatcacaaggtcaggagccaagaccacgccattgccctccatcttgggcgagtgagactccgtctcaaataaaacaaacaaaaaatccccagggctttgtaggtagacgctttttggctttgaacaaggcaggtagcttcagtgtttcagatcaaggagtggatgtaggttgaagtgggcaaatcacttgaggtcagaagtttgagaccagcgtggccaacatggtgaaaccctgtctttactaagaataaaaacattagctgggtgtggtggcacacacttgtaatcccaactactccggaggctgaggtgggaggatggaggattgctcgaaccggaaggcgggggttgcagtgagccaagatcgcaccactgcactccagcctgagcaacagagcaggactccatctcagaaaaaaaaaaacaaaaacgagtggttgagcctgattgacccagggacacgttttgtttgtttgtttgttttttgttttgttttgttttgttttagatcaaggaccctctctgttgcccaggctaagtgcagtcgcacaattatagctcagttaacctcaaactcctggggtcaagccaccatcccacctcagcgtcctgagtagctaggaccacaacaagcacatgccacggcgcccggctaatttttaaaattttctgtagagatggggtctcgatacgctacccagcctggtctggaattcttggccttgagtgatcctctcgcctcagcctcccaaagcactaggatt

SEQ ID NO: 503 - DNA, 1167 bp, Homo Sapiens
gaatattctggtgttcctatagatcaggttttgctgatttgggaaaataaagactatggatcaactaggaatactgttcatattaatgagaaaatgcttctgttagaaccttgttgaaggcacaattttgagttgatccagttcttgaactctgtagactctgataattctgaatctgttgttttgtcttttgctgatattttgtgtgtggcaaatgtcgaggaagccagttttctcagatttcaaaatagtatatggaaaaatgaagagaaaatgcaatgtgtccatcctttgcaactagtttgggatccagtgtcatctgctctaaaacacaacaaaccagtgaaaaatgatctgcttgtaaatgaagctgcaattaaaaaaaaaataggtgcccttgaagatgagctaacttttcttcactctcagattcctgcaattttggaaatgcaggaactgaaaaacagtacaaattctagttcctttggcttgaatgatgggcccattagtttgggacaaatgccatcatcacgggctgttcagctgagtggggagtcacacatatatatttgttctttactacatttatactctgttcctttgtagagtgtataataagccttaacataataaaaatcagtttccaagttcaatgctttcttctcctcctccactaccacttcctcctcagttttcttctctctagcttccatgttttcttcccatacaactaggatctaataatatttgtgactcagataatccagctactgaaatgaacaaacagcacccaggtgctagtatagtcatcatccaaaaagccacagaaataaagatgttctaaacatgttggatgttctagaggacataaataaagtgaagctctgtgcaattgaacagtcacctggtggcagatccattcataagaggaaaataaaaaattcatattgggatccgatgtctttaacgtctcatgcacttaagcagaaatttgcatttcaaaaagatgattcatttgagaaagaaaatagatcttaggagccttctccattttcttgtccagaaacttcaacatttggacatcacatttctcagtcagaaggacagtgaactaaggaagaactgataagcacaaaggctgttgaccaaggtatcagcaacaaaagc

SEQ ID NO: 504 - DNA, 1340 bp, Homo Sapiens
agtcctgcttccaccccaaccagctaggtgctcatgaaagtgttctttgggcctcagttcccccatctgtaaaagaaggatgggtatgttagattttaaggtgggttctctgtgatttatttatttatttatttatttatttatttatttatttattttgagacggagtttcgctcttgttgcccaggctagagtacaatggcgaggtctcagctcactgcaacctccacctcccaggttcaagcaattctcctgcctcagcctcccaagtagctgggattacaggcacgtgccaccacactcaggtaatttttgtattttcagtacagacggggtttcaccatgttggccaggctggtctcaaactcttgacctcatgtgatccgcctgcctcggcctcccaaagtgctgggattataggtgtgagccaccgcgcctggccttctctgtaattcttgagttgtctttgttaattagcaggagagggaggcaggaacggagggaggagagacagattttaacagctgttctgcgtgagcccattttggcccccagattccctccatcccctagtctgttctcctttatggagttcactcccctctaatcccgtttctacctaggctaacccacccaggagagctttgaaatttcagtggagtcaaccacaattctacagcctttgaggaaaaggcctaataatgacgatagcctacagatgcaaagctcctcctgggagcacaaggtcttgcacctcttcgtgtcccttgaggtcccattcacagggaccggctgcaggcccaggagtgatttgcccgagggactgggctgggagtcaaaccaacatgtgtggactccagaacttttgactcttcagctagctttgtctttggcaccttccatctgtgtcctgggccacatcttcctggcttcagttgtttctttctctatctggcactcagggctcccaagctgaaggtcctgatgcttcagcatgagccaaagcattcccacctgagagagaccaggaaggaaggacaaaacgaggacccatggaggacaccaggcagtgtggcccctgcacccaccccactagctggacaggctactcagcattggtgacccctgcctgcctccaggtccctttccattcttggtgaccccaggcagagcccccaaagccagtatgctcgccaaagccccatgcagttggctagagcccaagccctccttttctgcagcgactccaccgggctgggctggggctcgagcttggccactttcctgggccgctgctgtatcgattattttggctccctttttgctggggatatcaattt

SEQ ID NO: 505 - DNA, 3337 bp, Homo Sapiens
agagcgagctacgctgcaggagcgcagttaccagccggctgcgatcacgtgcctgggaggaggagctgagacctcaggggaggggcgcgcggtagcgtcccgggtcccctagcagggctctagagaccacgtgaagtctcctcgacagctgctttgcctcaggcataaatcagaagaggaaaaccagcttctggacctggagagaggatgaaagggaataggaattgagggaagcggaagggaagaataagggacccctggagagtccctaccaagccagacataacaaacaaaagtcctctactactgaggaagacagaacagggaagccagcaggggaagaaaaagatgctgctgctcttgatgcctcaaaaacagcaaggaagaacccaagcaactgatgtacacacccttggaacaaatctgccccagaagtacaagacacactcttcgaattcatggaataaatgggaggagctggtgtagtgaaggatgaagagaaggcaatgcattggtttagacaagcctcccagcaggaccatcctggtgctgcctttaaccttgcagtaggaacactgaaaaacatgactgcctccatggaagcaggggatgtagaaatgctccttaatgttgctgcaaaatgggggatccaagaagcccaagaacttctggagaatgttatttggactaaaagcaagctcttgccaactgaaagaaccaggagttcttataaaccataatgtgtgcctgcatgctcttcctggaacatgggatgttctgctctcacttgtccactgtggccttgcaatgctttgtggcattttcaatggaagctccttttacttatagtctcatatgctgctgcagcattaatttgctggttaaaatcctttaaatgaagtgttacttatatgttttcctgggatctgagtttgatctcttctggatagaggaatattttatttgggtttcattactgctcacttcagctaaagtttcattcaagccagtgagcattctataacgtggtaagtggaaaataacgaagaaacctgtcataccagagattggcttcttggatgtgttagctggcactcacagatccactgaaagagctagactcatcattagcctaatctatgacatgtgatgttctgcctaaaataagcctgttttcatttctctccatttcaattttctgctctattaggtttctatagtattttattacactcactttttgtattatagaaagtcctttataggggtaaaaaggctgttattgttgtcaattaaagggaaaaggataaagtataagacctaacaattattgaccatctgccacatgcaagatattttcttagctgtttaacatatatatatatatttgagactgagtttcgctcttgttgctcaggctggagtacaatggcatgatctctactcactgcaacctcagcctctcaggttcaggatgttatcctgcctcagcctcctgagtagctgggattacatgcgtgcaccatcacatccggctagttttttcatttttagtagagacggggtttcaccatgttggtcaggctggtcttgaacttctgacctcaggtgatctacctgccctgccctcccaaaatgctgggattacaggagtgagccaccacgtctggcctgcttaacaaatattttaacattcactagttataaaagtcttataaggtggatcttataactcctattttacagagtgaaaacaggtgtagagaagttgtgatatgtgcaaagtcacagagtgagtgatagagtggggtttttagtgctggcagtctgattctagagtcaacattcttaaccagttctaccaacattactctcccaagtcattaacatctctttcctaacaacaaagatgttctaagaacagataactgggtttattactggcatatggtgaacacttatcttagcaaataactcagccccattttctgactatgatttttttaaggacaaaccacgtagtcctattcttcaaaagtgatgtttttaaccttaattataattagctgtatttatctcatttagattatagcgcaattttctccttggaatatacatacagaaacacaaattgagggtgacaaaagtgtcaaactggaattcaatatgatgattaagctgtgtttaaaatatttgtttcccttttgattgccttgtttacactgtatacatatggaatatgactgtaagccttcagcaatcttctctttgtccaacgtgaacacataaacctttaaagatgtacatgaaatggtcacatgcaattttaaattctttaatgtagaaaatcccaaattcataaactaaattcttcacgtgaacctttggtaatagtatttttatcttctctagaagcactttatttttcttacatttttcccagagaaaccagtcttcatttcagtttatgttgttcaagatacaactctggaaattttattctgtgccacaaacacttataaaatactaggacaataatttcaatcatcgtgttagtgtgcatttttttaaccttcacagtaatatcctcttaactgtcttgtaatttaaatgcttgtttacagtaacaacccaaacttacaagtatgaaaatataccataggaatatgatcactaaatagtgtttttttattttaaaaaattcctttaggtgtcttctataaacatctccaactaacattgatttaggttgttttagggttctaatgtcttctaacagttctttgttgttgaaataaagtaatagagtagttgaaaaagcataacaacaattagaaagactttgtaaagcctcacatataaaaccccttcacttttaacttcggtaatacttgggtttaagatcgggaataacctaccagtccatcagggttgaaaaataatgcttcatgcaaaaccagaaaatgtgatggatgaggattcccctgaatccaaagctctgcttctacttcctttgctgtatctgggcaaaaattcaggggaaaagcaagacataagaaagaaattggatcataaagagagtgagagcatgagagaatgagaatggatttgcatgtgtttggccggttcagataccccaggttctgcttgctttcttccttccctgtgctccttctgggccacagaggttgagaacctctgcactcttttagatgccccaggtttcctatttagccatttgatgtcttgatcctttttctcaaggtctgccttaatgttaatataaaaatattttacattaaatatgacatatatttacagtacacatatcttaaat

SEQ ID NO: 506 - DNA, 3090 bp, Homo Sapiens
gattctgattcagtaggcctttgccagggcagaggtatgtaggtgatgctcacgctcagctaggtttgggagcaaccagactagaacccattcacatacagactcttagtaaatgttttctgctctcatcttgcaaagtgaaagtgcccagcacaggcaatggtgttagtacgttgtagtcattcacaaactagggctgcccagaagagagacaggctgggactttcgagagagaaacagctgtttcatttgaatgcctggtgtgggaagaagaaggacagcctagcttcatggaaccttcttgcaccaaacaaagcctccagatccctccacagtgctccattcaatccctgtccattggtggtggaccaaagaagaaaccaatttgccttggccacatgtctttgagaaaaaaagccactctcccttctgggactcagagcatctgtacctgtaatataagaggggaatgtggaaaattctaactggatgatcacttttctgtggagggaaaaacacattttttgttttaaggggctagccagcatcaaacctttttttgagatggagtctcgctctgtcacccaggctagagtgcaatggcactatctccgatcacttgaacccaggaggaggaggtttcagtcagtagagattgaactactatactctagcctggatgacaaagtaagaccttgtcaaaaaaaaaaaaaaaaaaaaaaaaaaaaaaagaaggataatcaagacaatgagctaacacagaagccatagtggactttcttcaatattttaagaaaggtgaaaaatagcaggaatttaacctctcaaaaatgctattcccattatctattcttcctcagctacaaagcccctgatttcacctaggcacatggctgcccaaaaaagacaaccctgtctggccccccttaaacctgattgtagctatctaagttgtagccaatgaggtgtcagaggaagtaccatgcagtgcaacttcttaagtagcctagaaagatggggtcacatccccctgggttgtttccttctttgtgtcattttgatctctctcgctggaaaacagaaatgatgtctggagtgtaagcagccatcttgggctaggagactacatgctgacatggtgacacaccacccagaaagaatctgagtagtcgatgatcacagagctaccatatcagcactagactctctacctccacattttatttgtgtgacatagaaataaagtttaagctttgttttttctggggtgtatgtgtgtacacatgtgcgtctctgtctgtctcacatgcagtgagacctaattctaactgatatgccggtaggatggggggaccttgccacaaggtataattgtggtgggatggctgtgtcttgctcccattcaggatccatggaaagctcctcctccttcctgttcccctggatgccaagcgatgggcctgagaccctggctttgccatgtggatgctccccctcaggactttggatgtgcagtgattgctacaaaaagggcaatgaagatgcctggaccacagccacacagtctccatcacagcagtggtattctgtggaatgagtactaattttctggccacattttctgttaaaaactggttgttgagctgcccacttgtcttggtcaagggatgctggagtggcctgggaaggcagtgttgtttgcttttcttaggatggaacacacttaggcatatttttggtcaaagcaaaagaagaattcaaaggtgagagaagttgaagataaaaaggggaaaatgagggtagcagatgaagcaaagtcacacagaaagctggcaggcgagtagtagaatcagagtacaggctgagcatcccaaatctgaaaatccaaaatcggaagtgctccaaaacctgaaacttttggagcaccaacacaatgctcaaagtaaatgctcagtgaagcattttggatttcatattttcagatttgggtttgcccaaccggtgtaatacaaatattccaaaatcaaaaaaaaaaaaaaaaaaaaatctaaagtctgaaacactcctggtcccaagcattttgaatacaggatactcaacctgtatgacactttcctattggaccctctttcctaccccaaataatacttaataagtttttgtttcaaaagtgccactctgagcatctttggctataaggagcagagtcacattctagctcccctggcacctgcttcacaggagcccatgtgagaagaccaggttctggtcaggacaggcatacctgagagctgttggggtctgtgatctgctgaaaaatgacttctcaatgttcttcacatcctaatcctcagaaactgtgaatatattactttatatgacaacagggattttaaagatgtgattaagtaaatagtttggagatggacagattatcctggattatccagatgggcccaatgtaaacacaagggccctcatgagagggaggcaagagggtcagagaagatgctgtgacagcagaagcagaggacagagagtcgcagagagatttgaagatactacacagctggctttgaaaatgcaggaaagggccatatctgttgcttcacaccactaagtttgtgataatttgttacagcagcagtgggaaactaatagagcatctttcctttttttctagttaaaggactcacttgtacgtgtacacatttctcaggagtcctgtcaaccactgggaagaaagaggctggacttctgcattgaacccaggaacggggtttcacagcaatggaaacctggggttaaatatcaatggaaccttacatgacttgaagaatctttaatacaagctaggttttgaccccaaattagacatttggcagcctctcattacagtctatcttgcaaacctcagtgtggcaaggaatcagattcacccacactccctagtctaaaggattgtcctctgatccttccaggtggattaagccctttctaatctgtcatggacagagcaatgtacctgcctttgtttgttttccttaattctttcaagtgcctttgggtaataaatggttgcgtactcag

SEQ ID NO: 507 - DNA, 2132 bp, Homo Sapiens
actaaccagctgcatgaccttaaaaaagatatatcactggggctttatttttcttacctttaaaatgaaaaagttagactacatttggcgtagtccaaaagtatgtttttttaaaaaagcaacaaaatcctttcttcaaacaaaattgtataaggaacatcaatatgggggaaaaatgaagaaaagcttttctgattaacatgcgggagggggcagaataactttttcaccttcaagaatccctaatgaatgctgggagcaatagagctcctggcatgcacaactggaaaatctttggcctggatgatctttgaagtcttttctatttggtccaaccagtctcctccaggaaatttctaaatgacatgaattcattggataagtgataatatcagatatagaaatatgactaaatgtgctattatgaatgaggattgttatatacatataacctgctccgagaaaggactttttgaaagagaaaggttaagagatcagagtaacttttgagctaatgaggacactaggtgacatcaagcccaaacactttctgaacaagtggctggtcctgagaggtgatcgaggtcacacaactataagatataagcaggaactgaaaaatcacatctccagactcatcacttggactagctatgtctcatgattttcacatatattatacagaagaagaggaaatgctcaaagatgatgcttagctcaacttatttcctttttgcaataaataatattccatcatctggatgtaccacagtttatttatccattcactactgaagatcgtcttgcttccaagttttgacagttaccagtaaagctgctgtaaacatctatgtgcaggtttttgtgtagatataagtgttcagttcatttgggtaaataccaaggagcacaactgctggattatatgagacaggatctccctatattgtctaggctggtatagaactgggctcaagtgatccacctacctcgacctcagaaagtggcttttaaattttgaggcaactcaaatatggatgatgattgttttctcaaatttgctagcatctttttataagatacctgcttgggcataactatttgtattcaactggtaacagactaacttcacttttgatcctatcggagtagacagtctggaatgtggtgatactctgtagctatcaaatctgcagggcttggccatggacttgcatatcattgctgagagaagtctcaacagcagcttaagtactattgaagacctcaagatgacaaattttctccatcacttctaaggctgaattgtcatatccaatgtgctttatgactatgctttgagagatggtgatagaagacaaatacatcgcatcatcatccactcagtgagaaatggcttttgcagatttgtgctgatggatctaaggtgtgcacctctggaggctttgaggtggctatacttcagttgtggataaagaggtgaagaaggacatctatggtgatgctcagtaatatctgcgaagaactgtggagacagacaaatagtcaaaggagaatacagatgactttcagaagaagtgtgaacatcaagctgaggagcttttttgaagagcaggatctttctatcaacatgggatagtggaagattaaagtagtgatgactacatatagaaatacaaagttgaagtgagagacgcaagtctgatactgcaaaagaaaaatgtaagaaacttaggactcaactttatcaatgagttcgttcaactatagaaatgcactagggactgaatggtgtccccccaaaatttatatgtcaaagctctaatcctcaatatgatgatctccagagatggaactttggggtggtaattgggtttagatgaggttatgaggatggggtcctcatgaagggattagtgcccttataaggagaggccagagtgctcacttgttcgcatatgctcttgtattctctctctctcctcaacccccaccatgtgaggacacaacaagaagatggttgtctacaagccaggaagagaaccttcacaaggaaccaaatcagcgggcaccgtgatcacgagactcccagcctccagaactgtgagaaataaatgtctgctgttgaagcc

SEQ ID NO: 508 - DNA, 2607 bp, Homo Sapiens
aatacccagctagttgcaaaaccttcttttattgctgcaataggaccttttcatgtgtctaaagcataatttattcagtgagtaccctgctgttggccatggaagatagtagtctttttcactattgcaaacaatgtttcaataaataacaaaatttttttcacacctaaaacagcaggtattttatatagcatttataattgtaaataagatcactattttcttctctctttctctctttttcctccttctctcactaattattgctgatattaaaagattaattcttgtagtctgcctgtgaatagccactgcactccagcctgggcaacatagcaagctatgcctctgtttaaaaacaaaactaaaaactactcataatcttactcaaaatgactagtttacattttggtctttatttgcatatatacctacatttttagaataagattctactttacacagtattcctgttgtgaattctgtcattgccaaccttcttgaagattcttactagtttccattttcttccactgattctcttgagttttctagatctatattcttatcatctgataacgaggatgatcttgcctctttcttttaagtagtcttactttttatttctttttcttgtttaactgcactggctgacccgaaatgaggctaaatgatactgaggacagttggtatcagtgtctcacttctttctagagtggaaatggttctttgtgtggtttatttttgcctgatggtgactgttggtttgtaattgatcttaactgaggagtaacaaacatggtaaaacatttaacacagaatctttcaaataataaatacacaacaaatgtttttgttattattatatttttgtcatggtaaagaggtatactttaatttcctgtcattaagatttatttttaaattgagaatggatgttgaattttgactcctgcctttcttaaggggatatctatttaaataattacttatatttttctttaaactgttaatagaatgatatattagcattgatatagttgtctttcttggactgcaaaaccaattttgtcaaaagtttgttacccttttgaaataatgctaggttttattttctagtattttattagagtatgtgcatctattttcatgagttaaactgtcctctatcatgatttttcagagatagctttgttaagatttgaaatcaaggttatgctagctttgcaaaatgaattggaagttttctttttccatcctccatctcccttaccaccccttccccagtatgttctgttccaagaaattttgaaggagcttacatgtgaaattgccctggaaaagaatcttttaaaatataaatatacatacaaatatatatatatgtatatatatatacacacacacacaatattttccatttattctataattagtacaacttttagactttcttctcagtttgaattaattttggcaattgtactttcaaagaaaatcattctgattccattgagtttattggcatagagctgcaaacagcctctgattctgaaatagctcttctggatcagtgattatataccttttttgttttgtatcactgagtgcttgtgctctctctcttatttctgactgaagttgctaaaaatttaattagttgatagaaccagttagtgtacaaattagtgttggattactaattattttaatttattatttccttttaaatataaaagaacttgcagctgtaagttcttctctaacagtaggtataactgaatcctagatgtgttcatatgtaatatttttgttactggtgtgttctaaatatctgtggtggttgttttgaattatgcttttgcccaaaggttactcggtgaagactgtttcttaaatttcaattggattggctctttgttcatattttgttattaaagtctaattttattgcattttaggtagattttgtgacctaaattatacccaattttggaaatttgtagtttttgtgtgtgtatgcatggcatatgtacaactaatttttgtaactattatatgggcacttaagagtatcttcacaatgtataattaatatatcatgattaggagaaagtgtgtttatgatgttattcaaatattttctttctttttttttttttttgagatggaatctcactctgttgcccaggctggagtgcagtggcgcaatctcggctcaccacaacctccgcctcctgggttcatgccattctcctgcctcagcctcccaagtagctgggactacaggcgcccgccaccacacctggctaagtttttgtgtttttagtagagacggggtttcaccgtgttagccaggatggtctggatctcctgacctcgtgatatgcctgcctcggcctcctaaagtgctgggattacaggcgtgaaccactgtgccgggcctcaaatattttctctctctatatatttatttttgttctcttgattaaagttgttaggaatgtgttaatttcttccactgtgattgtgttttgtattttcttgcattatgccatggaaattgctggtttcctaggtcaaaacaattaaatattgtcagttaca

SEQ ID NO: 509 - DNA, 1272 bp, Homo Sapiens
gtttggggcagtgccaaggctcccaccagccctggagcacttcacatccgctgtcccatcccaaaaccttggtgggcagagaaatagaggcgaaaaatgactcttggagaagttaagtcacttgatctggaccacatagcaagtacagaattggggtcagagttccaaaggcaccttgcacacagccctaggaggaggtgacctcctgtggtcatctgacgctgacccttggtgatggctcactggttcccaaccacttccaaccttcctgctgtcctcactgctctagtctggtggggcagtttccgggttagctggctgcctcctctactaactcccagccactgacttcccatcagaggaccttctctgagttgagactgtgtggaaaaggctaacattccctccaaaatgtgtgctccctcttccataggccagagtgagccctgtgaagtagctgcatttcccagccctctgcagtatagagagatgggggcatgtcattattcttgccaatgattctgcctgggtgcacagactcaattcctgggggacagtggagccacgggatgtaaagggcctgcacccctgaatgccagaatggaggtgcactgcccccaaccagggacatggactgttaggtgagcaaaaaataaattttgattaggataagccactaaaatgctcacctgttacagcagatagcattgccctaacccagtagtgaggtgccaacaatgggacacattccgtgatgttccccattcaatcctttgatccccgcaacagccccacaaggtatatattagtactgtcatcctcattttcaggtaaggctcagggagattaagggatgcacccaaggtcaaacacaaccagtaggcagtaggccaggattgaatctggatgtctgactccagagacttctggaggttcagttaccagcacacggtggagatcttcctccaccaccaccacctagagagaatgagcaggaaacctcagaagaaatggcacccaaaagagccagaagtgtcgcctcagccagctaaggttggaaccacttaccaacgcccagaatcacgtctttccaatcaaacccaatgactgttcatctctgggtttcagtttcctggtttgtaaactcccatgagtaaacaatctctgattatcccgaccacagagagggttcaatcaggtgtgctggtggtcttcaatcaaacatggatttacctcccctattctattcttcaaagagggtgacaaatctgc

SEQ ID NO: 510 - DNA, 2488 bp, Homo Sapiens
aagtcaggaaacaacaggtgctggagaggatgtggagaaataggaacacttttacactgttggtgggactgtaaactagttcagtcattgtggaagtcagtgtggcgattcctcagggatctagaactagaaataccatttgacccagccatcccattactgggtatatacccaaaggactataaatcatgctgctataaagacacatgcacacgtatgtttactgcggcattattcacaatagcaaagacttggaaccaaccgaaatgtccaacaatgatagactggattaagaaaatgtggcacatatacaccatggaatattatgcagccataaaaaatgatgagttcatgtccttcatagggacatggatgaaattggaaatcatcattctcagtaaactcttgcaagaacaaaaaaccaaacaccgcatattctcactcataggtgggagttgaacaatgagaacacatggacacaggaaggggaacatcacactctggggactgttgtggggtgggggtagtggggagggatagcactgggagatacacctaatgctagatgacgagttaatgggtgcagcgcaccagcatggcacatgtatacatatgtaactaacctgcacattgtgcacatgtaccctcaaacttaaagtataataaaaaaaaagaaaagtcatacttaaaaaaaaaaaaagaactgcttctattgggtgaaaacagtgatttttctgagattctaaggcattacagtttttcctgccactgagcagtttaatactagataattgcattttggtatgcaatcattggcctaaatatagtataactatagggaaaaaaagcccctttatctttgctattatttacttatttatttatttattgtagaatatttggagttttttttatcttattggatgtggctctcatccttgctaacctaattttcactgatagcaaagtttatattcctttggattatcattctattttttctagctattgccttattttttctcatgaatggtcttcttcgagtatttgtagaagggtaagtttgattattttcataatgcataaagctattttgtacttttataagaagcactttgtgagactgaggcaggaggatcaggaggtcaggagttcaagaccactgcacccagcctaaatcattgtcttataaagatacatgcatgcatgcatagacatggaatcaatctaaatgccatcaatgatagattggataatgaaaatgtggtacatagagagaatgggacatctggcttccgagcagaaacctttgtagtgccagcgatgaaagagataattaaatacgggtgatgttgagaaaggcaagaagatttttgttcagaagtgtgcccagtgccacaccgtggaaagggaggcaagcacaagactgggcctaatctccatggtctcttcaggcaggagacaggtcaggccattggattctcttacacagatgccaataagaacaaaggcatcacctggggggaggatacactgatggagtatgtggagaatcccaagaagtacatccctggaacaaaaatgatctttgccggcattaagaaggcagaaaggcagacttgatagcttatctcaaaaaagctattagtgggtaacaattttccactgccttatttattaaaaaacagaaatgtctcctgacttttttgtgtgtaccataatttaatagatctcatacaccagacttcagatcatgaatgactgagagcatattttgttggacagtcctgatttaaaactaagactggcttgtgattaaatgaataagtttggtagtttggtttttgaattttaataagtaattttaattcagtaaatgctatcactgtttaccccttctaaagatatgattagactttgttaataatgttcaacttttcacaaagatggtgagtgccatcttaaaacttattggagagtggttttatatttagatttatataactggttatgtgaatatatttaaatactggggaaattccttcactgtctcaaaaccatgcaagattcacatatattttgtgtttatttgcttcttaaaggccagggttgaagataaggtagcaatgtttactttatatttttggccttaactatgccaatctaattagaattccctgtatttaaaatggttccttttacttattgaatggtattttagtgtggtttatgtgtaatatcaaataaagattatttaacacttaaaaaaataaaaaaataaaatgtggtacataaacaccatggaaaactatgcagccataaaaaggaacgagattacatcctttgcagggacatggatggagctggaagctgtcatcctcagcaaactaacacaggaacagaaaaccaaacactgcatgttctcacttgtatgtgggagttgacgatgagaacacatggccacatggtggggaacaacacacactgg

SEQ ID NO: 511 - DNA, 1112 bp, Homo Sapiens
cctgcgtctgttctctcccaaagaagctggtccttagcctgtgttaaggagcaatctttcggtggccagatggagccggggcatccttcttcaaataatggcttttaattcgcagactagaatgtttcggattacaaaagaaaccggttctcttcacatccttatccttgtgatgcagcattccgcttgcatttggaagccgtttaatatcagagagaagccatatttatgaaagtaaagaggctgctcagatgactgcaaaccagccttccttactggttttatcactggtaatgttataaagacagttgtccagtttcatgaatcttgtaggttttttttttttgatgttgtttttttttcaaaaatccgtattgtagaaaaatatgctgtcccagaagagatgattggacactctcaagcgtggtgctggactttgtcatctcttgcacagccatctccacaccttagtgcttacctcatgttagttttttatattctgcaaagacgaaaccaaaataatccaaatttgacacaaatacctgggctacatcttatttgagatgtttaacaaatgtctggatcatcttttcttatatattacgcaggaaacactgtgaagtaagcaaagttggaatgcccaagtgaaagaccatttgaatatttacaagtagatttcagacaggaatactacagggtggtcacaggataacaaattctaggcagcagatttacatgacttgaggctgtgggctgttaagacgctgaaaaaccagggtgtggaccaagctggctaaggctgagtggacccaacgtggtgctggattggatggaggttttacctaggccctcattatatgctcattaacatactaaatcacacacccgccagtgccatgacagttctgagaccagtgtttgatgtaaaaatggcaccacagttccaagaaatctccacctttacccaggaattttcgtgaacattccactccttggttaaagaaacccatcaagatgaaaccccagaacccattattctctcttgggtatgcccaagctcccctttcttgagagtgtactttttgctttgcaataaatctcttctttcacta

SEQ ID NO: 512 - DNA, 1110 bp, Homo Sapiens
tgcgtctgttctctcccaaagaagctggtccttagcctgtgttaaggagcaatctttcggtggccagatggagccggggcatccttcttcaaataatggcttttaattcgcagactagaatgtttcggattacaaaagaaaccggttctcttcacatccttatccttgtgatgcagcattccgcttgcatttggaagccgtttaatatcagagagaagccatatttatgaaagtaaagaggctgctcagatgactgcaaaccagccttccttactggttttatcactggtaatgttataaagacagttgtccagtttcatgaatcttgtaggttttttttttttgatgttgtttttttttcaaaaatccgtattgtagaaaaatatgctgtcccagaagagatgattggacactctcaagcgtggtgctggactttgtcatctcttgcacagccatctccacaccttagtgcttacctcatgttagttttttatattctgcaaagacgaaaccaaaataatccaaatttgacacaaatacctgggctacatcttatttgagatgtttaacaaatgtctggatcatcttttcttatatattacgcaggaaacactgtgaagtaagcaaagttggaatgcccaagtgaaagaccatttgaatatttacaagtagatttcagacaggaatactacagggtggtcacaggataacaaattctaggcagcagatttacatgacttgaggctgtgggctgttaagacgctgaaaaaccagggtgtggaccaagctggctaaggctgagtggacccaacgtggtgctggattggatggaggttttacctaggccctcattatatgctcattaacatactaaatcacacacccgccagtgccatgacagttctgagaccagtgtttgatgtaaaaatggcaccacagttccaagaaatctccacctttacccaggaattttcgtgaacattccactccttggttaaagaaacccatcaagatgaaaccccagaacccattattctctcttgggtatgcccaagctcccctttcttgagagtgtactttttgctttgcaataaatctcttctttcacta

SEQ ID NO: 513 - DNA, 4924 bp, Homo Sapiens
actttctgtcccgctgttttatggggaaggcgggggaagacacgcagacatcaattcgactaaacaaagtttatcaataatattaaaaataaaaagtaaagcccctttctgaacattatggcttattccttgattatccttcttaatgccacagcgtggctatctcagaacaaaattagagactaacagtaaatttactttaatttttacgaataattctctatcaatgtaaaaatttttcatatacgcgtgtatgaaagaaaaacactactatttttccacattcgtgaaaactgcttaactgggacagtaaccgagcggccagtgaatatttaaaatactgtaaccgacgaatacgtatgcttctaggaccacgtggaatctttcccatggtagagacaggatttcaccatgttgcccaggctggtctcaaaacttctgaattcaagcagtccgcccgcctctgcctcccaaactgttgagattacaggcgtgagccaccgcacccagcctcaagaatgtcttaaataatgtatgtactattttatcagtttacaccctcactagcattgatgagttctctttgttccacattctctccaacacaagatatggtcagactcttaccatttttaccgctgtgaaaattgcaatttacatttccctaacaaagtggtgcattcttccatacttatgaaaccttatttcctcttctgtgaactgtccactcttaccttttataaagtttgctatggagttttctttcacaaatgatgtgtacgtcattagatagcctgctctattcattcacctgtataaagtaaaactaaactcctaagtccgccaccaacagaataggcccccttgtggccaaggggatcctagaaaaccttaaaactgagttctagaccacgatgggacaggttagacacaccttgttatactccctcccttttgtagtttaacacaacaactggccagcattaatgttaaaacagagatgataagactgacagaacagactctggcaataagatgccaaattataaaaaagacctaaagccattccaggcaaggttttagtcccacacccctatacttaaagaataaactgtgttctaactgccacaagattcttctctagcagctaaacaagtactggcctaaagataaacaatattaaaataatgtgcagctccacgagatgctgacttactgacccccagtccccgttccaccagccatagctacagctttcattggacaactttttgttgatttcagtaactttctccaggtaagaagaccactggccatggactggttctggctggtctacagaggtcgcacatttgcatggcttcatgtcctgaaagaccttttgacgtatagggctcgtaatacatttaaatgttaagtcttggctgggtgtggtggctcacgcctgtaatcccagcactttgggaggcccaggtgggaagatcacgaggtcaggagcttgagaccagcctggccaacatggggaaaccccatctctactaaaaatacgaaaattagccaggcgtgggggcaggttcctgtaatcccagctactcaggaggctgaggcaggagtatcgcttgaaaccgggaagtggaggttacagtgagctgagatcacatcgttgcagtccagcctgggtgacagagcaagactccgtctgaacaacaacaacaaaaaagttaagtctccatcccaaagtgaatatgggtcatatgttacatgagtttttgttcaatacgcatgtgtcaggaccactttcatgaatattcatagctcttcctgtaacctggtgaaaatgtaggtttagccaacctgttcagcctgaactacactccaagccctcctccttcaaagcgcctgtttctggaggcacgcttcccagcctgcaggatggccaccttgcaggccataaagtctccccttcttttctaaatttattcattgtggggctttttaatatatacatttttaaaagagagagagagacagagtctcgctttgttgcccgggctggtctcaaactcctaggctcaagctatccttctgcctcagcctcccaaagtgctgggattacaggcatgagccaccgcacccagcccattgttgggcttttttaagttaacgcttggtatatgttataaataccttctcccaggttgacacttgtcgtctttgtttacggtgatttgttctctagattttaatttcaatgtagtcaaatttatcaatctgttgttatgatagctgacttgtagctttcttaagaaatccttccctctcctgaggtcactaagattttcattttcattttcatagttttatagttttgtttttcacatctttttttttctatttggctattattggggtatagcaacactgtggatttttgtacagcaatcttgtaccaaaaaccttgttgaattctgttattctagtattttgtctgtgccaggaacagtggtacacacctgtaatcccagcttcttgagaggctgaggcaggaggattgcttgaacccaggtgttcaaggctagcctgggcaatatagcaagattctgtctctaaaaaaaaaaatcatattatggtagatggaaactagtatgtgataaaataaaaatgactttaaaaaaatttgtctaaagttctttaggattttttatttagcagaacattatgcaaacaccaaccttttaaattctattttatttaatgttttaatttgtaaaataaacttagtatgaaaattttcaaacaaatacaagagatgatataataaatccctgtgttcctatcatccagcttcagcttaaacaatttgccattcttgttttatctatcctacctctcctctccacaacttttttcattttgttctgtgtttttcccagaatttttttttttttttgagacggagtctctctctgtcacccaggctggagtgcaatggcgtgagctcggctcactgcaacttctgcctcccacaatcaagcgattctcctgcctcagcctcccaagtagctggaattacaggtgcctgccaccatgcccagctaatttttgtatttttagtagagatagggtttcaccaagctggccaggctagtcttgaactcctgacctaaggtgatccacctgcctcggcctcccaaagtgctgggattacaggcgtgagccaccttgcccagccttcctggagtattttaaagcatatctagatatattatttcacccataaatacttcaatgtatatctctaagagacaaggccttttttttttttttgagatggagtcttgctctgtcgccaggctggagtgcagtggcgtgatcactgcaacctctgcctcctgggttcaagcgattcttctgcctcagcctcccgagtagctgggactacaggcgcgcgccaccacgcccagctactttttgtatttttttagtagagatggggtttcaccatgttggccaggatggtctcgatctcttgaccttgtgatccatccgtttcagcctcccaaaatgctgggattacaggcatgagccactgcacctagcctgccttttcttatttttaaaaaacatactgataatcccattatcatacccaacaaaattaataattccttaatatcatctgatacctgttccatgttcagttttctgtctcaaaaatgcccttccttccacagttagttaaaatcaggatccaacaagattgtcacattgcatttagttcacatgacaattccctctccatttcttcccccctgccatttgttgaagaatctaagtcattggtcctatagaatttcccacttcatgattctgctgattacatcttcatggtgatgcttaatttgttccagaaactgccagtgacatctagaggcttgattagtttttggttttttgtttgcttttgcaagaatacttcataggtacttccttgcatcatagcagaaggcatatacatactgtcccacttttagagatgtcgagatttattagtgagttcagatttttttcctacgtcttaaactgtttagccccttgttttactgcaatggttaggccctctaatacgatacagaaggtaggggctagacatcttttaacttacttctaaattttaatgtgaatgtttgaaaagttttaccactaaataagattttttcccatatatttttcacagctgctctgattaaggaagcttccttccactctagttaccaggcttttctttttaaatcattaaatgttggatgttatggaattctttttcttgaatctactcattcattttcaacttaaacccttggaatagaaatacaatttgaaaaagaaccttatgtctagagacaataccactctttggtctaggtaagaggagcccctaccctggaccgacactttagaagactttactctgacctctggctctgccccacaggataagaatccatactgccaacgtgatgtgcccagctagaacagatgcccccttctagaagtgcatctaacacccaaatagcccaaatagctccaagccggcttccagggcttgctctggcctcatacctcttacgagtgaaatgggctaatggtatacaccagggctgtagccagatcttatacatataggtgggggacccacatatatatatatgcaccaggctcttcatgatgcagaacaaatcaaggggtggggaaataaaggaggcacccagtgggcgggggccacctctccctgcattgccatgctttgtcatggaatctgataaaatcagagaattctgaattcaaacctggtctgacaggtcattatgaagggatatttgtcaagataatagaataaaacattttatttaacagatagctt

SEQ ID NO: 514 - DNA, 4920 bp, Homo Sapiens
actttctgtcccgctgttttatggggaaggcgggggaagacacgcagacatcaattcgactaaacaaagtttatcaataatattaaaaataaaaagtaaagcccctttctgaacattatggcttattccttgattatccttcttaatgccacagcgtggctatctcagaacaaaattagagactaacagtaaatttactttaatttttacgaataattctctatcaatgtaaaaatttttcatatacgcgtgtatgaaagaaaaacactactatttttccacattcgtgaaaactgcttaactgggacagtaaccgagcggccagtgaatatttaaaatactgtaaccgacgaatacgtatgcttctaggaccacgtggaatctttcccatgagacaggatttcaccatgttgcccaggctggtctcaaaacttctgaattcaagcagtccgcccgcctctgcctcccaaactgttgagattacaggcgtgagccaccgcacccagcctcaagaatgtcttaaataatgtatgtactattttatcagtttacaccctcactagcattgatgagttctctttgttccacattctctccaacacaagatatggtcagactcttaccatttttaccgctgtgaaaattgcaatttacatttccctaacaaagtggtgcattcttccatacttatgaaaccttatttcctcttctgtgaactgtccactcttaccttttataaagtttgctatggagttttctttcacaaatgatgtgtacgtcattagatagcctgctctattcattcacctgtataaagtaaaactaaactcctaagtccgccaccaacagaataggcccccttgtggccaaggggatcctagaaaaccttaaaactgagttctagaccacgatgggacaggttagacacaccttgttatactccctcccttttgtagtttaacacaacaactggccagcattaatgttaaaacagagatgataagactgacagaacagactctggcaataagatgccaaattataaaaaagacctaaagccattccaggcaaggttttagtcccacacccctatacttaaagaataaactgtgttctaactgccacaagattcttctctagcagctaaacaagtactggcctaaagataaacaatattaaaataatgtgcagctccacgagatgctgacttactgacccccagtccccgttccaccagccatagctacagctttcattggacaactttttgttgatttcagtaactttctccaggtaagaagaccactggccatggactggttctggctggtctacagaggtcgcacatttgcatggcttcatgtcctgaaagaccttttgacgtatagggctcgtaatacatttaaatgttaagtcttggctgggtgtggtggctcacgcctgtaatcccagcactttgggaggcccaggtgggaagatcacgaggtcaggagcttgagaccagcctggccaacatggggaaaccccatctctactaaaaatacgaaaattagccaggcgtgggggcaggttcctgtaatcccagctactcaggaggctgaggcaggagtatcgcttgaaaccgggaagtggaggttacagtgagctgagatcacatcgttgcagtccagcctgggtgacagagcaagactccgtctgaacaacaacaacaaaaaagttaagtctccatcccaaagtgaatatgggtcatatgttacatgagtttttgttcaatacgcatgtgtcaggaccactttcatgaatattcatagctcttcctgtaacctggtgaaaatgtaggtttagccaacctgttcagcctgaactacactccaagccctcctccttcaaagcgcctgtttctggaggcacgcttcccagcctgcaggatggccaccttgcaggccataaagtctccccttcttttctaaatttattcattgtggggctttttaatatatacatttttaaaagagagagagagacagagtctcgctttgttgcccgggctggtctcaaactcctaggctcaagctatccttctgcctcagcctcccaaagtgctgggattacaggcatgagccaccgcacccagcccattgttgggcttttttaagttaacgcttggtatatgttataaataccttctcccaggttgacacttgtcgtctttgtttacggtgatttgttctctagattttaatttcaatgtagtcaaatttatcaatctgttgttatgatagctgacttgtagctttcttaagaaatccttccctctcctgaggtcactaagattttcattttcattttcatagttttatagttttgtttttcacatctttttttttctatttggctattattggggtatagcaacactgtggatttttgtacagcaatcttgtaccaaaaaccttgttgaattctgttattctagtattttgtctgtgccaggaacagtggtacacacctgtaatcccagcttcttgagaggctgaggcaggaggattgcttgaacccaggtgttcaaggctagcctgggcaatatagcaagattctgtctctaaaaaaaaaaatcatattatggtagatggaaactagtatgtgataaaataaaaatgactttaaaaaaatttgtctaaagttctttaggattttttatttagcagaacattatgcaaacaccaaccttttaaattctattttatttaatgttttaatttgtaaaataaacttagtatgaaaattttcaaacaaatacaagagatgatataataaatccctgtgttcctatcatccagcttcagcttaaacaatttgccattcttgttttatctatcctacctctcctctccacaacttttttcattttgttctgtgtttttcccagaatttttttttttttttgagacggagtctctctctgtcacccaggctggagtgcaatggcgtgagctcggctcactgcaacttctgcctcccacaatcaagcgattctcctgcctcagcctcccaagtagctggaattacaggtgcctgccaccatgcccagctaatttttgtatttttagtagagatagggtttcaccaagctggccaggctagtcttgaactcctgacctaaggtgatccacctgcctcggcctcccaaagtgctgggattacaggcgtgagccaccttgcccagccttcctggagtattttaaagcatatctagatatattatttcacccataaatacttcaatgtatatctctaagagacaaggccttttttttttttttgagatggagtcttgctctgtcgccaggctggagtgcagtggcgtgatcactgcaacctctgcctcctgggttcaagcgattcttctgcctcagcctcccgagtagctgggactacaggcgcgcgccaccacgcccagctactttttgtatttttttagtagagatggggtttcaccatgttggccaggatggtctcgatctcttgaccttgtgatccatccgtttcagcctcccaaaatgctgggattacaggcatgagccactgcacctagcctgccttttcttatttttaaaaaacatactgataatcccattatcatacccaacaaaattaataattccttaatatcatctgatacctgttccatgttcagttttctgtctcaaaaatgcccttccttccacagttagttaaaatcaggatccaacaagattgtcacattgcatttagttcacatgacaattccctctccatttcttcccccctgccatttgttgaagaatctaagtcattggtcctatagaatttcccacttcatgattctgctgattacatcttcatggtgatgcttaatttgttccagaaactgccagtgacatctagaggcttgattagtttttggttttttgtttgcttttgcaagaatacttcataggtacttccttgcatcatagcagaaggcatatacatactgtcccacttttagagatgtcgagatttattagtgagttcagatttttttcctacgtcttaaactgtttagccccttgttttactgcaatggttaggccctctaatacgatacagaaggtaggggctagacatcttttaacttacttctaaattttaatgtgaatgtttgaaaagttttaccactaaataagattttttcccatatatttttcacagctgctctgattaaggaagcttccttccactctagttaccaggcttttctttttaaatcattaaatgttggatgttatggaattctttttcttgaatctactcattcattttcaacttaaacccttggaatagaaatacaatttgaaaaagaaccttatgtctagagacaataccactctttggtctaggtaagaggagcccctaccctggaccgacactttagaagactttactctgacctctggctctgccccacaggataagaatccatactgccaacgtgatgtgcccagctagaacagatgcccccttctagaagtgcatctaacacccaaatagcccaaatagctccaagccggcttccagggcttgctctggcctcatacctcttacgagtgaaatgggctaatggtatacaccagggctgtagccagatcttatacatataggtgggggacccacatatatatatatgcaccaggctcttcatgatgcagaacaaatcaaggggtggggaaataaaggaggcacccagtgggcgggggccacctctccctgcattgccatgctttgtcatggaatctgataaaatcagagaattctgaattcaaacctggtctgacaggtcattatgaagggatatttgtcaagataatagaataaaacattttatttaacagatagctt

SEQ ID NO: 515 - DNA, 1456 bp, Homo Sapiens
ctggaggggctctgctcggccctcaaagatggacaaaatgttggaatcaagcacattcctgcaatccagtatgacatttggattcaaaccagcaatgaggtcattttgcttcaccaaattatcctgtctcatatccaccaaacaaggagcgtatctacattttggacgctgctccacgtgaaagaatcgagcttcgatgaacattattatatagagccatcatttgagtgtcggtttgatcccttggaagttccagatgggccatttggtttctctccccttatagattattactgcggcatgaaaaaccctccattaatcagatcaacagggagattcatgtggattaagtttagttctgatgaaaagaactaatattcatttattccagatccagactttacttacctaggagattgtgggtttcagctcttgggagccgatggaatagtgcactctagtcaggtacaacaagaagagaaaacaaaacctggccaagccgttgattgcatctggaccatgaaagccactccaaaagctaggatttgaggttcctagattatccaatggagcactcaaatgaatccaagagagacattgttgcagtctacgatgaaagcagttctattgaaaacctgaaggccaagtttcgcagcactgtggccaatgatggaatgcttaaaacaggaataggcgtgatacaaatgtgggcagatgaaggtagtcggcttagctcaaattctctttacttcctttgttgagccctgcacaggcagcactgtcttttgccatagcaacatgtgcatcaataatcctttagtctgtaatggtgtccaaaattgtgtatacccttgggatgaaaatcattgtaaagaaaagagaaaaggcaggactatctgaacaaatcactgaaactcatgggacagttattggcattacttcagagattgtcttggtctttctcattatttctgttttagtacaagtgaaacagcctcaagaaaaggtcatggcttgcaaaactgcttttcataaaaccgggttccaagaaatgtttgatcctccttattatgaactgttttcgctaagggacaaagacatttctgcagatctggcagacttgtcagaagaactgaacaaccactagaagacgcggcactcctccaccacctcccagtgcatccatgaccaccactgtgggtcgctgacctccagcgtcaaacaaagcaggaccaacctcagttccacggagcttcctttccaaaatgactttgcacaaccacagccaatgaaaacatttaatagcaccttcaagaaaagtagttacactttcaaacggggacacaagtgccctgaacagcccctagaagatcaagtaatggaggagattccttgtgaaatttatgtcggggggagagaagattctgcataagcattcatatccattgaattctaa

SEQ ID NO: 516 - DNA, 4622 bp, Homo Sapiens
cattttgtttactcattcatctgtcaatggacatgggttgtttccacctcttggctatcgtgaataacactgctataaacatggcaggtaagcagctgttcgagcccctgctttcagttcttttgagtatcctgagctcccgggttcacgccattctcctgcctcagcctcccaagtagctgggactacaggcgcccgccaccacacctggctaattttttgtatttttagtagagacggggtttcaccatgttagccaggatggtcttgatctcctgacctcatgatctgctcttggctttccactgcatttagaatgcaatcggtctccttctctggttactagctacctccaaaccacctctcagcacttccctgctggctccctgagcaacccctagggctcctttctcttcagaggcaccaagctcctgcccagctctccctcccagccctgaccatcgcagcacaaagaggtcttccctgactgcctgagctatccgccagaggtcacctttaaactgtccgttgtggaaacctctggaaacaaatgcttacacctgtgaggacagctttccactgtgcctccctgtgtccccctcccttactcaactcatctgaccctcttcctcccagctcaagccccgcctcctcctccaagaagcccacccagcctgtgggttccctctcagcccacagtgcttcctccctccttggagtcccctgaacccccaagccagagctgcctggcttgtctcagcatggtccccgtctgctgaccccagatttgcctggacgacctctccaacagacttgcgctcggttgaaacttcctcactggtctgtgcacaccatggaatgttattctgctttaggaaggaaatccgtcaaaagcccccgcgggatgtgggtggggaaatagccactacagtccggagtctccccaccctcacatggtgggaggggccgaggatccctccgggtctcttttataagtccatcaatcccattcaggaggactctgccccaccacctgtttgtattgtctcccaaaggccccacctcctaagactatcactttgggggtcaggatgtcaacatgtgactttgtggaaaagggggtgcggcatgaacattcagtccgttgcactgcagtagtcagactcgtggagacaggaggtagaatggtggtgacgggctgcaggaagggggaatggggagctagtgtttcctggggacagagtttcagttttgcaagatgaaatgttctgaatatggatggtggtgacggctgtgcaccattgtgagtatacttaatgccacactgaactgcacacttaaaaatgtttaagggctgggtgcggtggctcacgcctgtaatcccaacactctgggaggctggggctgggggtggatcacttgaggtcaggagtttgggaccagcctggtcaacatggtgaaaccccgtctctactaaaaatacaaaaattagctgggtgtggtggcacaagcctgtaatcctggctactgcggaagctgaggcacgagaatcacttgaacccaagaggcggaggttgcaatgaggtgagattgcaccacagcactccagcctgggcaacataatgagactccatctcaaaaaaaaaaaaaaaaaagttaagatggtagattttatgttatgtgtattttaacacaataaaaaatcaaaggtagctaattcccattctgccccaatttcagagaaacacgtgggcgaagacagggaggggtgactgtcggtgctgcccgggccctgctgccttccagatctctggcaccagggctctttctagctccctccccagaagaggacatcagcgacttgcacaggccccttcctgggcctgcctgaactgctgggggcaatggttgtggagagaacccagtgtgtgggcagagagcaggcagcgtgcccccttcccattctgctccagcatatcactcttgttgcaacacaggatgagtgttcccacattttgtttaatattcacacgctatagagtgcttcctccagctcctcagtcttcaggacagcctggactccgggactggtggtgagaagcagcagaaataacaagcatccctggcccagctcgctggcccctggttgctttagggagtcctgtgccttctctgagcaggaagtccctcattgaaaatgagagggttggacaagacgatccctgagaagccttggagtgccagctttctgagaactggcctggcacaaatgccccatttagtacacacgaagccaaaacagagaggaacagggccccagcaggaggagtcagcgagccggcccagagcacgcttcttagaaaaggacacgctcagggacaagggcaccatgaccttcccaaaggcacaaagggcacagggctctgcatctcctgtttgttcccggtagaacatctcgctgtcccgggagaatatatgaggagtgcataaatatacagccccgcactgcttcctgggctcttgtgtgattccagggcctgttctccagcagctgtgagcacccacccagaccccactggcctggggacggccattgagccagtcccacctgtgagcccttcagcgattctctggcccccagccccacctgtctgtccacttttcctggcaggctggttaggggataaagcagatgcacgggacactttacttgcccctttcccgtccaccccagttcaaccctccaggttaccctccggcagcagagccacccctgcccaggacgcgcactgccttccattaggcaacagtttcatgaggcatttgccgtcctcaagaggctgacgtgacagtgcctgattcacagaggcttccctctgacccaggtctagctggctccccagtgggacaccccagggcctttcctggcccagatctgccgctctgggctgtcctgagtgaggaacacctgaataagccacaacatcaaggaaaggaccatgaggatgggagcacccgggagcaagcccctccctgagccttggaaaccccgtgactcctattttccatgtcattttctccatcatggaatgaacacttagaaactggaagctcgtgagcagaatgattctgtcctagagcctgaaggcgtgcatcagggctgggtccttccctgcagcatagcttctaaaccaacgattgatatcttcatttaccagcacgataaaaaaggaattcgttttcttagaagctgtgcctgtcactctgctcagaaacagtccaagcagccgttccaagtgtggccttcagcccatgccaaacttagatcaactgcaggcttggagctttctgaggcgagaatggaagtatgtgtgctgcagtggtgtgtgtgggtgtgcactcgtgtttgtaggtagcatttacacacacccaccgtgggcatgtacatgtgtctccctgtgccagtatgctgagagcttcaggacatggcaggcactccacatgcaggggatggaaaagccatcacatttattgtctgtccttgtgcggtatttaaaatacaactgagaatgtgtgcagatttttaaatgttactggaccacttgggttttttttgagaccgggctgactctgagccagactgcatctgtctgcgttgaaagggaccattctttccctcctgctcccgccctgccccctccacacacaccctccttcatgtgaaacccgagcatttcctttcccgtaagccttcttctagaagcctgtgctcagcacaggggccaagccctgcggctcaggcaggcccacgtgactcttgaactgcagactcaagtcccaaggtgggaaaccgtttgtcaacggcccccagatttacaaccacgaggccaggctggtcttggggtgcaaagccattgttcaaaccatcagtcatgcaaggagttcctaggattttttattttcccctccaaaaagctctcttcagctttgaagaaatgctgtttcctcctctggttacttctgcctgatgagaatgctgatctggggatccaagtaaagggtggaccacagagcaccttgtctctgtgtaaaaggacacccctgttactcagcgtgcctgaaagtgcctgagtgtttcccagtcctcatcagtgtaatcttaagctagaagttccccttgggcaatgcatcaggtcttccactttttttccaatagacaccatgggccatacttcctaaaatacatgtttctaaatcttctactttttttgaaaaacaattttgaatcattaaagaaatttttgaaaatagctttctataacccacaacacctctttgtgaaccccatgattttcatttgttgaaattttccgattctgaccatgggaatgtgtgtcttaccaaatttcaaccagacatccagtgtttccacctaacatgccatttaaagccacttccatattcaattcagtctgcgcaattctagttccaaacgctcggtttctgttccattcagagaatgtgctgagatttcttctgtcattcccttattcctggacatttaggtgcaacaagtgtagacgggttgttttttccactgaatcatttccttcagatgaatt

SEQ ID NO: 517 - DNA, 3210 bp, Homo Sapiens
ctcattttttctcttgctgccaccatgtgagaagtgcatttcacctcctgccgtgaatgtgaggcctcctcagccatgtggaactgtaagtccagtgaaacctctttttcttctcagtctcgggtctttatcagcagcgtgaaagcggactaatacactggtcatcctgataaggttttagggagcccgatcttttcataatgtaaagcagaagacaccttctaatgagaggctgagtaggataacactagtgggagtttggagatcttatgttaaggattcccctgacctctacaacaagtttggttgtctcatattctctccagttccttaggccagctcaagttttatcagtatcttttggacccaatgagtccttcctggcctcactccagaagaagactggcctcagtccagagaaacaaaaaatgtgaaattcacccactggaactctccttctccaagtatcagtctccttccagaatttccggcttctggtctcttttcaaggaatttagaagcttctgggagccttctgcattccgtggtttgggtccctttcctccatcttcaaaaccagtctaacagcattttcatatctctatgatactaatttcctcttttttgaggcataaacatattttcattgaaaatcgtgaagaattgagaaggaaaggagtctgaaattttaaatggtgagattctacaagtcatcaggttctttcttgctggctaagccctaacctctggaattcataatcggaggacctcataaggattatggaaacagaatttcatggtaaaataagtggaagtgctaaattctcaaggaaacattaacctttaacagtggttgcttctaaagttccaaacataaggttataattctgagaggaatagaaggaagaaaaacttttgtccctaaattttccacttttctcctcgttctcttgtccacaccatatggctagacatgaccactttgaaatgaaggtgatgttgtctttcttggattccatttcccacatgttgaactcatttggtgcaactaaatgctgcatgcagagacttaatgaatactttggatgattatgatgacaaggcactaacatggcagactgaattttccctcatgggagaagaatcagatactgtataatggattgaaatgcttaagttcatggccagcttcaaaagtaagctgaaggaaggactacttttcaaatgaagaagctaattatttgtgctcgattagatgatgtgggaaatagtgtttctagtttcacttttaaatatcaacaagcaagtcaactgattatagattacgagttgctctttagaaatctggacaaaatgatattccttgtcattgccaatagctcttgtttgcacaaggttcatttatcatctcttcttgttttcaggtttgagcatgagtcattgtggtaaggttcttgtatgtggctgatcatattgaatgctaattcagaacatattgtacaatagacataccaaacttcaataatgattaattttatttagtctattgcttgaattacttgtaaaatatggtttattgttctttaaaagatcaaatattctatcgaaatccaaaccacattaatcatctgtttctaaatactatatatccatgctttgtgtaaatacaacttgatatctaaagctattaaactaaattttaaaattcctattttatgtctgatataaatcagcagtgcaaactcaaaaatgcattcacataagccattttttagatgcctctcattttattgaatatcactcttttatgtctattgaaacccttttttgttgttggcatttaaaaatatactttcattctgagaacacgtcttagttctagatacttgaggtcagataatatgatagcacaagagctttaaaaaattttcgcaaactagttaatctctgagtagcttgtcctgtttttttcctcagttatgattaaatatttatggcctctatcactcacttgctcctgaacagatttttccttattgatataaaatgtcctcatattttgcctatatgtgctccatatgtcagctacatattgaatcacaaatactcattagctttctttgtgtattactcagagcaagaagatgaaacatatgactagggcaaaactcatgaacactccagtaattatcataaaaggcacattcttcacgagtagctgattattgtatacaaatttctacttgcaaaatagaaattaactatgctttgttattttatttttagaattaatccttcttaaatgtattagagtgaaacattaatagaattatgtcagaggataattttgcataagatattgaggcattataccagtacagaaaggttagaaagtatattgactacttttagacttttgtcttatgtatattataatttactatgtcagacatagcaaatttttttctgaaggaactcttggaatggaaatgatcttaaaagacctgaaaaaaaaaatgcttctttgctgggtttaggtcaaaagtcatcatctgggagcaccatgaaattcaaaccaaggaagggaattttcccagtaatggtcccagcaaaatgggtggtcttatgccagaataatgtgtttagaatgactatgtgcactctttaaaagttaggataataaagaagtgggtcaaccagtacactcattatttacaactggaatgataatgtagcagcaaaagctcctacgagaatgtattgaaagactattatacttcaacccctgtacatatctccttccatatgatttcttattgtcacaattctattacattgtagaaataaaatctgagcaatattttgaacctcattgataatgtatagaagggatgaactctttctacccgataatattttttaaactttaccacttggtgattagaataacatcaacaacaaataaataatatagaataaaactcaagcaaacactgagtagaatagagaagcattattagatatagggatagattatggtaaaagaatagttgcttccagataaagttgaggctttctgaagcatttttaaaaatctggtcaatttggctgctgttccaagtcccaatcacaccacaccgtaagaagacaacttattcaagcctcgaagaacattccatgctcatgggtaggaagaatcaatatcatgaa

SEQ ID NO: 518 - DNA, 4432 bp, Homo Sapiens
ccaaaagttgggagtcttatgactcttaaggccctgttccggttgctatggctacataacaaacccctccagactgagtgctttacatcttactatgctcatgggctccacgatcaggaatttggaaagtgcacagaaaagatgggctgtctctgctccctgatccctggacctcagctgggaaaactgaaaaacagggaaggttggaatcatctgactcccatctggactgaatctggcagccaacatggatgttggctgggacctcggtgaggactgctggcaggaacacctacacgtggccttttcctttggctgctggccttgctcacagaatggtgaccgggttccaagtgtgaacccaggtacaggaagagacaggaaacggaaactgccagtttccttaaaatctgggcccactaactagcatggcatcatttctatcatcttctattagtcaagcatcacaaagcccatattcaagaggagacaacctagacccagcctctcaataaacagtgtcaaaggctttagagagcatggtgtcaagctcccagattctaaggctgtgactcaacccagtgcactgggctgcctggctgtacacaggtgtccatattgatgcaaagcccccaagctgctcttatcctcttgtgaagcacccttagcttggttagtatttaaataattcaggaatctttcccctcctggattttgagagacctccacatcttctcctcagttctcccactctgttccctcatcccacaaaacaggctcctttccccagaactattctacctgaatacaggcgaaagatcgctcaatgagttagccttcccccacaccccagctctgactccccgagggctacctttccaaaaggagactcaacccaatttcttatagctttcatctgggaggggcaggtgggggcggggagggagaatgaaaggggcgaggtggtcttggatgagtgacctgattgcagggagtcacggctttttctgcacacatcactagctggatggctgtgtctgacctaggagaccacagtgagaacctgtcactaaagcaggtgcccatgatgggaagaactggaaattttatctaaagagagaggctgaagcattccttaaaccacagaagaaaacagtgaaagtacaaaatgacaacagccgtcttcaaatactgcttgtcagagggacaagagagaacagaggtgctgtgctgctccacaaggcaaaacaagagcaaacaagtctgtctgagtttcaagaggctggccctgaggctgcactgtggcagtctaggtgaggatacaactagaagccagcagtctacaggctggaagaaggccctcaccagaacccaacccttggacttcagcctccagaactattcattcagcttttccagaccaggcatcaccgagcggagagaggggaaacaccctggcttctctttggcacatcagcccctagttcttgagagagaagggcagggtggtctactcaccatgtctgtatcctgccgttcttcatttgactcatcctggatttctaactcttcttcctcgtcctcttccataaggctgagtctgatgtaggggcaaagagactggcttttcaaactgttctttgaggacccctgagagtttctcagacacccggggtgggggaagtggggagcagtaagtacagcatagtagtttcccgattgtgctgacaggaagtgctctgtggctaaaacaagtccaaaaagcacccacagagaggcaatgggtgagacaggaatcccctcacagtgggcgacagatctgaagtgaagacaggagatgatgagaaaagctcaccgcatcagctggttgcccaggccaggacctgaagggttgtgtggagtctggaaatattgtggacccaagaaccttgacctctcggtgcctgcgacgggctgactgctgggaatgaagcaggatcaatgatgggataaaaatcaagggtaagaagaggatgtaaggcagctggtgttaatggggagaaaagctcagagagatgcattttaaagctaaacaatggagaagggtttgagaagaacccaacaatgtgggagtgctacagcagggaaccatgaaacagaaacagcaagatggaggcagccagacaccaaactgggaactcagacacccagattccctccatggcctcacccctgggcaaaatccaactctgagccatcttcttcctccatctctttcaacccccacaggggctgcctgctcttcacagctgtggaggtgagggtgggcgtgggcgggatgctgttcagctgcagactttcttcctgggacgaggagacgtcctctctgttaggcttggcaggccctgccaagcagatgcatacattaaccacagcccagggcctgcgacaggtgtgctctctttccaagacctgcccaggatttagtaagggaaagtcaatcaggaagagaatggaaaacttatacagcttcattctgttgccctcaaatgggcatagccctatgtactaaatacatagccctatgtaccaaaaagtaaggcttagagaattgtagctaggccttgtccaagaagaacttgctacacagcctagaaaacaagatggaaagatatataaatatacatttcacagataaactgtaacaggtgaacaggtgaacacaaacatgagggagggttggagtctctaagattgagaggtctgagttagccaatgaagacatctgagatcctatccaagatttctgtggtcagaaaaagctgtaaatggcaatagagttttggtaccagaggctagagtggacaaatgagggccagggaggaaccggaaaatgggagacaggattttctaaaagctagaaaaaaatgaagtgattgcaatgccagtataactgatatgatatgaagggggacttatctcctgcagagattggagaaggtagaggaggagaaagaatccaaagattctcactgcctgagaaaacccaggcaatactattttaaagcatcagtcaaattgacattaacatctgttaactgtaaacagtcacactcccattaccccccttctccactaaaaacaataatcccaaagtgagcgctcagcctatgggtttaagcagagggctacagaaaacagggaagagacatacccctgggcttggattcccagagaggaaaccttggggccccagatgtgtcctcctgatctccctgagctattaatggtgtgatgcccgagggctgggcccttgagtctctcctcttctccatcttcactggcttccccagccactcacgttcatgtccttaaatatcacctatactctgccacatcccaaagggatctcaagccttcagctctcccctgaactccatcttaacagcccccatggtttgttcaacatctccacctgtaatcctgtggccaacaccaatgccccaaccttcccccacagctatcttcactctctgccttccccatctcagatactgtcaactccatccttctgtcaggccaaaatccttggagccatcctcaactgctctttttgtcttacatcccacatccagtttgtcagaaaagcctattagagataccttgaaaatgcacccagaatctggccgtttctcggcacctccaccattgcccccggcctaagaagctctcttatcttgcatcttgggctggactcctacaacagccacaacctccctgctggtctcccagcttctagccttcccccatctcctgtcgttttcgacacagcagccagaaggatcctttaaaaacagaggttgatcctgtcgttcctcaaaatcctccaatggttttcctactgcactcagagtaaaagccagtctctgccttagatgctctgggatcctgtaccctctttggtctcatgtcctacaatctgcattctggccataatggtcttctctgctgttccttgaacattccaggaacattccccccatcccctcgtggcctcaggactggctgcttcctttggtatgctattctgatacacactaagcaccctccctcacctgttataaaaaattcgctgggaggccaataggctgaaatggctcctgcactttgggttcctaagtcagcaaactgaaactcaactcagagtgaaagtgttgtgtgtaacctaggagcaggaaacttcagcttaaccagtcagaaactaccgactaacctctaacaagagatttatggtcagttaacctctaaatatgaactttccactctaaccaatcaaatagtttctttgtcttgctcccagagacaccttgtaagtgtcccctctggtttcctcggtggtggcgccctgaactgctggcggtctgccactgcctgattgataaaattgctgaat

SEQ ID NO: 519 - DNA, 16176 bp, Homo Sapiens
ttggggatattatataaatcctcaagtggggtcatggggatcaaaatgcttgggatttattgctatacaggaaaaaaagtgtattttctgtttaattcttcaaaaaggtcacacatgggatctcagcaggtttagtaaatcatatatcctgggggaggaacccagatggtgtggagctactgacctagcacagagactgaggcatgctgctggaggcataaagcttggctggcctctgtgggcttgggttgtggctgtgtcacggtctaccactttgccatttgtctctgtggatcctgaaagctgcagataaaaattttaaaggcttagctgcctgtaatttaagaaagaacttggttagaagtcagatcaagtgaaagaaaatgaaatgtcattgcacaaaaggaaaatgaccaatctggtggaaatggagcattttttaaaatagttttttgtttgtttgttttccattagttatttttatctactttttgtcttagcttttgacgccaatacttctttttttggctgaaatctagtaacttttaatgtttaggacaaaaagaagacagctaatctgagaccaatgaaagaaaggaatgcagaagcctgatgcctgggcatcatcagctatgcagtagcatttcctccttgggaaaaatattgacagtttgaaggagacttgagatgttaacataattacttaagacaaaggctgagcagggagagagagtggtcatttcaaattatatggtcaaaaataggtaaatcaaagttacatgctttcaatttgatgtatgtgcttttcattttggtttatgattcagaccacttacagttgatctctgtagaagtgcttttaagtcaaagtttcaaaaatgttagggaatagtgctttttagttattttttagtataataaaaaaaattccttgcttctatgtgtgactatgcactttacgtatcaaaaagtaatcttaaaaattcccagagttgagtctatttattaactcttgttgagatagtttctgggtttggatttaaagtctaaaatgtgaaactttatgaaaagtagagcccagggccaggtgtcgtggttcagatctgtaatccaagcactttggaaggccaaggtgggagctttgcttgagctcaagagtttgagaccactctgggcaacatagtgagactccatctctacaaaaaataaaaataaaaaaaaacttagccagttatggtagtgtgcacgtgtagtcttagccacttgggaagctggggtgggaggatcacctgagcctaggagttcaaggctgtagagaggtatgattgtgccactgtactccaaactggatgaaagagcaagagccaaaaaaaaaaaaaaaaaaaaaaaaaaaaatgctcagctctagaactgactatagtaataaaaagaagacattctttagtgacataaaacttgggtgttatatcttacattggctattattcttacgtgcaacaacataacaatgagaaaaacaagccagatacaaaaaagtatgtattgtttgattcccatttatataaacttaaaaatgggcaaaactaatctatggtgttgaaagtcagaattgtggtgtacctcagggagaggtaaacactgagaaggggcaccatggggtctgccagcttctggtagtgtgccagttcctaatctagggactgataacttgagtgtgttcattttgtgttcatcatactcttcacctaatcatttgtacacttttctgtaacctttatgttacattttaaaagaagttaaagagttatgttatagaacttaatgtgcattctttagaaaaattttatcctaaagaaatgtaaatttatagtcagttctagagcttatgatgtgtctttttgaaagtttgacctgcacctgtaccctaaaacttaaagtataataataataaaaaaaaagaaaaaaaagaaatgcagaaaatgatttgacaaaaaaaaaaaaagtttgacctaatcttaatcatggcagatttgggaatgctaatgtttatatatatactttcataattacaccaaaattgatgaatctttctctgggagctatccattgatgttccttgtaattagcaacctgcttctgtttccgaaattgtattttcaatcatataagtgtgttcaaaggcctcagcggggaccagaattagctacaatttatattcagttcagaacatagaattcgtttctcaaatttctcattagcttggcagtttataaacttggatgtgtgtatgtgagttttaggaatctgaggattggacaaaaaagagagacagagaatattaaggcagtaaagaagagtttggaagagtagagataagtagaaataatgacattagaaggcagaagtcttcagatagtcattcagaagcaagatgatgaaatactcttttggccagacacatcatacttactcaacctttgtatttagcttcaattgttggttgaatggactcagctgttcacactgtagaagtagtggtagtggtagtagcataaggagtgtagattttgctttaaatatcactcatttaaaatacttttgttctttgccaggtgatatgatatgatatgatatacatgtcacatttcttgtcatgcatgaacctaccctttagttggagaaacaaggcatttggaggtgaaatgttcaaatgaaaatatatgtacaagataagtggtgtaaatacacacacagtaacagtaacaatatttgatacattttgcatttgtttgtatgccagccaaataataaagaccagctttctaacagaaaaatgacaaaggactggattggacagtctgtgaggagcgatatataaatcaccaatacatacatgaaaatatgttcagtatcactggtaatcaaaggatcacaaattaaaatttcacctatcaaattggccaaattgagaaaaactgataatagccaatgttggttaagttttaaggaaatcaggagtggcaatgggcataatctttccaatgggaaattaagcgatgcatgtcaaaatttaaaatctacatactctgtgaccaaaggcagatacagggtttgtggagcccaagcctatgcaactggggaagggagagagttcttttaaaaaaggatcccaaagttataaatacaaatttaggtatgacattaaatatttagttcgaatgagaaaaaatcacaacaaatttttatgaaattggtaaataccataaacatcacaaaatccatctctatgaggcaaacttgggaatcagtctggctccagggcatggctcttaacagctgtgctctgactgcctcagaatgtatcattcatctgtgtccattgactactacagaccaaaacacatttgcaacttcttgtcacctctgctgctagtgccttggtccaaacctccatcgtgtctctcttggatcatgggaacactctcctaactggtctctgtattttgcccttgaacagaatgcatgtattatgtttttaacattttttagtaattgactttctgacactcctctattttatttattatattattttggttactctttgattgccttttcatgtgacgatggttttgtactattttctacaaaaagacaggaaagataagtcctctatcatggtaggtggaaatctattttttattgttaatagttgcataaaacctgaaaattctcacgcacacaaatttgctatttgtagcactgccacaggtttgttgcatttgtaattgcatatactgcattattgaatatgtttctgacaggagagagccttcgtttagtctagccactgatggaaactgaatcctttgtttacaattttagatacctgatgattggaagaattttctacagactagcttgtggctctatacattttacatgctgtttctccttcactactcatatatttctggtgccaggcttggcaagaggtgttttcattgtgatgtgacctctgaccttgcagggtgagatggaatgaggggcagtaggaatattcctgcctttttttctagtctggaacagctatcaatacctatccctggaggtgaccccaaatccatataaaaaagccactaaaccaaaataaagtataattccaaagtcagtttgaccccccagattccaaaaatgtccatgtctccttcagtgcagtcaatttaaaggaatgtttgatgagaggaaaattgcagtggatggcaacagcagtcataacagatccagttgaaatattttatttttacaaattttacaaaagcagagccattgaacacatttcgaggatcccttttacgtcttggaagaagctttaggaaatgagggaccctgaaaattacacttaattaggcacttaatatatgtgcctctgtctatgacctggatacttctaagaatttatcataaggaaaatgtgcagtaaaaatcaataatagcaaacatttgttgaacgcttactgtacaccagacaccttgctaagaacttcattttgactttttataatgagcgttttatttttatatcttatttaaaaattccagagaacaatatccgtgtttaaatgggaattttagtttagacaatgtcaaaattatgttcatttttacttcatcttttcacttcaacttttatatggatttatgcagtttatacaacaactacatagtgaatgctaggcagtgttctagatgttgaaattcctgccttcatgaagcttatattctagttggacaagatactcaataaataagttaacaaataagataaataagtctgttatcgcatgttggatgggtataagtactaaggagaaacaagatagcaagcaaggaggtaagaaatatgtatgtgtatggagtgggggttgagattttagatggatcatttcacagagaaggtaatacttaagtaaagaccaggccaggtgcggtggctcatgcctgtaatcccagcactttgggaggctgaggtgggaggatcacctgaggtcaggagttcaagaccagcctggccaacatgagaaaccccatctctactaaaaatacaaaaattagttgggcgtgttggcaggcgcctgtaatccccacctactcaggaggctagggcaggcagaatggcttgaaccagggaggcggaggttgcagtgagccgagatcacgccattacactactccagtctgggcgacaaagtgagactctgactcaaaaaaaaaaaaaaaaaagaaaagaaaagaaaagccttctaactgtgtattctaggaaaactctagagttcaatattcaatatgctgaagggtcttcttatataattttaatgcctggattacattaggatggtagtaaagagaagctacaaccatcacatagctgatgcacttgtacctgatatgtactcttggtaaaggcaatatggtacctacaaaattactttagggtcatgttatatgtggtcttttactggatggcattggaatgaattaccatttgaggtaacagaattatctttcctagagttctttaaaaataggataaatactggcagagttgtgatgctttgatttaagccaatagaggtcagattttttgatatacataggtcttttgatttagtaagatgaatttattcagaattcaaagatcttttcaaaatacactctcctatatggaggcggtaggatctgaaccaggggaattacaaatggttttaacaggctgaaagaggggttttgaagtacattttccttcaaaaaaaaaaaaaaaaaagaatgaaaaaggaaaaaagggaaaaaataaccattttcctgtcaaaagagaaaaaagttaaagaaaaaaacctaccccaaacccctgaataacctacataatgtgggttttttttgtttgtattaaggagtgtttttaatatttaaaaaatacttttcaacaatggttctactgaaaaaataacagttttacatgacatatagatttataaaaattacatgttactgtgtttatagaaaaaaatggtggctgtgttttaaaaagacattgaagcaactcttgtgtgaaaatacacaggtggtgttgaaatagaaacaagcctaggcactagggttcctaaggtctgctttcatctcagcctctcatttgttatgttacatttcagggctatcattaatactgccattgtatcccatttttctttcatcttctcttttcaccccggaccctgtttgggggccaggagttcctttgagaatgtgaaggcggccctaaaagctctcctctaaataatgtgcaaatacacaacagatttgcatgtaagtttaggggtttcatggtttctggaaagcatctttggaccttagctgagtgtgcatgaattagaatgcattagtaagaacatggggctgcaaaatataccatatgaacaatagttagagcatttcactgtgatgagctagaaaaagaaaagcttgaggacaggtcgttaatgaactgtcacacatatctgaagagctgttatgtggaaggaagaagtttatttggggttgttttagagctaggtggtccaccactgtagccactggtcacatgtgactatttaaatgaaaattaaataaaataaaaaattcagctttccactcatagtaggcacatttcaagtgctcagtggtcacatggctgctgaattggactgttatatctttgtaagaagttctgttgggcagagctgctctgaagttttgaactttcaacagagtgaattatggcaaggcagatttcagctcatttctaacaaaactgttctattaattttaactgttcagtgccagagctgttgaactggctgcctcaaagaatagtaagctttctgtcatttgaagtactcagacagagactagattcctactttttggagtgatgtagaagagtttcctacccagaaccttagggtgtttaagtgggaagaagactcagcaattcaatgtttcttttactgcagatgaagacacagactcagagtcagacagttttgcccaaagacccacaactggttaatggcaaatgctagctgtcctcatgaatcctagcttagtacttttcccattccacccattggctaatgttttaacaacaaggtcctcgcggttcttgttgagcaacacatttccgcttctggcattcaccagcttttccacttattctctcccactcttctgcagtgaaaactacactgcagccaagctgaactggctatattgaaatacgttattctgattcctgcctctgcgtctttgctattgctttgccctttatcaaagtgacatttcttcacaaacttaattctacttattttctaacttctcctcaggtctcagaatattcaaacccataccatctcttctctttgctaaactaccttgttacaatgcactcagacatttatactctctgtgatgattatattttgtcttatccctttgatgagcttcttaaagactgtgattactattttcatgcatatatcctttttctgtctccctcactagaatataagttcctcaagggcagggactatagctgtctttttcaccataccttactatccagttgctatccagcaagtgtcttagcaccataataggtgctcaacaaatatttattgaatgagtgaatcaatttttctcttcccaagcatgctattattctccttaagtttgccatgaattctcaataaatacttttctaagcaaacatttctgtttctataaagtaagtattgaaaataggaatatgaaaaaaacaaagtaaggcactccagcatgtaaagtgcttgggagtcctcactcccttccaaacctgagcaagtaaaacttggtaagttttcctggaactgtcagcaatctcagggcaaatcacttgccaccccaaaatctgaagaaataggtacattcagacagtcacagctaagatttgcttacctacagcagaagcaactggaaccatagactagaagggccatttaaatagtaattttgatgaattgctggaggctaagtgttgactagcttgagagtggaactcctaggcgcaggagtctgagaaagggtctcacacgtacatggattttacctcccggaaacccgtcaggttttcacagcaaagagccaagatagaccctgtcctggctctggcaaagggaaggggaaagtaatgactttgaagtgcgctcagaatgttctctatgataaagacttactctccaaggaaaagggctttaccagagtcttatcccatctggggagaagatagttctctgactcgaggcacctctagattcctgtgtcaactaaggaaggaggaaaaaggttaagaaacatttgtaaaggtcacagtacagcaacataggcccaccaaaagattgagatgtaatcctaagaaaatggaatgtttcccttccccactccttaccaccacagcaacagggctccttataataacagtggattacagctgaaagagctgcaagatgcagacagacactggctggccaaggagagggggtctcaggaaagtccaaagacaacaggagagatgaaaaaaaaaaaaaaaaaagacactagaggactttgaaacctctgacaaccacatttatagcaaacattatatacaacccaatcttagacagataagcctcaagctgaagtcctttttgcctcatttcctgttatctgatacatcatgtctagctttcaacagaaaattacacagatgaggctgggcacatggctcatgcctataattctagcactttgggaagccaaggtggacagatgacttgaggctagaagttcaagagcatcctgggcaacatggtaaaaccccatctatacaaaaaataagaagattagcctggcatggtggtgcatggctgtagtcccagctacttaggaggctgaggtgggaggatcacttgagcccaggaggtcaagactgcagtaagctgtgatcacatcattgcattccagcttgggcaacagagtaagtaagaccctgtctcaacaaagcatgctaacaggcaaggaaaaacagcctgtagatacaaagcaagcgtcagaaccagactcagatgtgacgcagattttggaattatcacacagggaatttcggtagctatgattcatatgttaagggctctaatagaaaaagtagataacatgcaagaacagaggggtgatgtaagtggagcgatgaaagagctaagaaaagatcaaaaggaaaagctagacattagaaacacagtaacagaaatgaagaatgcctctgaagggtcactcagaagacttaacacgatttttaaaagtctcagtaatcttgaagataggtcaatagaaacttcccaaactgaaatgcaaaaataaaagaatgggaaaaaaaagagccaggcatggtggctcacacctgtgatcccagcactttgggaggccgaggcaggaggattgcttgagcccaagagttccagaccagcctgggcaacatagtgagaccctgtttctaaaaaaataaaaaaaattagccaggcgtggtggcatatgcccgtggtcccagctacttgagatggtaaaaggctaaggtgggaggattgggaggatcacttgaccctgggaggtggaggctgcagttagctattaactgcactctggctgcttgatagagtgagactgtgtctcaaaaaccaaccaaacaaacaacagaagatgcaagaactcagaactttggcacaatttcaaaaggtgaaacatacatatacaggtaattggaagatcagaaggagaaataagaatggaacaagagaaatatttgaagtaataatgactgataattttccaaaattaatgacagacatctaacctaaattcagatccaggaagctcagagaacacaaagtagaataaattccacaaagtctatacttagatatatgacattcaacttcggaatgtgaaaaaatcttgaaagaagccctggggttgtggggatcaccatatctatagagaaacaagaataagaattacagtggacttctcatcataaactatgcaagtgaagaaaaatacttaaagagttgaaagaaaaataaaccctcatcaactttgaattctaaatccataaaaattatccttcacatgtgaaggagaaataaagactttctcacataagcaaaaccgaggggatttattattagcacagcatacctattctttataaaatgttaaaagaagttcttcagagaaaagaataatgatagttcagcaacttagatcaacattaaggaaagaacatcagagaaggaataaatttaaggtaaagtaaaatcttttgcttttctcattaattgagctaaaagaaaactttgtttaaactaataattgtaacggtgtattagataattatagcatatggttaagtgaaatgaatgacaacaatgtcataagagattggagggaggaattggaaatactttaagttatctgaactacacatgaaatggcatagtattagttgaaactgaacttagattagtttaaaatgcatattgcaaactctagaaccaccactaaaaaagttaaaagaaatataattgagatgctcagagagtagataacatgttatataaaacgctcaattaaaacgggagaaagaagaacaagaggggagaattaaagcaagagaaggcaaaataagaaaaaaatatataaaacataggaaacctagagtcgtaggcaaatccttattgtctacaagaagcccactttaaatataaagcatcaagttaagagtaaagggatggagaattatacagtatgttaacaccaatcaaaagaaagctggagtcactatcttaattttagacaaagcagacttcagtacaagggaaattatcagggataaatagggacattaagactgataaaagtatcagttctccaggaagacataatcataaaaacatatgcaccaaacaacagagaatcagaatacatgaggcaaaaactgatgaacttgcaaagaggcacaatttcaaaataacaaattgactattgtagctgtggacttcaacacccctctttcactagttgatagatcaagccagcagaaaatcagtaaggacgtagttgacttgaatagcattatcagtcagcttgatctaattgacatgtataaaacactccatccaacaatagcagaatccacattttcaagcttgcatggaaattcaccaagatagatcacatcctgggccataaaacataccttaacaaattttaaagaatagaaattatacaaagtatgtactcagactgcagtgaaattaaactataagtcaataacagaaagatatttggaaaatgccaaaatatttacagattaaacagcacccttcacaataacacatgactgaagaggtcacaagataaatttaagagtattttgaatagcctgtagtctcagctacttgggaggctgaggcaggaggatttcttgagcccaggagtttgagtctagcctgaacaacatagtgagacccaggcacttgaaaaattttttgaataaaataaaatttaaaatataacttataaaaaattgtgagtttaactcctgtcttgccatatactagcagtagcagtacaactgtgaataacatacttaaatggctgtgcttattttcgtaaaataattttagtatttaaaacttcacctaaaataagttctaatgttctattgcatagtatggtgactagagttaacaataacatgttgcatatattttgaagtagctagaaagaaatgacacatatttgaggtgatagatatgctaattaccctggttttattgttacacaatgtatacatgtatcaaaacatcacactgtaccacataaatgtgtacagttattatttgtcaattaaaagcaaaataaaacaaaaacaaacacaaaaaattgtgggatgcaaggaaagcaatgcttagagaacaactgataccactaaatgcttacattagaaaagaagaaacaatgaaacaacaaaaatatctttcaataggtaaatgaataaacaaattgtggtgtatctatacaaaaaataaataaatggaggagaagaagcagtatctcctacagaattccaaacaattgatgcagatacttcactctcaagaaagtggtaattttccactccttaaagtgtaggttatgcatagtgactttgtttcagagtatagtgtggaaagggcaaggaagcgactttatggtagttactcacagccagatgatcaagacatcagcagtgataagcactattgctattatgtatgatgtgataaagataacacttcacctctgtggtcttccttcccaaaatacataactccagtctcataatgagaaaaacgtcagacaaattttaattgatggcattttacaaagataaatactcctcaaatctgttaaggtcattaaaaccaacggaaatctcagaaattgttagagccaagaggaccgtaaggaaacatgacagctaatgaaatatgttttcttggatggggtcctagaacagaaaataatattaggtaaaatgaagacaattgaataaagtatggactttagttaataatgatgtatcaatattggtcctttagttgtagcaaatgtgcacttagaacgtgtagtaataggggaaactctctgggttgatataagtggagcgatgaaacaaataggtgaaactgtaatatttgtaatttttgcaatttttgtaatttttctataaatctaaaactgctgaaatacattttattttagaaaaatcaatgtaagtatacctactcatgtgttcatttgtagaattattagccgaaccattttttccagtttcaataatttctgctgaataaaacttttggtattcatgctactcagtttatttctggaatacagcaattctttgatttctccttataaatatatgcaagaacaacagtgtcctttagttgttagaatcttatatagtccatatattcttcagcacccatgttattcattgtctttttacaacctgctatttaaggacaaaatacatagagtcacaaatggaaagtaaagaagaaccatctctttcatctcctcctcattttgtcatcacagtgtgaagtgtcagtatggagaaggcattactttgaaagcagactgtctggcagaaactgcaaaactgcattttgcaatagtgtcatccaaactctggggaattctgttattcagaagcctctgtggttcattcatgcattaagaggatgagtcttgctgctttctcatctgacagaggagaatgttgccatgacagctgttaggaggtgaggagatgtgtaaagggcatccataatgaaaagagaaaatagcctggcttcttaggtctcactgatgatgcatggagtggcttgtgtggattctcaaaatgaaccttgaaaatccgttagtcccattttagtaataatatctcacacacacacacacacacacacacacacacacacacacacacacacaatgtttcttttccagtagcctaagaagcatgtagaaaaattaaacctcaactaaaaccccctcatagatacctccttttccatctttggagtgtagactgaagatctaccatattgaaggtttaaaacatttgttttgttagtgattattatgagggaaaatattttccaaaaaggcagaatctttttagaaaatgtcctaaaaccagaaaaggtgttagagagtaatcagagagcttaagtagatttcatctctttagtcccagagagtaaaatatattttctttatctaaagatgttgaaggagtatttactgattgaaggatatggtatcttgcattttcttcaaaataatatgggaatggggagttttttagggccacaggcaaaaaaaagattggtaatgaatcgattatagaatattattagggactgacttgtgccccctgcccctgctcccaaaattcatgttaaactaacccccagtacctcagaatgtgactgtatttgaagacagggtctttaaagaggtgcttaagttaaaaatgaagcctttagggtattctctaatttggtctgttatcctcatgagaagaggaaatttggacacacaaagagacaccagaaacatccgtgtaaagaggaaagaccatatgaggacatattgagaaggcattcatctgcacaccaagaaaagaggcctcagaggaaaccacccctgcctgccaatcccttgatcttaggcttatagcatccagaactgtgagaaaataaatttctgtggtttaagccaccagtctgtggtaatttgttatggcaaccagagcaaactcatacaaatacctatcacataatcggagtatgtgttatctactctctggggaaggtttagttgctttgggagcctcatgatggagagcaaaataagaactggggggatcagggaaaactggccgggagagggtaggtgttagcctggtgaaaagccagtgggaagagaactttaagtagaaggaggagaatgtacacaggcctgaatataggggcatggcatgcttgggaaagtaaaagtagctcaatagggatgaattctagggtgtgggtgaatgggggactagtgagattaggcattagggcagtaagcttttattaccattcatatgcacacccacacatcacacatctatacacacacatgtgtttatactcattttgtttactgtcagtatctctcctctagaacataagtcctttgatgccctttctgtctcttttgttaactggtatatttctggctacttagaatagtacctggcacacagaaggtattcaacaaaaaaattgctgaataaataaatgagtaaactgcatgatttattctttagaaaaatcactttggcagcactgcgggaaacatttggaatgtggcctcaagcaggactgttaggagattgttgcaatagtcccgctgaagttgacggtggaggtgtagatgagaagactcagctaacgggtgagttactcaggaggtagaactaagagaacttgtaatgtgattgtctatagggcttaaaggagaatggtcactcccaggttcctggtgtaggcactgacagaaagatagggttattttctgaggtaagaaacatacaaagaaaagtagactttgggtctgggttggaggtactgagttcagtgttggtcatgtttagcttcaggtagcagaatgacatccaaatcaagatgtctacttggtggtgactgagagggggctgtctaggctggatcttcaacttagacgtgaacctaaagctgtagaaatggatggtgttgttcaagtagaaggtgtagacgcagaagatgagaacaaggagtattgagagaagaaaatagaaacaggaaatcaaaataagcagtgaaaagtttactgcacttccaaaaaactcttgaattccttattgttatgtttgtcattacattacagaactttaaaacaaatatgtagttcagattctagctctgaagctgtagtcttggtaacttaacctccttattccttctttttcttcatctctaagatgggtccaattataatccctacctttattatagatatgttgtgagggctagatgaaatacatgtaaagcctttagtattagaatgtgcattcaataattgttcactcatttttaattattaagtttaaactttcattatttttatttatttatttttttgagacagcgtctcactcttgctcaggctggagtacagtggtgcaatcatggctcactgcagccttgacttgctgggctcaggtgatcctcccatctcagcctcccaagtagctgggactacaggtgcatgccaccacacctggctaatgtttttttttgtttgtttgtggaggtggggtcccaccatgttgctcacgctgatctcaaactctgggctcaagcagctcgcccaccttggcctcccaaagtgctaggattacatgtgtgagccactgtgcctggccta

SEQ ID NO: 520 - DNA, 2615 bp, Homo Sapiens
ttgaatctttgatacatatttgttgaggagcttgtcagatcactacctttcactgaacagtaaaacatggatcatttatttcacctcattttgcacttcaatgcaatttcactctttaggtggttgtacttggacagttaaatgaagactgtctttaagggtgcagggatggagaacacagcatatatgagaggtgggagggcagagacgccttgcgattcctgtgaggagggacttaccgtctcctccaaaacagaaattcagtgctgcagagacggtagcaaagtgcagttctcttgttaaaacacaggctaaaagcagtgactgcttaacttattaagcagagaaaaccaaaatgtcattttcaaccaaaattgagtgttagagtttatggtctctgttatgatacttttcaagacctgggaaatatttgtatcctttagtgaaaaggggaagaatcaattactgaaagccataagcttacagtaacggagccaattaatcctttgtcatctttgttgagtttagttttcttctgttcttagcacgtcagctagtagatctttgatgaactgttgctcctctttaaatgtttcttttattatattgatgatgtgcactcattcagtattcttattttaagctgcagtaatcactgtacatttgattgccatctgtacttcccttgaagcagctttgcttattacagccacacctgcatctgttttgactagcccacataacctacacatttttcatccaaagctatcccattaccttatttatgtccatttattttcatatatagtatctgccaaaatagtagcaaaagttttatcaatgtgtagatttcaatcagaaaaacctaagcaaaaggaaaaaaaagtgatattctaaaagccacacttcttttatcaccagtgcagttttttccatcatcataaacttagttttatgaaaatgttaatatcttggatttaaacattggggtagaaatcaggacaaaatttaaatgtcatatccaggacttaatctcagatattctggtagaagatatttagataaggttgtggctgcctgtcaagttttttaattttttaaattatataatgtcagaaaattaaatcacaaatgagccttccagattgtgaggaaaattacttggctgaaaatgactttgcataatgcccaaatcttgaagtatctgctcagatgtttgttccatctgaaatgctgccaaatccatctgtattgaggaaagagctatgaggtagtttcagagaaagtgaaaacaaaacaaagcaaaacaaaaatgctattacagaagttggacagcccaatgtgttaagtattatacacctggaacaagagcagcaaaactgaagctctttggaaagttatggcaacagtggtctgggaattctgggcctttagaaataatcattcccagtgatacagggatgtgcagcatccagacactgcttaatcacagtgagctgccgtcttccctgaataagttgtatcttataacattgaagtgaatgaaaatgtattagtatttgagaatttactattccttcacctccttgcacatgtaaattaaagatgttttggaaaatatgagaacttgatgttcactgccctagagcactattctccaaccttttagattcctgcaatctgttaataaaatattgtaggacaacaactctatagactgatacatgctgctctcaatccatatactacatattaggacagcttttcttttctaaatgagcatgaatataaatagaaattctagtattttcttcacctaccccagtgaatcatctttatattttacttgggaaactgctacagttggctagtgggtcttcacttttattgctttgagaaatggataaaagacatagactatcacccctccaaaaatgtgcatatggccccatacaagacacatgtactgccagagcttggggaactccctagaatctactcctagaccaccctagtgaagtaccatagaccatattgtctagatgggacaaaataataaattttgactaagaacttactgtttagagagaaaaaatagtaaataatgttcaaaatgagaagacaataactgacaagtctgtgatttttgggttagatgagaccacttttgatttttgaggaataaaaggagttagttttttggtcctgatgtgtaaaatgattcatggggtttcacatacagacaagtagttttcttttcagcaaatatttaacatatctctcaatatatttttcaccagtttttggtaaatatgcattgctataggtataccaagttttttttgttatgtttagtaactaatttcattttttctgtatatgtaaatatagctattggaccctgcattgaaaaccttcttagtactaacaacactccttttattattaccttcatagttactttaaatgacatatttatttcgagttttacttctggctgagttgcaaagtctatgagaatgttacctcctgtctcagaagcttgttagttattgtgccacctaaatattgtaataaaagtgtttaaataaaaatcttcttaaaatttaaaatga

SEQ ID NO: 521 - DNA, 8209 bp, Homo Sapiens
tacattctttgagcctggtggagcacgtttgctgaggtgatgtggtctcctcagtgtcactgtgaagagctcagtcaggaaaagccagcagcatctaccctgccaccctccaaaccttctgactttggggagactccagtcccccaggtctttacccagcctgcagatctcattctagcttaacaagggcatgcgtgtgcatgaagttgaactaagagtggaggaaggccagaggtagggttgggtgtgatactaggtagcagatattacagacttctgaatgcattcagatttccaaagggtttcctgagacctctcaaccaatctttctaggacaatagctagtgtaggggtctcctgactcaataggggacccaggccttcagataccagccactcactggctgctctgtgacgtgctatcttaagaccgtgaatggaagacaagccctatgtaaacacaaatcttaaagccactgttggctactcgagggcctccttgtgctaatatcttttgttggatattatttcaaaatatgtgaattttagacccttttgtggttgcctttgctgccgcttgttaagggcaaaataaaaacgcaagaaattcttttagcatgaagaaatacatttaatgagctccagaactcaaaataaatggcttcagctccttgaacagtcatctgtatgccattgacaatattttattagataggcgtttaattagaggaagtctgtgggccagattcttccctgcatgtgtgattcatatttggaaatttctgatttatctccccccaattgtgccatgtggcctgcacttaaaatgtaagtaattctgattttattctcaagaacttatttgaagattcaagccaagcaatgctgaaaaaagctaggcctgcaaaactaaaacatagcacgagcctctcaaaatttccaccaaatatacaaaatccagtctgctctgaatgtgcatcagaaactcaactttggttattagccctggaatttggtgccaaaaacaaaaatttggttttgttgtcaagcaatttctaaaggaagaaacaatgtaaatattaatctgtcattttaaatgttgttgaaactgccatgagtgtgcacacagctctctgtttcatacctgtaatcagtattcgcatgctttcagtccactgtttctacttaaagcattattccgtatttcagcacagaatgactttggtgaaactgtagctgttagtgagtaattgcgttacaggcagacccagtcttaaattaacaaatctgggttcccttaactatcaggtttatgttggttttatttgcttctatctggatcccttctctttgcctgggaccttattctgattagctagatttttaagagcttttaaagttacattccccagaaagactttttttctctggactttctcttttatggtctgtaaacatttctcctctgatggtcatggacttagttctaagactggccttcctctagtgtgatggtatgagtctattctattgctgctaaattttacaaattgaactgcagaagagtctttctaggtaatccctgtaacagagcaagtttctttgaaccctagccatgtatgtgtagtgttccattattggaacgctaagcatgtgggagttatttatatcttactgctcacggtcatcatcaaggtctgattacaaaaattcaaaaaattacaacctcaggcataaatttaaagaggtggccatttaaaaataatccgttgctaccatttccacttaaaatggtagctctctgatgagttttatattggctctctgttagccaagcccgtaagagcatatggagagaaaggtacgattgaatgaacttctgtgagcggcataaagacatttactctgacaacattaaagaatttactggtactgttttttttccttgttagtttaattccatctgtttctgtttaattgagtgaaacttaataaaaatggtgtctctagtgagcacatgtacacacctctcccagttgttgggatttaaaatgaagctgtgacttttaggccaaaattagcgtgacacttaatataacagttttctttctattaaaaaataatgacaaaacacacacacacacacacacacaatctgtatgatgatttggcctggagttgtagacatcacagatcaaaagtggcctggtgctagctgtttgggtatatccttgaaaagggcaactttgtcatttcctagagtaacctagagagagatttccaagcatttccccatgaacagaagtggtaaatgctgatttattgtgccatatgtgtgtttgggaggaggggagatagcgtcttgttttgaaaaaagttctcacttcataaaataaactgcacaccactccaaaaaaaaaaaaaaagatgaaacctcaagcaggaggaacttttttatttaacccctagtgaaagcaattaaacgtcttggtagatgctagggaagaattagaaaatcttcttttcctgaaagctttaaacattgaatagactctgatttattcaggatcatttcggtgtagattggccactcgacacagacatcacagcatggtagcctcgaaaccaagccttcagcatcttctcggcgcccggtgttggagtgttacttggagtggaggcagtgcatttgcatcttcatgtagtctccagatcaggttactctgatttgtcttggagtggctttctgtttgaaagtagggaagattaaaaatcaacttgccacgggatatctgatctccatgagtagttgaaagccagtctaaaaggttaactctacagggccggcgccgccagtgcggtcatggaaaatcgtgctgtgagatactggagtgtgctgctggggccaggtgcagcaattgcagaatgttgaggagtgaggagtagttagaaatcactgcaacatggaaaagcacacagaccaaggacgctaaggagggagcgaggactaccgggcaggtgtgcgtgtgtggagtaaaatgcatcggacagtgattgactccacttttgagtgagatgtggaggcggtagtggtgtgggggttgtgagggagtgagtctgctttattatgaatcaggattgatagctggccttaaagtgggaaatgatagaagggtcacttaggagcctgcagtggcatggtgaccagtctgttattactcatagatgaccttttctggctcttgaaaccaagctaacgactcctttttcttctgggcctcaaagtttctttgtaggaagtaaagcatttgtcactttccctgcagtgatttattgaaagactgaagataggtcttccttagttaaggacgcacactggctgctcgctccagaagcaccaagaatggctgatggataaatcccttacccatactcctgtttctgcctcctaaggttgctgtgaaaacctaactaaccaaacctcaccagcttggcctatattattaatcaaattcccttctgttctctctgtgtgtatatttaatactgtagataatatgttttatttaaaatttctaatacaccaaattaatttgaaatagaaaaggctggggacttcattctcatttttgtcatttgtttaatcagtttgggaaaacattttccgttgttccattgtatgcagtgtcttgtcagcatgtacctatctaggagaaaacgctttgttttcagcgttctgtctttaccctcaaagcatggtgtagcttctgttcttacactgttggagcactgtctgatgtctttttttttttttttaacactgctgaataccaatttgtacttggaatacctctttcctctagaatacagtgatcctattccccaaagtgcaagctttcatgtggaagcatcctaagtgatcgtcctgggtgatgccatatttcactaaagtgggaaaagaagaggtgaactttgctcttccaacaaggcttgcactttatactttgggcagtgcatgggagaaggggggcccttagaggtgagcaggatcactgtagctagaggagaggtctcactgaaacagaacgcatctgtgactgtagcttgcatggagagcctagacagccaaccatggatttgcctttatgttttgaatggaaacatctatttcaattgggatagaaacctttacctatgtcatatctgtaagagaatttagcttatagatatgtagatacgtgtgtgtgttgctgggtggggaagtgggtgggaatgtagaaaaggcctcacctgacttggtcccagttggcttctgatggccaaggagctgtttttcattttggtgggcacccaacatgtaggttctcacagatgctgtctggtttcttcttctctccatggcggaacaatgaagtacgtcaataaagcatggactcataccactgggaagaatgctggcttctccagtaacaatgagcttggtggttctttgagcatggaaggccaagctcatgtcacagtgtatgcacggtattaatatatctcttgttgatctaaactgaaggggcttttacttgtcctaacaggtatcatgctgtaaaaactgtccattgtaactgttctttcccactgatggctgaagctttgtcctgagtacaagatggtatttttcattggtacgaagcaccatgttcccaacccaaacactgcctccaccaccaccaccaccaccatcaccaccaccactgctactaccaacatcaccaccaccatcaccaccaccgtgttcaaacaaagcagcattctcctgtgtcttttcctcataagtaagaacaaggtagcacattcatttttccattagtgcatttcaattcttttcctgcaagttgcattgctattgcttttctgaattgcttgatgatgaactgtgaagctgatgcttagctgcttgtgaaacttttcttaaaggaactgggtctaagaagcacacatacattaccctcaacaacctcaggtatcaagaagaggaccacactgctaacatgggtaatcctataacctggcttttcttgtggaactttgtaatttctataaaataccgccagctttgcgtattccactgagccccaacttagatatcagacgctagtgagtcctgcctattcaggaagctacgtattattcagcataatactgcccttttttttgataactggctttcaaatgggataatctcaagagaggtttcattgtatcctcttagagcgtatggatttaaatagagcctttcaaaaaaatagatgaaaacctacatctctaatatatttcctacttgggccttttgagcatattctgggcacatagagagaaaatctcctatgttttagaacagaataaaagaagacaaattatggtagataagtggcacccagaagattgcaaaataaataattttatgtgggggaatattgaagaaaaagcatagaaacttttttataattgcactttaaaattttggaaaagaaaaattgagaatgcaatcagtagtctcatttttgtcagtattctgtcagatattagctattcaataagcatatcttggattactatttttttagttgtcagtttttctagtttccccctttataggaaaaaataatacctatgtggttaaaaactgagacccatttaaaaaacaggacaggtacagttaagtactagaaatgccgtttttatcacttgaaaaatagattagaaatgtttttcttttcccagaattgtgtgagtttgttttgaagccttgaataccggtacatggttaacaggcagcttgtgcccaatcccaaagcgggaagaaaggcctggctttggctcactgatgataaagtctcctcccactgcctttcagcagctctgccgaagagctgatcaagatgctgcaaacccagcttccccagaccggccaagagggaagaatgatgagcgtgttttaaattacaaagagagagcagcgcaggcagtttctggtctgggtgataaattgaaatccataaatatagcagtgctaatttgaagttccgtaattgtttgtgccatgagaatgtgtacatttgaaaggattttataaagcaattactagaaatgcctcccttgagagctgtatgactggaggtgttttcagtctgaggggggcagcataaacccaaacctcttctagatgaatggcagggtggcgggaggggtcatgaaatcatggggaagaggtgaaggatttgagagctactaacctgacatctaactgaatgcctaagaaattgcagggcaatttcaggaaataggaaaaataattttgaaaacattcaaagcctccagactttcggtgtgtgactgatcttttttctaatctctttaaacttctttccacctattgccttaatagcaggtgcttcctcttagggtccccccaaattatttacctcgagttccctaatgaaattactttgcattaatttgtcataaagggagaagtgctagaaataccgaggcattgataatttcatggagtagcaatgaatgtcagtcacagtttcctctccccgttgcccggggctgtgccttcaaagcaggtgacagactgcaaggtgtaaacaagctttataatgccatataaatcaaaccgggctcattttacctaacaacagaaccatgtttgtttgcttttttgtaaaatggactacttcagtgaaaaattgattccacgtagttctaataactctgtgaccttggacattggctttttatagacacagctcttcccacctgctggtatggacaccagtttgtacagactgttgtcacacaccctggctcaaagtcaaaagagaattttaattactcatcaagctgccaaattctactaattgcccccttgtcagcatatttcattaattgctgaaaggtaaatgagttacatattttgtttggaccacgtcacctgtacattttcaaagcctcggattgtttatcttgcaaagagagaaggggcctcttctccacagatgcagctcaaattagcaaaactgaactgtagagtttcaggcctttcccttccttaaaatgctgatagatttctagaccagactttgatatttattggcttcttggtcttgctgtttaaacacacccattgccctttctttcttaggccctataagcaaagctggagtagcgtcttgggaaaaggccaactgaccaccctaattttgtcgttccaagtctgcagagcgcacatattaagtagttgttactgacatctttaggctccgtgagtgaaatgcagcaagcctgcccccagcagcctgtgggctaatcctgagctgttccttcgtttaggtacacaggtgaccctgaagttcccactcggccctctgttttctgagtcctgtctcctctgtagcacagtggggattgttctgaaccgtggcacgccttcttggcgaggcaggctctcttatggaaccatagtctgttacctcatttcttccaactgctctgtcccctaaatgtgtgttcccaggtgcagtgcagcaagggtgctcgctgttggcctttgagagtggaggtggctgtatcggagtgtgctccccctactttttcccttgccccgagtggcagttcttttcctctctgttgccggatgctgtctagggcctgttagttgctatttccttgcctccgctccccttcccactagccttctaactaccttttattctcggctccaactctttcaatgatgaggtgaatgctttttctgttccacgtcactgcaaagtcaaggtgtccagcatgctctcacttataactgcctcacccgatctcacgcacagtgcgagagctgaaggtaagccccggatgttgccagattacggtggacaaataaaaaacaactctccaacagcaactcacaaatgcatgaaatgttttaacctctagacagactgccagaatttctctcttctaattcctacttgtagtgataacatttttctttttgtgatttttttttttttaaataatagtgtagtaccttgaaacaactgcagttctaactcattgtcaccatttctgtttgacacgttccacttcctttgcaattattgtatttagttgtgcactagtgtcaataaaattgacatttgtgaagcaa

SEQ ID NO: 522 - DNA, 7186 bp, Homo Sapiens
agtttcccaaagatctgactgagctgaaaatggaccatgctcaccaagaccactggtaaaaactttgggtatattaaccagaattatttttaaatttctggccacactgccaaaatcttgctgaactttgggttttcttgactttgtggaagtgtttctttcatggaactgctgggatcaaaactgcatctgtcttagggatgcagattgtggctgggaaatgagatgtgtcttaacttaaagaatgtctgagcttcttcagagtagctcagtttaaaatgttttcttattgactgattgagatgtgcaagcggctgccacctgacttgtaaaaatggattttcaagtgtatttgttttttagatagcttcatactgagtgaaggaatacatagcctggaatttcctctaattataagcctaatccagttagtgcacaaatctggcagatattttagtgtaatacaaattaatgttttcgtttgcttcacctgatttgtttagttgaaacttaaatgtgttttaaatgtgaatttttagtaactatgtatcaattgcaacgatcaacaattttttggagaaatctggtagctttactctcctataaccttgcatgtttttgaaatattttctactatgattgcaaaatgatactactcttcaactgacaaatcaccttcatcctttatcaaaaacatcttcctctaagaagcctagtttcagtttggcagaagagagaggctatacgtttttaaggggtgacaatatgcttttagctcagccaagcctggtttattagaccttcaattaaaataatgagttcaatggctatttagtttattagtgtttgtagtagtagtgatggtagtagtggtagtagtactactaattacatttattgggcactgggtaagactaagtaaaattagctaggtcatctcatttaatcctcatagcaattctgtgaggcaggcattattattatccccattctaagatgaggaaactgaggcacagtgaagtcagatgacttctccaggtggtaaatctagaaaacagaacagttcaggcccaaacagtgtcatttgactcaaaactcacagttgtcccaaaatactataccagcatactgtctcttacctaaatagattgtctcgctgtaataaaacatgaatggctagtggcaactctttttgagcaggcaaaatggatgcttaaaacttaatgtcagtcattctaactctggtttaagcaccattgtaggtggggtcctggaacaggttatgaagaatggttatgaagaatgatgtcaagtctgccatctctactggatcatgctctgaaagatcttttagagtttagacccattcatggcaaaatggaataccctagaagtaggggagagaggcaaaaagaaagggagagagactgagagaaagggaaaggaaaagagagagagcatgctccatctttaccactatcaaggaatcattgaccatcctacatctctccaggtccttctcagtgacccaggacatctcagtacaacgtagtatttcagtctcactgcctgaaatattaaaggtcaaaacacattttaaggtgttatctctttcctgtctcattctaatcaattttgtacatagctggtttcatttgaactcaatcattgtgatttgccccttatgggcagctacaattaatcaagtgcatgttagtcaacatagtttgtgtacaccacataatgaaaatcccatgaaatttaggcattttgaatgttttaagagcaagcctcagtgagacttcccttgcagaaccgacttcccagctggagggagatgcatggcccatgcctttcccaaacaaatgtgtttgtgacatttccctgtgtaaacgctgactttgttggggggaaatctgtggtgcctggagagatgggagaaatagatttcggaaatgctaatctaggggagcaatccgcagtattgcagcctgctggggctgtgttctgcatgctccccacagctgcctctgagcgaacttattgacaaaggcgaaggaagcttacagtgcaccaggatgactcactccacgtttactgggtggttcacacggctgcctgcttgccggaacaggaaggcccttattgtgctcaattgttttcctgaatgcctttctcaacaacagcaaaaggaaacattactttttggcttccagccatcctggccacttggtacttccagtgcttagaatgcaaaagttgggctcagccaagacatgcagaggcacaaggctgcagttatttctgtctgtgtttcagattaaccactgccttttgcagtaaacaatccagggtgatttaagacaacgggaactccctttactagcaacagccccgacccgagtttgaccgtttgttttatggacttgtttcatgtacagtaaccccatggggggccttgacaccaccacccactgagttgcctgaataaaatagaaaaggccctgcctgtcagttacctccttcttgaatctgattgttccagagatactgtgagggaggggaaagtgcagcctggagaaaaagggaaggaggaaaccagaaagttaacagcaaagggaatagagtcagagtgctgggggctccccagcctctggatgtaatcacaggcacagtaagggctaatggtggtggttttacccttccatgctcttgcatttgatgtctttcctgtgctcagtgacaagtctgaatctgtcttcccctctggacaccttggcctggtcctttactggttcttcagctgctgctgccctggaaaggctgttattttttagctcaaggggccaaagttatgctgcagtttgtggccagaaaatggggatgggagatgaagtggcaaaacagagtatcagcagagtaaacagacaacctaccaaatggaggaagatattcacaaactatgcatctgacaaaggcgaaatatgcagaatctatagggaacttgagcaaatcaacaggtaaaaaacaacctcattaaaaatgggcaaaagacatgaacagacacttctcaaaaaggacatacaagtggtcaaaaaacatgaaaaattgctcagcatcggtaatcatcacgtgtccggaattggtgggttcttggtctcactgatttcaagaatgaggccgtggaccctcgaggtattacagttcttaaaggcggcgggcgtgtccggagtttgttccttctgatgtttggatgtgttccttctgctgtttgggtgtgttcggagttttttccttctggtgggttcatggtcttgctggcttcagaagtgaagctgtaaaccttcatgatgagtgttacagctcctaaaggcagtgtggacccaaagagtgagcagcaacaagatttattgcaaagagtgaaaaaacaaagccttcacagtgtagaaggggacccaagcaggttgccactgctggcaggggcagcctgcttttattctcttatctggccccacccacatcctgctgattggtccattttacagagagccaattggtctgttttacagagagctgattggtccgttttgacagggtgctgataggtgtgtttacaatccctgagctagacacaaaagttctccccctccccactagattagccagatacagagtgctgattggtgtagttacaaaccctgagctagacacagagtgctgattggtgcatttacaaaccttgagctagatacagagtgccgattaatgtatttacaatccctcggctagacataaagattttccaagtccccaccagattagctagatacagagtgccgattggtgcatccacaaaccctgagctagacacaaggtgctgattggtgtgtttacaaaccttgagctagatagagtgtgctgattggtgtatttacaacccttagctagacataaaggttctccaagtccctactagactcaggagcccagctggcttcacccagtggatctcacacctgggcagcaggtggagttgcctgccagtctggcgccgtttgcttgcactcctcagcccttgggcggttgatgggatcagcaccgtggagcagggggcggcactcattggggaggctcaggccgtgcaggagcccatggtggggtggggaggggaggctcaggcatggcaggctgcaggtcctgagccctgcccctttgggaggcagctaaggcctggtgagaaatcgagtgcagtgccagtgggctggcactgctgggggacccggcacaccctccgcagctgctggcctgggtgctaagcccttcactgcccggggccggcagggctggccagccactcggagtgtggggcccgccaagcccatgcccacccagaactctagctggccggcaagtgccatgcgcagccccagttcccgcccgtgccactccctccacaactccctgcaagcggagagagccggctctggcctcggccagcccagagaagggcccccacagtgcagcagcaggctgaagggctcctcaagcgtggccagaatgggtgccgaggctgaggaggcaccgagagcgagcaagggctgcgagggctgccagcacgctgtcacctctcaatcagagaaatacaaagcaaaaccacagtgaaataccacctcacacgagtcagcatggctatcacttgaaagtccaaaaacaacagatgccaatgagactgcaaaaagaagggaacacttatacgctgctggtgggaatgtaagttagttcagccactgtggaaaacagtctgaagatttctcaaagaacttaaaacagagctaccatttgacccagcaatctcattattgggcatatactcaaaggaaactaaatcattctacctaaaagacacatacacttatatgttcatcgctccactattcacaatagtaaagacatggaatcaacccacgtgcccatcagcggtagattgtataaagaaaatgtggcacatatacatgacggaatactaaacaaccataaaaaggaaagaaatcatgtcctttatagcaacatggatacagctggaggccataatcttaagtgaattaacacaggaacagaaaaccaaataccctatgttctcacttgtaagtgggagctaaatatttagcacacatggacataaatataggaagaatagacacgtggactactggagggaggaggaaaaaaggggggtgtgggtgggtaactccctactgggtactatgctcactacttgggtggtgggatccatacccaaacctcagcatcacataatattcccatgtaacaaacctgcacatgtaccccctgtatctaaaataaaagttgaaatttaaaaaaaaatgtttcggcccagcatggtggctcatgcctgtaatcccagcatgatttgggaggccgaggcaggtggatcacaaggtcagaagattgagaccatacactgtgttaaccataacagggttaacagagtaaaaccctgtctctactaaaaatacaaaaattagccaggcgtggtgggcacttatagtcccagctcctctggaggctgaggcaggagaatggcgtgaacccgggaggcggagcttgcaatgaactgagatcgtgccactgcactccagcctgggcaacagaatgtttctcttttcaactcagtattgctctgggcctcaagtggcccccactgtgttcacagtcttatgcacctaccgtgtcatggttttcagagctactctgagctttctctgtccaggtgttcaagctggaggccacggaaggtgcgtaggaagggtaggggtggcaggaggaggcagattccacactgttccttctggcctctctgctcccttttcccttcctcctttcaggttctcctgcaccaactccacctacgttaccagcacaggatctggagctcacatgcagattatttcatgccaaggtacacaagtaacccttcctaggccacctgttctgacccacctgaaagcttaaatcagtctgggctcacccagagcatcctgctgcatgagctccttccaaagcccccaggacttttgccagtctttagcaacatggatccctaaaaatcaggttgttcaaaagtgttccatgttcaaaatagtttgagaaactagattaaaggaaagcaagcaggttcttggcagcaggactcctcagatacatggctgtgttgctgcatgctgtggctctgcaatgaggctcaagtatgtagggttctcttgtgctttagactggttaagcgccaatgccaaagagggaacaaaggattggtacttttccttcaactgattgggcctctctcagagaatacaaactcacaaaatgagaggaaaagtacagcaaactttgtggctgcctttagcacccctacgcctactggtggtaaagggaaagtccactctggagaggggaagggtcactgctttcagaccctgggcagggtgacatgcatggtgctggtgggtggagccagccacatctgcatttaatgtataatacttcaccgggtgtagggtggggatagccagtatggtggcaggtcccattggagcagcagcaataggttggttgtgggtcctgctacatcaggctgtttttgggaaaggacctgaggcctcgtcctttggcaggacaaactggtagagtcagggctgccaatgaaaatagccaagctcatacaagctagggtgcatagactcatctagctcatgattcgctccggtacatcaaaaagccagcaagcccgacagcagcaaaaaacaagtcaccgtcttaaattcaaacatcatatttgtacacaaattatactgtcagtgtgttctaagcagatggaatcatcttgttcatttcttggggccagagtgataatcccatttggtggccgggcatggtggctcatgcctgtaaaccccagcactttgggaggccaaggcaggtagattgcttgagcccaggaatttaagaccagcctgggaagcatggcaaaactctgtctctgcaaaaacaacaaaaattagccaggcgtggtggctcactcctgcagttccagctactcaggaggctgaggtgggaggatcgctggagcccaggaggtcaaggctgcagtgagttgtgatcgtgctac

SEQ ID NO: 523 - DNA, 976 bp, Homo Sapiens
gggcccaggctgtacagctggcagtgcctgacagcctacctgacgctgaattggatgggatacagcatagggagcagtagctgggtgaggtaggagaagggagtcggggttatcacttacaaatggtactgaagcctaaactctgaagtgagtaggtgctgtgcttttatgggcctctttatgaagcaaattatgtaaaagttgccatcgaggacaaacaagtgaaatactttacacattacggtggattggatgaaaattggaatgaatgggctccaaaaagtagagtactcaggtacatgaacaccaatctgtagaaaccgggagaacttcgagaagcaaatcaggaacaaaattcatgggggaagaggagagaggctgccccagcaaagaagacatctggtctgcaagggaaaaatgttgaaatcatgtggaaatggaaatggagcagtaccaatgagatacctcagcctcctcagaagagccccagtagatgccgctgttgaaaacattcatgaagagagttgaagttaaagatttctgaagaattaaaaccatgttttgttgatgagtgagacataatgaccaaacaaaaacagctttatcttcgtgccaggaaaaatgtggattctattgtagagaattatgtaaattacaagaaaacttgagggaccacagataataaggagtatgtttttaatatggttgtggcaaaaatggaaaatatttgaatataatgttaggcactcagatactttacaaatctgaaagactccagcatgctgaaatccttgaagattacccagaggcactcaagttccaggggtatggaagaccacatctgttgatataatttgtatgaattggaccaatgttgacccaaacacctctagaggagaagaaccttgctttatgactgaactatcttcataatgacttcctggtaaagaattctgcaattttatttaaagccaac

SEQ ID NO: 524 - DNA, 2653 bp, Homo Sapiens
ctctattggtccctcttttctattggcacccctcttcctgtttgtctctcattcttacatctcattaccatcgtccctgcctcctaattggtccctctttctatcattcttcccccccattggctgtcttcctcattaatagtctcttctccaggagtcctcatttcctattggttttccttttctcttaggtccctcctccacttttctctcttccactggtcccaccttcttcagtagtttcagttgacctggaggactcttcctctgttacgccctcctctactgtacccctcctgatcagtagtccattcttcattggacacttcctgcccattgattcatcttgattggtcactctgtgaccattggtcttttcctaactggccatgccctctcccattggttcttcctttctattggttcttcatccaatggtccacctccatcattggtccttttctaactgtccccaccctccctcatggatcctccctttctattggcccttcctccaatggtctaccttcctcattggtcctttcctaactggccctgccctccctcattggctctctcttcctattggtctgcttccctccttggtccttttctaactggcctcaccatcccccactggctctcccttcctattagcccttcatccaatggtccacctccctcattggtccttttctaacttgccgcatcctcccccattgtctctgccttcccactggcccttcatccaatggttcacctttcttattggcccttcacacacaggcccaccttcatggatcctgctgatctattggacctgttttttcctctagtgactcctctggaccattgatcctttccccttagtccctcttccatcagctatacccccattcactgtctcaattcacatccttcagttggcttttgtgctttattggtttctcttcttccatcagttccttctccattattccttcctgctgttcaatgaatcctgatcagtcccctttgacctttgacatccttcctgattagcatctccccactgaccttccctctttattgaaccttcatcttatgttccatctctcccatgctattcacccattggtctacattttccattggctgttcactcactggcccagctcccaaattcactctccctcccccttgacctttctcccattgaaaccctgtcccattggtcctcaccattagcccatcttcccatggcccctcaccaattttcccactccccatcctttggcacacttccccaagtagccagtagcctgctccccaccagcctcccactactgaccatctgctgtcttgccccagcccaggatgtggcagctggtggtgttggctgagcagtccctctccaggggaaggggctggatgagttcagagagtttggctgggcgtgccaggcgcaacagcatgatgtcctggtcatggctggcggcatcatagtcagggtggatcacagcccggacaacagaactctgctcctgggaactctccctttgccgaaggttatgcttccccaggaagacctgaagattcctgggaaggaagagggctgggtctcacctggagcccttgggctgcagttgaggcttcagagagggctgggaagtcatgaatcgctggcctgctcctcccacagtcttccccagctgggtaaatggcaattccatcctttcagaataatcttgggggctattcttcactctctttatttcatgccctacatccaagctgtccagaattccttttgcctctctgaagcatatccagaatctggccacatctcacctttcccacggctaccatcttggtttgagctgccttttcacttcctacctgaactagagcagtagcctcctcactgggctccctgctctgtctctggtcccccacagtccatcctccacaaagcaaccagagatattttaacaatgtaagttggtcctgtgcctcctctgctcagcccctcctatgactcccatctcactcagaatcaaagccaaagttctcaacgtggcacaccaggccttgcaagcactgccccatcatctcacagacatcttctcctcccactctccccttctctccctctgctccagccaaacgctggcttccctgtcttgccttgaacacaatagtgatcttcccacctcagggcctttgcactgctgttccctctgccagcaagtctgtcctccaagtatctgcatagctcactccctcacttcctttaaatgtcgcctctcagggaagccttccttagttgcccaattaaaatacaaatacctgttagtaggcaattcctatctccctcccctgctttctgttccaccagagaacctatcacaatcatccgacctgctatatatttattgttaaatatttactcattgtgttatttctcctccttgcagagcaatgctgtccactaaatgctacgatgccatgatctcgatctgcactgtccagaggtggctgggggaaccacaagctacaggctgagggagagaagatctgagtcagagaggagttctggagaaaccaagcgcatccccctcaacatgaactccagtcaagattggtcaggtgcagtggcttatgcctgtaatcc

SEQ ID NO: 525 - DNA, 1669 bp, Homo Sapiens
gaagaccccaaatgacatagaaggtcttggagaagagtccaacagagacatatattcacagacacgtgtacatctttatgcccacacagaagggtaacagcagccttgcttcagaggccacaccttccaggaaacccttcagcctgccgtgtcttagctgatccctctgccatccccttgcagaaggagcttggagtctctcagctcagctggactagatgaatcttctcagggtcgtcttctcccacctctggctcccagttccttcccccagtctctccctccctgctctgtgtgatcagggaagctgcaaacccaacccttacatcaaaagggaacttgaaaaatacttggagcaaaaactgctaactgtgcatccttgctgtatgctggcgctgatattaaatcaggaaatggcactgaacagccgctccgaacacagaaacaggggttgtcaacacagcaaccaaaagcaatctctaacgggcagaggtgaaagggacctggcacagggccaggaggggggctgcaacccaggaaagaattcctgagctgagtgtgtctgtgccacctctccagtgtccagaatgaagcctggatctcagtccctggcatggaatgcaccttgtctctctccatgagggatgaaagataattagataattaagcatgttgcttaaatacctttgaaattctcctttttatttccatacatgtttaccgagcacccactatgtgcctgacagtccaataaaaaagatgccttcccatgtggagatgaccttctagccctcaggacagaactctgaccctttgacatggcattcaaggtccttcgagtgttggctcctgcagaagctttcatctctgtttccagcctccctgaaatagctccccaagggcacgaggcagtacctttgctccatgcctttgcttggactagtcctaccaccagcaattcctgcatttctgtgtttggcaagtttctgctcagcctccaaagccttaaccaagtgtcaccttttctctgcagcattttctgccaccctccccatttcttccaatagaaccagggatcttttacttgggatccagaagcactgtggacatattgccatcacaacacctttcatgtcacaatggcaaggtttgcactgtcttggaggagaggaaggaagccatattcatccctgaaccctcatctcccagcactggttgtaaaactgaaacaaaaatggaaaaccttgatgaaattcattgttggtgtggctatggggaaacagattttccatttctgatagtaaatgaaataggcaccatcttgttagaggctaatttgacattattaacactgaaaatgcacacatctttcaacccagcaattttatttcttgctttctagaggaatgtttgcccatgtgcagaaaggcgcatgtaaaaagctgagttgcagcattgtttgcaatagtaaaagatttgaaattgcttaaatgtcggtcaatatggcctggataaaaaactatagggcatccattggatagaatgctatgcattagttaaaaagaagtagatttccatgtattgaccaagcatttgctgagtaaaaatcaaaagcaagctgtagctctagacatagatgttaaaattacattgctgcattttttcacaa

SEQ ID NO: 526 - DNA, 2707 bp, Homo Sapiens
agtcacacaagtgcttttccttgaaacaacatttatacttttgaatatactacaaatatttaataagcacagcctgccctccatattcgtgggttgcacatccatggattcaaccaaccacagatcaaaaatattcaagaggccaggtgcagtgtctcatacttgtaaccccaacactttgtgaggccaaggcggaaggatcacttgagtccaggagtttgagaccagcctgggcaacatggcaagacctcatctctttaggcagggcagggaggagggaagaaagaaaaatattcagggggacaaaaatggatggttatgtctgtatggaacacatacagacttttttcttgtcattattccttaagcaatacaatataacaactatttacatagcatttatgttgtattaggtattataactaatctagagataatataaaatatatgggaggatgttcataggccatatgcaaatactacatcattttatataagggacttaagcatctgtggattttggaatccttagggagtcctgcaaccaatgtctgatggatactgggggacaactatattatgtacttcctatgtcatgacattgaatattaaaaatatatatacttaagattttgaggtttaataaaatttatgaattttactgcttcatcaaggatattcttaagggaatttggcatttttaaaaatttcaattgcatggcagtgaagaatctaagaactagtatactttggtgcactagttttggtacactaccttgatttattctaaagcactagcatttttactttccattgcttttacaccgtcagtgcaaatgacagcatggtgagaaaggcaaatgatgtcctgttaccaccatgaaaatagtttttaactcacagactcctgaaatagtttcaggtatccccaggagtctgtagaccggactttgagaaccactgccctacatgattatccaaaacaatatgtcccttgagttctgaatggtaggagaggagaggggaaggcagaaaaattgtcaaactaggctgttttttctctagttctgaaagagagtaatagggaaggaggaggttatattgagtttcacagaatagattgggcacctgagggtttatctcactcatttagttgcagtcttccttgtgacaattagaattatgtctgcttggccttaatgggtcatatattccacagaattctgtacaaaatgtaaatataatattgtcaaatgtcttttttttttttttttgagacggggtcttgctctgttacccaggctggagtgcagtggcatgctcacagctcactacagctttgaactcttgggctcaagcaatcctcacgcctcagcctcctgagtggctgggaccacaggtgtgcaccactatgcccagcttttttgtagagatggggtcttgctatgttgctggggctggtctcgaacaccagacctcaatcagtcctcccgcctcagcctcccaaagtgctaggattacaggcatgagccaccacacccagccaaaagtcttttctaaacagaaaactgctgatttattgtgaaaacccagtcacccattctcagaacgattgtaacttttattttgaatttagatcttttgtagaaaccagaatatataaggtgggataaaagctattagggtttcaagtctggggaaaaggcacacggtttccagtttcaaggttttttccatatcctaccataacacagcccacagctttttgttgttgttgttgttctgacttctcgtctatagactaaagatagatattagtgacataatctttaataataagtaacagctcattgtcttgaataaggtatgtttaccttgacttaatatcgtttgtatttctaaacacatttataaattgaatcatatttgaaatgtattaggaagatttgttctttgttgtttatgtttttttaaagcaaacaattgcccattaacttctatttttaaaattggtaatgtgccttggttgtttaaagcaagatatatctatttagtctagcttcctagaatttgtttcaactttaaacctttctttaaacttttaaccctttccttcattcctattcaatcttctgcaaaacgctcaacctttattgcgcaattgctgtattgaacccattgtctaaaactaaactttctcctcgtaaagtaatgttgatttttcacagtgagatgacttttcatacgtgttactagcctactatctcctacttctgttcactttggactactgcagtggtgacctagttagtggtctctgcctgactagtcacttctgtatttaattcatccaaaagactgttgcaaaatttattttctttgcatgttcctaccccattcaagaatattcattatgaggccaggtgcggtggctcacgcctgtaatcccagcactttgggaggccgaggtgcgtggatcacttgaggtcaggagtttgagaccagcctggccaacatgatgaaaccctgtctctactaaaaatacaaaaattatccgggcatggcggtgggcgcctgtaatcccagcttctcgggaggctgaggcaggagaattgcttgagctgggaagtggaagttgcagtgagctgagattgtgctgctgcactccagcctaggcaaaagaataagactcctatctcaaacaaac

SEQ ID NO: 527 - DNA, 7209 bp, Homo Sapiens
gagtgcaacagctgatccctttcggagtggagtttcctagctggtgcctgtcctctcttgagcctttgtttcttgagtgagcactcactggggctgtggctccatgaactggatttcaggaaaccagccaaggcattctctctctctctccattcctagaaaggcagaaagcctgggaatgggttcggcaggaagatctctgtacctcaatctccattgctttcagcaccactggctttctccccagctcaagtgcaaaacctgccatcgttgctacctggggtgcctcagactcacccaagtcccccaggccagaggacatgctctcaagccttgtttcagaaagagggacccaaaggctgttagggaagagaaccagggtcctcaaacccagggttttctcacccactgcctctgctctggctgtggcctgccagacctctcctctgattttcgctttccttcctgccagtgcctttgtttatccgaggcgccaagatcccactgtgaagtctgaaaggaagaccagtggttctcgcttttcctctagatgctgtgtctcccaatgtcatcttctttcctctcaaagacaattggacgttgttacagattttcttggaatgagtaaatacctagcagtgggattgctggatcatatgaaaatgccagactatatttcatcagcaacatcggagagttccagttgctctacaccctcactagcacttaatattgttgatcgctgcctggattcacagaaggacaaattacaatgcattttgaaagactcgtctacagtcaactaaaataccagttatcacagacttcactggccttaatgaggaggctgagagggatttaattactgggacatgcaacgcttacaccaaactctgttcgattcacgacttggaaaagcaaatgtggatacagatgagtgtggacatggcttcagtaggaaatgtcgagtttgttcatcactctgaagtttcttcagctgcaacggaaactgcaccctccctcccgacttgttggttatcttgctgtgctcccaagaaggtattttctgctgacctgatagatcaggtaagagaatagcaatgtgtcttttgtcatctgcctccagttccctggctgcctgcattgctgtgtttgttatctgtggattgaaggtgacaccactctcaaggagggtgaaggcagaggtgtatgcacagctagtaccagtaacacccctagagtgagccaagagaagatgaggtaaggaggaaagggagacttagtcatgggcctaggaaaaagcgtggggggttacctatgtagaaggtatggatggtgaagctggatctctttttacctgtggtgagcacaccataccggacaacccagggcctacattatagagggtgcactctgcacatgcaatgcattttgtcaacagaaagctctgtgtaaaagtcttaaagcaactctttagaaatcctgtttcattattaatttagaaggattcaaataggaaatgtggcaacagctgtaatgggtattaaaagcccccactggcagtgctgggtcttagctgcctccagtggtgatcctcttcaaataaggaatcttgagccaaaaatccacccttcctgttaaataagtgttcatactcattattttattataaaagtcataatagcttgacagtacggcaaaggacagtgaaagataaatgcacataagtagtataatgcagtaattaagagcctggtaaaaatctcaactctgtcacttaataacctaaatcacttaatagctttgtgcctcaatctaaaatactgataataataacagtaataatgtttgccttcgtgatgttgttgtggagaagaaacaagttaatatagataaagtacttaacatagtatcaggccaacataggatcatagcaagaggaagcattcaataattagttgtggttgggttatcattattgttgttgctattgttgttattatgacactaacatctacaactttctgtatttcatctgtcaacaaatatttcaatatcaaatctgatcctgctccttgactcagacctttgtcattttgattgaaaagatgtttacctgttggtccccagcctcactcttctgaacctcagatccactgagtgtgtatccagaggtaagtatgtggtaagtatgcttgtcatttacattatctgtcagcatgagtattggtttcctagaaacctaatattgaaaacacttagcattgctaaaagcattaaatgaaataaagactcaatatagctgcactaatctgtgctttctaaatttactgatggacgtgaagaaagtaggttggcatggagtttatacaatttatggatcacactgatctgaattcagacagtgtgtgctcagataaaaatattgtttcctcccatgaggtttccaattttgcagagaagaatacctctgtttagctcattacttaacacaatgggtagctgggtggccttgcattctggaagtgaaatgacacaagaatgtctccactgcattctccagaggtaaagattctctggcacaaaatcacaaccaaggtggggttccaaaactatagaacaaatggcagcagccatgcagccagccttggttcgggtgggctgtaaaagcagaggttgtcctcgtgttatcagcactgacttcctgttgtggccacactgacagagatgagatggcagaaagcaggaaagagaccagagctgcaattgacagatggctggccaaagttgaagggtcagagactacaccaaagacttctcagaaaatacttgcctaggaggctctcacttggaaagatattcagggttgttaaacatatcctgttattaggaaaacgagagttttatctttctcttactcagaaagaaaaaacaaaaagaaaattagtgctcttaagaaaagctattttaatgttatccattataaaattagaaaaccttgaaaggcaaatgtttcttctgaccatttacactgagcttctttcattatctcatatgcaaccttgtggattgaaggtggagagtccttaggattacccaggaacatccctgtctgctccccctgctaggcaggaggagatttgaaaccacatgtgtctacttcatttctgtcacgggtaggacagtgtcatatactttgtaggtaactcaaagatattataggtaactcatagatattgattgaattaatgtttaataaaatgagaacaccagctctgctgttatcatcatcctcatttcgattcgctgaactctgcaccaaggccaaatacattatactttaggctttgttaaagccatctatgtaaagctggctgaagtcgaactgtacagtaaacaagagatggtaatagtctctgcatgtgttatttctttcaactccaaacctcaaagcattttaggaagaaatactatttcatctttaaaaaaaaatagaaaaaagaaacttctgaaaaattaatgcaatctaaataatagtcattaaaaagtaaattatggtaaaatggcatactatgcagtcattaaagagacgatgttgctctatacttatttacatagaacattatccttgggaaaaaaacttatttaaaaaatagaaacagtttaaaatatgtttaatataatgcctttcgtaaaaaaaaatgtatgggtatatgtgtaaaaatgtgtatgggtgtgtgtgtgtttgtaaataggaaataattggaagatattcaacacaagtttccatggatgagatgggaggcagatgataagtgatatttgtttctatattgtatgtattactacattttctgtttttatagtaatgaaaaagtattagtttacattctgaaataaatgtaactagcttaaaataatatgtagcagcaatcttaaaaaatttttatttactaaaaatctcatcatccaataattatttaaataccttttcatactatctgtataagttagctaatgttttataacaaagccttgaagtagtaatttattattatggcccatgaatctgtgggacacctgaggactaagtattgactgacttaggttgagcttcactgacattatagactgaattatggccttcaaaattcatatgttgaaatccaaatccccagtacctcagaatgtgattgtattcagagatggggtctttaaagaggtaattaaggtaaagtgaggtcataagggtgggttctaatccaataagattggtatccttataaaaagaggagatttggacacaaacctgagcatagagaaaacaccatgtgaacataaagacagccatctacaaggcacagagagaggcctcagaagaaatcagacctgctgacaccttgatcttagatctccagcctgcagaactgttaggaaataaatgtctgttgttttaatttacatagtctctgatactttgttatggcagccctagcaaactcacaagctgctatcaactggggtcacattataggttgactaggagacctgctctaagctagatctgtgtagggtactttagctgggggaactcatctccaaatgtctaaatttcttcttcaagcacctgtgaacttcaagctctggcatatccttctcatggatggcaagaacacaagagagaaagtggaaacatgcaaaatttcttgagacctaatcttggagctagcacactgtcacttctgtctcattctgttggtttaagcaattcacatgactaagcctaagatagagaattatgctgtgtctactatgggaaagcattgcaaagtggcatggtaaagagtgtagatgccggggagggagagtagggcagagcaatcagggccaatgatataatctaccatgataccttagtgttcacatatctgtttatattgcagcattcttagtccacatactgtaactatatatttccaatttcactcaatatttaatcttatatcacatttttaacataattcattttttattttatcgaatgcataatatatatattaattgagacttcagaggtacatggtcaattgcacagtaggatagtgaggaactagaataaggaaaatcacattgaaaatttgttccaaaaaattagtcagtaaaattagcacataaataaaccaatataaaagtttaattcaaatggaaaatttcataacagcacagtatagtgttttgcacatagcaagcactcaatcatgtttgttgactagactctatgtgaatttgttttgaatgtgggaactgttgctaaaacaacacattcaaaatgtggaaaacctcattttttgaaataaagaacaacagcaacaataaaaaatacatacaaaatactgatgacagtataaactgtaaaatgtcacaatttagtatccatcctcagctttctgcttagaaacatgtggaagcattttacaggcctgttaaaactttttgatctacttggatgaaagattagctaaaatttagccattctgttaccactttaaaactatgattttatttttgcactccaaacacttttaagttactgaaaaatgaataatcaaagaattttgttttctgaagagagatagcctcatttttctaagaggatcaaaggatgagaaagctttgttgaaggtttccttctaagagaaagtaaatcttggctccaaattcattttccaaatcaggaagtagaaaattttttcaggaaaggattgaactagggaagcagaaaaaaaaaattttccactggttaattattttgataatttggttctaaaaacattaccagtatatatattgctaaaaaaatattttagtgtcttatatggtaagtaattccatcatttaaaaagcatgtggaaattgcaaagctaaatagcagacatatatttattatatttggttcatgcacatactctagggatagctaaatgtgtgtatagtactcttttgtatcctctatgaaacctctccaaagctattatgaattatattgtttaaatatgtcctcactcagcttcatgagagttattcccaactcagtttcaaactgaacacatgttgcatctgttttctgtttgtgaatattgaatgtttggcactttcattgggatatttttctttggaatgaaataatttcaaatattcacttaatcaaaacatcagtttccttttccagtttccattgtggattgttggtaggtttcccagaccagctctcttgtgctgtgcagagggaccctcctcctcttggtgcataggaaggaacagaggggaaaggaaacaacatctggaccatgggcttgtcccttctccacatcttgttcctctctagatttcacctgacttgaggtctcattcaagtactcttgaagattttaactgttttgtcctcttctgattatttataacttcctttttttctttttgaaaatgttactgggagcagaataattgaagttctgtgaagccactggaaactcactgctccctctcctgccagtttcaataaaaagctttttttttttttttgaggacctatatctttgggatatacatgtttaagcaaaattaacctggcaggggagatacattgagaagggttgattgaagcagtaagagattggaagggggaaagacaaactcagaggctctggccaccatgcatggaggaaatgaggaagattactgctgtaaaattcagtgaaaaaaatccatgtgctactaggaaaagcatggacttcaaaatcagaaaaattggagttgaatcccagcccaacaactcataaactctgtgacttcaagcaagcttttcttgagtgaaattcagtttgaccagctaatacgtgcagttcctagactcccttggaatctctccaagagacagatggagtttcactcttgttgcccaggctagagtgcaacggcatgatctcaactctctgcaaactctgcctcttgggttcaaatgattctcctgcctcagcctccctagtagctgggatgcttgactggcctagcctcccagcctacatcattctcctgtgcgggatgcttcctgcttcaagcatcggactccaagttcttcagttttgagactcagactggctcttcttgctcctcaagtttgcagacagtctgttgtgggaccttgtgatc

SEQ ID NO: 528 - DNA, 4523 bp, Homo Sapiens
gttatgttagttctagtttggcagggggaagatagcaaagaagtttgagccaaagactcagtgatatttgtgaacttgattcgtgtcctctaaaatgtgtaagtgcatactttctctgtcatttagagacttatagctggagaaatgggctaagatttcagatttccaaatgttggatttctttatacttaaataattattatcaataagtttttatttggactagttttgtttggagtagtaatttaaaataaaataaatatattttcaaagaatgaaatctgaagttataaacaggagtgttatttacatttttgtacattaagttagcatttaagaacgtttagccatttgcataagaattcagtatttgaaagcattaaataatacaaaattttcaaaccctccatgctaatttttcatatttgaactttctggaatgccttttctgcccacttgttgtccatgtccaagtagaatcttttaaaattctgaactatggtgataggttttgtgtagaagagatccacagataggtttatttatcttaaaatgtaactcaatattctgaagtcatactgaaaaattctgtggacagtaagtagtttcagatgctaacgattttcagggatgaatcacatgacagctgaaaaaataccatggaaacatcatagactagaagtaggcatgtgagttccatattactgcatgagaaagcatatatagatatagatatagatatagatatagatatagatatagatatagatatacacatatatatggatatatatatagatacacatatatatatgggggattcattttataactttttcaaaatccacacacatatatatatatgtatgtattttagaagttaagaggaaaagaaaggtgtaataaaagtactttatatgttttggtatacttaaatccatatacattatgtttataattataaatatgttctctaacattttcttaatatttggccagacaattgctgtgatgatggcacatacccgatcacagaattaaactgcattgtgagtttgtgccacagcccatggtgatggaaaaggagattgaacctaaagattctccaggactggagctctgtctactatttgctaatgaactttagaggctgcctgtgggagtgaaattgttatagtgtatcatattggtggttaatcagaatttataaccacaggaaatagttttataattctggacttcttgtataaaattctgttggggtagagtgtgtttttcgtacttctctgacaaagatgcatctggtacttcccaggccatttatctgacctgagttttccagtttaatcggattgagggagaagggagggattcccatgatccgtcaaggaaagagtattttagcaataattttgcctttaaaaacgctaaaatctaaagagagtaaagatcaaatctggaataaatatttgaaataaagaagtgccgaagaacactgtgtgcttaggaggttttgaaaagacacttaagaatgcgaggaggatatctgcgttggcctggttctagtacagatttccagccccagctttttccagcaatgcttggtggttattttactcaaccttccttacatttcctataattgctattaaaaatctcacccatttccaacttgagcccttttattaccacaaacctaagtaaaatctccttgcctctgaagccattaagaaaacaatttccactgggtgtgaagtcattctacacattttttttttttttgtcttctttcttccctgctgcagagaaatttccattctccttcactagggagaattagcagtgtttgaagccacgtcctcaggacattttttcaatacgtgtccccaccccaccccctcgcctctgccacattgcatgtatttttgaacccttatcttttttgctagctcgtttttcgtcaaaacttcctcaccctaaacagatactttctcatatgactgcttttctttactagctacactgtgtttctttctcttgttacctagattcttttaaaaagcaatggtcctactgtctcttttttcttatcgcttactgatttacttttttatttgtttgttttaaagtttatagacttatttgtccctcttccaactagccatcttccagtcactcatctgaatcttcagcctgcttgtcatatttgcacattcccactcttaacacttcttgcaattcttgttttctggcttccagatagcattctctcctgggcttcttattatttttatacttgtttttcctaagacttctttgctggcttttcttctgttaaatgatacttttcaaaaggtaaaaacataactctgacgtaagtataaaatggacacataaagaattttattcaactcattaatgaaggagagagatgctaaatcttgttcaaaaagctttgtaaagggtagggtgtgtgagtatgtgtgtgatgtcaatttaataaacattaggacaaaactgctgagttagatgattaatcaagtctcaaatatctcataggacaataagtcatatttttgtcgttaattttttatcttacagcccaattgagttttcacacatccactttcttcctcaacatttcattcttgtttatggtgcttgagcattgtgttagcttcctattgctgccattaaaaattaccacaaacttgtggctgaaagcatcacaaatttattatcttacagacctggaggtcagaagttcaaaatgggtttcactggactaaaatcaaggtgtcagcatgactgtgttgcttctggaggctctaggagacaatccatttccttgctctttgccgttacaggaggttgcccatattccttgattcatgcttcctttctttcctctcgaaagccagcaactgcaggttgaatgtcaaatcgttggaatatctttaaggggccattattctgcctaacacagccacgttagatttttcatgaaggaatttttattaggtgttccactgaccatacaatttactatattattattatacattctatgcttagccttatttttggtaacaaaacactgaaagtgatattggattattggatcatttgcttggttctttgctatcaacactgaaatgtttgtgattcatttgagaaaaagatgaaaaactaaaagaaaagaaagcttctatagccatttcttcctgatagtctttgcaagatctcactcatttgatcctcactaccagatattgagtgtccttcactctactaaaaccttctgggtagtcaagaaattgtttatttgaaattagttttaattgtacccataagccatgcagtttttgtttttattttcctagagacagagtctcactctgttgcccaggctggagtgtagtgggtcattcatagctcactgtagccttgaacttctgtactcatggggtcctatagcctcagcatccaagtagctaggactacaggattgtaccaccatatacagctaatattttttatttttttgtagaaataggggtctcacttgttgcccatgctggttttgaaatcctgacctcaagcgattgtcctgcctcagcctccaaaactactggcattacaggcgtgagccactgcacctggctgccatgcagttttgatgctcacttaggagaagtaatcagttggactacaaattttagaaaaataaagagaaaagagctctctggttagcatatgtctcttgcttacagacctgattcttcagaagaagtcagcaacacctcattttattgcttcagagataattaattctgatggacaagtgacatggtgtgataacaatatgtattatgtattcttaaaattgaagcttttttcagtgcttttaatttgactttggattttctaaatgctacaaagctaaacttggaggagaatgtataaacatgactaatgggaatgtgcaaaggagaatgaaataacattttaattaaaaagaaagtggacttgaaatttgctaataaaatagattttaagtattcttaccactcatatatacacacgtcaaaaaccacgtgaaatgatgtagatgttatttagcatgattttggtaatcatttcacaatgtatatgtatagtaaaacatcacactgtataccgtataccttaaatatatacaattttatttgtcagttgtaccttaataaagctgaaaggaaagcaaaagtgaattataggcatattctagagcactatagaaaaataacatttggccattatattgaaggcatatttataatctctacaataattaagatattttattcttcttttctctcgtggacagtgtaaaccaatacaaaaaataatttcattttaaggttctagaattttaggtgtttgaaatcaagcagttattaatagatgcttatgttacaaatcaacattaaacatgtatgtattggtttgaattaattcatgtattagaaagtaggaattta

SEQ ID NO: 529 - DNA, 2298 bp, Homo Sapiens
aagacccagccccagaccaggccctagcagttcatagtctgatacggtggttctcagccaggggtgattttgatccccaggtaatatttaacaatgtctggagatgcttctggctgtcgcacttgtgggggctgggaggtatgctattatcatctagcgggtagtggccacggatgctgctaaacatcctactctgctgaggacagtccttcaacaaggagttccccatcccaattgtcaaaagtgccacggttgagaaactgtggtctaatgaaagtgtcagaaacatatacagacaccaacagcacagcaggtcagcatgcgggcttcagcgtccagaggaggtacatagaccagcaggcggtgaggtgtcagataaggcttctgagggaagaaactcccctgcagggggtttggaaagaacatgtatggaagggagcaggacacatggaaccaaggaacaactgcagtccttcagtgcacacagcccagagagagaggggagaggagttccaggctagagccacggaagccttggaggctgtgttaaggagggagacttcatccagataggagtggtaaggcattgtgggatgctaagcaggggagggatgtagacagatgcctgctttagaaggcacctcctcctggggatacaggaaccctcaggcactgctggtaagatggtaaattggtgccgctcttctggaatctgtagaaatctgtcattattcggtcacttcagtcttattaagttcatgcatacccacgactgagcagttccactcatggatacatagctcgggggaatattccacaggtccataaagagagatgcatgaggaagttgatcagtgttctttgtggtggtggggagaggaggcagcctgggtatccaccccttgggagagtatgtgtgccgtggagccctgcacagcagttcggggctgccagatgggacctaaaacccagtgctgaggggaaaaagtgtatcaagaatgtatacacaaaagttggccaggcgcggtggcttacttctgtaatgccagcactttgggagcctgaagcgggtggatcacctgagtcaggagttcgagaccagcctgacaaacatggttaaaccccgtctctactagaaatacaaaattagccaggcgtggtggcgcatacctgtaatcccagctactcaggaggctgaggcaggagaatcgcttgaacctgggaggcggaggttgcagtgagccaaggtcgcgccattgcactcctgcctaggcaataagagtgaaactccatctcaaaaaaaaaaaaaaaaaaaaaaaagaatgtacacacaaaagaattcacattttggaagaacacttagaaactgagaagacacagtaaacacactagaggccaggtgtggtggctcatgcctgtaatcccaacactttaagaggccaaggtgggaggatcacttgaggccaggagttcaagaccagcctgggcaacatagtgagacctccatctctataaaacaaaacaaaaaaatgctaataaaacatgctagaatgattgattagggtaaggaggagggctttggggtataaaagggagtaaataaaaaaggaagcagaagaagctcactatgtcatggagtgaaagggctggatggcagggtggacaagagcaccatcagggagacttagccagaaactgctgagagaacagtgaccagaccttgcagcacaaaatggagaggatggccaggcctgcaggagactgaggaaggggattttcagagcctagtggttgacagaatggaggagggaggagggagagggaggagctgagtttggcacccagatttctgggtggatgactaagccaatggagcccacactaagtggtgaacccaggaccaggagcaggttgtggggcaggggatgagttcaatatgggcatggtaagcttgagggactgtgcagcaagctagtggagatatccacagggcagttggctgccgctgtggtctgaatgctgtgtccctgcaaattcatatgaaatccgaacccccaaggtcattatattaggaggtgggggcctttgagaggtgattagggattagtgaatgggattagtgcccttataaaaaagagccttcagagagctccctcactactcacaccatgggaggacactgagaagatggcatctgtgaaccagaaagcaggccctcaccagacaccgaatctgccaggccttgatctcggacttcccagcctccacaactgtgagaaataaatgtttgctgtttac

SEQ ID NO: 530 - DNA, 949 bp, Homo Sapiens
gtccataactaaccttctacttcttattgtacctatcctaatcgccatggcattcttcatgctaactgaatgaaaaatcctaggctacatgcaactacgcaaagggcccaatattgtaggcccctatggactattacaaccttttgccgatgccataaaactctttaccaaagaatccttaaaaccctcaacgtcaactgttaccctctacatcactgccccaaccttagccctctctattgcccttctactatgaactcccctccctatacctaaccccctagttaatcttaacttaggccttctattcattctggctacatccagcctagctgtctactctatcctatgatcaggatgagcatcaaactcaaactatgccctgatcggcgcattatgagcagttgcccaaacaatttcatacgaagttaccctagctatcatcctattatcgatcctactaataagtggccaattcaatctctgcaccctcattagaacacaagaacacctctgactactcctaacatcatgacccctagctataatatgatttatttccacactagcagaaaccaatcgagctgcttttgaccttactgaaggagaatcagaactagtctcaggcttcaacattgaatatgctgcaggcccattcgccctattctttatagccgaatacataaatatcattaaaataaatgccctaactgccataatcttcctaggtacaatatataatattcacctaccagaactctacacaatatgcttcaccattaaaaccctattcctaacctctctatttttatgaatccgaacagcatacccccgattccactacgatcaactcatgtatctcttatgaaaaaatttcttaccatttacactagcactacttatatgatacatctcaatatccgctacaatttccaacattcccccctaa

SEQ ID NO: 531 - DNA, 2627 bp, Homo Sapiens
ttgatccaggatttctaggaggattctaggtgacagaaaaaggggtaccacgtcatctcagtttgctatttgctatattgacctcctaatttctttttttaaatttatcaaaatagataaattgtggtatattcacacatttaaatattatacaaaaatgcaaataagcaaattacaaaagggtctgatatcgtagaaccttggagagacttggcctcaaagacgccatgtgtaagggaaagtggaagtggcacatggggcttaaaacaagggggttgactgaaggctggtggataatgctatctactcctagacctcctaaccctactcctacacacagaacacccagaactctagtgtctagccacaaggcaagaggtcagagggttcctcattggagaaagccccagcaaaaaagactacctcattctagccctacctcatttggggtctttggctcaactactcatgtatgcaaggctcccagtcagcttttcattgcctgcctcttaaatataaacagataaccaagataaaatagagaaatcaagtgtataaacagaaaacgtgaacccagaggaaatcaagataacatgcaaagtagaagagtatttcaaaagaatcaaattagtgtgctcagaaaaagatgaaaaacttgtaactagacggtactatactgtctatgagaaaggaactatcaataagaaaggactctgagaaattaaaaattgaaatgctgaagtgaacaattcaatagaattaaaagataaatttaagggattttcccaggaggtaagataaagataaaggaggcagaaaacacaagaagaaaataagaaacaaaatatttatttaagggtttcaatagttgactaatggtagatccagaaaaattaattttaaaagggggcgtggaggaagaattaacaaagatataatacaagaaattttctcacagctgaagaatacaagtctacagaatagacagaaccactgaatgctcaacaaagataaatgcaaagtaatcaacatatagatacactgccatgaaatgtcagaacactaaaaataggcaatataaaaagcttcaagaaagaaaaatatgtcatacataaaggattaagtaccaaaatgccatcacatttttcaatagtagcattggatgcaatattttcaatatcatcaaaattctgagagaaatcattttcaactgaatttatatgcccagccaaactgttgatcaatgtgagattaaaagaaatagtctcacaaagtttacctccagtgcactctttttaaaggaaattatttgagaatgtgctccagcaaaatgagggagtaaaccaaggaaaaggatacatggtatccaagaaacaatgggccaacccagaaaaacagcaaagagaaatctcagaagagaagcaatgcacagagccaaggaggagccagaccacattggagatggagtctctggaaagggagagtataataaaatatggaattggatgggaaggctggaaaccaatgaaaatgtgataatggtaaatagcacaaggggaaaagggcaggtagaaattccaggttggggttgggggtgcggaatgatattaaaaaaataaaatacaatcataatacactacttggctctccaaaggaacagtatttaaatagtgtttttggcgtggaggggtataagctaaaacctcacctatcacagcaggaatacaatgactaatgaaagatacataataaatcaagaaacagaaattgaagcatattattgcaagtgatcagacatactgtaactaggagctgtaaaggagctgaaattctgggatgagaactagggattcggggtggatgtgggcagagatctatttttttaaccaacgtatgtaatacactgatgtcttttttaaatggcctttaactctggtagcagggtagaactctgattacaggtggttaagaatggattcagggaaactggttaggagagtattgcagcagtaccggcaggaaacaaaggtttattggactacatttgtggttggtggagatggggacaagacgatggaaaaaatgccattaggagatcaaattgacaggcctagctggtgggttgggtgaagggatagtgagaaagctggggatccagggaggatgcctagtttcctgcttgtgcatgtgggtggacagtgaggcccctcaatgagaatcctagtcaagaatcaagttgttaggaggaagtagtgggctcagatggagacaggtagagtttaaggtgcttgggaggcatggaggacaagacactaggcaggaggttataaacacagctctgagctcccatcacatatccagggctaggcaacaagcctgttaatgcaggtgagctctcctagggagggactgaggacaccagagagaagtagttgatggtgtaagggtgacactggtctcacatcagatatatccagcacagagacccggactggtacagatctcaacatagtcacacagtcacagcatccttacaggcacacttataactcagaccccccaaggattagccattactttaatttttttttttcaagacagggtctcactctgtcacccaggttgga

SEQ ID NO: 532 - DNA, 2846 bp, Homo Sapiens
gaaacacccatcagctagatttcacagttaacattttgctatatatatttcatctacttgttttttgccaaaatatctttaagtaaattaaaaactcatgaaatcctcaagcctaaatactttataacatatctttaaaagtaataataatgacatttttctgcataaccacaacactattattacacctaataaaatctttgtcatatcttagaaaataatttttactatctgtttttttttttttttttttggagaatagtgaatatatttacataaatcaaaatccaaaaggaacgaaagtgcacccggttaaggggaagtcttcctgccattcctgagcctggtcccaggccctgccctagtttcccgtgtagctttctagaatagtccatgcacagaatcatttatatataaagaaaatataagcacagtgaagtcagagacttgttcaccactgaatccttagacctaaaataatgcccagcactcacatatttttttgaataaataatttttttttttttttttgagacagagtctcacactgtcgcccaggctggagtgcagtggcgccatcttggctcactgcaacctccacctcctgggttcaagcgattctcctgcctcagccttccgagtagctgggattacaggtgtgcaccaccatgcctggctaatttttgtatttctagtagagacagtgtttcaacatgttggccaggctggtctcgaactcctgacctccagtcatccacccgcgtcaacctcccaaagtgctggaattacaggcatgagccactgggcctggccagaataaatgaatttttaatcagtggttatatgctataatactgtttgtacttcactattttttttacttgtttccaaatcagttcttgtgagctgcctcattctttttagtagctgcaaaatactcttatgtgagactgaactatgatttatgtaacaagtctcctacggatacacatttgtgtttttccaacattctgctattaacaacgctgtaataaatatccttgtacaaggccaggcatggtggctcacacctgtaatcccagcactctgggaggcagacacgagttcaagaccagactgggcaacatggtgaaaccccgtctctacaaaaaatataaaaaattagccaggaatagtggagtgtgcctgtaggcccagctactcaggaggcttgggtgggaggatcaccagagcccaggaagtcaaggctgcagtgagtcgtgattgcgccactgcattccagtctgggcgacagagtgagatcctgtctcaaaaaaaaaaaaaagaaaaaaaagaaagaaaagaaagaagaaaaggaaggaaggaaggaagggagggagggaaggaaggaaaggaaggtacatttcggggcacggtggctcacacctgtaatcccaacaacttgtaagactgagatgggaattcaagaccaagaccagcctgggcaacacagcaagaccccatctctaaaaataaacacataaatgctgctgctgctttttttttttttttaaggtgcatttggctcataaacgtcacaggctttgtccgtaaaaaaggagaaatgtttgttccctgtctgctttctcttttcacttaggggttctcaagtgtgggtgtggaccctccaccaaaatacctaacactgggtgcactataaatgcttgtttgatgaatgatgttgttggcagtgcaccccagaggtcccatttttcacatatgaggaaccactcctaattatttagcccaggatatgattcatctaggtgaaaaccctttccaaacagattgccacacctgtgattcttcgctcttgggaaaagacagagtaaaagagcaaagttttgtgagaggttgggaggtggcggtggtagcagggacggagccgtggaggagcaggtgcagaggtgcagagagaagccccgttcacccaacctgggtgagttccctgcacagaagaggcctcgtgggcagcttagcttttgacagtaaagatgcctacagcaggaaaaaaacggggatgagctgtgggcagagaggcgtgaagtcaggaaacacaggatctagcccagctctgacggtgacgagccagtgagcccttgatctccctagcctcaggctcctcatctgatctgtggaggtcgaacctggatgttttccaaagttggttttaggtaaaacagtttgaaattgtatggccagcttcaattatataaatattttaaatttctatatgaagatagcaccaacaaagttacagggcaagcaaagatccaaagattggaaacagtgtctccctcaaatggggaacagttaaataaatgatggtgtccctgtagctacccactggaatatcatgcagtggtaaaaagaaagcagaggctctttacatactgataaggaacaatcttcaactcacaggtaaataagatagtaaggtgcaggctgggggcagtggctcatgcctgtaatcccagcactttgagaggctgaggctggcagatcacctgaggtcaggagtttgagaccagcctggccaacatggcaaaaccccgtctctactaaaaatacaaaaatcagccgggcgtggtggcgggcacctgtagtcccagctactcaggaggctgaggcaggagaatctcttgaacccaggaggtggaggttgcagtgagctgagattgcgccactgcactccagcctgggtgacagtaatatcggctgctttcagagaggaaagctggtgactagagaacagaaggtgggcgaggggaaacttcttattggatactcctttgtacctttcacac

SEQ ID NO: 533 - DNA, 1595 bp, Homo Sapiens
gcaggcgtgagccaccgtgcccggccgagttgaagtactttttctggaacaaagaaacttagcataaatagttaaaatagtaagaattgtaattaagggaaatttcagctcaatatgacttcaacagttttaaaaatgtattatttcacataagaccatggagagaggaattggaagccccagaattgattgggtcagaaattgaaaatgatattatcagtgacccaggtttgaatgtctctccccacagcattgacttcactaatggatgtgacctggttggcagcagcagcttgcacaacatgcttgtttgcagtgagtagtagagagaaggttttgctttcccagaaactctgaaaaaggtcatcaaacctaaatttccttagcctttttcttccatgagcaaatcactagcagatgactgctagcaaggtgttactattacaatgaacccctaagtgtcagagaaagagttagtttggggaaatatcctctccaccacaatcttagtcattgaagtcaatttaacaatatattgaaatatttttcttagaagtttaaagttccattaaagagtagcaattacagaaattataggtagcctttagttctacaagtgacatttcaaaagggagatgattcatcaatttcaaactttgcctgcaaataatactggatgaaaattaacttggcaaacataattaataatcatgggttattaattacttctgcaaggtgggtgtgctgattttaaaaggcttgaataaaacataaatttccttaatttatactgtaaatggagtaatttggtgatgtaaatggtaatatgtaagtgacttctgcttcagatcttacaacttaaaatatttttctaaaattagtttttgtaccatctctccagcatgttccagcctttatcagtcagtccaggcttctataacaaaatatcatggactgaattgcttacacaacagacatttctcacaattgtagaagctggaaagtgcaagattaaggtgctagcaaatttgtttcctggtgagggtcctcttcccggcttgctgtatcctcacatagcagatagagagagaaagagagagagagagagcactctatagactctcttcctgttcttctaaggacactaattccattgatgagggccctacgctcatgacttagtctaaacctaattaattctcaaaggcctcacttcccaacactgtcacattgtggggtagggctttaacatatgaaatttgagggaaaaggaatgttcagtctagaacaaagccccatacatttcaaaaagctgtgggacaggagggaatggggatggtattcaatggtaccacatccaagcaagtcttgtatggttaaaacaaatcaatataataacatgaaattttacacagaaacctatctgattataaactgtatgcttaccataatcaacactgatgtacattgttttaaaaatacttaatagtgttctttgtttaaccaaataatagaggtattaactagtttcctagtgctgccaaaagaaattgctacaaaatttgtggcttaaaatagtaaaaaaaaaaaaaaaa

SEQ ID NO: 534 - DNA, 8243 bp, Homo Sapiens
atagtaggcgttgataggatagggtgcccgggagaactaaggagaggagttcggggtcggggcgcgggaaggcgggaggtgcccggcaaccctaggagcccggcgcggggcacgatgggacgcccccgggaagaggcggagctgggttcgagcgctggggctgcggttgggaaactactggaggatgtggtgcaccagaataagagaataaaccaagaaacaggaagacgtgatccaggcaacaggatattccagtatagatgtgaaggagcaaagagaaggagccagaagctagagggggctgcttggtaagagctgtggtctttgctaaagggacacagacaacccatgtgacctggcaatgagaaagccagagtactctgaccatctcttccttatatcttctcatcttctttggatattaataattggataaacagaagctgaagtcagagggcaagggagccattcatgctgcagtccatgtgggtcagcacccgctggggtccagagtgggatgaagaggggttctgaaaggcaaatggaagacatctagtataacctctccctgaacgtaattcaaactacttaactattattacagacaaaaatcacatgtatgctgaaagtaaaataacctgtttccagaatttctgattgcaaaattctgagttcttcaattaaacctgcatttttctcagtctttttggtgcccctgcttcactggtgccttaagaacatttgagagcctaagggcagccctgagcatggtgcctgaactagggtgcctcaaaactagggactgaggaagtctcaagttcattcctgaatgctgactataagagtctctgagagagttttgagaatgtagaactgatttagaatgaatctcaggatttttctgttaagatctataaattaggaattaaggaactggattttttttgaatttgaaaaatcctatgatagtataactttgcataagcctactgaatgataggaaagtttttagtttcttatcaaagaaagagaataaagtgaatcaggacatcagtttcacattgacatttttattaacgccaactgttttttaattatttttttaaaacaatagcacaaaaatgtttcaaggaagcagtctcacaatctgatgaccttctgaaataccgttaagccacaccaaatatgaatttctgttaataacacaaaatatttttttaagaaaaaaagaaaaaaaaggtagggaaagaagaagggaatgagatttagatttaaaactcattggattaaataggtgaggcttattaggatatactgttgaagcaaacagtggcacacacaggcttacagtctttgttttttaaaccagttaccactaatgtattaagccctgcagcagttaccactgacttctcgcacgcataaaatgaaccgggagaagccagtgttgatactgttgtgaagaggttcaagagctggcttttcagacaactaagaccatttttagcagaataactccttcagaaaggcctggctgaagatctttttatttctattgtctcacctatataaatttcagggttcttataagtcatctttaaaaagaaaaaaataatgtatatcagtttctcttatttaatgtggctatgaaagatgtttccttattatttcttcatctctaagaaggacaccagggaatgggggttgggggtggaactaaagggaggaaaaaaaccagaacagggtaggtttttgttttttgctttttgtttttttttggccaaggggtcggtcacacagaagggaaggcaaggaggaaaactaaactacaatccttggttcagattgagttatgcaggaatatatcttcctgatcagtccccgtgccaaaaaaaaaaaaagccacttggaattatgcactgactccaactatgtgataccagctatcagccttttgtgtttaaccattcccagaaatggacaccacccttggctttataggctccttgcagaacccacttcacaaaaatgctcttcaccaagaagcctctagtttccttttggtaggttataaaaacagaacatctgtcattaacagtagagtgttaaatacttttaaccactgacaaggcttcagaaagtttcacagtttcgttatgctctattttattactatcatatttacatttttattttttatttattttttgctgaattgctgattttcctttttcaatagaatttaattctggagtgtgagcaggaaccagttaactacattcattgtccaacccccactggtttgaaagaagactccaaattcttggcatatgaatcagctgttcggtagctccaccttatccctgcagcgaagcagcagaaccgccaatggcggcacctcaggattcacactgtgggtggtgaggccttccgctgaaggaggtactggtggatgctctcagcatctcgctttagccaggcagcattcagcagaatattttcacaacactgctggatggtacgctcagctgaaggagctgggtgactctcgaagaaagcctggtataaaacaacccagaatgcaggatcattactagcaataagaagttaatattacaggttatgaaaaaatacccactggtctatatgaaggatgcataatcttcaggcatgagaatttaccactgccaccctcaggctaaaagaaaacaagcaactccttggacctgcatataggaattctccccttaattatatgcttaacaacctaatcaaaagttaataaagagacagaacctactgcctttcttttaggctaattgtgtagtggtaaatatagtctttggaatgaagacttggaacctgaatccaggcttagtcatgtactagcttgtgactgtgagaaaattaactgctctaagtctcagttttctcaactatgagaaaatatctactccagaagattaaagagacaatccatataaacatttgacaaaatacctagcacagagtacttaaggattcaacacattttggctgcttcaaataaagattaatttgtaagggatgataatacaaagaagtttaaattgctgctatgccctaataatttaacaccccatggtcttttttttttttttttttttgagacagggtctcactctgttgcccaggctagagtgcaatgaaacgatcatggctcatcacagcctcaaccttctgggctcaagtaaacctcccaccttaacttcctgggtagctgggaccacaagcgtgcactcccaggccaaattgttttttcctttttgtagagatggggtcctaccatgttgcccagactggtcttgaactcttgaactcaagcaatcctcccacctcagcctcccaaaatgctggaattacaggaatccaacatttttaatacagtaaaccaaacaatttctaagtttacaatttatcacaatgcttaatgattaaaagttgaataaacttttctaatgcagtacacctggtttcacagaaaacaaagcaactcttaaacaccagctggcaaaatgatagggcttttcctttgaattagtcaccacaggtgtgaaagacagaatgactaatccatctgattaaacatagaccttttagaaatcaataaccttatttacacagatgacaattgctactgttccaaggctcctaatcatggttcagttctcagggcctcaagtctttttccattccatcgcagagtagtaccaacatttatacaccagaaacctggggattatcctggcttgtttttcttcctctcccagatatgctcacaacagagaagccaatcaataaatattgttgaactaaatggttaacaaattcaagcccctgaatctccattattccatctcctccactactgccactaccctactgtaagctattctatcattcttgctaggagagttagcttcccaacatcttctcttccccattccaaactattatccacattgcagccagactgaaatttttataacacaaatcagatcaaggcactgccttgtttataaaccattcgaaggctttccatttttaggacttttttttttttttttttttttgagacaggagtctcgctctgtcacccaggctggagtgcaatggcacgatctcagctcactgcaacctccacctcccgggctcaagcaattctcctgcctcagcctcccgagtagctgggattagaggcgtgcaccaccatgtccagctaatttggggtttcaccatgttgcccgggctggtcttgaagtcctgacctcaggtgatccacccacctcggcctcccaaagtgctgagattacagatgtgagctaccatgcctggccatttttaggaaattcttaatatggcctatacagccctgcatgatgtctttctctaaacaaaaacacagagatgctacagtacattatcccaacactataattacaaccaggttattgtttttacttactagactgaaaagtgaagagtaaacagtattttccttaccttaacctctccagccattttatcaactgcaaatccctcaactgatagctgcaaaacaatggttttaaacagtaagtgaaaccaagaggctgagaacaaacttccatttaccctaaaaataaatcattctgttctctgccaacttcagtctgttataaaggatgtgtgatgggagatggagaagtccttaaataaagccagtaactatttaaggaaacttttttttttttgagacggagtttcacacttgttgcccaggctggagtgcaatgacctcatctcggctcaccacaacctctgcctcccaggttcaagcgattctcctgcctcagcctcccaagtagctgggattacaggcacacaccaccacgctcagctaatttttgtatttttagtagggacaggatttcaccatgttggccaggatagtctcgaactcccgacctcaggtgatctgcccacctcggcgtcccaaagtgctggtattacaggcgtgagccactgcacctggccacaggaaacatttaaagagcaaagaccacaatgtatgggtgtagtgaatcatggatgtcactaaataatatccatgattagcaagctactcaaagtttttcacatacctttattagtctggatattaagaatcctccctggtatcggttataaagttcttcccagttgtcctttatgaatttccaagcagctttcctaccatgcttgctgcctccagctactccaccaattaccgatacagtgtcctgtggacgtacctcttcctaaaaaaagaaagagagctaaaagtctagtgtatcaaaaacatattctggtaccagaaagtgcaccatactgtgacactgaagtaatcacactgaagacacttattccttgttttaggaataactggaaccagaagttctcagcaaagaagataatgtttaagctaaagataaccaaaatgagaatgaggtactgagacaggttcagacagacagactgctcaacagatacttgcttaggagcctataggtttaagaaaggaagagacacaaagtaagcaaaggcataagccagtttcccagttttcaagagtccctgtcctcatagtttccattctggagagacaatttgtttactctcccaactattctgattctcgccactagtgggagaaaaacagaagtcagtaacaaaaactcaagccagttactctggaaaaggaagctttagttagggttaaggcagctcaagaggatcagagctgaatcagagacacttctcagagatgggtaacgattcacttctaaatgcagttttcaccgtaacttactgaaagtgcaaacgtgaggactttttgaatcaggtcaggcaaaagagtagcgccaaggactctttcgattcggtttttctcttcttgcatatctgcttgtttatgaagctacaggaaaaaagataaagataggaatagttaactctcccttggatgttctgcatatgattatatgagcttcttccccagtaaggtaaaacttaggttctatattctcactaggtaagaatggcagggcattatattaaagaaagagaatacttttcaagatgctttgggccaggtgcggtggttcacacctgtaatcccagcactttgggaggccgaggcgggtggatcacctgaggtcaagagttcgagatcagcctggccaacatggtgaaaccctgtttctactaaaaatacaaaaaaaaaaaattagccgggcgtggtggtgcccacctgtaatcccagctacttgggaggccgaggcgggagaatcgcttgaacctgggaggttgcagtgagctgagatcgtgccactgcactccagtttgggcaagagagcgagactctgtctcaaaaataaaagaaaaaaaaaatgatgctttggcactaaatttgtcatctgctgttacagtaagtaaatcactagatgtaaatgctaccagatgaacagcctgtcattagttcagaccagtttaacatcaagatctaagaggtaaaatctatcatagccaaattctttacatcattgatatctggctaatgttctgttttagaagaacaaactaatcattagtgttcttataccagatcatcaaattaatttataatagtgaaaaattgaaaatgaatactgtacttataaaaatgcattattgaaagttatattttaagaatatatcataaacatgttcttatatttaagtgaagaaagcagacaaagcagaattatcctaaaaaatatatatatatatatggctgggcacagtggttcacgcctgtaatcctagcactttggaaggctgaggtggaggttgcagtgagcccatatcgtaccactgcactccagtctggacaacagagcaagactgtgtttccaaaaaaagggggtgggggagaacccctggaaatacatcaaaatggtagtattaattaatgatggtttctgatcagtgggattatgcatcttcacactttttaactgcaaaagcagcacatactgaatgcagaatatctgaaagacagagaagcataaagaaaaaaataaaattactactatatgtacattaacaaatctggaaagagagcatgttatacatgctgtttttgctacctgctttctaaactataggtaagttttattttcctctttatacttttctagtctctaaatcttccatagtatatatgtatataaaatcttttcatagaaacaaaatgttgtaattcttaaaaattagaactataaatgtataagagctatgtctccaagacaatttagactcttttgatcttttctaccccttaagatttaacactgaccagagtgtctggagacctcatcaaagctctcagtttcctcttcctttcgacacttttttttttttcaataaacaattttaatttataagaagtagagatggggtctcgctgtgttgaccaggctggtctcttttttttttttttttgagatggagtctcgctctgttgcccatgctggagtgcaatggtgttacctcagctcactacaaccacgcctagctaatttttcttttctttttttttttttgagacggagtcttactctgtcacccaggctggagtgcaatggcacaatatcggctcaccacaacctccacctcccaggttcaagcaatgctcctgcctcagcctcctgagtagctgggactacaggcgcccgccaccacacccggcgaatttttgtatatttagtagagacagggtttcaccatttgggccaggctggtcttgaactcctgaccttgtgatccacacccgcctcggcctcccaaagtgctgggattgcaggcgtgagccaccgcgcctggcctaatttttctatttttagtagagccggagtttctccatgttgcccaggctggtcttgaactcctggcctcaagtgatcctcccatccaaagtgctgggattacaggcatgaaccaccacgcctggcccctttggactctaagcagcagtgcagtaaaatagacaggaccttgggagatctgggttctagtcccagttttgcctctaactagctgtgtgatcttgactaagtccttcatccctctgggtctcagtttccccatgtgtaaaatgagatgggtggacagataatttctaaggcccttttcagctccaatat

SEQ ID NO: 535 - DNA, 8324 bp, Homo Sapiens
atagtaggcgttgataggatagggtgcccgggagaactaaggagaggagttcggggtcggggcgcgggaaggcgggaggtgcccggcaaccctaggagcccggcgcggggcacgatgggacgcccccgggaagaggcggagctgggttcgagcgctggggctgcggttgggaaactactggaggatgtggtgcaccagaataagagaataaaccaagaaacaggaagacgtgatccaggcaacaggatattccagtatagtgttggaaacagaagcccagtagtgaaagctacagctgccatatacttgcagtggaatcacaggagcaatcacaggtctttatgtgaaggagcaaagagaaggagccagaagctagagggggctgcttggtaagagctgtggtctttgctaaagggacacagacaacccatgtgacctggcaatgagaaagccagagtactctgaccatctcttccttatatcttctcatcttctttggatattaataattggataaacagaagctgaagtcagagggcaagggagccattcatgctgcagtccatgtgggtcagcacccgctggggtccagagtgggatgaagaggggttctgaaaggcaaatggaagacatctagtataacctctccctgaacgtaattcaaactacttaactattattacagacaaaaatcacatgtatgctgaaagtaaaataacctgtttccagaatttctgattgcaaaattctgagttcttcaattaaacctgcatttttctcagtctttttggtgcccctgcttcactggtgccttaagaacatttgagagcctaagggcagccctgagcatggtgcctgaactagggtgcctcaaaactagggactgaggaagtctcaagttcattcctgaatgctgactataagagtctctgagagagttttgagaatgtagaactgatttagaatgaatctcaggatttttctgttaagatctataaattaggaattaaggaactggattttttttgaatttgaaaaatcctatgatagtataactttgcataagcctactgaatgataggaaagtttttagtttcttatcaaagaaagagaataaagtgaatcaggacatcagtttcacattgacatttttattaacgccaactgttttttaattatttttttaaaacaatagcacaaaaatgtttcaaggaagcagtctcacaatctgatgaccttctgaaataccgttaagccacaccaaatatgaatttctgttaataacacaaaatatttttttaagaaaaaaagaaaaaaaaggtagggaaagaagaagggaatgagatttagatttaaaactcattggattaaataggtgaggcttattaggatatactgttgaagcaaacagtggcacacacaggcttacagtctttgttttttaaaccagttaccactaatgtattaagccctgcagcagttaccactgacttctcgcacgcataaaatgaaccgggagaagccagtgttgatactgttgtgaagaggttcaagagctggcttttcagacaactaagaccatttttagcagaataactccttcagaaaggcctggctgaagatctttttatttctattgtctcacctatataaatttcagggttcttataagtcatctttaaaaagaaaaaaataatgtatatcagtttctcttatttaatgtggctatgaaagatgtttccttattatttcttcatctctaagaaggacaccagggaatgggggttgggggtggaactaaagggaggaaaaaaaccagaacagggtaggtttttgttttttgctttttgtttttttttggccaaggggtcggtcacacagaagggaaggcaaggaggaaaactaaactacaatccttggttcagattgagttatgcaggaatatatcttcctgatcagtccccgtgccaaaaaaaaaaaaagccacttggaattatgcactgactccaactatgtgataccagctatcagccttttgtgtttaaccattcccagaaatggacaccacccttggctttataggctccttgcagaacccacttcacaaaaatgctcttcaccaagaagcctctagtttccttttggtaggttataaaaacagaacatctgtcattaacagtagagtgttaaatacttttaaccactgacaaggcttcagaaagtttcacagtttcgttatgctctattttattactatcatatttacatttttattttttatttattttttgctgaattgctgattttcctttttcaatagaatttaattctggagtgtgagcaggaaccagttaactacattcattgtccaacccccactggtttgaaagaagactccaaattcttggcatatgaatcagctgttcggtagctccaccttatccctgcagcgaagcagcagaaccgccaatggcggcacctcaggattcacactgtgggtggtgaggccttccgctgaaggaggtactggtggatgctctcagcatctcgctttagccaggcagcattcagcagaatattttcacaacactgctggatggtacgctcagctgaaggagctgggtgactctcgaagaaagcctggtataaaacaacccagaatgcaggatcattactagcaataagaagttaatattacaggttatgaaaaaatacccactggtctatatgaaggatgcataatcttcaggcatgagaatttaccactgccaccctcaggctaaaagaaaacaagcaactccttggacctgcatataggaattctccccttaattatatgcttaacaacctaatcaaaagttaataaagagacagaacctactgcctttcttttaggctaattgtgtagtggtaaatatagtctttggaatgaagacttggaacctgaatccaggcttagtcatgtactagcttgtgactgtgagaaaattaactgctctaagtctcagttttctcaactatgagaaaatatctactccagaagattaaagagacaatccatataaacatttgacaaaatacctagcacagagtacttaaggattcaacacattttggctgcttcaaataaagattaatttgtaagggatgataatacaaagaagtttaaattgctgctatgccctaataatttaacaccccatggtcttttttttttttttttttttgagacagggtctcactctgttgcccaggctagagtgcaatgaaacgatcatggctcatcacagcctcaaccttctgggctcaagtaaacctcccaccttaacttcctgggtagctgggaccacaagcgtgcactcccaggccaaattgttttttcctttttgtagagatggggtcctaccatgttgcccagactggtcttgaactcttgaactcaagcaatcctcccacctcagcctcccaaaatgctggaattacaggaatccaacatttttaatacagtaaaccaaacaatttctaagtttacaatttatcacaatgcttaatgattaaaagttgaataaacttttctaatgcagtacacctggtttcacagaaaacaaagcaactcttaaacaccagctggcaaaatgatagggcttttcctttgaattagtcaccacaggtgtgaaagacagaatgactaatccatctgattaaacatagaccttttagaaatcaataaccttatttacacagatgacaattgctactgttccaaggctcctaatcatggttcagttctcagggcctcaagtctttttccattccatcgcagagtagtaccaacatttatacaccagaaacctggggattatcctggcttgtttttcttcctctcccagatatgctcacaacagagaagccaatcaataaatattgttgaactaaatggttaacaaattcaagcccctgaatctccattattccatctcctccactactgccactaccctactgtaagctattctatcattcttgctaggagagttagcttcccaacatcttctcttccccattccaaactattatccacattgcagccagactgaaatttttataacacaaatcagatcaaggcactgccttgtttataaaccattcgaaggctttccatttttaggacttttttttttttttttttttttgagacaggagtctcgctctgtcacccaggctggagtgcaatggcacgatctcagctcactgcaacctccacctcccgggctcaagcaattctcctgcctcagcctcccgagtagctgggattagaggcgtgcaccaccatgtccagctaatttggggtttcaccatgttgcccgggctggtcttgaagtcctgacctcaggtgatccacccacctcggcctcccaaagtgctgagattacagatgtgagctaccatgcctggccatttttaggaaattcttaatatggcctatacagccctgcatgatgtctttctctaaacaaaaacacagagatgctacagtacattatcccaacactataattacaaccaggttattgtttttacttactagactgaaaagtgaagagtaaacagtattttccttaccttaacctctccagccattttatcaactgcaaatccctcaactgatagctgcaaaacaatggttttaaacagtaagtgaaaccaagaggctgagaacaaacttccatttaccctaaaaataaatcattctgttctctgccaacttcagtctgttataaaggatgtgtgatgggagatggagaagtccttaaataaagccagtaactatttaaggaaacttttttttttttgagacggagtttcacacttgttgcccaggctggagtgcaatgacctcatctcggctcaccacaacctctgcctcccaggttcaagcgattctcctgcctcagcctcccaagtagctgggattacaggcacacaccaccacgctcagctaatttttgtatttttagtagggacaggatttcaccatgttggccaggatagtctcgaactcccgacctcaggtgatctgcccacctcggcgtcccaaagtgctggtattacaggcgtgagccactgcacctggccacaggaaacatttaaagagcaaagaccacaatgtatgggtgtagtgaatcatggatgtcactaaataatatccatgattagcaagctactcaaagtttttcacatacctttattagtctggatattaagaatcctccctggtatcggttataaagttcttcccagttgtcctttatgaatttccaagcagctttcctaccatgcttgctgcctccagctactccaccaattaccgatacagtgtcctgtggacgtacctcttcctaaaaaaagaaagagagctaaaagtctagtgtatcaaaaacatattctggtaccagaaagtgcaccatactgtgacactgaagtaatcacactgaagacacttattccttgttttaggaataactggaaccagaagttctcagcaaagaagataatgtttaagctaaagataaccaaaatgagaatgaggtactgagacaggttcagacagacagactgctcaacagatacttgcttaggagcctataggtttaagaaaggaagagacacaaagtaagcaaaggcataagccagtttcccagttttcaagagtccctgtcctcatagtttccattctggagagacaatttgtttactctcccaactattctgattctcgccactagtgggagaaaaacagaagtcagtaacaaaaactcaagccagttactctggaaaaggaagctttagttagggttaaggcagctcaagaggatcagagctgaatcagagacacttctcagagatgggtaacgattcacttctaaatgcagttttcaccgtaacttactgaaagtgcaaacgtgaggactttttgaatcaggtcaggcaaaagagtagcgccaaggactctttcgattcggtttttctcttcttgcatatctgcttgtttatgaagctacaggaaaaaagataaagataggaatagttaactctcccttggatgttctgcatatgattatatgagcttcttccccagtaaggtaaaacttaggttctatattctcactaggtaagaatggcagggcattatattaaagaaagagaatacttttcaagatgctttgggccaggtgcggtggttcacacctgtaatcccagcactttgggaggccgaggcgggtggatcacctgaggtcaagagttcgagatcagcctggccaacatggtgaaaccctgtttctactaaaaatacaaaaaaaaaaaattagccgggcgtggtggtgcccacctgtaatcccagctacttgggaggccgaggcgggagaatcgcttgaacctgggaggttgcagtgagctgagatcgtgccactgcactccagtttgggcaagagagcgagactctgtctcaaaaataaaagaaaaaaaaaatgatgctttggcactaaatttgtcatctgctgttacagtaagtaaatcactagatgtaaatgctaccagatgaacagcctgtcattagttcagaccagtttaacatcaagatctaagaggtaaaatctatcatagccaaattctttacatcattgatatctggctaatgttctgttttagaagaacaaactaatcattagtgttcttataccagatcatcaaattaatttataatagtgaaaaattgaaaatgaatactgtacttataaaaatgcattattgaaagttatattttaagaatatatcataaacatgttcttatatttaagtgaagaaagcagacaaagcagaattatcctaaaaaatatatatatatatatggctgggcacagtggttcacgcctgtaatcctagcactttggaaggctgaggtggaggttgcagtgagcccatatcgtaccactgcactccagtctggacaacagagcaagactgtgtttccaaaaaaagggggtgggggagaacccctggaaatacatcaaaatggtagtattaattaatgatggtttctgatcagtgggattatgcatcttcacactttttaactgcaaaagcagcacatactgaatgcagaatatctgaaagacagagaagcataaagaaaaaaataaaattactactatatgtacattaacaaatctggaaagagagcatgttatacatgctgtttttgctacctgctttctaaactataggtaagttttattttcctctttatacttttctagtctctaaatcttccatagtatatatgtatataaaatcttttcatagaaacaaaatgttgtaattcttaaaaattagaactataaatgtataagagctatgtctccaagacaatttagactcttttgatcttttctaccccttaagatttaacactgaccagagtgtctggagacctcatcaaagctctcagtttcctcttcctttcgacacttttttttttttcaataaacaattttaatttataagaagtagagatggggtctcgctgtgttgaccaggctggtctcttttttttttttttttgagatggagtctcgctctgttgcccatgctggagtgcaatggtgttacctcagctcactacaaccacgcctagctaatttttcttttctttttttttttttgagacggagtcttactctgtcacccaggctggagtgcaatggcacaatatcggctcaccacaacctccacctcccaggttcaagcaatgctcctgcctcagcctcctgagtagctgggactacaggcgcccgccaccacacccggcgaatttttgtatatttagtagagacagggtttcaccatttgggccaggctggtcttgaactcctgaccttgtgatccacacccgcctcggcctcccaaagtgctgggattgcaggcgtgagccaccgcgcctggcctaatttttctatttttagtagagccggagtttctccatgttgcccaggctggtcttgaactcctggcctcaagtgatcctcccatccaaagtgctgggattacaggcatgaaccaccacgcctggcccctttggactctaagcagcagtgcagtaaaatagacaggaccttgggagatctgggttctagtcccagttttgcctctaactagctgtgtgatcttgactaagtccttcatccctctgggtctcagtttccccatgtgtaaaatgagatgggtggacagataatttctaaggcccttttcagctccaatat

SEQ ID NO: 536 - DNA, 8157 bp, Homo Sapiens
atagaaactactggaggatgtggtgcaccagaataagagaataaaccaagaaacaggaagacgtgatccaggcaacaggatattccagtatagtgttggaaacagaagcccagtagtgaaagctacagctgccatatacttgcagtggaatcacaggagcaatcacaggtctttatgtgaaggagcaaagagaaggagccagaagctagagggggctgcttggtaagagctgtggtctttgctaaagggacacagacaacccatgtgacctggcaatgagaaagccagagtactctgaccatctcttccttatatcttctcatcttctttggatattaataattggataaacagaagctgaagtcagagggcaagggagccattcatgctgcagtccatgtgggtcagcacccgctggggtccagagtgggatgaagaggggttctgaaaggcaaatggaagacatctagtataacctctccctgaacgtaattcaaactacttaactattattacagacaaaaatcacatgtatgctgaaagtaaaataacctgtttccagaatttctgattgcaaaattctgagttcttcaattaaacctgcatttttctcagtctttttggtgcccctgcttcactggtgccttaagaacatttgagagcctaagggcagccctgagcatggtgcctgaactagggtgcctcaaaactagggactgaggaagtctcaagttcattcctgaatgctgactataagagtctctgagagagttttgagaatgtagaactgatttagaatgaatctcaggatttttctgttaagatctataaattaggaattaaggaactggattttttttgaatttgaaaaatcctatgatagtataactttgcataagcctactgaatgataggaaagtttttagtttcttatcaaagaaagagaataaagtgaatcaggacatcagtttcacattgacatttttattaacgccaactgttttttaattatttttttaaaacaatagcacaaaaatgtttcaaggaagcagtctcacaatctgatgaccttctgaaataccgttaagccacaccaaatatgaatttctgttaataacacaaaatatttttttaagaaaaaaagaaaaaaaaggtagggaaagaagaagggaatgagatttagatttaaaactcattggattaaataggtgaggcttattaggatatactgttgaagcaaacagtggcacacacaggcttacagtctttgttttttaaaccagttaccactaatgtattaagccctgcagcagttaccactgacttctcgcacgcataaaatgaaccgggagaagccagtgttgatactgttgtgaagaggttcaagagctggcttttcagacaactaagaccatttttagcagaataactccttcagaaaggcctggctgaagatctttttatttctattgtctcacctatataaatttcagggttcttataagtcatctttaaaaagaaaaaaataatgtatatcagtttctcttatttaatgtggctatgaaagatgtttccttattatttcttcatctctaagaaggacaccagggaatgggggttgggggtggaactaaagggaggaaaaaaaccagaacagggtaggtttttgttttttgctttttgtttttttttggccaaggggtcggtcacacagaagggaaggcaaggaggaaaactaaactacaatccttggttcagattgagttatgcaggaatatatcttcctgatcagtccccgtgccaaaaaaaaaaaaagccacttggaattatgcactgactccaactatgtgataccagctatcagccttttgtgtttaaccattcccagaaatggacaccacccttggctttataggctccttgcagaacccacttcacaaaaatgctcttcaccaagaagcctctagtttccttttggtaggttataaaaacagaacatctgtcattaacagtagagtgttaaatacttttaaccactgacaaggcttcagaaagtttcacagtttcgttatgctctattttattactatcatatttacatttttattttttatttattttttgctgaattgctgattttcctttttcaatagaatttaattctggagtgtgagcaggaaccagttaactacattcattgtccaacccccactggtttgaaagaagactccaaattcttggcatatgaatcagctgttcggtagctccaccttatccctgcagcgaagcagcagaaccgccaatggcggcacctcaggattcacactgtgggtggtgaggccttccgctgaaggaggtactggtggatgctctcagcatctcgctttagccaggcagcattcagcagaatattttcacaacactgctggatggtacgctcagctgaaggagctgggtgactctcgaagaaagcctggtataaaacaacccagaatgcaggatcattactagcaataagaagttaatattacaggttatgaaaaaatacccactggtctatatgaaggatgcataatcttcaggcatgagaatttaccactgccaccctcaggctaaaagaaaacaagcaactccttggacctgcatataggaattctccccttaattatatgcttaacaacctaatcaaaagttaataaagagacagaacctactgcctttcttttaggctaattgtgtagtggtaaatatagtctttggaatgaagacttggaacctgaatccaggcttagtcatgtactagcttgtgactgtgagaaaattaactgctctaagtctcagttttctcaactatgagaaaatatctactccagaagattaaagagacaatccatataaacatttgacaaaatacctagcacagagtacttaaggattcaacacattttggctgcttcaaataaagattaatttgtaagggatgataatacaaagaagtttaaattgctgctatgccctaataatttaacaccccatggtcttttttttttttttttttttgagacagggtctcactctgttgcccaggctagagtgcaatgaaacgatcatggctcatcacagcctcaaccttctgggctcaagtaaacctcccaccttaacttcctgggtagctgggaccacaagcgtgcactcccaggccaaattgttttttcctttttgtagagatggggtcctaccatgttgcccagactggtcttgaactcttgaactcaagcaatcctcccacctcagcctcccaaaatgctggaattacaggaatccaacatttttaatacagtaaaccaaacaatttctaagtttacaatttatcacaatgcttaatgattaaaagttgaataaacttttctaatgcagtacacctggtttcacagaaaacaaagcaactcttaaacaccagctggcaaaatgatagggcttttcctttgaattagtcaccacaggtgtgaaagacagaatgactaatccatctgattaaacatagaccttttagaaatcaataaccttatttacacagatgacaattgctactgttccaaggctcctaatcatggttcagttctcagggcctcaagtctttttccattccatcgcagagtagtaccaacatttatacaccagaaacctggggattatcctggcttgtttttcttcctctcccagatatgctcacaacagagaagccaatcaataaatattgttgaactaaatggttaacaaattcaagcccctgaatctccattattccatctcctccactactgccactaccctactgtaagctattctatcattcttgctaggagagttagcttcccaacatcttctcttccccattccaaactattatccacattgcagccagactgaaatttttataacacaaatcagatcaaggcactgccttgtttataaaccattcgaaggctttccatttttaggacttttttttttttttttttttttgagacaggagtctcgctctgtcacccaggctggagtgcaatggcacgatctcagctcactgcaacctccacctcccgggctcaagcaattctcctgcctcagcctcccgagtagctgggattagaggcgtgcaccaccatgtccagctaatttggggtttcaccatgttgcccgggctggtcttgaagtcctgacctcaggtgatccacccacctcggcctcccaaagtgctgagattacagatgtgagctaccatgcctggccatttttaggaaattcttaatatggcctatacagccctgcatgatgtctttctctaaacaaaaacacagagatgctacagtacattatcccaacactataattacaaccaggttattgtttttacttactagactgaaaagtgaagagtaaacagtattttccttaccttaacctctccagccattttatcaactgcaaatccctcaactgatagctgcaaaacaatggttttaaacagtaagtgaaaccaagaggctgagaacaaacttccatttaccctaaaaataaatcattctgttctctgccaacttcagtctgttataaaggatgtgtgatgggagatggagaagtccttaaataaagccagtaactatttaaggaaacttttttttttttgagacggagtttcacacttgttgcccaggctggagtgcaatgacctcatctcggctcaccacaacctctgcctcccaggttcaagcgattctcctgcctcagcctcccaagtagctgggattacaggcacacaccaccacgctcagctaatttttgtatttttagtagggacaggatttcaccatgttggccaggatagtctcgaactcccgacctcaggtgatctgcccacctcggcgtcccaaagtgctggtattacaggcgtgagccactgcacctggccacaggaaacatttaaagagcaaagaccacaatgtatgggtgtagtgaatcatggatgtcactaaataatatccatgattagcaagctactcaaagtttttcacatacctttattagtctggatattaagaatcctccctggtatcggttataaagttcttcccagttgtcctttatgaatttccaagcagctttcctaccatgcttgctgcctccagctactccaccaattaccgatacagtgtcctgtggacgtacctcttcctaaaaaaagaaagagagctaaaagtctagtgtatcaaaaacatattctggtaccagaaagtgcaccatactgtgacactgaagtaatcacactgaagacacttattccttgttttaggaataactggaaccagaagttctcagcaaagaagataatgtttaagctaaagataaccaaaatgagaatgaggtactgagacaggttcagacagacagactgctcaacagatacttgcttaggagcctataggtttaagaaaggaagagacacaaagtaagcaaaggcataagccagtttcccagttttcaagagtccctgtcctcatagtttccattctggagagacaatttgtttactctcccaactattctgattctcgccactagtgggagaaaaacagaagtcagtaacaaaaactcaagccagttactctggaaaaggaagctttagttagggttaaggcagctcaagaggatcagagctgaatcagagacacttctcagagatgggtaacgattcacttctaaatgcagttttcaccgtaacttactgaaagtgcaaacgtgaggactttttgaatcaggtcaggcaaaagagtagcgccaaggactctttcgattcggtttttctcttcttgcatatctgcttgtttatgaagctacaggaaaaaagataaagataggaatagttaactctcccttggatgttctgcatatgattatatgagcttcttccccagtaaggtaaaacttaggttctatattctcactaggtaagaatggcagggcattatattaaagaaagagaatacttttcaagatgctttgggccaggtgcggtggttcacacctgtaatcccagcactttgggaggccgaggcgggtggatcacctgaggtcaagagttcgagatcagcctggccaacatggtgaaaccctgtttctactaaaaatacaaaaaaaaaaaattagccgggcgtggtggtgcccacctgtaatcccagctacttgggaggccgaggcgggagaatcgcttgaacctgggaggttgcagtgagctgagatcgtgccactgcactccagtttgggcaagagagcgagactctgtctcaaaaataaaagaaaaaaaaaatgatgctttggcactaaatttgtcatctgctgttacagtaagtaaatcactagatgtaaatgctaccagatgaacagcctgtcattagttcagaccagtttaacatcaagatctaagaggtaaaatctatcatagccaaattctttacatcattgatatctggctaatgttctgttttagaagaacaaactaatcattagtgttcttataccagatcatcaaattaatttataatagtgaaaaattgaaaatgaatactgtacttataaaaatgcattattgaaagttatattttaagaatatatcataaacatgttcttatatttaagtgaagaaagcagacaaagcagaattatcctaaaaaatatatatatatatatggctgggcacagtggttcacgcctgtaatcctagcactttggaaggctgaggtggaggttgcagtgagcccatatcgtaccactgcactccagtctggacaacagagcaagactgtgtttccaaaaaaagggggtgggggagaacccctggaaatacatcaaaatggtagtattaattaatgatggtttctgatcagtgggattatgcatcttcacactttttaactgcaaaagcagcacatactgaatgcagaatatctgaaagacagagaagcataaagaaaaaaataaaattactactatatgtacattaacaaatctggaaagagagcatgttatacatgctgtttttgctacctgctttctaaactataggtaagttttattttcctctttatacttttctagtctctaaatcttccatagtatatatgtatataaaatcttttcatagaaacaaaatgttgtaattcttaaaaattagaactataaatgtataagagctatgtctccaagacaatttagactcttttgatcttttctaccccttaagatttaacactgaccagagtgtctggagacctcatcaaagctctcagtttcctcttcctttcgacacttttttttttttcaataaacaattttaatttataagaagtagagatggggtctcgctgtgttgaccaggctggtctcttttttttttttttttgagatggagtctcgctctgttgcccatgctggagtgcaatggtgttacctcagctcactacaaccacgcctagctaatttttcttttctttttttttttttgagacggagtcttactctgtcacccaggctggagtgcaatggcacaatatcggctcaccacaacctccacctcccaggttcaagcaatgctcctgcctcagcctcctgagtagctgggactacaggcgcccgccaccacacccggcgaatttttgtatatttagtagagacagggtttcaccatttgggccaggctggtcttgaactcctgaccttgtgatccacacccgcctcggcctcccaaagtgctgggattgcaggcgtgagccaccgcgcctggcctaatttttctatttttagtagagccggagtttctccatgttgcccaggctggtcttgaactcctggcctcaagtgatcctcccatccaaagtgctgggattacaggcatgaaccaccacgcctggcccctttggactctaagcagcagtgcagtaaaatagacaggaccttgggagatctgggttctagtcccagttttgcctctaactagctgtgtgatcttgactaagtccttcatccctctgggtctcagtttccccatgtgtaaaatgagatgggtggacagataatttctaaggcccttttcagctccaatat

SEQ ID NO: 537 - DNA, 2813 bp, Homo Sapiens
ctcaggtctaggacagcatctgggagaggatagggggaaggactctggcatagctggtcacaaaccagccccagggcaactgagcattgatttgatcaatggctttttcctcttcccttgaattcccctatgatggccttttaattgggtccatttgttccaaggccgtgggctgagctgagcagacgccaaatgatatgcctattattaaatagattaggaaatggccctacatcttgggcggccagaaaaaccagagtgactgaacagtgtccctgaggagtaacacgtgtattgtggaatactggatgtattgcagaatcccttccaggcaccttgcctttcctatgctgtccctgcgtctacagaatccttctgacttccttgctcacctgaaatgtgtctcctcctccaagattcacttcaaatcccctcctcggtgaaggagctgaaggagcgcgctaatcgccacccctccctcagcctgcctgagctactgccacagagaactcacacatctgcctggcaagagatccaacctgaattggagggtctgccctaggggacactgtccaagtcagggttgtccagggaacaggattacccaaagaacatttaaataacaatcccacttcagtaaaaaaaaaaaaaaagatgtctccatttcctgagctggagtcaaaaagggtggctgggaggcagcagagaagaggagtgagtgtaaattccgtgtgatggaaatgagtggcaatttaaattcgactggagaaaaagaaaactttcatgtcagtatcaaactcagaccatttttaaaaatcggtttcttccattttagacattatatactggtttccttttgtgaaatgaggctttagttctcttccttctctcattctcccattgcaatttttgattaaatattcagtgcttccatttttatgatgtcaaaaatgttgctcacagtgacatcttagggcattctatgtttatattttctttcttgcataactttttgtttttcctggaattaataactgcctcactgtacattcctaagaaggacatattctaaggacaaagagaactaactctaaagaaatctgaagcagtctttgtaatcatattacaagtacggttacccctgaacatcatgggcttgaactgcatgggtccacatatatgcagattttcttctgcctctgccactccggagatagcaagaccaatccccaccttccaccttttcctcagcctactcaatatgaagatgagagggatgaagaactttatgatgatccacctccacttaatgagcagtaaatatattttctcttccttatgttttcttaataacattttcttttctctagcttaatttattataagaatacagtatatgatatatgcaacatacaaaatatgtgttaatcaactatttatattttcggtaaggctttggtcaacagtagaatattggtagttaagttttgggggagtcaaaagttatatgtggattttcaactgcgtgaggggttgacatccctaacccctgcactgttcaagggtcaactttaatactattgatggtgttagtttgaaactattacatgtagtaggatataatgaaaatctaattatgttaatgtcactggaaaccaacattttcaacataagagaaaagagatacgaatataaaatcaaagaagaaaaaactactatcagtatagtcttggatttggaaacatctgtataaactcatgatgcttttttctctttaaaaagtattctctatttctaacttctaaaaaggcctgggaacaataactagccctgtgatgctgagcacctctagtacccgcttcaaaggttctaaatgtatttcctattaaaaggaacaagggcttcttggagaaatggctgattctgggttcgtggcaggaaatgcataagatgggttcagaatattttgtcatacaaaaagcaagttgtcagcactactaacgttgtgtttaaaggacataaaaaccaacttgaggactgtgctgcacaaagatggggtattttaagtatcaaaaagaataatgcctacgatggattgaaacatacaaatctgaaacttgtgtttcaatctatgagtttataatgatactaagagcaaacaaacaagcaaacgtgtaggtctgttctgtaggttggtagcttatcaatgtattattctgaaaggcaggttaaaaggaaaagaatctgtctttcctatacaaactgtatttcagagtaactaaatagacaccgaggaaaattcttctttactgaactccagccaataaatgaagaaggtatcacagaattaaatatcatcattttgcatgccctaatcaattaatgcctgtaggcctggggtgtccaatgtggcagccactacccacaagtgcctactgaacatttgaaatgtggcttatcggaattgatatgtggtataagtgtaaaatacacactagatttttgaagacttaatacagaaaagaaagattgtaaaatatcttggtttttatataatatttttgatataacagattaaataaaatatattatttaaattaatctcagtatttctgattacttttttaatgtgcttactttaacattaaaaaatatacctatatgctttgctttctatttctacaggcaagtctgagcagtaatcatcccaatggttgctagtctgataacaccagaacccaatggccaatattaacatcacaaaaaagagagagaactagacattatgtcctgctttatggggtacaaagaag

SEQ ID NO: 538 - DNA, 1753 bp, Homo Sapiens
aggttggtcttgaactcttgacctcaagtgatctacacgcctcggcctcccaaagtgctgggattacgggtgtgagccactgcgcccagctatccagtattttatttaaaagttgtcactagggtgttcactattgtgaatttataatcttaaaagttggggatgctaaaagtaccagactaaaatactacgaggttttctcatcttttaattccattttgttagaaaaaaataatcacaaccggggttcttttacctttccccagccatctagactgctttactgcaatgttgggaagattgcatacaataaaaactgtagctagttgattgggatttgggaaaattgaatcaagcatttgcattcatccagaatggtcttaaactgctgactgtggggtgcccacaggatgagcactggtggcatgggtgggaggaatttccttggatactgcaattgcatttgaaagatctattttccaaaacctgagcagagagaggctaggaggaatgcagacaggacattgaaaatgcgaattccctttactagtagaacatgaaatatctgataatggtttaaaaaaaataagtgccaggatacattgtagtataaaggttcaactagtataatttaaaatgagtctttatattcaggccaggtgcggtggctcacacctgtaatcccagcactttgggagtccgaggcgggtggatcacctgagattaggagttcaaaaccagtgtgaccaacatggagaaaccccttctctactaaaaatacaaaaaattagccaggcatggtggtgcacgcctgtagtcccagctacttgtgaggctgaggtaggagaatcgcttgaacccaagaggcagaggttgcagtgagctgagatcacaccactgcactccagcctgggtgacagagcgagaccctgtttcaaaaaaataagaaataaaaagtgagtcttcatattcaaattagtatatgaggttaggcaacaattcttatatgggaccaggtatatttaatttgcctttctttgcagtcatcctagtaaatccttgtaaagggttattttatatacaattttgtagtatattctaaatcccctttggcaaataaagctgaagttatctagtgtcagcatactgtgatttgtatatttatataagacaagattgcatcattctgattaagttgcagcattttagttttatctgataggcctgtattgagtaatcagtagctatgtgcaaatattaagtcaacttaattaccagacccagaaggccagaggtaatcaaagagtactttcggaagatgaaatatttataatgagttatggaaacaatgttttagaaatgtttttcttggtgtaatttaatgcagatttttacctcaattttgttaaaaaacttgataatttgatccctccatctatttaatatttaatattttcagattctagagtatttaaaatttaaacacaattataaaattaattataattcctacttatgttagctatgatttagggccaaaactaccctggttttgtcttgcaacttgaaacattgtgtattttaaactatataatttgggaacattattttatagactgtggataaccaaatataagatttgtgatttttaatgcttcatttgtgtaaaatcatttgtatattctatttatagtatgcattttctagctcattaaaagtacagaaaaacctcaaatctgtccttatacaaata

SEQ ID NO: 539 - DNA, 1913 bp, Homo Sapiens
tatcatttttagttagttaaattcaatgtttatggctctttttataaaatgttgcttaggaaaatgactccattttaaactagagctataatttgtagcagacaatattagacacttacctgtactcaaatacagtcagaagtgcctgcaaatttactttcctctgaagcagcccttgaccaattagtgacaaatgtagagtatgaagttccagctcccttgtctgggagtaagagtaagagctagtgacagtcacatcaccagaattaacttaacttctatggttcccaacaagatcaagtcgaagcttccccctgtgggactttgcatgaaatcatatccttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatgctctcgatctcctgacctcatgatccacccgcctcggcctcccaaagtgctgggattacaggcgtgagccaccgtgcccggccgaaatcatatccttaattggttcccatccttccctgtccttctttccccacttccctgccagtgtcccctgggagaacttgtacaataaattacttgcacacaaaccctgcccctgagtcagctcctagagaaccctatctaagaccattgtatcccaaatgtcctgggcctcactagcttatagatcataaaataaaattacattctttttataccacaaaaattatagcatatgcctccttttattctgttattcattcaaaagataaactgtgctaagagctggggatagaaaggtaaacataatttctatctttgcagagattaaactccaggtctgagagccagataacagccctcctcaagataaccagctgaatatggattggatattaaatattatagaactattgtcattttagataacaatattgtgtatgtacagaacattcttatttttaaagtgatcatgctggtacacataggagtgatttatgatagccgcaacctactttcaaatggttccaccaaatattagatgtagaaagggataaagcaaatatggcaaaatgttaacaactgttcaatataggtggacggtatacaaatattcactgcacaatttttttcatttttctggtgcctaaaatttttcaaactaaagagatcggaatgaacaagatcatgggaccccatgatgggtataggccctcaccaaggagtaatatcaacaattcccagatgcccatttatcatccctttgtagttattataaatacaagatacaccactgatgactaaaagaacttacatttagatggatgtatgcttcagaccttaattatgaagattttagaaaaacatatcacttttctcaagtagctcctaaagttatgtcactcaagaaatatatggctttctttaaacttgagccacttccagatattcctttgttcataaaattggcttaagcatttgtgaaggcttgaggcgtcatttgcctcttgccagtatcaaatgaggtattgcagctgtgatgaacacttctgtgagagttcactctgtggaagttcacttctgtgggagttcaaggtcaccttatgctaacagctctccacctcaagcattcactgcctgtcccttccatccattccccctccctcttcatcttcttcatctgaagggaaaaggaggggctctcagaagtcaagcaagagctggtcacttacctccttgaggtttattataaaat

SEQ ID NO: 540 - DNA, 3109 bp, Homo Sapiens
agagctggatgcctcccacggagagcgtcccttccaagcggccccggagtggagtggagtggagtggataggggtagacttttcacacggggacaaattattacaggatatctgcgccccctgttccgagtcactcggggccatcggttacttcagcaggttctctgcatcacggacccttttgaggctcaggtaaaagtttggatcctctccccacaaacgagcaaaattatctgtacattgaaaattatgcattgagaaaattcacattactctagaaacccttagactgcagttcctaacccaagttaagaacccgcggtccaggaactaggggtaacgatagaagagagacttgtttttctttgtataaccatttgcaccgttgtaactttttgaccatgtttctttatccaaatgaaatttccgaaaaaagaaaactcctgccccagaacttcgtaggaaaactagcttgattatggaattacaaataatagtaagagaaaaaaggctaagtggtggccgtgataggacttaatggtatttcaattcccagagttacagtggcggcttcaagggattgttgaataattgggagtacttgtttcagcttctttccttcctcagcctgaacatctgctgtttatgtaacttaatttcctaagtctgcgatttcaagaatttgatgcaacatctttctgttctaggaatttaccatggaaattattggccataattgttggtgacactatcaaactcatagtcactctataacgatatggagccttgctctgtcacccaggctggtgtgcaatggcacaatctcgactcactgcaacctccatctccaaggttcaagttattctcctgcctcaacctcctgagtagctggagttcaatggcacaatctcgactcactgcaacctccatctccaaggttcaagttattctcctgcctcaacctcctgagtagctgggattacagacgtgcacaaccatgcccacctaatttttatttttagtagagaccatgttggccaggcttgtctcgaactcctgacttcaggtgatcctcctgcctcggcctcccaaagtgctatgattacaggcgtgagccaccaccactgtgcccagtgttagcaattatttacaacaactgatactcttacctttcttcctatagatctaattatatggaaagatacaatcatttttgaccaaatttttatcttactatgttgtactctactcatctacatttcttccagtagtggcagtaattttcctatatacaaatacatccatatataagcacacagtatatatacaatatatataaaacatatagacaagttaaaaatatggaaggaaagattataaaagcaataaaaacataaaatatggaagaataaagtaaaaaaaaatgcgatggacctgtgtggaaaagctacaggacaatagggggaggtgaaagaggattttaatgaaaggagggacatgctttgttcccggaaagacaatattgtgaaattttgacttctattgagaatagaattgtttctactctcaacaattccactcatttttgtggtcaaaacagcatatagttgtatctttttttggtaaatgctaaatctgacagttgttgccctttaataaaagaaactctttcatatattaataattggtatacccgattttgcttcagccatcatgtttacactttcagccatcatggtttatactttccactcattgtatattcttgctttctttcttttccttggaaagaaaagtcttcggctaaatggatttttttttctttttttaaagagaaagggtcttgctcttgtcgcccatgctagattgctatgccactatcaaagctcacttcaaggccaggcatgatggctcacgcctgtaatcccagcactttgagaggccaaggcaggcggatcgcttgagctcaggagttcaagaccagcctgggcaacatggcaaaaccccatctctacaaaaaaataccaaaaaatttagccaggtgtggtggcatatgcctctagtcccagctactcgggaggcagagatgggaggaacacttgagcccagaaggcaaaggttgcagtgaaccaagattgtgcctttgccctccagccttggtgacagagggagactctgtctcaaggaaaaaaaaaaaaaaagctcactgcagcctggaactcctgacctcaagtgatcctcttgcctcagcctcccaaaatgctgggattagaagtactgtatccccccttttttttttttttttgtcagagtctcgcactgtcgcccaggctggagtgcagtggcgcaatcttggctcactgcaacctccgcctcccaggttcaagtgattctccttgcttcagcctcctgagtagctgggattacaggtgcacgctaccatgcccagccaatttttgtttttgctttgttttgtttttttaagacagagtcttgctctgttgcccaggctggagagcagtggcgtgatctctgctcactgcaacctctgcttcctggattcaagtgattctcctgcctcagcctcttgagtagctgggactacaggcacgtgccaccatgcctggctaatgttttgtatttttagtagagacgtggtttcaccatgttagccaggatggtcttgatctcctgacctcatgatctgcccgccttggcctctcaaagtgctgggattacaggcatgagccactgcgcccggcctaatttttgtatttttagtagagaaagtgtttcatcatgttggccagggtggtctcgaacttctgacctcaggtgatctgcctgccttggcctcccaaagtattgggattacagacatgagccaccacacctggccagaagtactgtatcctgtttccactttcatggtggtgaattttaccttttagaaaacaatagttatttttattttctgattataaaagtaatacatactcatgaacagaaatttggaataaatagcaaactagaaggaaagtgccatgcagagataatcactattaatatctttaatttttcgtattattaaattttttcgaccgcagcc

SEQ ID NO: 541 - DNA, 2964 bp, Homo Sapiens
aaacctgatacccttccttcctccatctctaaaaaatgggggaagacagagaaatggaatgaaaaatcttcaaagctggaaggacaaagggagtttcctgttctaggatgtgatgtgaagggaaattagaagatggactgtcctgaagcatagacatgaccctctccaactcatcatctgagatcagctgtcctgcttataaatggggaaataaagactggaaaatgtatgtgatttgctcaacatcaaacagtcatcaagagcctgtgttaacatctggcgtggatccaaaacccatgttctttaccgtggtaagttgttgcaaagcattctttgaaaaagatggaagccttcttcactcaaaattgattaatttcttcaaacacttgacctcccatgaataccaagtccatgttatactcatggtatattttagtgtacttaaggtacacacagtaaaagaaatttaaatttcacaatttagcacagatagttggttgctgtgaatgaaaatgtttctttttgtgcgaatgagtttatatgtgttatcctaggttccttaaaaaaaggtaggtcagattccaaagaaactgtgttctagaaaataatagtttaatgaaaatctaggttgtggcccacagaattgtgactctatacttatcagaccagagaatgatgattcaggcttataactaaagatccttgagtgtttttgagggatttacacctgggttcttatatcgtgtctcctctgtaaatctagcaggaagacaaggaaattgttctgtaccatttcaccactgaggaaactgagtctagaggagttacattttctgctgaagatcacataactaggggaacttgtttctacctccagacaattttctgctgtgaccctaaggtagtaggcataaagggctgggggctattcctcaagctaatttgtggataaagatttatttttcttctaggccttaggattataatgggaaagctttctcctcctgtattcatctttaatgtaattagtataaactgtgagtcagaaggctgggtttcagtcctgctctgtcacataccaactgataaactaggtcacttaacctatctggggctgtgtttcctcttgtgaaaaatgaagataatagtgcttatcattcttgtcctatggggctgtggagagcatctaaccagagactgtaggtggtaagaaagtggtctcagcattcaagtcctggacaagctctagccacccagcataacctcttctttcttaatcataccataattttcttttgaagaattgcttatcttctgttatgtgtgatcttggaggggctgtgaatcagggtctttctgccttcctactacagtcgtcaaaaatgttctggaggccattgcaagcttctccctccacacccctcctcaccctctggcatagtcacagggcaaacactggatctaagccaatcagatgggctctttcttctggaactgaatcctcagcagaatgacaaagaaagactaaacaatgatgactcaaatgaattgatcctttgattccacatcagctccttcatgagactgggaagcagttcctttaccttctttgttgtcccattgtggagctggctcctccagctctcccagcaattctatgggaatcattctccagtgatttctctttttggatggcctaagttggattatgttgattgcaatcacagaattgtattacatatgtcagtttttaacgtatttccttaaccttaaaatgccacaaatttaatatgcatcattaagtttttcagggaaaaaggaagaagcagtcacactatattcaatatatacaccgataggcaagaggcatactggtttgagaaatgtgaaacatgagaagtagaatgtaaaaaaaaaaatgtgtgtgttagaattgaggaattatggtacccatattatcattattaataaattatattagaatagtagttatgacaactgagtattttatgtacctagaacccacaaggagtcagggaagtaggccaaaggacaaaggagttgattctaaaattctcttgattgcttctctgagaacttctcaatttattccccttttggtataagaaatatctggttttgactgccagctaatttccagaagttgaaggcagttatggtttattgtgagtgggaggtttgtaagaaaatagcagtgcagcagtaaggagaagctctctgaagttgttctgaatgtacagctaatgggcagttatctatgagagagatttttatagcttcctccatatagctggtgaaaagttagcctggatgttgggggaggagcctgtcaatttggcttcttatcaaactcaactttgttaagcagttaattctaaggtgttttatccacttattactaaggcatgtaagtctgagctggcagccttgattaatagattaatgatcactgctccctacaatgtaattgtcattgtgtccctagaagaactacaaatatacctccggggttaggattaggtgagggtgactgtcaagcagccatagaaggtgtgaggatttgggactgtttaaatgaagacaaagacatgccctcaagaagcaattttccaagctgctgttttgacttgacagtggcagatacttcattggaagatgttgtgaaaatgaaatgcagcaggatcaagaggagagggtctattagtcactcaaaactgacttgtgcagatcttgcaattccatttgtatttctgtctccctatctgtaaagcaagagaaattattcataatttgactgtcattcatatcatgctaagtgatttagggctgcatcttcacatgacccagcttataacagatgggctgtagatttaatgaggtggtgtatccctgctctatcatttcccagctccataagcaagggcagttatgcaactctttatg

SEQ ID NO: 542 - DNA, 2979 bp, Homo Sapiens
attcacctcctgctgactcgggaagctgttccaccatccatcacgcaaggtaagaaaggcgaatggcagcacctggctggaaaaggagtgaggggaagtatgggtggctgattgtgacggaaacacaaggctgtacagcactggccatgttccttgagtcaaaatgatccaggtggctttcaaaaatcttagtacatgagaaataccccatggcccactctcttatttcccctttcaccatggaaactcgccaagctgagtttcttgactgggctacctgcacgaccaaaccaaacaggcacctaatctctaatcttactgctgggctctgtctcagaccagatgagcagagttcaggctggatatcccacaggaggaaggctgaatacccctctcctcaccaaagttggttaaggtctgggtgagttatgtctcatgttcctgttgtgaaatggaatgaacaaacaggggatgtgattcatgtctgtagacacgtagtattcctgagagctaatcaggaaatgccatttcatgtctggtcttataaagcctcttcaaaaatttgatagaggctaaaggggagcaatcattttaaagtgagctcttgttatctcttcaaccacctacgccacacgcccaccactaagttctgagaaaactttacacccccctcttcttcctctgccctagtccctctccccaacccgtaccgccaacacacacacctgcatacacatgcacatgcaaattgtttgaaagaaacatcatatggccaggtacggcggctcacgcctgcaatctcaggactttggatggctgaggcggaaggatctcttgaaccggccatagtggctcatacctgtggtcccagccactcaggaggctgaagtgggaggatagcttgagcctgggaattccaggctgggtgagccgagatcgcgccattggcctccagatcaagtgacagagccagaccccgtctcaaaaaaaaaaaaaagaaaggaaacatcatacaacatgaggcatactttacactgaagtaagttgttgttttcaaggcaaaatgagtttcccttaatttataggaaataaaaagaaatatttaaaagactagtaagaacaaataaatccagttctcagctggtgatcgataaataagaaaaagaaagacagataaggagaagattcacctataaattaagtgcatttaacaacttaaattattacttcccccaaaggaaatgaaaatggaccctctgatcagagagataaagtatgttttattttagttttttaattaattttgcagggagacacctaaatttaccaaaaaagggagctaatatcagggaaatacaagatcttaatggaaagattatggaattcacaagttactggtggcaacagtttggacacaattagacatcttaacgataatgaaagtatatagtttaatgaatctatgtcaagggaagccttgagtataaaacctttacagggtccgacgagatgaggacttttgctcaatgagtaaatagtgtttgaccagttgattagtaaggatgtgtttttgaattcctcgagatttaacaagatgacaaatcggacttgtttagatttctttttcgggctagcaagaacactttgacacactaagtaggaggagtcccctcaaccctctgtgagactcctaagcccactaaccctgaagtcacacacagctcaagacacacagagggggcctctaagctgagagacgtttattcaaagacttctctgatctatcagaactggtgatctaggagctttttgtaaagctaggtattcttcctctccagaaaacaaaagcaaaaacaaaacactttgcttctctatcagagggatccttttcatttcttttcggggaagtcttctttcacgtttaaatgagctcaatttatagatgactcttctccctgtctgttctccttgtcccctttatcaagcatggtgaaaactgtggagtcatccttgtctcatctgctctgactaatttgtttaccatatctggccagttcttcttttgaagggtggctgcaattttctctttcttatctcagttgttgttgctttgcattagcatgttttcatagcctctcctcctctcagtcccttcccttcctcctgaaatctaaacctttctgacactctttcatctggcactgccccctcacaactgttatgagttcctttttctcccacattgagtctgaattcctctctatggctttcaaagactttcttattcttcctcaaccctcttcattatctgctactccctagtgctcccttctctagtgaggtcaatattctcttccacttactgggcttgtttctcttcttccttctctttacccatcaattgccctgtccattggcttatttttttttttttttttgagaaagggtcttgctctgtcacccagggcagagtgcagtggtgtgatcttgaactcctgggatcaagcaattctcctgcctcagcctcagccttccaagtagctagagttatagacgcatggcaccatgcccagctaattgtttttatttatttatttatttatttatttttgagataggatctcactttgttgcccaggctgggttgaactcctgggctcaagtggtcctccctccttcacttcccaaagcgttgggattatagccttgagccaccgcgctggggccggcatttctcacttctgtctgcagagcatgtctcctcatcagagaccaacttcttacaaagtcccactcaatgactgagattcttccctttctctaagctcccacagcatgtaaagtttgtggcacctggcttgatacaggtctggatcattttcaaaccgctctatttgtgtgaatcttgtctcccacaaaaatgatacacttttcaaacaaaaagtccattttctctgcttacatgcattttgtgtctat

SEQ ID NO: 543 - DNA, 3983 bp, Homo Sapiens
agcaaccctttgggtccccttctgcactgtggaagctttgttcttttgctctttacaatatatcttgctactactcagtttttgggtccgcactgcttttataagctgtaacactcaccgtgaagacctgcagctttgctcctgagcccagcgagaccatgagcccacggggaggaatgaacaactccagacgtgctgccttaaaagttgtaacattcaccatgaaggtctgtagcttcactcccgagccagcgagaccacgaacccaccagaaggaagaaactccgaacacatttgaacatcagaaggaacaaactccagacgcgctgccttaagagctgtaacactcactgcgagggtgcgcagcttcattcttgaagtcagtgagaccaagaacccaccaattccggacacaccaggaggtggaggttaaactgagctgagattgtgccattgcactccagcctggataacaagagtgaaactcttaaaataatacatatatgtatatgtatacgtatatatgtatgtatatgcacaaattaaacttgtcattataaaatgtttcttgttgttgttctcatgctatatcttttcccatccttttcttggacacctctaataacatacccttttatgttgacctttctgtatcattttgtttcaatgtgtctcaattgaatgatttatctagtttgttcacacttactgatttacttggttttaaaaaatctaccttttgtgccttttttcttgctttttatacatttccttgtctctcgtttctttaaattttgtttacttatttgagacaggagtcttgctctgtcacccaggctggagtgcagtggcacaatctcactgcaacctctgccccggggttcaagtgattctcctgcctcaacctcctgggaagctgggattataggcatgcaccaccatgcacgcctaatttttgtatttttagttgggggcgggagggagtctgaccacgtcagccaggctggtctcaaactcctgacctcaggtgatctgcccgcctcagcctcccaaggtgctggggttacaggtgtgagccatcgcacccagctggaagtcctttttttcccaaagtgaaaaatcatttaattttgtgatcataagttacacgtgaaattttaaatactagacagtaagaggtatttaaaagttacctcaaatcctccctaaagatgctagcgttctgcggtatatatttagacatatctacagacaaggatataactttcccagttctatttgtgggacctgggcggtccacctctctgaaactgtttccctagctaagaagtaggggtgcgatcaacatgggtaggctatagtacccagttactttgtcaaacactaatctaggtgttcccataaggtattttgtacatgggttgagtcaacatctacagctgacttcaagtaaagattacccttggctgggcttggtggctcacacctgtaattccaacactttgggagcccgaggtgggtggatcacttgaggtcaggagttcgagaacagcctggccaacatggtgaaacatctgtctctgctaaaaatacaaaaaaattagccagatgtggcagtgcacgcctgtagtcccagctacttaggaggctgaggcacgagaatcgcttgaacctgggagacggaggttgcagtaaaccgagatcataccatttcactccagcctgggcaatagagtgaaactccgtcttgaaaaaaaaaagggggggggccaggcctggtggctcactcctgtaattctagccctttgagaggccaagatgagcggatcacctgagttcaggagtttgagaccagtctgggcaacacagtgaaaccctgtctttattaaaaatacaaaaaattagctgggcatggtagtgcatgcctgtaatcctagctactcaggagacaggcacaagaatcacttgaacccaggaggcggaggttgttgtaagccaagatcacaccacttcactccagtctgggtgacagagtgagactctgtctcaaaaaaaaaaattacccttgatgtgtgggtggtgggcctcatccaatcagttgaaggctttaagagcaaaaacgcatttgccagagaagacattctgcctcaaaactgcaacatcaaatcctgcctgagtttccaacctgctggcccaccctacacattttggacctgccagcgcccataatcacatgagccatatccttaaaataaggtataggccacacataaacacacactctctctctttccctctctctctctatatgtgtgtgtgtgtgtgtatatatatgtgcgtgtatatatatatgtgtgtgtatatatacacacacgtatatatagatacacacacacacatatatatatatgttgtattccctatctaagacccaggggaggcagagcagcattcatctccactgtcggaaggtagtccaaggtcaccccaaggaggcagaacccagggctacagactctcaaaccagtgttcttcccacaaaatcaaaggcagtgcagtccctgagaaagggtcatctggtgccaggctgcccaagcgggatccccactgtgtgaggctgggtggggaacttgacatctgctctcctaggagtgggatcatggaccccagctcacagggtccttgtgcattttctatgcaagtagagtgtagttcagcccggcacacagtaaatgcaagatattgttgctattaataaaactctagaacaaattccccagaggtcaaagtctggctgtgtgccagcctccaacaggcttctgtggctggcggggagccaggctacagggaaaactccccgtacacccagacctggagcctggggcctggtgaggaacgtgggatgattctgaaaccagttggcggaggaagggtttatggtgtgtctcagcgagtggtcagcacggcaccagggtggcgtacagaaggggcctgggagggcagcctcacctacaggggcccctctacagtgccactggcaccagggccgtgtccatccctaggctggaaaacgtgcttcccacttagggccccggggaagctgcttgggtctgctctgcgtcggagggagctcaggagggaaggccaagatgccaggctcaggaggtcccctgccctctggcactgcctgggactctgtctcaggtgcagtcaggtggctccgtaagtagcttctcccctacacctggccgggcctccagattctcttaacagccttattagtgcaagtgttctttgagtcatcggatgtgtcattggccccatttgacagatgaaagtgtggctcagaggggcagggactcgcctgagctcatggctggattggaaccctgcccccatcccacccagctcagattccaggctctcacaccctgccccaccctcagcctcggcagtctgccccttcccagcccagtgccccagccccacaagtaacacgctcccagcctggtcctctcctgtggctccctgctgcccggttccagcctctgcagcagaacaagctgctgtctagtccctgcctggttccctgtcgctgtgcccatcaaatgccacttacaaaggctctcacagctcctcaaagctactgctccccctccatctggaaattgagtttagtttgtttgttttgtttttgagacagagtctcactctggtgcccaggctgcagtgcctggcgcaatcatggctcactgcggcctcgacctcctggctcgggtgattctctcgcctcagcctcctgagtagctgggaccacaaatgcacatcaccatgcctggctactttttaaattttttttgtagagatggggtctcaccacattgcccaggctggtcttgaactttggaactcaagccagccttccaccttggcctcccaaaatgctgggattacaggcgtgagccactgtgcctggccaattt

SEQ ID NO: 544 - DNA, 9058 bp, Homo Sapiens
accacaccgctagcgcctctgaacctcgccaggcacgtccggttctgcggcccccactccgcccccgcctgccgggagccgcgcagtgagttactgactccgccggcgcgcacttcatttattcaatagctctgggcctgaaaaacaccggggaaattgcatcccattttccccaagcccattagcaaccagcggtctcattctcgatgattccgctgagccaccccggctctaggggagggggttttattctgcctctgccgccacccccacccaccctcagaagggcaccagcttttccaatctgtgaaccccaaagaactgcagggcagggacccctggggacccctcaacccccctcacccccgcagccttcagtacctcccgccggcattcctctaccccctctccatgtccacccagcctggccccaagggcggatttcttctggctctgggctctattctcgggaggggggcactggggtgggggcgcccagatttggagtggcagcaccccctccgcctccacctcgggctgtgggaccgcaggcaggtggcttctctggcctgcgtttacttttttttggctgaaaaggggaaaggtggaaccactggctggctgccaggaaagggcattgggggagataaggggtgtaaaggccttgacgaacggggtcctcttggccaggaagcatcttggggctgcactgggcacacggcattttccccaacccagaggtgggcgcccagtgccagtaactggtccaggcttctaaaggtcccattcctttgtctctgcagcctggtgcgccctgccaggcagttgcggggaggtggtggtctctctgtggggtcatagttcagagcacgcgtgctcggagacatagttaaatagaagctgaatgcgtgaaatatgaatacatcctcacggtcctcgtctcgttataggttacaaagtgccgggagccgtgcagggccagtgaacccctcgctgagactcagtttgctgccatcacaagtgctctgagaatcctggagagggaggatattggagacaaacgggactgctgcccgccttttaggcgaccgttggaggctgctctgtgccggacacaggcagggaggtggaggccagatacaagaaaaccacagtaccagtaaatgacaaaggctggatcttaacccaagtcctccgactctgaaggccatacccaacaggtcccattttatttgttttacttttttttaattgaagaaaaaaaaactagcattcccctacagtgccccccacctggtggggacatcttgggttggcaaggccaccactttcaagagtagaagtgtttttcagcaggaggagttggctgcaccaaaggagctcaggagaagctggagtctcaggcccagcaggaacagccagaggttttgcagctttgcccagcggctgggttcgccgaagggtctccctgggggttcccagcatgagccgaagccaccctcccctgtgggatctgtgaggccaggcattgggcctctttaggcctcagtttcctcccctgtcataggcaactgacagtccctctggagcgccactggggctgcagagggaggccggagagatggtgccccccctcctccccgccacccccacacacagccctcagcaggatggtggctgcctggccgattgcttttgcatttgcagcagagcgggggagtgaggccaagctgagtgccccctccccctgcccagccagctcagacccaggcggtggagcaggaaggctctggggaaaacagtgtgagtcaccgggcggccagagtgtgtccttccctgctagcgcactacacggcaggtttcatagcttgacagcaaagtgtttgaaaacgaagagcaggaattccgcggttcctgcccggcctcgccatccagctgggagaagagcatggtcatttccttcacttagtccacggccactcggcgctcatccccagcacagccctccccaggctgcggcaaagactgttgctgtcctgctgagggatgtgcccccggggattcaatcgagattctgtaagatgtgggggatgtggcggggtggggggtggcttctccacatccccagggctctccttcttccccagtgaggtgggagaagccgcagattggggtctgctgaggagcgggcctacatgaggcccaggtcgtgacccatggctccggggaccagaaggtaaacagtttcggcacagggtgctcccactaggtcataggtggattcagccttctctgagaaccgagaagattctggagtcttttgaagcaggaaaggagatcagaggaggagatggtggcaaagcggggactgagactcttgaaatgtgtttatcccaggcagagcagccgctgaaaggggagatggagagagaatgtcaaaagcagcactgggtgttttcctggggtctctccacagtgccccatcatttccgaatcaccaggcccgctggcacaggggtctgcagcccaacctcgcagaatgaccccctctctgcaggcgggcatcaccctgacagccccctcccaggacagaaaacctatagacacctggctgctgggtgtcaggccacccgcccgtttctcttcctttccttccagcctttcctctcccaaccagccccctccccacccggtcccccttctatttttcctggctaaaaccagccacagataccaccacacccggaaagagataaataaataaaagaaaaacaacctcaactgtgaaaagcagtccaaatctgaattttttccggcctgagttaattacactttaaattggcatgtttactgatcggggaatttcaagttaacagagacagcgccccctccccaactgtttgtacagtagaactcagcaggctggcgggctcccccaggccttggcaggtcctgccgctcccctgccaacgagagagcataacagaaacatctatttttgagtgttagagaaaacgaagatctcacagatggcgggaagcagcattctggatggtttcctgcacccaggctctgtgcaccttctcagcagcctcttgccccaggaaagaccagggcctttggcctctcgggaccctgcaagctagctgccttgcacagggggctgtctgcctatcccatcgtcgagggccgagcctggtcgaggctccccatgctgtagcactgtccagttggctctgaccccttctccttggagcaaggctgtgtggggtgcggagggggctctgggcaggaagcaggagtccctgatgcattcattcactcagcacacaccaatggagcgaggagctacaccaaataaagtggtggcctgatctctgccttctcaagaccgaccctaataatgggcctgggtctcccctagaccccatgtaccttggaaaaatcccatccctgctccaggcccaaatagaggcaaccagtggatcttctgatggatgcaaacccaaggaatgcctccggggacaggccagacccccagctcacagccacatctctcctggcagaagtggcctgatgtggccacccccgccccaggccttggttcatggtcgggatcaaccgcaggctctgccgtgggatgtccacaccctcaggacccgccgggtgccctgtgctgcccacagaggagagacaaggccaacaagcatcactgagcactttctctggactcagtcctgtgctaggtacagggatgccattgtgcacaagtcagaaacagccgcggccccagcagagcctgcagtctgggtagggagatacttgctgatctaagaatcagagcagtggatatctgactgcaaattgagactgcctgtgaaggatgaatcagggaaggcttcctggaggaggtggcctcccagagctcagcttgtccttccttgaggtcctttccattcccagtccccctctggtcactcacttggcccagggcctagggccttcgggcaggcagtgcagctgcacaggcaggtgctgtacctgctcccctgcacgctgctgggataacgggaaaatgatgaatgaggccccatcatgccctgcttcccggccctcaagcccattcccatccatgacaaattgtccctctacctccacagggtcttttcagcagcctcgcctgggaagccttggcagcacttggtggagatttatgcccatcttccccagattcttctttgtttttctgcttctttattccctcaaaatatgcttttatttattcattccacaaacgttctctgagtgcctcccgtgtgcttcctcctggtgatagagagatcgggttcagtacaccctcctgtgttgaacacctgctttgcactggtgtctatggtcagatttcatccaaggagacaggcatgaactaagcacctactatgagccagcactgccgagccaagggccctggcttctaaaagctctgccacagggtggccgaaaccccagccccttgggtattgaggtcctggcttggtgattttgcagcccttcttggtctgggtcgcctcaatttttacaaagaaggaagccgctcgttcatcagaggtgggtcttgaccccagagtctcaaccccaaagctggggagacagtgctcagaacaaaagccacagcaatgcaccctgccctctgtggacctcagttttcttacctgtccaagggtgtgagcagagaggcaggacaagaagggagcagccctgacatttgggggttctctgaatccttgaggacccctgacgaccgtgagctccgtgggtctccaggactgcaccagccaacgtgtctgtgcagagtggtggtacacagacaagggtgggggtggtgaggggagcacctggtcccacccaggagagatcaaccagatggtctcagcgcacccaccaccttcactaggtcttgttcactccatgcaactgaggcagtgaatatagccctcaactgccatcaagcggagtgaaaaacacaggtcaacataggtctttggtatttggatgcccatcatgctttgagtcttctgacaaagcaagcagccctctccccaggccagacacgcaccaaagcatcccacttcatgggtgatggcaccaagttggagagatgacaggtgagtacagagaaaaaaccatgaatattctggcaagctaagtctgggggaaagtgagcctacctcatcatatgataccaagaaaagaggcccattcggtgagcgatctgtcttccaggacacaggggctattcctaaagcccgtgcaagcagggtgggtgagagcacacagcctggagccagaccctgccccacctccagctgggtgaccttggttgactcactcaacctctctgcgctccatttcctcaactatggaaaagaaactgtctcctcacagcagctgatggggcccaggaccaaggcaagcgccccaacacgacagctattacttctcctcttatctcccgctgaaacaacaaggaaatgggaacggaggtccaggttgttcaatttcccaaccacgtccaggagacatagtggggataaaccgggcccttgcactggagaagggagcacacctcgtgaacttggaccggcggcagggtttacacaccgcactgaagacgggacaagtcacagagcctctggttgaagggtccatggagactttcatcctggccacctgtggggcacacgttcttatttggcttatctgatgagaaaggccctttgtttattttttcttctccgcaaacaatagataaatcaatcatttttgcttttaatgaaattctgcatcaagtggcacagggtcactgtgtttgggttagaaatcggcggggaacatgcacgctgctgcatgccgggccgacgccggactcaccccctaattctcaagtggcgcgtgatgcacccagcactcttcctgagtggtggcctgggagactcggcgggggggccgtgcctgttaacgccgtggtgtgcggggatggttatattgaagctattaaataaggctaatgtcactcttcccctcacacacacatttaatatattccaaagatgtgtagatgcattaacagcaattttcatctccaaatgttcccatttagtcagccccatgcataaaatatgagccctaacaccacgctccagcccgttgcagatggagttccccagagcatttggctctcagcgctggggcgtttgctggaggggcgggggcgcgatcagtcggcatctgcaggggaacacagggcctgtcacttcctctggggctttggtgcccccaccccccgacaagtggaagagagaacccagacccaactgactcgtgcctcctgcagctaatctcagcctcatcctggaagggcagaaaaagctagaaaaccaaacagctttgaacaaatgggaagaatttctaaaaatcaattaacatattcatgtactccatcaccacatcttattgactgcctgctttgtgcccagcacctgcctgggaattcatctgatccggtccctgcctttggggactccattagtcaatcaacaaacactcactgttctgctactgaacacagcaggggatgagagagagagagagagagagagagagagagagagagagagagaaatttctgccaatgagaaatctcacagtctagggcacaaagaaggtagacattaacattaggcaatttcagagaactgtaagctaggaagaaaacagtaacggggcaactggtagaatgtgatagggaagaggcaaggggagctgcttttatagggttatcagggatgaccttgctgaacaagagccattccatccccttgggaattgtgaacccctgggaaaggaaaatgcaaaggatgtgggcctttaaggaaggaagggccagagcctggacaggaggcagccgagggcagagcagggcggcccaggacccagctccggaaggaggggcatgtgcaaggccagaatgaaggatgaaaacacgtgggggataggctgtggctccaaaagaagaggggggctgccactctgagggcctggggggtcctcggatcattttggtaccaagcccaagggaaggggcctgcagaggtgccctgggcagcggagttaaacagctggactctgcacttggaaatgctctccctggcagagggaggggcactggagggagacccaagtgccacaggctggagggacctagcctgtggggcggcctctccagcagggctgtggcccaggggctggggaagaggggtgctgagggagagtgggagcaggcagcccagagggatggtgccagggatccccactcccatgctaggcatggagaggagcggtcccgaggaggaggacaagggggagggcaggcacaggctgtgacttccaaggcagcgacgtctcaactaggggatgacgggagcccagctcaggaagatctcccgagcccaggagctcactgatcaacaatgagtgataaaggacagccttagctcattctttggggtcactcctgaggtgctccttgccttcagccctggaccctgggcatgggcagcatgttctggagtcactaagtctccaggtcagctgcaaacaggcctctggtcatcttcctgtagtctgggcaggccaggggtgcaaatatgacataagcatcgggtagctgagagccagcccagcctgggggatgtgccaaccggaagcaagggcatggcgggtgctcccgctgacactggaattggggatgccattctgtcacacttccaaagccccccagaacagagtggagctggaaaattaacaggccaagtgacacaggtcctacacaaagtccacagggtcaaccagcgcagagccagctgctgcctggagttgacagcaaagaggaaggcatccaaggtgggattcgatatcggaaagaggttgactgtataatattcatcatatagaaagtgaacacctcacaggcaacctatttcaggtaccactgagcagcactgactccagggaggaggcttcttccacagggaagggccctgccacccacccgcctccaggatggaggccagcacagggctgcaggtggaagtcaagcgcgtgctcggccaccagccatgcctctgggggcccacagggcgcgcaaccggacctccccgacatcagcaggtgcaggaatcatgcaggtgggatctgatactgaagagaggccgctcgtgtcttgtgtgtcatgatttctgtgaatgcaacacaggccacctctcctcaggcaccacaaggagcagcacacgcacacggccacccaaggcaccagctcccacccagggtctcacagcactgagatgagcagaaggcagcccaggtgcagggaatgcatgcagccgcccccaacatcctggcgaggggtgggtggccttccagcaggatgccttccagcgggactagctcccccgtgtcctctgcctcgatgacactggccatgaaaaacagactgagccccgtcaccattgctcatcagcttcatgaccgccccccaccacagtgcacaaccctagcatcttccccaaagtccacatggccccccgaaagctctcccaaaatgattcaatggcgggggtcaggggaaaggatgacaaatgtcacaccagcccatgcattcacgtaccctggaaagtcccgcctcaggcgtggcgcccgcacaccaccgggcggtagcggtactgaaaacaggccatctgtgttatattcgtcattaataaaagcgaactcatcacagacaacctcttctcaggtacccagagtgccatcggctcaagaacgtggctgccgcgtcccgtggtgccagcgctgcccccgggaagcagtcctgaggacggatgggacatcaaaggtgagaagacacagagacaggaaagagacccctgcccggcccactctcggtgaccaggccccactgaggcagcgactccaaagcacccgtcctgctcctaccctcaaa

SEQ ID NO: 545 - DNA, 8200 bp, Homo Sapiens
cccagctactcgggaggctaaggcaggagaattgcttgaaccaggacccaggaggcagaggtggcagtgagctgagattgtgccactgcactccagcctgggctacggagtgagactccgtctcaagaaaaaaaacaatggactagctgaatccatttttttttaaatttctgtaggttattggtgaacaggtgatgtttggttacattattaagttctttattggtgatttgtgagattttgatgcacccatcacccaagcagaatacactgcaccctatttgtagtcttttatccctcacccccttcccaccctttccccgtgagtccccaaagtccattgtgtcattcttatgcctttcatcctcatagcttagctcccacttacgagtgagaacatatggtgtttggttttccattcctgagttacttcacttagaatagtaagtctccaatctcatccagatcactgcaaatgccattagttcattcctttttatggctgagtagtattccatcatatatataatatatataaaacacacatatataatatatgtatatataaaacacagtttctttatccactcgttgattgatgggcatttgggttggtgccactgaatgcatttttaaaaataacccaactatatggtgccatcaagaaactcacttcacttgtaaagacacatacagactgaaagtgaaggatggaaaaagatattccacacatttcacacaaatggaaaccaaaagtgagcaggaatagctatagttatatctgataaaacagactttaagtcaaaaactataaaaagataaaaaggtcattatatatgacaaatggatcaattcagcaaggggatatattagattggtacaaaagtaattgtagtttttgacattaaaagcaagaactgcaattacttttgcaccaacctataacaatgcttgatatacatgtaccccacactcgagcacccagctgtataaggcaaatattacatctatagggagagatagacttcaatacaataatagttggggacttcaacaatctgctctcagcatttttaacagatcacctagacggaagaatcaacatagaaacattggattttaactggattttagtaagaacagaaaataaataagctggactttagatcaaatttgacttaacatttacaaaacattttattttatccaaaagctgcagaatacacattcttctcatcagcacatggaacattctccaggataggccatatgttaggccacaaaataaatctcaacacattttaaaattaagatcaaatcaagcatctttttaaactacaatggaataaaagtagaaataacaggagctttggaaactgtacaaatacatggaaattaaacaatatgctcctgaatgaccactgggtcgatgaagaaattgagaggaaatttttaaaaatatgtttttaaatatttaatatgaaaatagaaatgcaacatacccacacctatgggatacagaaaagcagtgctaaaagggaagtatatagcactaaatgcctatatcacaaaagcagaaatattttaaataaacagcctagtgatacacctcaaggaactagaaaaccaatgacaaaccaaacccaaaattagtagaaggaaaagtatagtaaatatcagaacaaaaacaaaatagagactaaaaaacaatacaaaggatcaagagacaaaaagtgcgtgttttaaaaaaaagatacacaaaattgataaacctcctagctagactaaccatgaaaaaaggaagaagagtcaaataaaatcagaaatgagaaagaagatattataactgataccacagaaacacaaaggatcatcagagattactatgaacaactatagccaacaaaatggaaaacctagaggaaatgggtaaattcctggacacatacaaccttccaagattgaacctggaagaaatagaaaacctgaacagaccaataactggtaatgagattgaatcagtaataagtctcccaacaaagagaagcccagtagtggatgactttattgctgaaccctaccaaacctatagagaaaaactaacaccaattcttcacaaactgtttaaaaacaattgaagaggagggaatttttcctaactcattctacaaggccagcacaaccctgacaccaaaaccagagaaggacacaacgaaaaagaaagctacaggccaatatccctgatgaacacaggcataaaaatcatcaacaaaatgctagcaagctgaattcaacagtacaccaaaaagataatatactatggtcaagtgtgatttacccaaagatgcaaggatggtttaacacatgcaaatcaataaatgtgatgacatcagtggaatgaaggaaaaaactttatgattatctcaatagatgcagaaaattgtttgataaattcagtatcccttcatgataaaaaaaaactctcaacaaattagacatacaaggaacatacctcaacataataaaggccatatatgacagattcacagctgacatcatactaaatggggaaaagctgaaagaccttcttctaaaaactggaaccagagcaggatgcccacattcaccactcttattcaacatagcactagaagttctagccagagcaatcaggcaagagaaataaataaaaagcatctaaattggaaaagagtaagtcaaattgtctctttctgtagatagcatgatcttatatatagacaacctaaagactttaccaagaaaaacccttacaactgataaattcagtaaaatatcagaatataatattagtagtattttgatgcatcaatgatgaaaaagctgaaaaagaaatcaggaagacaatcccatttacaataattaaaagataaaatacctcggatctaaccaaaaaggtgaaaggtctctacaagggaaactacaaaacactaatgaaagaaataaacaaatggaaagacattccatgtgcatgaatcagaagaattaatatcattaaaatgtttacccaaagtaaacttgattcaaagcaatctctatcaaaatactattgtcatttgtcacagaaattgaaaacaaaaataccaaagttcatatgaaatcaaaaaagaatcagaatagccaaagcaaccctgagcaaaaaagaaaaagctggaagcatcacactacttaacttcaaaacattacagggctatggtaacccaaagagcatagtattgatataaacagacacacagaccaatggaacagaatagaaaacccagaaataaatacatatatttaccaccaactgattttcaccaaaggtgccaagaatgtgtatcagggaagggataccctcttcgataaagggtactgagaaaactgaatattcatctgcaaaataatgaaactagacccctaatgtctcaccatacacaaaaattaaaatgattaaagacataaatataagacctgaaattatgaaactactggaagaaaccacaggggaaatgtttcaggacataggtcaaggcaaaaattttgtggctaagatctcaaaaacaaaaatagacaaatgggactatattaagctaaaaagattctgcaaaacaaaggaaacagtcaacagagtgaagagacaatctgtagaacaggaaaatatgtgcaaactatttatccaacaagggactaatattgagaatatacaaggaattcaacagcaaaaaaaaaatcccttttaaaaagtaggcaaaggacatgaagagacatttctcaaaagaagacatacaaatggccaagtatatgaaaaaatgtttaacatcactagccatcagggaaatgcatatcaaaaccacaatgagatatcaccttaccccacttagaatgactattattaaaaagaccaaaaaaaaaatgctggcaacaatatggagaaaagggaactcttacacactgttggtggatatataaatcactacagtcattatggaaaacagtatagaggtttctcaaaaaaactgaccactaaatcagactactaaatccccactactgggtatttacccaaaagacaggaaatcggtgtatcacagggacacttgacctccatgtttactgaagcactattcacaatagccaacatacggaatcatctaagtgtctatcaatgaatgaatgaagaaagaaaatgagacatacttacacaatggaatactgtttcgctattaaaaaaatgaaattccgtcatttgcagcaacattaaaaaatgaaattccatcatttgcagcaacatggattggaactcgaggtcattatgttaagtgaaataagccaggaaaacaaatatcacatgttgtcagcaatatatgggagctaaaaaaggtgatctcatgcgagtagaaggaagattgataattaccagaggctgggaagttgcaggggttggggcgacacggtgtcacgaagagaggttggttgatgggtacaaagttacagctcgaaagaaggaataatttatattgttcaacagcacagtagggtgactatagttaataatatattttataatagctagaagagaatattattatactttaagttctggggtacatgtgcagaacgtgcaggtttgtcacataggtatacaggtgccatggtggtttgctgcacccatcaacccatcatctacattaggtgtttctcctaatgccatccctcccctagacccccatcccccgacaggccctggtgtgtgatgttcccctccctgtgtccatgtgttttcattgttcaactcccacttatgagtgagaacatgcggtgttcggttttctgttcttgtgttagtttgctgagaatgatggtttccagcttcatccaagtgcctgcaaaggacatgaactcatcctttttttatggctgcatagtattacatggtgtatatgtgccacattttctttatccagtctaccattgatgggcatttgggttgattccaagtctttgccattgtgaacagtgctgcaataaacataggtgtgcatgagtctttatagtagaatgatttataatcctttggatatatacccagtaatgggattgctgggtcaaatggtatttctagttctagatccttgcggaatcaccacactgtcttccacaatggctgaactaatttacacttccaccaacagtgtaaaagcattcctatttctccacatcctctcaagcatctgttgtttcctgactttttaatgatcaccattctaactggcacgagttggtttctcaatgtggttttgatttgcatttctctaatgaccagtgatgatgagctttttttcatgtttgttggctgcataaatgtcttcttttgagaagtgtctgttcatatcctttgcccactttttgatggggttgtttttttcttataaatttgtttaagttctttgtagattctggatattagccctttgtcagatggatagattgtaaaaattttctcccgttctgtaggttgcctgttcactctgatgatagtttcttttgctgtgcagaagctctttagtttaattagatcccatttgtctattttggcttttgttgccattgcttttggagtttgagtcatgaagtctttgcccatgcctatgtcctgaatggtattgcctaggttttcttctagggtttttatggttttaggtcttacgtttaagtatttaatccatcttgagttaatttttgtataaggtgtaaggaaaggacccagtttcagctttctgcatatggctagccagttttctcaacaccatttattaaatagggaatcctttccccattgcttatttttgtcagatttgtgaaagatcagatggttgtagatgtgtggtgttatttctgaggtctctgttctgttccatttgtctatatatctgttttggtaccagtaccatgctgtttttgttactgtagccttgtagtatagtttgaagtcaggtagcatgatgcctctacctttgttctttttgcttagaattgtcttggctatgtgggctcttttttggttccatatgaaattgaaagtagtttttttccaattctgtgaagaaagtcaatggtagcttgatagggactgcattgaatctataaattactttgggcagtatggattttcacaatatttattcttcctatccatgagcatggaatgtttttccatttgtgtcctctcttatttccttgagcagtggtttgtagttctccttgaagagatccttcacttcccttgtaagttgtattcctaggtattttattttctttgtagcaattgtgaatgggagttcactcatgatatggctctctgtttgtctgtattggtgtgtaggaatgcttgtgatttttgcgtgttgattttgtatcctgagactttgctgaagttgcttatcagcttaaggagattgtgggctgagacaatggggttttctaaatatacaatcatgctgtctgcaaacagagacaatttgacttcctcttttcctaattgaatacgctttatttctttatttctttctcttgcctgattgccttggccagaacttccaatactgtgttgaataggagtgatgagagagggcatccttgtcttgtgctggttttcaagggaaatgcttccagcttttgcccattcagtatgatattggctgtgggtttgtcataaatagctcttattattttgagatatgttccatcaatacctagtttattgagagtttttatcatgaagggctattgaattttgtcgaagaccttttctgcatctattgagataatcatgtggtttttgtcattggttctctttatgtaatgtattatgtttattgatttgtgtatgttgaaccagcgttgcatcccagggatgaagccaacttgatcatggtacataagctttttgatgtgctgctggatttggtttgccagtattttattaagaatttttgcattgatgttcatcagggatattggcctgaaattttctttttttgttgtgtctctgccaggttttggtatcaggatgatgctggcttcataaaatgagttagggaggattccctctttttctattgtttggaatagtttcagaaggaatgttcccagctcctctttgtacctctggtagaattcggctgtgaatctctctggtcctggactttcattggttggtaggctattaattgctgcctcagtttcagaacttgttataggtctattcagggatttgacctctttctggtttagtcttgggagggtgtatgtgtccagaaatttatccatttagaagagaaaatttttaatgttcctagcacaagaaaaagataaatgactgaggtgagagctatcctaaataccctggtttgatcattacaccttgcataattgtctcaaaatatgacatataccccataaatgcatataattgttatatgtctattaacaaaattttaaaaataaggactggatgtgggtgatgaataaatgaggatttggtatactattttctctacttcttatgttcaaaatattttataataagttaaaatgaataataaaataaccaaaaaagatctcaaaaactactatattttgtacattcatattacaggcacactttattgtacttcgctttattgctctttgtaggtattgagttttttacaaattgaaagtttgtgacaaccctgtatcaaggaagtctatcagtgccatttttttccaacagcatgtgctcactttttatctctatgtctcatttggtaattcacataatatttcaaactttttcattaataaataactgttatggtgatctgtgatcagtgatatttgatgttagtgttgtactatagggtgccaataactctgcctatacaagatggtgtacttaatcaataaacgtgtattctgactgccttaccctccattccctcatctctttcccactctcttccctgacacacaacaaacaataatgaaattaggctagttagtaaccctacaatggcctataagtgttcaagtgaaaggaagagttgtatgtcactcattttaaatcaaaagctagaaatgattaagtctagtaaggaaggcatgtcaaaagctgaaacaggctgaaagctaggcctct

SEQ ID NO: 546 - DNA, 2114 bp, Homo Sapiens
tcatgatagacacaatgaaatccaccctcaaagaggtaaggcggggctcaggcagctggtgtccagccactgtcgcccactctggtcccacctcacccatctcttctcatgcactgggaaagacccctggtctgcccccaggcccaacaagtgaccaccaggatctatcaggcctcatgctccagtgatcagtccctagaggcctggggacacatgtaatcagaatttaagaaacagagacctttggtggggaggttctttaccatcctcaagtacccacccctccttcttggggccaggcacaattaggtgacccaactgccagagacagtcccacattttttgagagacagggtctcattctgttgctcaggctcagtcatagctcactgcagcctcaaactcctgggctcaaatgatcctcccacctcagccacctgagtaggtggcactacaggcgcatgccatcatgcccagctaatagtcacactttttttttttttttgagatggagtctcactctgtcgctcaggctggagtgcagtgggaagatctcagcttactgtaacctccacctcccgggttcaagcgactctcgtgcctcagcctcctgagtagctgggattacaggcacctgccaccatgcccagctaatttttatatttttaagagatgggggttcaccatgttggccaggctggtctcaaactcctgacctcaggcgatccgcccaccttggcctcccaaagtgctggttttgcagatgggagccaccatgcccagcctagtctcactttataggctcccaaaccacagcagaacacctggctgcctcatccctctgcacccatcacgccagtgggcatgctggctgtaggtggggatggcctttgcccgggttcctgggagcacctggtgttttatggtcacctacccacttacacctgaccctggggcctctgcagttttcttggcgttgtcaccacaaaaggaagaagcccacctgtggctggctggctggccgccaggtcagagccaaggcaggcagggccttcctgtctggcttcttgaaggcagacacaagtctgcaggctgctcacgtcatctcattatcttttctcacgaggactacttcggatacaatcacagcaaccctggcctcggccctgccctgtccctgccatgcaacttcacaactcagctggcctagacccctgggaggcctccaagtccctaagcggttccagtttgtggaagtcccaggcaatcactgtgtccacatgagcgaaccccagcacgtggccagtatcatcagctccttcttacagtgcacacacacgctcccagcccagctgtagctctgggcctggaactatgaagacctagtgctcccagactcaacactgggactctgagttcctgagccccacaacaaggccagggatggtggggacaggcctcactagtcttgaggcccagcctaggatggtagtcaggggaaggagcgagattccaacttcaacatctgtgacctcaagggggagacagagtctgggttccagggctgctgtctcctggctaataatctccagccagctggaggaaggaagggcgggctgggcccacctagcctttccctgctgcccaactggatggaaaataaaaggttcttgtattctcactgcttttgaggctttttcgttgccagcaagggcttttgcattgagggaaaaggaagcacagaacggattcatccagggtcctggagaggagggtgtggaggcaagaagcaggaaggacaagtcctcctctcggcacgcctgggtccccaggactgctgaagcacaagacccgaggggtggcctggtccttccctcctggcctgtgtggactctgatggggctgttggacgcggtggccttcaacctggggcccgttggccagagctcggcctctcagagaccgctgcaggccctgcctcgcctcctcctggccctgcacctccagccattcactgcggctctcacagctcagtacggtcggaatttgcgctgggcccgcagcagctcgatcctctgcttgtcctcctcgaacttcttgcgcagctgcgctag

SEQ ID NO: 547 - DNA, 2412 bp, Homo Sapiens
acatcttgttaaatggcgattgtgaaccagtagatctggagtagggtttgagagtctgcatttctaacaaacccaaaggtgatgttatgctctcagcaaggttctagactgctaaatttcctatatagacttagttgttgcgatgtctttattcaaaaagaactgctttgttcttggtcttataattgtaagatattttgttaggtgagtcccatatattttttctcacttaatcttcacaacacccctgcaagactgtaatacatgttcattatggaaaattcagataagcaaaaagaagaaaaataaaagttacgtagataccagaaattaaaataatatttatttataagtttaagactccaagtgaagattaaagttctaaaaggaactaaagttatagcttcgggagtattatatgcattttcccaccttaagtaaagaaaacaaaacattgtgggagtaatatgactgaaactaaaatgtatttacttagaaaagaccagaagaaaatgtcagagcatacagtagttgcattagggcagcactatcatcatgggcaccttaggctcagaatttgtcatgttttaactgtttctctgtctttgctcccatgtcatcttcagttgttgggtccaacttgcacatcttttccatatacctttattgttcttcctgtctttatcctagttcacttcatacctagattattatagtagcctgtgaagctggtctcttttcggcttaagtatttccagccgtggagagtatacctcaatgaaaatattgctgtagcaatttgtacctctttactctataatttattttttatcttacctttttttagtggtggagtaagaaggtaaaggtaaagggagatataggagctgatactattgtgtttcagtactggtgatctattgctaaataattatataagcttgcatactgacccaactcttctagaagggagagtgttaacaaaactaggagagagattgtagccaaggtttaaaatggatatatttatgggagaagcctgcttagtgaattgtgttttagggtaggaattctgaatgagtaagcatgtctgctctttttctaatatctgttaagtttggggctattttattccatgtcttttatcttcccttttagaaatccctcagttgaattaagaggaaaaaagatcatttaaaaaaatatctagactagcattgtatgaatgaagactgcagaaatctgtagaaacccgctagaaattggtcagttagtaaggtgtatccccttgatagcaatttctcatatggaggatgtagtagggaggtcatagcatctggagagctttttcctaagtgacagtcatcacattctgagatggcatcccacttatcacctttctccctttgagaatcagttttaatgagtcattattactaagggaatgtgttttatttctcatgtgcaggggcagaaaattaatttggaacagttaccttaaagaaagtgagttggcagtaacagtgattatttccttcactcccatgcccaaatctttcatactctttaaggctgaaaactgccacttcctgtaggaaatattccctgctttccttctggcctttcctatttaatttgtccctcttctgatcttacttgaatcttttttatgacccttgttattttctacattgtactataaattatgtgtgtgcttattaaaaaatctatattctatactagaaactcttcctagagcagagtacatgtctaacgcctcttgtattctcacagtacttaatagaacatcttgcacataatatagaggctcagcaaatatttcctgatcatattattaattgtgaagtttgctaggcaaaagttaatgaacttcaaatgtcattgctcttctacccctttaaaatgtcttttaccacagagaaaaattagcaaaaattataaagctgatatccaataactgaaattaggaaagcaatgtattgaagaaggagctagtgtaaatctagaagtgagtagagatgtagataagcagtgaattttataaaaccttgtgggtaatgcaaagagtttgacctttttccgtacttgaagagagccatttgaagacttttaagaggggagtcatttgatcaaattcgtgttttaaataaattagtgtgatacaatgaggaagctaactgtacagatagtaacaccagaagatgggaacccaattaggttattgcaagaatctaggaaagaataaatcctaaaatcttagagcagaggcagtatagtaggataaaagagaatagatttaagaaatacagataaaattgataggcttggtgccttatttgatgtgaagtaaggcagatggaagcatcttgatgaggctttagagattgaagt

SEQ ID NO: 548 - DNA, 4852 bp, Homo Sapiens
tttctttctttctatcactgtagattcatttgtatttcatagaattttatgtaaatgtctagcttttcactctgcaaagtcaatcagagttatctgtgttgttgcatgtctcaataatttattctttgttttgcagagtagtattcccttgtaggaacattccacagtatgagacaaggccctgcagagaaactctacatagaaagggtctccatggggctgggcactgtggctcacacctgtaatcccagcactttgggaggctgaggtgggcggatcacaaggtcaggagatggagaccatcctggccaacatggtgaaaccccatctctaataaaaacacaaaaattagctgggtgtggtggcacatgcctggaatcccagctacttgggaggctgaggcacgagagtcgcttgaacccaggaggtggaggttgcagtgagctgagattgcgccactgcatgccagcctgggtgacagagtgagactccacttaaaaaaaattaaaaaaaaaaaaataataataataaaaaaagaaagagtctccatggaacacttgatccctaattggcagaagaggtcaaggaaaaacactaatgtgaaacaagggcaaaaggtgcaagaaaattaaaaggcagttaataacttcaggaaaaattaaaaagctctaatataaacgaaatgtggctgggtgtggcggctcatgcctatataatcccagcactttgagaagctgaagtgggcagatcgcttgaggctaggagtttgagaccagccttggtaacgtagcaaaaccccatctgtacgaaaaatataaaaattagctgggcatggtggcctgtgcttgtagtcccagctattgaggggagagcagctaaggtgggaggattgcttgagcctgggaggtcaggctgcagtgagctgtgattgtgccactgcactccagcctgggcaacagagcgagaccctgtctcaaaaaaaaaaaaaaagaaatgtaattatagtgaacactagctcggcagtgaaaaatactgcaaagtcacatcatcaatgtgctttcaaaatcaaactgtaggcctaaatatagctatagaagaatgtaaacaaggaagcaaatgtaatcagaagctgagcagtaggagagaggaggtggggtgaaaagggaaggatgaggaaggtgggggtgtgcaaggctcttgcttacctgggtacccgacaggtgagatggctgtagcagacactggcagttccctgcccacacacctggccctgaccacggctgcacaaggcagctctgtgtgcaattgccagcatctgctttggtgttgctcttggtgctggagcttacttgctgcccatgtgacaggagcagctctaaaccagtggtcgtgagctctgtttcgcactggctcccatttctacactgggtctggtgcaggtgcctatggtggcagctggtgtgatgatttgccctttactgatggccttctcctcatcttactttcccatcctgtccttgaatcatccatttcaggatctgcctctgaaagaacccaaactaaggcagtcaatccaccacagacagacaaggaaatagaagcagagcgttttatttagagattatggaggaaaatacgaaaagaagcaactaacagaactgcaggtcattacctctagggaccaagactagaggtgggaaggggcggaagaggagaccatgcttttaaatatatgcatggcatgtgctactttaatataattaaaaacaatcacttaaagcaaattggaacagtgtaacaaatgaaatcaaatgaaatcaaaaggagagagcacaaatatatctgagtaacttggtctgtcccccagcccccttaatgttgttacctgaatatgtcaattgttgtcaaaagacaagcataaactgaaatcgattattgtatggatctgaaccgatggaaaatattctctgtacagcaattttaaaagtataatggtaatcactgtgttagggattaagtatacttcccaccctgtgtttttgccattgtataggaaaaatcatgcagaatacattgataatcactgtagaaatgagatgagatttattaactaaaacacttagcacttcacctggcactactttatgaagaagcactttgtatagggcactatgtgtagtttatatatataaagaaacatttgtgtattgggtttgaatgttacttgttgttgttgaatattcttctgctagtccaccctgtccctgatggaagctatgcccccggatcagaaacgcttgatgctcaagcggtcctgggaaaccactattgcaagtaactgtcagtgccctctactttccactagatggcagacttcccccagctctgtggacggcagatacccaggagaggaggacagagcttcagatctttgctttctccctttcccttgacctggaaaatcactgggctgcctctgaggccagatttagatttcctgcacaagccatcattaccttgtttagaggagtgaaattagggtcgacctgtcctgtcattccaggacagaaggtgacaaataaggtcctttatgtgtagcactgaggagaagggcttgttcttaatttttaagatattttccaaaaatagaaaaattctgttttacaagtcaaataagaaatgattgaaaaacaagtatcactgttcatatacagagtcgtaggtaaatgttcagatacaaaaattgtgaccatagagcatatttttggatatttgttttcatagtgtgatgaatatttttgtttgcttaaaattatttcagaagtataatcataattcaagcttgaaatacaagagtggtaaaatgagagcaaaaataaacaagtaataaaacgcaccacaaaatttctgactccattcccttttagggatttctttttttacaagagttatttttattgatttgtgtgacacactggctgacacgttttaaaataaataaactttgggtttcagatgaacacagtttgcatgctgtctctctggaacaatacacatcagaggaagaagttaataggaaaatcaggcaacccaaactgtgttttttaggttaatcaggaatttccttcaattctagtaaacaggtggaaatagaaattttgagctgagaaaagtaggaatcaggacgtggaagggaaaagctgggttctgctgcggtgatgtgggtgacccttcatgatgagccagctgtctattctcccagctctctcccggcggtaggaactgagaagaggcgcccctcgctgcaggccctttgatgcctctcctctcccctgtcctttcacccccgactctgtgagttgcttttagatatcgttctttacttaccaattgtctctttctcccctgcttgttaacgtatcatgaaaaaactgtgacgtgatgaccccccatgaatgcctctggaggaaaagtgctagaaaatttaaaaagaaaattaaggtgataaaactggcctcattaatctgttaaactccttcaacattgccaaaaacagaggtgagcttctcagctcagtttccccaaaattcacagaaaaaattactgtgcttgaaaagaaaacacagcgggccaggcgcagtggctcatgcctatgactctagcactttagaaggccacggtcagagaactgcttgaacctaggagtttgagaccagcctgggaacatagtaagacctcatctctacaaaaaaaggagcaaaaattaaccaggtgtggtggtgcatgcctgtagtcccaagctacaggctgggaggcagaggcaggaggatcacttgagcccaggaggtagaggttacagtgagctgagagggcatcactgcactgcagcctgggcaacagagtgagaccccatcccctccccacaaaaagaaaagaaaaacacagaggatgtaaaatggagctgagatagtgatattctgcccaatattttaggcagtgctgggattttctcactaaatgatcaatattgaaaactaaaatattttattaaaatgagaaaaaattatcaaagtgaagattaaaattataaggctcattcaaagagacgagggtgtacttatataatctcccagttttaactgcaagatgtttcatgacttatgatggggtcatgtcacatcctgataaacccatagtaagtcgaaaatagcataagccaaaaacgcatttaataccccaataaaccaatcatgaagctgaaaatcgtaaatcaaaccgtcactaagttggggactgtctgtattgtttactttaatattttggaaagttttttagtgtgtgataccaaaatctacttgacatttaagcactgattaacgctaatgattttcactgggtcttttttaagccctagcacagctgtttgaaaacttggctgaacattagaaccacctgggcgggagctggggttagcttttaaaactctcaggtcatatcccagaccaattaaagcagaatctctggggtgggacacaggcaccagtatttttaaaattcccccaggtgattccaactgctgccaaggttgagaaccactgcagtctggcttcattctgaccactgtctacacatgatgttagtaatggttgggattgaaggactataaatacaaggacagtgtttcccagtgccctcccaagtggaggaggccaggagggagagatgacgggatttgctgaccaattaggtagaggtttaagagaagctgttaggccgaggcggacagatcacttgaggtcaggagtccaaggccagcctggccaatatggtgacacccccatctctactaaaa

SEQ ID NO: 549 - DNA, 2252 bp, Homo Sapiens
cattcgcctctaagctgatagctcttacggatctgctcctcagggaccccacccatctcctagttaaccaataagagcaccccacccccaccatcccagcaacaatgattggttcaggaatgagggcgtggccaaagctaagccaaccaaagccagtgatactggattctgggactaatttttaaatttcttaagaaaaactcttcgtactggattgctgagagaatgggatgtaaggtctgaactcatgtctgccttcatgctaccagcaaagagaaccttgaaaccaagtgccctgtatccagtaggtgcttaatagtagtttatcgagtgaaggaaataatggggaaaacatctgccaatgcaagtagtgccagtgcaatgattcaaagtggtactaagtgccccctggagagggctgcatacacatgcaattccaagtctaagaatgtatctcacagatacatttgcacatggacccatatcagtgttacggtgaaaggttggacaggttatgcactgcccaacattagtgtgcaccattcacatcaggcgggacagagtgggagaagataactttgctgtaaacctttgtgccctgtgtgattttttttttaccatgatcatatatagtttcttcagaagaaaaatttttatatcaaagccgaaactgtgcatttacatttctttatacattgcttggcacatcagtgctcaatatgtatcagctgtatcagcagccatcattattgttattttttaagctgttttgaaaaccttacggtgttattacaccatggagacacacgagggcgcgccaggcatctatttaaaaagtgttttcatagcagttcgtggaggctgtaattttgagtgtgtacaggagatgggggaaaaagtcttgggggtcccgtgtgggtgacaagggcaagtcttagttccaacttggtccagtctgccagccttgtcaatgaaataccaggactcccttcctgagtgctccatagtggaatcagggtgagcgtccactctttgcaagtccttagaggagagagctggctgagccggaggactggcccggggagcccctgctgcacccggacctgtgttctcatctgtgcagcagaaacaatcaaacccacctgcagggctatcgtgagattaagcagggtctctcagagatcaaaagaagcccgaactactttctagagtgaagaactggaaagaagagagagagagaaggaaaagaaagcctcaaacaatcaccaagattgaagtcactctcacaaggttaaattttacaactcacccctctgcctcatatacacggcaacctaacagtgccaggcagagatggtgggatttattttaaaacagtaacttatatggtctgatagaaggacccaagcttggccgggcgcggtggctcacgcctgtattcccagcactttgggaggctgaggcgggtggatcacgaggtcaggagtttgagaccagcctggccaacatggtgaaaccccgtctctactaaaaatacacaaattagccgggcgtggcggcgcgcgcctgtaatcccagctactcaggaggctgaggcaggagaattgcttgaaccctggaggcggaagctgcagtgagcggagatagcaccactgcactccagcctgggtgacagagcgagactccgtgtcaaaaaaaaaaaaaaaaagaaaagaaaaagaaggacccaagcttaataatttctttctgaccccttctgctatcagttctggcggtgcttctccgtgatttgggtataagcttattcgataaggttatacatatactcataagataatacacaaaagcatatgcagagggctgcggcagacagattgctggtctactggaaagccagctccccttcttggctaagagagtgcccaatgtgttccatgcacggcggatgacaatgtgcccaatggagagatgcttcagccccagccccagggcatccattgcgattgggctaagtcattcctttccgccagcaattgctttataggcaggcagatgccctggttctggccacagagacacaagtggatgtctcctgggagcttctgaaacagagtttttgtgtgtgtgtgataagatagagacacttgagaaacttctctcctgttggtcttatctttggatgttgtcagaacgtttggagctgcagcagccatcttgtgaccacaagggaaagaccaagggaattgtagaga

SEQ ID NO: 550 - DNA, 11880 bp, Homo Sapiens
gtcctggcgaggaaggaaggagggcgcgggacgccggagggagctgcgcggggccgaggctcccacgcttgcaatcccaagggacccagggccaagggcgcagtaagggtgtgggctgggaggagggaggggtcgggacgagacgtgcctgaggggagggaagacacggactccggtttattaataaacatctacggtttgtacggcattttaagatgtgcagtgtgcttttgtaggtacatcgccttatttaacacaaaacctctctgaggtagctattacatttcacagaagggtaaacgaggcgtaggtggtttgagtgatttgcttgagatcgttcggctaataaagcaaaattgggacacaaggcttttgtcatttttaaaaaacataatattgaaggcctggtatgttccgaaccctgtgctgaggctaggaatacaaaaaaggaccaggccggtgtggcctctgggctagaggagcaggggtactccggaggctagaggggagagaggggacgatagtgactacaaattaagtaaatgtgatcatgaccgacatatgttgggccctttgaattgcgttatcaacacagttctaagtgcttacatcctttatctcttttaatcttttcaataaccttacaagtacaatttacaggtgaagaaaccgagacatgaagggcttaaataaatatgcctaaggacatatttatgagtctagaatccatgctcattacactattctgtattgttcaaatataatgtaataaaacggccttatagtctgctgccacaggatggagacatcttagggaatctttggactgacagctaaaagataagagcgaactagtttggggtagtaggatatttaaaacaacattacgtgcagatctgcttgtgcaaaaacggaactggaaagaaggcctaagtctggctaaagttcagaaagtaaagtggagagtactgtgagatgaggttgtaagtagatggaggcaagtggtttttgttgttgtttttgtttgtttgttctaaataatgatagggtttagctatgttgcccaggtctgcgttgaactcctgggctcaagcgattctcctgctgcagccggctgagtaatgggaactacaggcgtgcatcatgggacctagctacaggttttttatgcagcctttgtaggcaagattaaggatgaggctttgtctttaaaaagccatcgaaggatttgagagaggaaaatgataaggccatatatgttatgtatatccactgccatggtcatacaactttgaagttccagatgttatgtgttctgccatgctgtcctttaggtgtcttctggtccttcacaatagccatgtttaatcctgagatttgagttggagtgtttcgtttgcatctttttttctttccgtcaattccacctgagaaattgtaaaactgcgaatcttttcttaaaaatcattttaacatttgctgattgctcacagttcaatgaatatgtattgaacatttgcttggtactagattctggagctataaagaagaaaagagcaattccctgtacctgagatgcttatatattttcctggggaaatagacatgcaaacagatatttaaaatgcagcatgggctgggtgcagtggctcacacctgtaatcctagcactttgggagctggaagcaggcagatcacttgaggtcagtagttcgacaccagcctggccaacatggcaaaagcccatctctactaaagatacaaaaaaaaaaattagccagacatcatggtgcatgcttgtagtcccagctattcaggagactgaggcacgagagtcgcttgaacctgagaggtagaggttgcagtgagcagagatcacgccactgcactccagcctaggtgacacagcaagactccatctcaaataataataataaaataataaaatgcagtgtgataaatgcttgatagagaaaggggctaaaccagaaagttgttgggagcaggagaaaacagcattcacggaagaggaacatgtaaaggcaagagatctgtgaaaagtcgtgttgttatctgagtaatggaaaacatttccctgtggctggagctctgggtgagcaggtgaagcaaaatgagatgaggttggagggacaggttggggccaaaacgaagggccttctatggtatgctgaggtttagggctttttcttatagacaacaggagataatggaggtcttttcacaaacatttggcattaaaaaaaaaaaattctggtggcagcatgaaggacagactaagattgggagaaagtaggaaccaggataccatttaagccactaatggtacgctaaggtagtgtcacatactggaaaggctttgaaaggaaggaaaaagtaggagtgaacctaagaaataccagaattcaaaagacagccagaagaaggggagcctgctttaaaggctatgccatcttcgaatcaaaagggcaaggaagtattgagaggttagaaagtagttcaaaagtagctaaaaagggatcataaagccctgaaaataggcttttggtgaccagtgtgaagagttgttttagtggctcagcaaggagaaaattccctttattttgagtcttacactcaagtttatgtcctattttaaatggtttgttacagtattaactaatacggggtacttttgagtatgctaaataagaagtaaattagatttgatgctggaatgatttaattatgtttacttaagctttatgttaaatagcttagaggatagaacattagtaatgatagctaacatttgttacatgtcaggccagggtttagttttttgcatatattgtttcaattaatcctgtgaggtagatactatcattatgcacatttcacagaaaatgctgaggcattgtatgagaacaagcaccctattttgttttactttttgtagtcgtctttgactttactcttaagtcagtctggtgacatagctaggtaaactgaggacaaattcagcttcattcacatctggcaagaaccctcctccctcctcctagctctttccccatttgttacctcatctgtctcctgtttgggtactattcttgtacttcatcttgtcagctgaatttgggtcttctgacctaaattttagtgctccctaacgatctaaaattacacttaactttgctcttttctgttatttgcctaagcttggccctgggcacccaaaccctattacccagcctgcttggttagccccctcttaaaagctgctttgtctccacagcacagtgccttgcatactttaggcaggtactcagcaggattttgaaatctagtatgtagtgagtgtctctttagaacttaagaagctggaagaggcatagagaagagaggtctgaaaatgtctcagagctaaggaagatacgatgttgagataagggaatgaccagtgatgtcagataatgattatgggaagatcgatggggtttggcaaatgggatgtcatttgcataatcttctggtgagcagtttaactataaaccagattgttaggaatgaagaatttataagaagaaaatggaggcagccaaattttatagatcattcttttcagaaagttgtccatttcaaaaaatagaatcaggattttggtttgaatgaaagttgggttttgtttttgtttcatgtgcatgattggacagaccaaagtttgttaggcagatgttagaaagagttggtgaaggggcaagagtgaagacagcagggaagagaagcagcaagaaggaatgattgagataatgatctctcagatgcccagaacagttgtgagagggaatcaaggacaaagatgcagctgttagaaaaaggaggcaggcccaggcgcagagactcactcctgtaatcctagcactttgggaggctgaggcaggtggatcacctgaggtcaggagttcaagaccagcctggccaacatggtgaaaccctgtgtctactaaaaatataaaattagctgggcatggtggtgcacgcctgtaatcccagctactcgggaggctgaggcaggagaatcacttgaacccaggaggtggaggttgcagtgagccgagatggtgccactgcactccagcctgggcgacagagcgagaccctgtctcaaaaaaaaaaaaaaaaaaaaaaaaaattatgcttccctacaaggctaggggtggaggagtagttcatataagggtagtggtattatacaaatcttaaacaataagaaaattactaggttttcgagggcctgaaaagaatctataagttataaaaaatatatccagatcttctttaaatgatttaaattcttacagtgttgggaagggttcaatatgcataatttaggataagtcatatttacaaatcttctctgcaagccccttcctatgtgttaagagatggagaaatatcaagttcatttgaccctttaaccctaagagatgagtgtttcatattttgaaatattttactagctataatttcagatgcagctgcttttaaaagagtgtctgctgattatgaaaagctgggttttgagaataagtactagagtagactatttggaatccaggagttttattttactactttacatctgcattgcatcagacatggcgcaagttagcattccatttttcatgcttttgtagccctattttaggtctgtctgtgctcagaattggtttatattttcaccataatctattcatttgcctgcacagcatacagctgatagattatatgcaatgagttttaaattctacacctatttcttttactatagccttctcccatcatttgccagcccacatgtgggagcatggagtaattttaatattagccaaataaaaatttaattcagaaagcatatctgccaaaagtatcatgtgcagagcctcacaaagcctaatatatacatgtatacatgatggtttcaattccattatatttttggatagtgtcagtattcccctccactggcatgaataattagtgggaatatctgtattttgaaaattcaaaaatttattccctgaagatacagacttgaggaaagaaatttagcctactcaaaacacaccagaatgttaccttgaaagcagtttacattaatcttattcagaattagaaagtcgatgcagaatcagagagctgaaaaagatggcctgcgacattctgattgtatggttggtatttgacttttttgttttttcttccagaagcaatgcatgttcactatagaaaatcagacaatgccaaaaggcaacaagaagaaaatagagaacacttaaacgcattacccagagataaccaacgtaaatgtattggtggatatccttagacgttcttctatgtgacagaatatatctatttatctttaagaaaataatagattgattccattttctaagtgagctcggaaattttcttttggcttttttatgaccatgttattatttaataaaacctgtcattgtggagacttagaaaacatccttcctttacttcttcgggaatgagaaattacacgtaggcaatttattcaacatttttcattatgtcagcatgattagatgccaaatggctgtttggaatttttgaaggtatgttttttggacactttgccagggaaatcataactcttaaaattctccagtaaccctaaccatacaattggagttatggatagatactatgttccatgttttgttgttttctcactgtttcagtatctgggattaatgccaaaaactattcagcctcactcatttattaaatgagggtgtccaactaagtttatacaatagagtttagaaaaaaaagaagaccttgtttgtttatcattctagttaggtgtttttacatgagcaagaaagaaaagtattgtttcttaaattccttgatgaacttgcctggttgagaagtagagtatcatggataacagaattaattacctgacacccgagccacaagcagacatccttgcttattccaaaccgtcctccacaccgctgccaaagttgttttctcaaattcaaattgattactttccttcttaaagccctgagtagctcctctttacccgccctacagatttaatttatgactctttagaatgtgaaacaggctttctgtaatctgtcaaccccactcttaaattctttactccagtcatattaaagtacttggaattctctgttaatgttgatttcatacccctatacattttttcctgttctcccctctttttggaatgtgctatcaaaccatgtcaggtcaagcatcgcttcctctacaaaacctttccttaccatctccgctgccctactttccctgcttggggaaaatagactctttatgcctcattgtttatgcatacatatgagtaattgtatctcaccagcagtaacacactgttgtacctcttgttttcacatgtgcttctccttattagactataaactccattcaccatctttctggagctgtcatctttcattaggaacatcgtaatagcctttcagctagtagcctgcccccctccactgttacctgcttttgaagtgattctccccatctccagagtaagtgggctcatcaaactatgcttctctgtgtgaaaggtgtggtggtgggaactgggtgaaattagctccaggacaccattagcacttggtctaatttatttactacagtaggtatccatgtgctgagaggttctcaagaaggatggggagtggggaagagtaggagtaagtggagaaagtaggggctgagaaactaggtgaagaatcagaatcaggtgtagacagccatacgagtcacagatctgaaaaggtcgagttagccagagttcaaccagggctgccagaacttgtgtggttagggtgtgccaggcagtgccgttaggagcttccatgtattcaagggttggagtggtcatgaaatgagaaaacgctgtgcagtgacaaaaagtagttgcaaaattctgagtttggagccgagaggaacatacactgtgggagatacaacgagcagcctaagtcagagtcttgtcaaaatccatttcatgaaaagctgaactttcaaaatagtgtagttatatttggtgcattgcaatgccacataatttcctccttgaccactatattaaagggttgctttcaaacgtcttccccaaatggtaaacatgattccaagtggtttaagttcacatttctgtcaacagaaatttaacttttgtggttctgatgggtgagaagtgataactcaggattactttagtttggatctttctgattactgttcagatcatgcattttttcatgtttactgtttagatttgcttttctgaaaatgcctattcacacattctttactcgtttttctgtggagttttttttttctttttcctgtaaatttttggtcactcatttcatactataggtattaacctttttctgatacatcccagatatttcttgaagtctactgtataataagattattcttttctttatggtatctttgacaatacacatgtttaaaaaattatcttttcctttgcaactccctggtttgctatttcagttgagaatgttttcctaacctgtagtgtataaattcattctcttaaattttattctaacatattaatttttttacatttttgtttttaatccatatggatttaactttggatatggattaaatagaggtctagttttttttcctctagatggctatattaaaatcccatgtatactaagatacattttggcactccccattttaaagatttatttttctgagtaatactagccaacacatatcagtgcatatactatagatgtcaaatcctgtcctgggtgctttacatactttacttcatttaatcctggcagcatcattgtgggtaaattctgttccacatgaactttaaaatgcctttatcaaattaaaaagaaaccattggaattatgattagaattacatgaaatttatatatggattttttggagaattgacatgctttatgtctttcaataatattttattttcttcatatgtcttaaacctgtcttgtcaaatttagccttaagcattctgtacttttatcactattacagaaagaatatagtcatacgtctcttaacaatagggatatgttccgagaaatgcagcattaggcgattttgtcgttgtgaaaaatgtcatcgtgtcgttacacaaacctaggtgggatagcctactaacacctaggctgtatggtctagcctattgcttctaggttacaaacctgcatggtatgttactgtatggaatcctgtaggccactgtaatacagtggtgtttgcttatttaaatatatctaaacatggagaaggaacagtaaaaataaagtgtttcattataatcttaagggaccaccatcatatgtgcagtccgttgttgactgaaacatcatcatgtggcatatgactgtgtttttccattctcacttctttttggttactgctgtaaccattcctacagatgcagtaaggatggtatgtgtattagtcaggtttgtctaaattacactgcaataacaagcaacctgaaaatatcagtggcttataacaacaaaaaatttcctgctcatactgcatgcccatcccaagctggctgcagctctgcttcacatcacccttactctggggcccaggctaatgaaaccattgctgtcgggcacattgcagtcttgtagtagagaggagtcaaagtatagcatctactggttctgaaagctcctgccaggaagtgtcacacatcacttcccccacactttataagccaaagcaagaagtgcccatatccgacattgaagcatccgggatgcctatgttctccacaaggaagggcccttcaagtcacaatgccaagcctgacacctaagaaataaccagtgagataggatcagtactctttcaacttgaagggcagcaaatattttgatcactaataccatgtatcgcaatatttttttgttaagttggcgagattgagaaatcctagaaaatgacacctatgcaatagatgtttatctccattcaaccataattggtttttctcttactttcaagtatgcaagaaggtgacgctttttcttgtctcttaaatatagccagccaggtgcagtgggtcatgcctgtaatcccagtactttgggaggtcaaggcaggtggatcacctgaagtcaggagtttgagaccagcctggccaacatggcaaaaccctgtctctactaaaaaatacaaaacaaaattagcctggcatggtggcagatgcctgtaatcccagctactagggaggttgaggcatgagaatcgcttgaacccgggaggcggaagttgcattgaaccgagatctcaccactgcactccagcctagaggatacaccgagactctatctccaaaaaaaaaaaaaaaaaaaaaaaattagatatagccatgtgactaatcctggccaatgaaaatgtgagtagaagtgatgtgtgtgtttcattcctgcacagaagcattgagaagttgaagcatgattctccatatcttccctgtcatagtgataatagaagtatatgctgatgtagaagtaccgaaagggtaaagtagctagaatgtcatcatatagaagacagtggctctggatgtcatccagataaagagtctgtggttttaagtcactgagacttaagggtttttttggttttacttctttattactgtaatataacctagcctagctttaatcaggataggctaggttatgctgtagtaataatacatatttaaaatattttaacataaaacatatgtgtgtgtgtatatatatatattcatttatccataatgtgatgtaggacaaggtccttctcttaagtatgggtctactgatttggagtaccatgatatctttcttgcataaactacatcaataatgcatcatatacagttttcagtttggatttctctaatgtggttcaataacttaataagacttgtagaaaaatgcaaatacaaaatcttaaaattttctccttatgctttacaattgttatgcccaaaccaacagcatttttttgcaacctgtctttattgaacctttctaaagcagacaacagcttccatgaaaacaaaaattcattcttatcacattattatgtgttggcttcagtagtatttgttcaagttacttggtttataataacagtacaactgtcataaaaatgtttaggagcaagcacaactagaaattggtaaacaaacaactcatctggtaaaagtggagtacatggttatgtaagcgagtagctcacaagttgagtgcattttttctgccataagcaatagtctgtaggtttcacagatgacattgagagcttgtgtaaaccccaagagttatttagatagaagcaaacgaagagaacatatggagaacaatgtacacacgtatgtatattcacatatttatgtatctttgtgtatttatcttgtgtccagccatgttaattaaacagatatgttctttttaaaagcatatcttagagcttctaagtatgttggcatattatcagcaaaaagataatttaatctcttctttcccaaatttatattattttctttccttatcttactgtacctgctaaaacctccaaaataatgttgaataaataatggtgatagtgaatgtcccagtttttttcctgatttcagtgtaagtatatttagtgtttcactctttgggacgatatatgttattagttttttggtaaggtctttaatattttaggtggtaactttctgtggcagagactggctagatgctcacccatacattttccttttctcctgagaacagagatcaactacattttccagtcttgcttatggttatgtagacccaacctaactgaattttgatcagaagaatgtgggtggaaaaaagagattatgtttccagtactaaccctgagcctcccacactctccacactgccttcctttctctaccagtcagatgcagaggacttgggacatctttctagaagatggaagaactactgatggaaagagcccaggtctttgaatgactgtgggtaggagagctccattgttgtcccacactggattatgacatgaggaaaaataacttactgtgtcaagccaataaagtttggggctctttgtaggacaagttagcttctgctgactaaaacatctagtcagatgttacagagagtttttaattgggatgactgctcaactttttcaaatgccttttaatcatctatttatataatcactatttttcccccgctaatttgctggcatgatgaattatgttgacaggtttcttaatattgaaatcatacctgtattcctagactaaccccacttgtttatatttttttattttgaaatattgtttcttaaaattgtatccagaatttttgcagttatagtcttaagtgaggtcattctatattttcctttgttatactatttttaatcagatattcagattaatattttgctgactttatacaattaaatgtggagctttctgtctttttctatggtctagaatgatttgattttaaaaacattgaaccaggtgtagtggcttagtctgtaatcccagctatttgggaagctgaggcagaaggatcaattgagtccaaaagttaaagaccagactgggcaacacagcacaaccccatctctaaaaaatatttttgttggatttatttctagatattttacattttgtgttattgtatccccttaaaat

SEQ ID NO: 551 - DNA, 565 bp, Homo Sapiens
aactcggtggtggccactgcgcagaccagacttcgctcgtactcgcgcgcctcgctccgcttttcctccgcaaccatgtctgacaaacccgatatggctgagatcgagaaattcgataagccgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaactactgacaacgaaggccgcgcctgcctttcccatctgtctgtctggctggcagggaaggaaagaacttgcatgttggtgaaggaagaagtggggtggaagaagtggggtgggacaacagtgaaatctagagtaaaaccaagctggcccaaggtgtcctgcaggctgtaatgcagtttaatcagagtgccattttttttttgttcaaatgattttaattattggaatgcacaatttttttaatatgcaaataaaaagttt

SEQ ID NO: 552 - DNA, 2264 bp, Homo Sapiens
atttgcctatttttgctcttacctaatttttaggaggaatgatagacaaacattaagcattggtttctctctagatcccgtcagtttcctcaaacacagtagtctcctctgttagaccctggtgtgctgctgggaattactgggactcactggccagctgctgtctcttctctgcggacctctttgcttttagggagcaggaaactaattcctctaagtgttatacacttggagaccctttagcatgaacaacggtgaagaaacagaagctctcgttgctttcctgcatcagacaaaaggctgtggccacttaaataccacatttttacttcctttttagttcagttgagggagcaggtgcaaccctgcagcaagataaagctgacctttccagaaattatggagtggagcacaaatataatcatgtccttgcctagcacgtagctatctctcaaccttcctttaattggggcttctttatccaacaatcttaacactccatgaaagagtctctgaatagccatatatcaaagcttataattttgcatatagaattgtatatagaaaagtacctagcacaaaagttttaaactcttattttacacaacttgcttattaggctctatgtccaaggcaaatcagaagtagaattaaagaggagtggtaagaaaggcaggcttgctgagcctggatggcatatgagtgtgagtgggtgtgtgattgagtgtgtgtgtgtgtgagagagtgtgtgtgtgggtgagtgcgtatgcgactgtgtgtgtgtatgcgagtgtgtgtgtatgcgagtgtgtgtgagtgtgtgagtgtgtgtgtgtgagtgtgtatgcgtgtgtgtgtctgtgagcgctcatgcgtgcacatcttcagtcatgtgcccactcctgtaccaaacatttatggtcctatgtgggagatagcctgcctctggggaaagaagccaagtctttcttcatagtcattatgctctatgcatgtgactctgccattcctatgactactactgagccagggggtctgtgcctgggccaaagggcagccatgtccatgagaaaggcccatgcagaggctctacaagagactgcccaatagcagggcaccatattagatggtatcaaatggatccagtttcctcctctctctcagtgagaataaatgtgagatacacagagcagttatcatggcactattaactcccatcaagcttggtcctggcttcagaaacctcaacacagtgctttgggtggctactacctgaaaatgcaacttatttgcaacctctgatctagaaggaatataaactcagaaaaagatagtctagaagtacacactcatcctcagagtttgtcaatatctgccacaactagagaaaataacccatgagatatttggttcattgacactactaatggtttcagtcttgagacacttatcaagatattaaagttaaagggaccaaagtcatcttgttctatgccctcattttatagatcaggaaactgcatcagacttatgtacattatcaaagcttagaacgtaggcttcctggtcttcctgctccgatgttcgtccatgctgaccctcttctgctctacttatcatatgctaggctcaacgaatctttatcatcttgattatatcatctgtgttcctacatatagacgtatggagtactgtatgaaatgttactacatgaaaatgattcactagtaaactaggacctttatcaatatgtagataaatggtacgaggctgatatgggagcatccatcactgactaccaggttgctactcccagctcctgtcttcacatctgcataccaaccagtaagaagaggagaaggagcaaggagagcacataactttccttttaaggacacaactaggcaagatgccatgttgtgagctgctctgtggagggggacctgtggcgaggaactgagggcagccagcaggcaacagccagctgccatgttgtgagtagccctatggaggggcccacatggcaaggaactgacatctttggtcaacagtcagtgaggacttaaggctgccaatagccacatgagggagcttggaagcagatcttcccccagtggagccttgagatgactgcagtctggctgacaccttgattgttgccttctgggagaccttgaggtgggggacccagctaagctgcccagcttcctgaccggcagaaactgggagacaataaatgttggtgttttaagccactacatttt

SEQ ID NO: 553 - DNA, 2787 bp, Homo Sapiens
ctttttgaggcagctaccagaagggagcaccaagcagatgcagctccccttccctcccattccaccatccactgtccccagcaagaacctgcgggagggtggcccaatggggagaaaactaaggattcggtgttgggaccactcctgccctgacctgccctgtgactccgtcatactctccaaaggccagaccctcctagaccagctggaaccaccatcaagatgtccccagccatgtcagactctggggccccaggcggagggcaaccagatgtcttcagctccaagtctggcctctcctcccagcaagcagccacctctgatggccaacaggtgctgctgtgtgcccagatcaagaatccacctctgcggaattcaaaaccgctgagggttctgggacagcagggaggagagaggtggagacgcaacatgggttttctgtgttcagactgcagagaccttggaaaggatcaaccatatacaatgtccatttcctgccctctaacctggcaggggagcaaggcccagccaaggagttacagaaactgaggcttggccaggcgtggtggctcacacctgcaatctcagcactgggaggccaaggtgggcagatcgcttgagcccaggagtttgagaccagcccgaggaacatggcgaaaccccatctctacaaaaaatacagaaattagccaagtgtggtggcacgtgtctgtagtttcagctactcaggaggcttaggtgggaggatcacctgagcctgggaggtagaggttgcaatgagcagagattgctctccagccagggagacagagtgagaccctgtcccaaaataaataaataaataagaataaaatttaaaaaagaaactgaggctcaaagagaacaagtgactagttcaaggactcattttcactaagctgggaccagatcccagggttctaaccgcttaccagatccttttccattaccctcttgtttaaccacatcttgagtacctgctgtgggccaggagctgagatactttggagagtctttcaggaatattgtcccagctcctgaaacctttagggatccccaagttctagactctggccaaagccggctgccttcacccccaccaagggagacccccacaaaccaagggagccctgctctcaggtgcacagggcctcttctctctgggaggtgacagttttttgagggtggggccagacacctcccaggctatccctcacaggagaggatggtctggactggaggagtagaagcaagtaggcactggggaaggggaggagagcgtcctgagtcccaagggtcagagataggagcaagaaggaaactgacgtgttgcagggcgtgtggttaaggaagtgagagaggggctcagggtcgattctgcctgcttttccttcctccagcttgctcagcactcttcccagaatgtgggccccaaactgccaggtgacaaacaatgcccccaccccaagagagtcatccagcatgtttgaagctccatctggtcctgtacaccagttgcacaccaccaaacgcagacccatgaccactccacaacctcgcacacagacagggcaaatcccaccacagatccgtgcatcccaggcatgcaggcaatgcgatactgacacatgcccgccccgcccacgcctgggcctctgaaccctgctccagtctcctcagtcaagggcggcggccccctcaggcctcttccacccttttgccccattcagatgcctggttcccagcattgcttgggtagagactcccgcctgacaagccccagcaggccaagttgatgagccggccaagcaagcctgtgtctccgcagcgccctccatgtacacataacccccatcaccgggaacctgggcaccccgcactggcactatgtctggcccacgggtaggggatggttcccagggtctccccagacccagtgctcttcccctgtagggccactcttgcccagggttaggatggactgtgctccctctccctcaaactaggccagagccacggaagcctgggaagggagatgaggaagcacttgtcactccagacatcccaccaccatcagggaggtgggctgagataatgccaaatgcacaaaatcctcaaaatctgtctgggcatgatgattcatgcctataatcccagcactctgggaggccaaggcaggaggatcgcttgagcccagaagttcaagaccagcctgggcaacacagcgaaaccccgtctctacaaaaaatataaaaattagccaggtgtggtagtgcatgcctgtggtctcaactactcaggaggctgaggtggggaggatcacctgaacccagggaggtcaaggctgcagtgtgagacccggtctcaaaaaaaaaaaaaaaaaggctgggcaacttggcaagaccccatctctacaaaaaatttaaaaattaatcggggatggtggcgtgcacctctggtcccagctattcaggaggctaaggtgggaagatcacttgagcccaggaagtcaagggtgcagtgagctgtgttcgcgccactgcactccagcctgggtgacggaccaagaccctgtctcaaaaaaaaaaaaaaaaaaaaaactccccaagttctttcagtggcagcacagctcaggggctgacacacgggatctggagtcctctggaggctgagtcagagccctatctctaccactttctagatatgagactttgggtgagttacttaacctctttaagccttggttcctcatcaataaaatggtaatga

SEQ ID NO: 554 - DNA, 1813 bp, Homo Sapiens
agagcctggttttgggtaggagtgaggcggcagcttgtcgtttcccggcccgcacccgcccttgcgctgacaccgcgggccttcctttgctctgggaacgagcgtggggagccctgttcaccctcacaccccggctccagagcggcgcggagcactccatgtttgctaaatgaaaatgaagtctcggcgcgagcgccacccaaacggcggcgtagttgcttgagaaccgcggaggcaaccgcttgggagggcgccccgaccccgaagctgcttctccaggcgcccgaggcggagagaaggcactggggtctccgtctccaccagtgatttctggtgaaacaggaaacaaaacccgggaaacaaatgggacgaaatgttggcggttttgatgctggatgatgggaatatgggcgtgtgttttgtacctttctgttatcttcagttttctcaaaacacgaaaaacagactaagaacagcgcatagaaaacattggggcacaactaaagctcataaatgcacacgttttcataacctgaccgaggtccatgctgctgtagcgcatacccccaagaacagagggccgcgtgttcttatggccccggtgccggcccccaagcggggttcccgcaggagatagggcctggctcccgcttcagcaccgcgtggcctggagtgcagttctggcggccaagatctgagggctgtagcccgtgccctcaccaggatcccagacttagagtccctgccctccccgggatcccagggctcgatcctgtgccctccccgggatcccagggctggagcccatgccctccccaggatcccagggcgcgagctggtggcttctcaagcggagttttgcctgcttgttacattagtgaatgtaggaccacttgagtaaaggaccaaacctttattcttttgcttttctgccattgaaaccattcaacccatgctgattaatacctactgtttgccaggtaatatgccccttgcagaaagacgcaaacagctaaaccccaaatgggatgttgtacaggacaaatgaccgtgtcaattaataccaataattaagataatagtataattatgatgataatataattaattcgagcctggaggaaacaaaagaaagtggaactgaactattagagaataaatgagcttaaaagacgtcattgaatggaatgtgtggaacttacttggatcatgatagaataaactagcttaaacggggcatttgagagataggtgggggaaattggaatataaagctgggtattagatgaaaactgggagtatcgatacttttggtagggagcagtaacggctggtgggtaaaatgtcctaacctttagagatgcaaacggaagtatttacagcaaattgcccctatgtctggtattcgctttgtaaattctccatgaaaaaaaattcaaggacaggtgaaacacaagtggcaaatgttagtaacggttgaagctgggtgatgaatgccataggagttatgacgattttcttttgcatatgtttgtagttttctgcgataaaatttattttattttatatatatattttgagacagagtctcattctgttgcccaggctggagtgcagtggcgcgatctcagctcactgcaaactctgcctcccggttcaagcgattctcatgcctcagcctccctagtagctggtattagaggtgtgtgccaccatgcttggctaatttttcgtctttttagtagagacggggtttcaccatgttacccaggctggtctcgaactgctgagttcaagcagtccggcctcctca

SEQ ID NO: 555 - DNA, 5393 bp, Homo Sapiens
gctgttcatatgacatactttatttccaatctacaaccattaaaaacgctttataagtttacactgtacagttattctcatgtctgaaataagacacaggggcagggagagctggtggattggactgcagttgtcctagcacccgatccatcctaggaaggagccttttgaagacagaagtggaaaggagagaatagtggacaagagaggtggacagttggcccaaggatgcccttggtcccttccctcccatgggccttgccctgggggtcccccagggcccatgactgcaggaccctcaccaggaaaccaggctgagtgggaagggggttcacagtattggcgggggctggggaggggccaggatgaggaggaagggcagcttctggctctcttcccagctgctgggggttggagctgttttttggcactgtctacaaggtatccctggggttgggaggaggaggaactggggatttaggatgctttctttgtggagttaagatttctttcagtttgaagaggcgctatctggcctatggtgaggttcccaagggagaaacagtcagggtcttctgcctcctgcctccccaggactcccaccccctccctggctggcaccatccacacagccttttgtaaaaccaagacaagtgagagaggtgagcaggagcagggaaacaaacaatgtgtgctttctccaggcccttcaacttctcttcctcttccaagaggagcgactatagggttggtttttgttggtggtggttcccaatctcaggagtccagataaggctggtgttttccacctgttcttggcctagccagtcccagtccctccccaggctctactaatggctagcccagatcagcagttggcatattcttatgcgtcagaatcatttggagggctccttaaaaccccagcttgtagggccccactccacaagctctaattcagtgggtcttgggtggggctgctaatctgcacttctatcaagttcccaggtgatattcctgctgctggaatgcaatacaagaaccactggctgagaatggtgcccgcagtcacctcattctgagcagcctggtgtctcctgggcagcactaaggagctgggccacagctggcaaagcccagccttggggcaccacatcacctgggaagctgctggaaatggtcttggggtgagtcccccgtgcagagaagtaaactaaggcacagagatcagtggcagagctgagagaggagccaggataccagggcccagtagagaaaggatggggctgcaggaccctacagcatgaggggtgctctagggaccacagggccatcctggtgctcatcacaggatcacaagactgggaaggtaggagaagtgaagacatctgcccagacctgggccaggtttccagattgccagctgaggtccctcttcttgggaatggtttgagtggcttccaaataaagagtgacaaggcagccagccctgactgcctcagcccttcaaagatgtttagagaaaaccaaaggtcccttcctcagggcatggtgtccagaaagctggtgaagggcaggaagggaggggagcagggccgttgggatagacaagcagcagaggaggctccaaggagggtgaggaaggagtggcagggctggcattggagagaagccctgagcaggagacttgggcccagcatcatgtcctcagtcccctcaggacttgggtctgtatattttgcaaactgcaaatgctgttgggttgggaggggtaaggcatagagttggggtgaactgtagattctgccaggacaagcagctctgagagtggtgaggtccagaggagaatggagaggatggttggatactgaatggacaaagagatggatcaatgaccagagacagggagagaagaacctgtcaggcagcacctgctttacagtcaaggccatctgggcctgggcagggcaggggaggaaaaaggagggatccaagccccccccacccaccaccacacacacgcccattgcaaagtgctggggctgctgctggcaggctgcttacagagaagacagtgtggcttaagggtggcaccggggggttgctggggcagggtgagcccagtgagaagggctggcagggctggtgcctcctgatgcattggaggaagaggcttttttttgtgtgtgtgagaaaacacaaaataaataaacacagaaccaggacaccaccacatttgagagcaaatatcagagttgggaaaccacagacgcggacaggaaggcttccctggtaggaagcagggggacaagaagccagttactgaggttacgggaaaatccgcacgaggcagcagtgctgggaagaacatcctgggaggactgagggctgaatactatagtgagctccggacccagaagaggaaaacctggcatggaccagggccactccatttgctggcaggaaccagccaaggagaagaggaggcaggaggacaagaggctttggagggagatgataaagaaagaatggccccacgtccagaggcttctgcaggaacagtgatgagtggccttgcacagtggcatgcaggaagtagaaactggggctttactgaaaaccaaggtctggctgagacaacaaagatggcaaggacaatcctggacggtacgatggtaaggctgagtggtccgtaggtcttggggctcaggtcccacggggatttctccccgaggctgagtacgcagcctccctggctgtcgctctgggaggtggcagaaggcctctggtggcttgtggcctgatgtgaatcccctcacctggagataaccttggagggcccccctgacctcatgggtgagagcagcagcatccaagagcggaactggcccacagctccactggctgcctgctctgcccacaccagtcactggggcatggaggaggcggctggcgggactggcatgaccctggtgttcagcctgcagggaagggagatgcaggacttggggtaactggtccaggtgatcccgaatgggtgggtctgggaactggcaggtgggaggtgggagtgcaggggcgcctccagagtcctgggggcagatcagcaaagctactggcttttggtcttcctgatgggcaattctgcagacaagctgatccatcctggtgtttccactctgggtccccagtcagttacaggaaggctgatgtctatgtgtgtgtggggagcatgtgtgcaaccaaaaggggttcaccggcaccaaggcgaggccatgggaggcgctgccccacatgctgcaatgagccacatcgaaatccaaccaatggctcaggcagctcacaggggacgtgaggaagggcgggcagcagagctggggcagggagaagagccgtgaaaggccataaggctaaggagagaggctggtgaaaaggctggcaggctggtgagaaccgaggcaggctgggagacactcaggtttatgtgcaaagctgcgataaacaacattctcaaagttcagtcctgttttcctgtgagttctcatttgggaaacttggagggatctccacactcttaatagagctttagtaatccacgttcgactcatgaagaaaggtgtcagagggagggagggaaatgagacaggcaatggagaacgtctggggagtggtgatggccgtccagccctccaccttgtcagtgagtatttatagactgaccgctggggctggccaagtaccaggcattgagtaataagtagtgttctgaggccacatggccagccgtgttggggtgcagggctccagctctgttgaggggccctccaaagctgaccaggaggccaggtctccaaacctggctgccaagcggcctcgtccacccaggggaccccatgcctgcccgtgctgttagaggcctcatgttgtcccagtggcaagaatgcatgtttcaacctccaataaattaccttagggactttggggtaaattaaattattaaaataaagtaaaccaccttaaatatttatagtaggaaaaattcaaataaacaatctaggcaagatacgtgtttccaggccccagtctactgctgtgtcctgggctctggcctcttggtgttctcctgggcctgacctggccaaccaagaatctcttactgggaatatctttgccccccgaccagctgcaggatgtaaacacagtggagatgtagtgcctgctgcctctcagggtgccagggaaagaggcctctgagatcacttgagatcaaggcagtgtatttaggcatttatctatgcaccaggtcttgagactgactctacctatttctgtcctcaaggggtctgctgggaacgttggggccccaagtcactttggcaaggaaggcaattgcaatcactccccaaccctgagccctgcatgtttccacttcgcctcccagctcttgctgcatccaggctatgggcagggagatccagggctccaggacactaagcaatggccctggctactgccctatcatactccctagtgtcccagcaatctagagcagtggggctgggaggaggaggtggtggagagaaggaggtgatggtgatgatgcccaacagggctccaccaggaaccaaacatggagccctagagcaaagcctgttcttctcagcagtgtctcctcccaaatgaaggggtggatggtcagcaggaaacatctctccgactccttttccccaaaggcatggccagacatgtatccttcttgggctcttccaagagggtggcatgggcagaaccaggcaaggctctctcttaggacccagggatcggctcttgacagatctctcagtggatgcttgggaagcccaggtttggtctctctcccactcactgccttcccctgggaagtcgaagctcaccacccaggggccagcaggagacccggctttaccttgatgtgaaagctgcattctggcagtggcatcactgctgtccctccagggccaggcaatgctgaggacacagcccctcgcctcacctcgtctcgtctctgctggttcccttctgctatccaggggctgggctggttgaggcggggagcttggctgctctgtcactcgctgggggggagtgccctctcctccccaccccagctggactctgaagggtgcagcctgcacttggaaggagagtggcggatggcagagcgggacgatcgggcgaagcaggaggtgagagactgggtactacagtcacaaacagcgtcctaggaagagggaggcagggaggcaggaagtcaagaggagccaggagacatggaccaccatgagctgtgtggtatgccaggcaaggaactgagactcggccataaaccagttcccaggggctgaagctcctca

SEQ ID NO: 556 - DNA, 1309 bp, Homo Sapiens
ttatttatttatttatttatttatttatttatttatttattttctgagatctaatttagaccatggagaagaaaaacaaaaaggtggtattaataaactgctttggggagtaaaagaacctcttagaatccacgacatcatggatggaagagatccttaaggagggaatgaagcacagctcagagtgggaaggttagcaatgttcaagaccaaagttaatcatctctacatgagtcaattgaaagaaaagaattaaaagcattaaaaaaaaaacaatatgagtaatgggaggagctgatgaagcctgctgcccagatgaggattggaaactatttaaactggataatacagtatgtgttttagctctgagaaaacagaagttgaacttttgagtagtaatcaagggcacggtctcaaagtatttgcaaatagtgctggtatggagaacagatgccgacattattgccaatgggaatcacaatgtgatagttggagtgagagactaaaagaaaccacagggaatttttgcagaaagcttggcattgaacatgatttatggttgatttaagaaggagacaaggaaaataaggctacagtgtataccatctgactgctgcggaccaaggatgtaaacagttagccatggctctccaacctcctggaaatcaggattctgctcatacagaaaggcgccagaatgtttgtctgagttaagtgcatacttcttttttagtatctaagaatagttatcctcctttcctctcccattactgcttgggtatccttaaaaatcctcaccagctattaagtatcatggagttacgcaaagaggtctgcagggaacttgatggcttcccaaagtggatcagagaacctcacaggaggccctaggcttgaaaggatgattgcagaaaggatgacctacaagtggatggtcagatctggctgcaaatggatgtctgaaagaaaacggggatcctaggaaacccatcacagccctctatgagcttcagaaaccagcaaggttaattatgtcattgcctctaagtgaatgcaggtgacattgttttgataatttgatgaacatgcctcctccaggaacagtgtgatccaagatgccaggtccatttcagggcctgaatcagatgtccggaatctcaaaaagactgggaattagaactgggttctcaaggggaaggacttcttaagggaaatttttttcttggctaaagagacactcaggaggaaatgtcttttcttttgctgccattgaatgactagatcatctatctatctctctctctgtcta

SEQ ID NO: 557 - DNA, 1405 bp, Homo Sapiens
gggtactactagccttgtaaaatgatttgggattgttccttagttaaatcagtcaaccacagatactgaatacctcattagcaccacagttacgaaaatgaagaaaccccgatacggttcatttatctatcctgtcacaataaccaaatttcctcaaagttaacatcactgctgctttcactgacacctcacgtaggagtcaggaaacccgcaagcagatctctgagtccccaaggcaggcaaagtgaaggcgtgatccctggagctgatctcgtgtcactccatttccccatgactcatacttttaagtcacattggcttgtttgtgactctgctacagtaacctgcctgcgtattccctttgaaataaggaaaattatgtgcttaaaatgggcctcttctattttcacacagaagtcttttcccctgcctctcttcattccttatttcttaacttatcacaaagctcctctcgccttagaacctgcaatattaatatcctcctgtaaggaaataaactgaacccacccacaaggtgaaagtgctttgtgaaactgtcaaaattctgttcatgtcattggcccaagtgtaggtgagagaatatgaccatagagggcctggacacacagggacctgaggcagagcagggcttcggagccacgtggaggatggagaatgaagacaccaagtttccaatagagaattaccagcggtcacctgcactcatgtttacacagcaatgtgcggaaatgcagaagaaaagatctcctcaactacaaatttgacttcactaatttcccttaccaatatatagccagctacacattgttgttaaattaaaacactttaaaaagtcaaatggtcgggcgcagtgccaaggggcttcactttgggaggccgaggcaggcggaggtcaggagattgagaccatcctggctaacacggtgaaaccccgactctactaaaaatataaaatattagccgggtgtggtggcaggtgcctgtagtcccagctactcgtgaggctgaggcaggagaatggcgtgaacccgggaggcggagattgcagtgagctgagattgtgccagtgcactccagcctgggcaacagagcaagactccgtctcaaaacaaacaaacaaacaaacaaaaagtcaaatcgacttttgttagattttcttccaatctacctgttctgattctcttttattaagcagactcttagctatttgatatgttctgcatggaagacacaacctgaatatttctgtatgtttctcttcaacttctgattttgcaatattctttccttagggacttcttgaagagagctcacagggaaaattactacccccaggactccatcagattttcatgtcagttaggaactttggcagtagttttaa

SEQ ID NO: 558 - DNA, 1052 bp, Homo Sapiens
ggcgcacatggaggttcaggacaagatggaagagaatgcttatcacaaagctggtgacagagcaggggctggggaggggccgctgcacaggtccatgatgaagtctttttgatgttgaaccattggcattcagcagtgatgaagaagacggtgtctcaagaagctctggatcttgacccgccatctgccagcgtccctgccctactttcttactcagaaatggaaacataagccctatagtgagccataatatgggatcaatgccacctcttccatgtgggtggcattgaccgtccctcatattatggttccttataggactctgttctttataggacatcctgcagtgatttaaaggtggctcatgcctgtaattccagcactttgggaggccgagacgggcagatcatgaggtcaggagatcaagaccatcctggctaacacggtgaaacctcgtctctactaaaaacacaaaaaattagccgggtgtggtggcgtgcgcctgtaatcccagctactcgggaggctgaggcaggagaattgcttgaacctgggaggtttcaacccgccactgcattccaacctaggcaacagagtaagactctatctcaaaaaaaaaaaaagcatctatttcttcattatctcattatcctcatcacatgaataagtaatatccattcccacaggaggtggatggcatctttcctgagaagtgggcactagaaaatagatcagccatgcagtggactcttaggatgggatcatccccagcagggcattggaggcattggaggcattgatttcaacaaggtaaggccaagttggattgacgcataccaggaaaaggacatgatttctgtttatgttttgagcatcttctcttttgaatggttttcctgctaaaaataacacatgctcattgcagaaaatctagaaggttcagaagggtgtgaagagacaccccatccagaaataaacactgttaatatttttcctattcaattattatttgaagtcatattgaagatatgatttattttggttttctttgc

SEQ ID NO: 559 - DNA, 1415 bp, Homo Sapiens
atgaggcccaagaagtcagctttggtatttctgctcctgcaactcttctgtgatggctgtggattctgggagaaggtcctggtgtggccctgtgacatgagccattggcttaatgtcaaggtcattctagaggagatcatagtgaggagccatgaggtaacagtattgactcactcaaagtctttgttaattgattacaggaagccttctgcactgaaatttgaggtggtccatatgccataggataaaacagaagaaaatgaaatatttgttgacctagctctgaatgtcttcccaggcttaccagcgtggcaatcagtcataaaattaaatgttttttgttgaaatgaggaacttcaaaaatgatgtgtgagagcattatctacaatcagacacttatgaagaagctacaggaaaccaactacgatgtagcactcatagaccctgtgattccccgtggagacctgatggctgagttgcttgcagtcccttttgtgctcacacttagaacttctctaagaggcaatatggaacaaagctgtgggaaacttccagctccactttcctatgtacctgtgcctatgacaggactaacagacagaatgacctttcaggaaagattgaaaaatccaatgctttcagttttcttccacttctggattcaggattatgaccatcatttttgggaagagttttagagtaaggcattggaaatggaaaatgttgtccagagttcaggggaagatgatattgggttgttttctctggggtcactgtttccaaatgttatagaagaaaaggctaatatcattgcttcagcccttgcccagatcccacagaagaaaaaaccatccacattaggaaccaatactcggctgtatgatgggataccccagaatgatcttcttgtactaggtgacctcaaaccaaagcttttatcgctcatggaggaatgaatgtgatctatgaagctatttaccatgaggtccctatggtgggagttcccctatttggtgatcagcttgatgccatagctcacatgaaggccaaaggagcagctgtagaaataaacttcaaaactatgacaagcaaagatttactcagggttttgagaacagtcattaacgattccttccagttataaagaggatgctatgagattatcaagaattcaccatgatcagcctgtgaagcccctggatcaggcagacttctggatcgagtttgtcatgtgccacaaaggagccaagcacctgtggtcagctgcccatgacctcacctggttccagcactactctatagatgtgattgggttcctgctggcctgtgtgtcaactgctatattcttggccacaagatgttgtttattttcctgtcaaaaatttaataaaactagaaagatagaaaagagggaa

SEQ ID NO: 560 - DNA, 7054 bp, Homo Sapiens
agtcctgcagggcggggcaaacttggagaggcgctgcgtcgggggacggggctacaagccgtcgctgggggcggggcttgcggcccacctgtaggtcccggtgccacctcgtcagtgtcccgagagatccccagaagaacgagagggctgaacaggggaccccactgacgtccggtgggccgactttacgatcctttaggatgaagaaactaagactcagagaagacaaatgacatgcccaaagacacattgataagaacgcatctggtagtggtgttcgagtccagcgttgcagcagagagatgggtaactgtatggccgaacagctgtcttctcgtggaagaaggaggccaatgtccaggagtggcaggcatactggaacttggacttctgtaggccaacctgggttccacttggtagatgggggtcttgctgtgttgcccaggctggtctcaaactcctggcctgaagcagtcctcctcccttagcctccagagtagctgggactacaggtacacaccactgcaacccctcagtggttgttatttaactgaagggggttttagctttcatgtatcagctcactctggagccagacagcctggccttcatggcagctctgccccttactacctgtgtgacatcgggcaacgttactgagtgtcagatttcttatttgtaaaacagggataaaaatgacattgctgtgcaaattaaaagaaagaatccatgtgagatatttagcacactggcatacaatgagagcttaataaacattgttagttttgtaaactgagggaaaaaaatagccacaggcctgggaacataaatgcttggtaagcttctcagttccctggaagtctgacacgcaatgtgtatgtatgaacaaggcaggaggaagcatgacaccaagccttccttttaacaaacactgtttaaatcagaggtcggaagtcatggactggagattcattctctccccactcatttctgcccagagacacctggtgatctggcatacacagtgctatgaacctcagaattatttgctagcatttacaaattgtgagtactcccacatacaaactgtggtagatggaataatgcctccccacaaaaatgtccacagcctaatccctggaacctgggaatatgttactttacacagcaaaggaatgttgcagctgtgattggagattgagatagggagagtgtattagtctgttgtcatgcggctatgaagaaatacctgagactgggtaatttacaaagaaaagaggtttaattcacttacagctcagcacggctggttgggggggcgccctcaggaaatttacaatcatggtaggaggcacctcttcacagggtggcaggagagaaaataagagcagagcgaagggggaaccccttataaaactgtcagatctcatgagaactcactgtcatgagaacagcatgggggaaaccgcccccatgatccatcacctccacctggtcccccccttgttacaattcaaggggattgtaacaattcaaggtgagatctgggtggggacacagagccaaaccatatcagagagtcttcctgcagtgtccgggtgggtgcggcatgttcatagggtcttagaagagggaagcaagaggtgagaggacagaaatgccacattgctggctttgagggtggggccagaggagggacctgcaggcagagatagagctggaaatggaaaggaaaccttctcccttagagtctccagaagaagtgcagccctacagacctgtgttaggcttcagacctccagaattgtaaaataataaaattgcattattttaagccactcgaggcccatgtcctcaacaaagagaaagacggtggggtgctgtcagccagggtaggtacctgcttggtggtctgggtcctttcccactgtgtccattcagttacattacctgcccatctgctgaggcctcgagtttgggacctcaggtttatataattccttgcacaagcatgatcgattgattccggagagtagcagaacactgatatgcaggggaatctcctagttccaagtgtgagttgtagtctagacacttcctgttccctacagtcttttttttttttttttttttttttgagacaaagttttgctctgttgcccaggctggagtgcagtggtgtgatctcggctcactgcaacctctgcctcctgggttcaagcaattctgcctcagcctcccgaatagctgggatcacaggcacatgccaccatgcccagctaatttttgtatttttagtagagttagggtttcgccatgttggccagggtgatctcaaactcttgacctcacatgatccgcccgccacagcctcccaaagtgctgggattacaggcgcaaaccaccgcccccagccctcttccctactgccttgatgtgttcatctgggcaatgtgtgttgagggggcatagggaggggagctctaaggcaaatgtgctgggattctgcattcgtcatcctcaaaacaaaattggtccctaggtagttctgcctgtgatcctgcataatgtgcaaagccagtaagatgcctttgcctcatccccagggaacatgcctcccagccactttcatctcacctagtgcctacacagaaaggcaaccgcctccctgctgaagggaccccacgcctgtctcctgtttccacacaattaccccgggaaatgcctggcttcccatttccagttgcagccatcttgacagtttcagcctctccccacagcccacgtccctcacttgagcagcgagatgtgaagacagacagccgcttgagaactgcacagactgtccttaatctaagccatttaaaaggcatttgtgttccataaaacccgtttctgtaattctgtgcccctacttctttgaaagatgataaccctagggaggagattagccagggaggagaagttcagatgtgctaatattttaatcgctcattctttcatcacattagtcacattcattaagtatgattaatttcaggctttgttgaaaaccctatcagtttccctatcagccacacatccatctcttgccaagcaggctggtgcagtagcaccaaaagtcccccagtgttttttacacctggattgtattatgtgccccctgaaaatgtgtggaattaattgagctcatttgtttcaaatactttgcaagagcctgggctcttgagtcaggcggcctaagtgtgatcctaagtcctcccattgctggagtcacctgggcaagtgactgacgccctctgagccctggtgtcctcgtctgaggatggagataagaatacctaactcgaaagttggttgtgaagatgaaagaaggctttcaaattgctaagttagttggttatgattgtaattaagggcccttggagatggatcattcatccattcattcatccattcagaagatttgtgtacagtgactactgtatgcaaccctgtgtgtccactgctgatgagagagacagcagcaaacacagcagtcaaatgcgtgtggcccccaggaccttatattttagtggtggaagctagacaaccaccaaacatgtaatataccagatggtggtacgttctatggaggaaagaaaggacgaggggcagggagtcctgggctggtgggacagggtgctatggctcagagggaactcagagatcacctaattcaggccctgacctggagggctcatgctttgcacactgtgctaagaatttggactttctttctccaagaataaggacaatgagagccagcaagcagggaagtggagcaaggatggtgccgtccggctgctcagctgctggctggaactcccggaggactctgtgaggatgcaggtagaaggtgtgtaagcatgtgactgcatggaagccctcggcatgtgatccactccgtgttccaaattgccatcctttctgcgtgctgttagggacttcccccagctctccctgcagagtgaggagtactctgagacagacgggtctaggatgaactgtgttgatggagaaatgaacattttttggagggaaggaagatttcggggtgtggggcataagttgaaggagtatggctctgaaagtccttgggcagtttgtagaggacagagaaggtggtaatgtcagtttctgcccctctcccacctccacctctggccttctcagtggtcctatggctccctaccttcagtcatcttgttctcaagcctgaagtgctggatccactcagctgcaacccagctcaacacctctgtggaagctttgcccatcaatcaggagaagctgagatccagagactgatgcccacgttctgtctttgcagagggaagcccaccagagccctcttctctctggggaggagctggctccctgaatctccaagacaaacccagacagccctggggaccttgaatgtgagcaaggggagcagaaaggaggctccagcccacccagggcccctgcagggtctgcacacacaattacaggtcctcatttccctctcctaatgatgccccaaaacattaagggaagttaaatcaaaccaccaggtgtccagcatgaacagctgaaataataaattcacgagatttgaatccaaataactgatgatttgttccatgaatgccagagctggaagggatggggttggcagaagagacaagactggaccatggacctggtggttctgtgcagaggccaaagctactctccttcccacctggccctgtgctgggcctaacctggagccccctctatcctctgcctcattcttctccgggtcaaggtccagcatgaactccatgtcctccaggaagccctggtggacttgggcagacctggggacacgtccagcctcctggcaagatgggggtaacaggagtgtgtataaaggggaaggcaagaatgtgcccttggtggagcagtgaaaagaagccctcatgtgacaagtgttttgctcctaacccacctcctctggtgacatcttctgggttaactgctcttgctgatctctgcacataaaccaagctaactgtgagaggcctttcatttctagtttaaagcaaggagaccacagttccttctgaacactcacccccaaggagataaggagggcgtcccatgagcaacactgtgtgttaaagatgtacacgagcactgggacctgaccaaggacaaacacgtctccagccccctcagacccttgctgctgctcagatgtccgctgtcatcggtcacatcctaacctcaaccccctctctcctcccacataaaaggaggctgaaattcatagtaacttcagatggttctttaggacactggcccaccaccttctcggttgctggctctccaaaacaaagccccctcccttgacccaattccttgtttcttgacgtactggctgttgtgcagtgcatggtaccggcttgaactcggttatgttggcatggcctctggcggtgctcagtttgtgtggatgagtattttacagctactgtcctatttccagtccccttcctctggacggctatgggatgtgctgtggatgccctctcttaggctggaataaaccaccctaccttctcctctgccttgtctccaccaaataaactccttaaggcagggatagagtcttgcactccacgaagaagtattgctgcatcctcagctgtgtaagagtgaccgggcttcttctattccacctgtaatggaactttaggcacgcagagagagatggcaaatttgtgctggctgaaggggtcagcaaatgcatataaggcttcttgtgctccagagagagaatggagtgcagtcagtgagaccctgaggggagaaggaaccaaaagcctgggcagaagggatcgtggaggtgcccagggtcaggagggatgggaagggtgaggaacacaagagatcacctggaggcattagaggagaaggcaggcactggggatggtgccgctgatccaggtggagcaacatcctaggacccgagtgctgggcaggtgcatccgtggagggaagcttctctcctctctcggctcctgctgagagaggcaatcattcccctggcttgccctgcaagagacaggagctctaggtagatctctgctatctagggaatagaatgtgaatatttgaaagttctagaggtcaagtcttaggttccctctcagctcagatcccaaatggtacactctaccctaacccccttttcttgtagctttgctacatggagaggaaaataccttgccagacaccaacagtcccttctcagcacttttgtgtgaagacaactcagaccctaagagaatggggtctaatttgcaggtgccactggaaggcagaggtcacgggagccctggacttcagacaaggtagagggatcctggagacagcacatctggccctggagccctgcccacccggggagtgagggcagctctcctgctctcctaggaggcctgcccgaggacccccatgtcctctatgtgtgggattctgcagtttgcactcacaacccagagccttttacccaactaccctgtttgtaggaatgtgtccaaaataagcatcagacaagtacatgaagatgaatgtgcaaagacgttcataacaggattgtttataatcatgaaaaatgatctgcagatttcctgtctgctgtgcaggatgagttagacggggatgcatccataaaatcactttgccctcatttaaaattatatcatagatctatgtttaatgacatagtaaacggtactcaatgcattaagtgaaaaaagcatatacatatcaggatgtatatgatcaagtttttgttaaatggatgcatgtatgcatgtcagtaactgtctgtgtttgcaaacaaaacgtctagcaagacgtgcatcaaatattaacaatcattatctttggattctggatttattgacttctatttttgactttgccctttgtttttctatgttatctgacacttttacactgagtttatattattttt

SEQ ID NO: 561 - DNA, 8304 bp, Homo Sapiens
caagtagctagggtcacaggcgccagccaccactccccgctaattttgtatttttagtagagacagggtttgccatgttggtcaggctggtctcgaactcctgacctcaagtgatccacccgccttcacctcccaaagtgctggaggttcaggatctctaaatgagaggtaaacaaactgaagcaggaggccagatcaaggagatgcccaccatgatgtcaggaggtgagttgggaaagggcctcaggagatagggattcttgcgtggcccccaaagggggtagtggggtagggaataagcttcctcctaccctaagcaccaataaattcaaaactttatttatgtatttatctatttatggtaaaaatataacataaaactcactatcttaaagtgtacagtagtgttaagtatatttgcatcatcatgccacagatctccagaagttttcatcttgcaaatggaaactctgtactcatcaaacaactccccattttcctctctccatatccccccactaactgccattctactttctgtttctatcagtttaactactttagatacctcgtatacgtggaatcataaagcatttatctgcattattttacttagcttaatgtcctccagtttcattcatgttatagtgtatgataggattttcttattttgaaggactgaataatattccattgtatgtatatatcacatttgctttatcattttttccatcactgaacatttaggttccatccacctcttggctattgtgaataatactgcaagcgacatagatgtgcaaatatctctgtgagatcttgttttcagttcttttggatatatatcaaggaatgggattgctggtcatatagttgctggtaattctatttttaattttttgaggaacctccattctgttttccatgggctctaccattttacattccacaaacagtgcacaagtgttttaatttctttatgtctttaccagcaagcacttgttatacagtctcccttctttcttttcatagtgggcatcctaatgggagtgaggtgatatctccttgtggttttcagttgcatttttctgatgattagtaatgcgaacatcttttcatgtgcttgttggccatttgtatatcacttttggagacatgtctgttcaagtactttgcccgttttttaattgggttatttgatttttgttgttgagttgagggaattctttatatattctagatattagtcccttctcagatgtattatatgagcatattttcttcaattccataagttgccttttcactatattgattgtatcttttggtgcacaaaagtttttaagtttgatataattccatttgtctacttttgctttttgttgcctatgcatttagtgtcataccaagaaatcattggaaatatgttttttcatttgtttaagcctgtaggaggaaatacggtttgagtgaactttaacatcttggaaaagtaagccttggtcaagcttacagacaagagactaggctggttattcatcctgtgaaacagccctacaaatttacctacaccatggaatccaagatcccactgataatgtgaacttactcctttttgtttgtcttctcccttctaatgttaatttttttaactgcaggaaaaataacaaaataacagaattcttcttttataagatagatttgggagcatgtactgatcttttgagtgaggtggagaggtcaaaataaaaatactaaaatgtgaataaaactttgagacttagatggagacctagttaaaccttttcttcaaatgccatcaatgccaaagagcagcagttgttttactaattcattcaccaaaagtgattatcaaacgtctactatgttctgggcactaactagccaaggcaatataggtgtgtataagaggcaagtctctgctgtctgtgagtctatgcagaatctcgtcttccgttagaagcatcaacaaacatgtattgcctgccctccctctgctagaagtttggggagacatgttatggactaaatgtttgtgtcccccaaaatgtacatgttgaagccttaacgcccaatgtgatggtatttggaagtgaggcttttgggaggtaattagatataaatgaggtcatgaaggtgtggtccccatgatgggattagtggccttataagaaaagagacaagagaggttcttctctttttctgccacatgaggacacagtaagaaggcagctatctacaagccaagaagagggtcctcactaggaactgaagcctgctggaccttgattttgaaatttccaggcttcagagctgggattcctgtgtttaagccaccacccagtctatggtattttgtatggcagccgaaacagactaatacaaggcataagggacagtgagatgctgttcatcctctcaagggttcgtgaacttgttaccgtggcctccgcagtccctgtgttcacttatctttgctaagggcaaatcactgatgagatggacgcattttataactggagaataaaagggatgaggccctacaggctgagggttacaaccaggtgtctgaaggagtcagtgtcccaaagagtgagaatagtggagtgtgtaagtggagaataaccaggtaggtgcttaaaagtgaacctgtgttgactgtattcacttatttcataagacaacttttggaggccagacacaccacctttaaaaagtaattgtataagtgtcctagtgctgtgcatgaagtcccataaactgggtgctttttaaacacccagttgtttttacaatagaagtttattttcccacagttctggaggctggaagtccaaaatcaaggtgtcatcaagcctatgcttcatttgaaaactagaggggagaatcctttcttgcctcttttagcttctggtgtttggtggtaatccttggtgtttcttggcttgtagatgcttcactcccatccctgcctccaaagtcatatcgtcatcctctccctgtgtgtttctccttccttttttcttttttttttttctttttttgagacaggatagcacgctgttgctcaggctggagtgcagtggcatgatcatagctcactgcaaccttgacttcctgggctcaggtgatcctcctgcctcagcctcccaagtagctgggactacaggcatgcaccaccatgcctggcaaattaaaaaaagattttttttttttggtagagacggggtcttgttatgttgcccaggctggtctcgaactgctgggctcaatcagtcctcctgccttggcctcccaaagtgctgagattactggtgtgagccaccatgccttgcctctgcttcctcttataaggacatcagtcataccaggttaaaggctcactctactccactgtgacctcatctcaaataaactaattacatctgcaacaacatgatttccaagtaaggtcacattctgtggtactgggtattaggactttgttgtagtcagggttctccagagaaacagagccaataggatggttccgtctctatagatagaaataaatttattataaggagttggctcacatgattatggaggctggaaagtcccaagatctgcatagtgaatcaacaagctggagacccagtggtttagttccaggctatgtccaaagacctgagatccaggagagctaatggtatagtttcagtctgaagtccagcaggcttgagacccagggagagctgatgtttcagttcaagtacaaagacaggaaaaaattaatgtcccagctcaaaggcagtcaaggagaaactctctcttactcaagggagaatgagctttttattctatttagaccttcaatgattggatgagggccacccacattagggagggtaatctggtttactctgtctaccaatataagtgttactctcatccaaaaacactctcacacaaacccccaggataatgtttgattaaatatctgggcaccccatgacccagttaagttgacacgtaaaattaaccatcacactttaaaatatctttttgggaagcacaattcaacccataaaagtaataatcatgcctagagaacttttttagttgaagagatagaaagtttaattcaaatctgtacctgttgctttgtactgttatttgataggggtcttaccccactcctatccatcaaggctggcagaggctattttccaggattttagggttgctggcagctgggcagtgactcaggagagttgtgagtggggacagaaaggaaggaagtatgccaaacagtgctaaaaaatatccaaagctaagaaatgtgtaattagccctgacctcctttgcccttcctccttactaaagcagagtgggtgaaatggctcatgggttattaattgccctctgctggtcactttacaggcatggcttcccatttgcttactttattttctagggatgtcagcaaattaccacaaacttgatgacttaaagcaacagtaatatattgtctcatagttctggaagttagaagtctaaaatcaaggtgtcacagggtccatgctccatctgaagttgtccagggactgaagtgtccaatccttccttgcctatccctagtttctggtggttcctggcaatcctggtgttccttggcttgcagctggctccccacaatatctgcctccattttacatggccttccctctgtttctctgtgtgccctctcttataaaaacagcagtcattggatttaaggtccaccataatccagcatgactttattttaagttaattacatttgcagaaaccctgtttccaaacatgtcacattctaaagttctggatagacatgcattttgagggagatgctattcaaccccctatactaaaactctttttctgtggaagagaaagaggcagggagagtaacttgtccagatcactgttaagtggttgagctgagctttcatgtgtactcattagccaaagtgtcttccttcttcccctctgccctcttccctctttcctttcatcgcctattttcttatccaaggatgccctggatattagtttaccttcatttgaatggagaaaaatgcccattgttaactgttaactgttggggtgaggggatgggaaggtgttcagtggaaggtctctcaatctccttgagagttagtttactttttttgcaaaaatggagaaaatgaaacttgtctcatttggtggttgcatgtattattaaatcacatacaaccgatcacaaaatcaatgtgtaagaaagtgtctgggaaaatcttccaaggcatacagccctgagggacttttgtagaaaatcatttagaaagtaaggcatccattactcacctagggtattaattaatttgtattcttgaaattctttttttttttttttgagatggagtcttgctctgttgcttaggctggagtgcagtggcgcgatcttggctcactgcaacttccgtgccctgggctcaaccaattctcctgcctcagcctcccaagtaactgggactacaggcacatgccaccacacctggctaatttttgtatttttagtagagacggtttcaccatgttgcctaggctggtctcgaactcctgacctcaactgatctggccttggcttcccaacgtgctgggattataggcatgagccaccatgcccggcctgtatttttgaatttctacattgttgacatgccttgaagtcttagacgatgagcaagaaacagaaatcatgtagcacatatattcaacattcccacgtaattttaggtttctatttggtctctttcaagcggtaagtaatttactttgatcttctctgctaggttataacaaaagttgacattgtagctctgccactcactagaaatatcatcttgtttatgttatttaactttatgacctctaattgtgaaggttaaaggaaagagcacatataaaagctcctggtacattatggttagtcaggaagtaaaagttttttttttaaattgcattgttattattattactgttattattaatatcattggtatgcaagacactgagttatacatatttgacttgtgaacatatttgttattttaaaaattgaaataatttgtcttaaaaaagttacaaaaatagtacagacaattcccatatatttcgtcacccagcttcccctactgtttaacatcttacataagcacagtatgatgatcaacactgggaaattaacattgctacaatactattaagtaaactatagatttgacttgaatttgcaggttttcccattaacggttttttctgatccaggatccaaaccttgatctccaattgaacttagttatgagaaggagacaaacttagtcttttataacttagtttttccttgtctttcatgattttgacacttctgaggaaagctggtcagtaaccttgtagaatgccctccaatttggctttgtctgtattttctctgattaaattgagataatacaattttggcaagaatacctcagaagtaatgttgtgtcctttctcatacaccatatccagaagtacacaatgctagtatatattattactggtgaaattaacattgatctctgggttaaagtggtgtcttccaggtttctccactaaattaccatttttccctcagtgactaacagatatcttggggaaatactttaaaactacgcaaatattgccaggcgtggtggcgtatgcctgtaatcctagcactgtgggaggccaaggtgggcggatcacttgaggtcaggagttcgagaccagcctggccaacatggtgaaaccttgtctctaccaaaaagtggtggtgtgcgcctataatcccagctacttgggaggctgaggcaggagaatagcttgaacccaggaggaggaggttgcagtgagccgagatcctgccattgcactctagcctgggggataagagcaaaactctgtctcaaaacaaaaacaaaaacaaaactatgcaaatatcctgtttcttgtaccttcacccactagttttagcatctatggatgattcttgcctgccacaattattactatggcatttgcctattagtgattttctgtttccttcatttcttctctattaataggaattcttctctaagagagagttattctcctccctcatttatttttttatatcaatatgggctgatgaatatttattttattttatgggttataatcgaacactgtcattatttattttgttgctccagtggttccagctctgggcattaggagcttaaacaggttggctcctgtatcctttcaacatgcctcattatttttagtgctttcttgctttttgatgcttactttttaatctaggctcatcttgtactttctttgccccaaccatggaattgatcttttctccaaagaactctgattccttttattggaaaatggacttaggaaccaagatcttggcattgagtagtctcattgctactggggtttcattgcttctgcgtcctctcagtggacagagtttggaaatatatgcaggtatgctaacacacatacatatgtttatatttgtaaattataaaattgtataattttaaatttctgtattataaaattatacatatgttataaatctatgtttatttcaacatatatctgtataactattaaggaccacaatgaatacattcaaaggtaaatgtgtgaatatctctaaggcatacttctacttatctcctaataataaagagagtaggtccattacactattgcagagtcattagtacttgtttactttcaagttttatgttgtaattcagatagctgaggttgtcagagaagagacctagccttatgtaattctggaaccagaaaaagaaatcatggaactatccaattcatgtttcctaaactggtgttccatggaatactattttaggagttgttaatagcattatcctgatcaaagggttttgcggttccataagtttgggaaacagcattgtagatcctccacacttgtgtgacactgccaatggattattttatttatatgtttatttatttttagggatggggtcttgccaggttgcccaggctggcctcaaactcctgggcccaagcagtcctcccacttcagtctcctgagttgcgagattacaggtgtgagacaccatgcccagcatgcctatggattattaaaggagtttttaaaaatttgttttccaggctgggtgcagtggctcacag

SEQ ID NO: 562 - DNA, 27380 bp, Homo Sapiens
gctctccctcagacacactggagggaaaggtcaaactaaaggcgagggagcagagagaccggagggagccgctgccgccgccgcgcgccatgacggacgcggcggaggctgctttctcagtgcggacgccgccgatccccagctctcgccgcgccccctgccccccgcccctcgcgcgcccctcaccctggcgctggcgcgtccccgcgccctctcccccggccgctccaggcgcgcctcgggctcggggcgcggggcgctgggagcgggagggtgggggccgcggcgggccggcggcctcctcgcccgacccccgaccccgggccaggtgagtgccttggggcgggagagggcgtccggagcggagaggacaccgggcgctcagccccccgcctgacccccttccggggcgctgacaggctctcgggacacggcctctggggggcgtcgtggggtcacttgtgtcggggggtgcttttttggcgcccccgtccctcagggtcgggcgtccgagtcgtggggggctcggggccgggaagtgggcgctgcggtgcggccctggagtgcagccgcggcgacagggtatggggcgggcggcgggaggcaggtgggcccctccccggggctcgtgaagtggggggaccgggcgtgggggccgcgggaagctttcgggaaatgtttatccggcagttgcaagaaactctgccctcgggacgaggcgccttgctttttgccggggccagcgaaagtggcggatttcacagcaaaactcgggtgaagccaggctggaccggccgggagtgagagaggccgggagcacccgtctggatggggaccagagatgaacgaatccgcctgtgtgtagcaccagggcatgatgtgtgcacgttgctatgccagtgtttaatgtttgttgcttatggttattttaggactaaatgataaaaaagttacttgggagagagggaactgcttgatttgacatgagttcttcacttgtgcatgcaggaaatacattaatcctgtacacacacaactgaatttatgtccagtggactttacaaataatatacacaaaattctaaagccccgaagcaaggtgatgtgtgtctgaagagtttcaggtgtcaggctccgtgttccgtgggaacaaaataggaggacaccgaagtacttgatatgcccaagcagtcatctttttgtaataagctttggataccatcaaagtggagtttagttgtaactgccagggttaagtaatcgcattgacccggtgccacccaccagtttggagcttctctgaaagtaatttacgagacagtcctgtgctgattgtgaataaccagtgcttttgctgatttttttcctgtttaattttacactgtcatcatgtatgtgtatgctacctgtttaccaaacgttagaatgaattatccatagttaaactctccactaaatcactaaatcaggtactagctgtggcatgtctttaaaaatatatatatttgaatgttacctggaaattaccgatataatggtttcaagctgatagggattttttgaacttaagtctagcataaacattatcccaagtggatgtgttttaaaatttaaatctcatctaagaaaacttcctggtttgtgaaaggtgcaggattgtgatgatagctgaggaaatgccagagagaatttttggtagagaataagagaacaacctgtgaatttggtgttaaccagcagtctcggcatatactcacttgctccttacctaagcatttctgatatgtgggtgctttttctgttgattatgtatctttggttatttgtcattttcaaaaagtttcctcaacagaggaccctcactttgaaattgagtccttgtggcatgtagccgggataccaaaagttttcagtaccagatgcagagagagatcagtccgtttgggatcttgttaattctttctgtgcagctacttttgtgctgtgaggtctcttttacatcttgctcctattggccatagctgacatatgtctgtatacagtcctgtagtggggtacttaattgttacaacctgaaaagattatttcttgtaatatataaataaatttttatgtttttctctcttctctctttttcaagggaactgtagaattggacaaatcaacacttagcatgtccccctcctgtaggtcttgttgaccttggtggcatcgtggaggtcatatgttcatggagataaacagttcttgaacggtttactccaggtggtaaaaacacatgggaaagtgatttgggctgtgcgtatcttggttttttaaaaaatcatttttatcgagcgtttattgtgatcatggccaaaaataaaataattctttgactttttttgaaatactatacacacatttctatattacatttttaagaattgcttatttttcaatttttctagtatttcttgtatattctaccacaggtgaacaactcattttttgggtgacatttttagagcttgcttgaggggcactagaaagaagggcagtaatgtgatgtgaatgtttcagcttatgaaaacagctgtgctctactttaagaaatttgacatttaaaagtgtaagattgcaaaacaaattaattactagttggttatattatgtgagaattttaaaaaagggattcactaaaagttgttttcaaatacttaatccctttaaatggtatttatctaatgtgatttgatttgtgaataatcagttggcatacaacaatttaggaacagatttttggcatatgtaagggttatcagtgtgttctttgagttctctctttaccaaaagtatttggggacaaagttaaattcagtgttgttccacttatatgccacctataatggtttaactgagtgggaaaattgtcatctgatttatcccatatcatttaaggcagcggtgtccaatcttttggcctccccgggccacgttggaagaagaagaattgtcttgggccacacatcaaatgcattaacaataactaatgagcttaaaaaattgcaacaaaaatttcatatttttagaaagtttacacatttgtgttgggcctcattcaaagctgtcctgggccatgggttggacaagcctgatttaaggagtacattgaagcctaattaaaatgcttttcaccattgagtaaaactttatgatcaggtttgtcaggaacctcatccaaggtagtttagttagtggagtatcaaaagcaccttgttgtcagacactctcactaggacagtggtcccccagcagaggccaacaagcagttatacccaaacttcagcaaaatcaaaataagtagatttggtctaaagtccacaagcagtaaaaaccgttaccttgaaattttctgtaggtgcaaattattcttcagaattaaaggcttgattttcctaagctgtaattctgtttgagtcacttgtgaaaaatgctattttggtaaaagaacaactatgtattctttcaaaggagttttttccctttgtgttaatgcatttgcgtttatttggaattgcaggagatgatgaatgaagtacttgggaagtttaattcagaaatcattttgctttgcttatgtagaaaaaaaaggaatgtgagttaataggagaacttatttgtgggttagttcgtacttcatgtggggataaggaggaaagggaggaagtagctgcaaactttattaaggataactaatcaagtttcatttgatttatactgttcatgcctggcttgggtaacagtgacgccttcaccttttcctagttttcgagaaattttattcttagagaaggggtttgaaggataagagctaagcatcagggcatacaagaagtaaaaaatatcttcagaatgcttaatagtattttgttttgtttttatacattagaaagcaagaaattattttaatactgaatatgggtcaaaagcccaacttcgggatactgggcacggtttcatacctcttagcataattgaatattataaaaatggaaggaacagcttgaatggtgccattgatttttttagtacaggctcttagttcctcaattgaacaaatgagtaaaaatgaagattaaagaagagatgatattaaaagaagtgttttccattttttaaaaaatcccaagggactgtctcaaatgactgttaatttcagaacatagattaaaaagtacattacattggatttatgattaatgaggacacaattacaatttttaaaaaatacatgtaaaaaaggtgagtatactactgcagtttacaaatatttgtgccaagatacgtgaggctagtggtaatgattagaaattataattggaagtgaagactgatttatgttctcaatttcattatttaagccaatgtcacttttaaaatgtcacttaatttttctattcccaatgttcttttcaataaaatgcagtcattagtgcaccatactttatgtaaactggggtttcaaaataatattaactagaatttttttttttttttttttagacagagtctcactctgtcacccaggctggagtgcagtggcgcgattttggctcaatgcaacctccgcctcccgggttcaagcaattctcctgcctcagcctcccaagtagctgagattacaggcacccaccaccacgcctgtctaatttttgtattttcagtagagacgggatttcaccatgttggccaggctggtctcaaactcctgacctcaggtgatccgccctcctgggccccccaaagtgctgggattacaggtgttagcccgtgcccagccaatttactagatttcttaagcataaaatattatctaataatatgtatatgtatgtccactacatgggatttttaaaaagtttagattttgtgatctgcagaactgtaggcaacagttcttaaaaataagaaaggctgagttcaggccaggcgtggtggctcatgcttgtaatcccagcactttgggaggccgagatgggcagattgcctgagctcaggaattcaagaccagcctggtgaaaccctgtctctacaaaaataacaaaacagttagctggatgtggtggcacacgcctgtagtcccagctacttgtggggctaaggtgggaggatcgcttgagcccaggaggttgaggctgcagtgagccgagatcacgccactacactccagtctgggatgacaaagcaagaccctgtctccctctccggacacccctaaaaaagaaaggctgagttcagagttttagtcatgggtgaccctataaattgcaatttctttttctccctaaagggttttctttcactattacatgtttgtgttttcctgattccactcatgctactgttaggtgttggatcatcttacctatagcgtcaatacaaagttcatttgtaaaaactgttccgtttattttctcccagctgtttcatctgagaattttgtttgaatttcagttgccaaatgtagtttaatcggttactctaaatagaaaggttattgcaattttcacaaactaggggaaatataaatttatcttaagtttatgaacatttttatattcctgtggggacaactaagcacagtatgtataatttaatatctctgttggcatttgttctaagttaaatttatttgctgtattgttaaaatcaatgtagtaaggtgtacagtcttttaaaaacaaatctgtttctctgtggaatatttttcaaaaggacctgaaaaacatgctcttaaatagatggagtggaaattttactattaaagtgaatgtatagttaaatgtgtgatactggtattgttttgattgtttttattttacatgtgaggattttttacatgtttctgtggaactacttttaagtaggttttaattttgatttataaacaagcttctctaaaagaaaaaagttgttttgttcttcgtgattatatggtagtcctcagacttttgtagttgaaagaagtagaaatgagtgatttattaagctgtttatgtaaaatgactagttggagcaggtgatgtaatttatttttactataatgtgcagagatgtctttatcccaaacaaatttatagctgaatcgtttgctattttttgcaaatttagggaatctggaatgtgcccagaaatgaactgattgccaagtgttcgattgagtaaatatcatatggaaatggttttttgcttgtaatgacatattgttactgattaaggaccatttcttttctttttttttttttttgagacagagtctcgctctgtcgcccaggctggagtgcagtggcgcaatctcggctcactgcaagctccgcctctcgggttcacgccattctcctgcctcagcctcctgagtagctgggactacaggcgcccgccaccacgcccggctaatttttttgtatttttagtagagaaggggtttcgccatgttagccaggatagtcttgatctcctgacctcgtgatccgcccgcctcgtcctcccaaagtgctgggattacaggcatgagccaccgcgcccagcctgaggaccatttcttaagtatgcctgtaagtaaatatactacacatattggtcaaatgatgtattgacagctttaatttgtagcgtatgcttctctcactcctttttccttttagtaattgtcaatagtttgtcttcagccgtattctgtgagtgaacttctaatgcgctgatagagtgctccagggttgttgttttctaatgttttatctgatggagtaaagaaataactatctgagatccttgtgtaactcttattgtgtgttaaacattgttttgaacatttcttttcaatctgttaattataaagcagatgattctttaaaaattcttaagactgagtgattgtgttccccacaaatgttagtactgggagggaagggggtaaaggtaaagagaaagatcatagggattagtttagattgtataaagtaagtgtaattgtttcgttctaaaacatgttgagctaatcattgtatgccttttccctgggattataaccttgatttttaattcacgcttctcactgtgaagagtcaggagtagtgaattgtaagagaggcatatgtacctctttaaccagttttacatgttattgctgggaatattagatggcaataaggaagacaaacagtttcacaatgatgatcatttttagtaatcacatttagatttccaaattttataaggtggaagaatagacaccatagttatagatggagaagggcttttagacagaaggtcattgttaggaaaattcaagtttaccaatcttggaaaaaaaattacacttatgccagttacattctatgccttacagcactgcactgtaccagttttgaatattctgtgtccataaatacactagtatttgtccaaccatgaattctgacttttaggttagaaaatgtgttcatttaaatgatagttttaacttgagtgaaaaagctggtaatttttatcttcttttttctgtattataattttttgtcattaattttgaagatctcatgctatatgattagttctgtatatgactacttctgtaattgatgaacaactactagaatgaattattgtacttgagcacttagaatcatgtcaggagaggcatgaagtaagtagaacatatttgtgtagagataataattttactttctaaagcagtgattttgaaactcttgctgagagtgtgctggaggaagtcaagcatttcatcccggtttcaaccagtgctgttttattttgattaattttaagcgtggaagtttgcatagtatttcagttgagcaaggttctgttgtttaaaaatacgatagcctctattgttaccatatttgctcttatcacttgcctgcttaaatccttgctatttttttattgttattacgactgataagacttttctttccctagctccaactttattctttatctctgatcactttttcctttccatgtaaaccctgcattctaattctacttaaattgtttgatgttccctgagaggaaaatgttatttttacatctgcatgccttcgcacatggaactgccaccattctcacttgagctaggcagcactcaattcccttggaaccttggtcatctttccataaaagcagttattacattgttttgtaaccgtggcctcccttgagagcagagaccatctaatttatcttgtattcatactacttggtgtttattcagtattcaaatgtctgttgaattattgcatttagaatttgagaagtagtaaaattactttaataaacactaatgtgaataaaatatcccagatctagttctgtgcaaaagagttttagtgacagtgtccgacattatgctaaatatataaaaggcacccatttgcacttatcatgaagtataataaatccaaaatatttttttaaattatattagattctaatggcttaagtgatatcttagattcagtgatctgatcttaaaagttgattgtgaaagcattttaataattctatacagccttggctgcctgtgataatatttcatatgcgattaaagctgatagacttaaaggggccttcaagtgtcaagatatgtaatacagcaataccaactctaaaggtagaatgaaacctggagctatcctgcctgaattcctatcactctcctgtctctcagtagctgtgttgtcttaggcaagttacttaaccattctatacctcctttttctcatcagtaaaatgaacacaatgataatattactttatatggctgtggggaagagtagccaggaattaatgtatataagcacttaaaagaatgcctgacatacagaaaatactcaatacatgttaactgtaattaatttgaagtggcttcttaaatcaatatttattgtgcatcattttcatcttttaaagataattgctttaatacttgagtatctaattttttttaaacttaagatttttagttagttactgtgttttagactggcaactgtttcagtactttccaaaactgctatctctactgaggtattgtcctgtctcccagtgaaatgtaggctgttcccgttggatggattgacatgggagatttgaaactagttctcctgatttctgagcttatcattgagttcccatgaccaggtgttggtagtgtccacaacagagcaggaagagaaatagtacagaattccagtggcaagttcttaagccttaacctgtactttaagtcagtcctaaactttcatattccttagtagagaacagatgttcccctttttttcccccacattttccttttttggcttgggggaatagattttttaaaaatctgaatttatattccaaaaaggcatgtgcaagttaattttcctaagtcaatgaagccgctttttaatcttactttgtaagatgcatacctgcagtgagagaagtaggtagggctttagtaatttgtgtcagggaccatgtcctattaaatcctgtgaaaatatgcacatgtagtacacaaagaaaaatttaagggaagaagagttttttccaagttattttataaagtattctttataaaagtatatttcttgtaataatcccccatctgtccttctagcccacctttactttctcacacttatgctctcataacaattaaaatataatcaaagttacttgggtaacttaaaaaattttcattataggaaggaaatgtgttttgaaaatcagaaatttttcaaattttaataaattttagtgttttttatgcaagctgtgagttgaagatgaggggctgggatataaagctaaatcgggtacttatctttattacttatgacctactagggtgtccagagtatgcagagaacatatgggaatttggaagctgggaatggagactggaaaagtgctggattttgaatagtgccaggaaataaaggaagacttagcaagggatcatttttcaatgccagtgacatgctgtgtaatagtctaccatgggaaatttgaatgcttatacgattggtcagtatactaatattgtcttgtaatttgaacactaactcttaatattaacaaatttttttctcaacagccatcgtaggaacttttaaaataggttttgcatttcccctgaaaatggtgagttaggtcatattaggaaaaataaattctagaataaatacaattttgattaaaccggttttctctataaaaacccaagacgctgtatctatctttaatgttatctattgttaaaatttcatttccctcaacagcatgcatttccatgtttattagaccaaacaacttcttgttttacttcttacctttgtttttccttgttgttgttatttaattagaaaagaaatgctgtttgggccttttcatatgcctcaaaaatgtttggttacacagaggagtgagttagatttataggactcacacccaatttgatctcctcaagtgcatttctaaccatgttttcatccacttttccttgttttaggtttctcatagaaacagcttttcattgagctaaatgtatttcctctcttactcgttcttggaaatctaggactatgtatgtgaaacttcttattcttgtacacaataactcttaagtatttgaaaatgactgttctacttcagtcttcttttttgccaaactgagggaaaaaattcttttttttttttttaaaccgcatgcatgtgacatggtttacagacctttccccatctatatcgctctactcatgacaaagtttttgtcagtttacctctgaaaatacagtggccagaactgaactgactacttccgatgtggtctgaccattgctgaatacagtgaagctattatctaggatactgtgtttctattaatgtagtctgaaatttgcattgcatttttttggcagccacattaccctttgatcacattcagcttataatcaactaaaaccttgtctttttttcatgtgaattactttaagtctaatctttgtcactctttacttgccagttgatgctttgaaagtaaatgtaggatattatgtattgcattactataaaactttaaatgaatttatatatctgaagatatcaccatttgtataaaatagcacagttttcatggtgttttcacatctatttaatcttcacaacaaccatctgagaatcagaaaaactgactttccactaagtctagaattggcacatgtagaacttcattgcaagctttttgattccagatctcatgctcatctcatcattattcattcacttaatatgcatttagtgtgtccattcatatatggtaggcaccatgtggtgctggtgtgtcaggggcgagacacattacagtctctatccttgtgtttatgatctggtgtataaatactaccaattactaggcacttttcataaggaaggcactgtggtagactattatttcaaaaatatttattgcttctctctatcagggttctttctgtagtcggattatacttcttattctgttgacatcaggtttgaccatttggctttccttgaccaataaaatgttaaagtgacatgtcccatgtttgagcagatatttttcatcctgtggttctgccagtggcccttgaccctctgtcatggaaccagcatgacttagctatggctggtcccagaataatggagcagagctgaagccaatctgtgataagcatataagtgtgagataaatactgtgctgtaaggcaccatgattttggacatttgttaccatagcagaatatagttcaagcgatgatactggcatcactcaaggtgctgtatgatgatgataagacttgggcattgtcctaaaggagcttacagtcttggtagatgtattacatttccacaggttattgggagttgaggaaaaggagagtaatattacataaggatctttgaagttgaggatctttcctgacctccatctcatccctaggctgaatcagtcaatatgttttaaaccctgggtttgtgatccactactcactgtcacaacctcttattgtccaaaatttgataggcatattttctatgccctcattcaaatcaccttttttaaaacaaacatttaagaggatgaacttctacagaattgtgattataagcttccttcataaatctattaatcagcatttaatagcaagctaagaatatacccagttaaactgtttctctattatccagaaagatatcatgatgtcctagattctatgtgaattttatttgtgagcatttaaatttcccattgtcatgtctatgtgtgcttctcactctgcatgggattttaaagaaacaaaaccttggctgggattccaaaaggaatctttttttttttcttccccccgtgagaagctaaggaatacatacatggccaaggttcagaagagttttgaaacctttgaaataattacatgtaaaattttatgtaaatatacattgttctggtccctagctttcatcatattatcaaaggaaatcaaaaactcccctggaaggttgtaaaccctgttgaagagtgagactagaagtagaacaaggatctgaagagcaccaatatttaagggacaagtggaataggagcccagaaagaagtcagagaaggtgtagttaattagaatattggaggagcgggagcaaatgtaatgtcagagaaaccagttccttattaatcagagcttttgtggtgtgttggggggcggggggggggggtggtaaatccggcagttctcatggcgtttcattgtgattccttggaaattaccaaatctgcagatacatttaatgtcttgggataatatttttcttgacctataaacatgaattaaaagtgattacttttcttttgctgtctccttcctatcttggactttgatttttcttttaatccgtatccttcacagattaaaagatcattcttttttttccttttttttttccttcacccccttcctcttccccttcccactcccagaccgattcaaggcaggagtaaaacaattatgtaggttatctgttagcagttttattgcaagtaagtaacctggcttttgtttgttgttgttgagaatgtatttaagtctttttattgtccttaacactttcggcaagtctctatttttattgaaacaattttattgacatatagttgttatacaataaatggcatatattacaatgtgcagtttgttaagttttgacgtgtttatccatgagaccatcaccacagtcaagacactaaacatatacccccaaaagttttctgatgtcccttgataaccctcccctgcattctctaggcaaccattatctgttttcttttactttacattggcatgcatgtcttagaatacaatatgcactccttttgtctggctactttcacccagcattatttggagattcatccgtgttgtaccatgcaccaatagttactctttcttattggtaagtagtattccattgtatggatataccacattttgtgtatccattcaccttttgataatctatttgggttgattccagtgtttgacttttaaagtaaagcttctatgaatatgtatgtacatgtctttgtatggacataaacttttcatttctctgggcatacacctaggagtagaatgactgaatcatatggtagctatatgttctatacctacctagtttcttcttaaactgccagtggttttccaaagtggcagtaccattttacattcccaccagcattatgctatcatttggtgcagtcagtctttttaattattgccattctaattagtgagtagtggtggttttaatttgcatttctctaatgactgctgatggttagcatccttgcatatgtttatttgccatccctttctcttttgggaagcatctgttcaaatcttttacccgttaaaaaaatctggttggttgttttcttactgcattctgagggttcttatgtataaatcctttatcagatttatgatttgcaaatatttttccagtctatggtttgtctcttcattctcttaacaatgtcttttgaagggcaaaggttttaattttgatatctaatttatcagttcttttatggattgtacttttggtactgtatctaaaaatgttttttttgcgtaattcaaggtcaacaaaggttttctcctgtgctttctccctgtagttttaggttttctatctaaatatagtgatccattttgagttaagttttgagtatagaaaacttttctatctggatgttcttaagacaccatttgttgaaaatttatcctttttctattgaattcccttttccccctgtgaataatcagttgactttatatatgtagtagttctattttggactcgattttgttccattgaggtatttgttgatcttgacaccagtgctgcactgcgttgattattcagtgttgaaatcatgtagtcttccaattttctttttttcaaagttatttttgctagtctaggtattttacatttccttatgaattttagaataagtgtcagtttttttaaaaagcttgcttgacgttttgattggaattgcagtgaatctgtaggtcaatttggaaagaattgacattttaaaattattgagtcttctgacccatgaacatggtatagcacttggtttagggcttcattaatttctctcagtaatgtttggtagtttataggatgcaagtcttttatattttggtctcgtatatgcctctgtaagttgggttctgcagagaaacaatcaataagggtgcgttgtgtgtgtgtgtgtgtgtgtgtgtgtgtgtgtgtgtgtgtgtagagagagagagacagagagattgattttaagaaattggctcgtgattgtggtgggtggcaagtccaaaattcatagaattggcaggcaggatggaaccttaggcaggatttctcttacagtcttgagatagaattccttcttccttaggttatctggttttgctctgaaggcctcatttgattggatgaggcccacccatgttatggaggagagctctttttcttaatgtcaactgattgttatcgttaatcacatctacagaatagcaatagctagactagtgtttgatcaactgggcagcatagcctagccaagttgacacattaaattaactattaatatcattgcaatccctgaatatttcatattttaaaatacttttgtaaatggtatactttttttttttttttttgagatggagtcttactctgtcacccaggcaggagtgcggtggcatgatctctgctcactgcaacctccgcctcccgggttcaagccattctcctgcctcggccttctgagtagctgggattataggcatgcaccaccatgcccagttaatttttgtatttttggtagagactgggttccaccatattggccaggctggtctcgaactcctgacctcctgatccacccactttggcctctcagtgttgggattacaggcgtgagccaccgtgcctggccagtggtatgcatttttaagctcagtttctgattgatgctagttcactattgctttttaaaaaatactttagccttcttttcattattaaactcatatgactagcagccttttcatttgaaattaggattaccctctatttttagacgtatcctttaaaaatacgaattttttaaagaaaagtcctaatgttgttacttaatctctcacttttttttttttctttttactggaatcatctgacagaaatggcaatttcatttcaagagtcttgtcttatttttctgggccatgttctggttgtttttttcatcacaggattgtaacagtccttaaatattttagagattaaaattctaggtcaatttagagcataattggcaaaatagacatgttaccaaaaacagagatataggaagtttgggagagaagttaaggttcatattttaggtatgacctttatgctagtctctttctttgataaagtcatttaatttctttgagtcctagttcctcatctgtaaagtagagtaatatccacctcctgtggaattgtcatgaagttaaatgagatgctttgtgtaaagagcctggactagtgctgctaaatagatgcagctccctttactatatttttatttattcagtaaatatttgacactcactatatgccagacactgttccagactctggaattagaggagtgaaaagataggcaacattcctattcttacagagcctctatgttggctgttctgacagaagaggaagataaacaaggaaaggaataaactaaacaatttcagattgtagtaagaagtgtaaagaaaatcaaagagtgcgtggtaataaagaattgctgtggtgaaagcccacttcagactaagtagtcagggaagacctctttaaaaaggtgacatttgagtagaaatgcccttaggattttggagaaactaggcatgtgaagatctgagtgaaaaagtttcctggcagagagaagagatagtgcaaagcctctaaagtgagaaaaatgtgacaaattgagagaattgaatgaagcctagaggtgctgattgcaagtagtggagaagtcagagaggaccagctagtgtagggtcttacaagccacaataagaagaatggattttattctaggtgcagagagaagccactggagggttttaaaacagaggtgttgtgatcattagatggaaatgttgctgtggactttcagaaatgtgaacttagctgtgaaacgttagcaaactaaatactagcaacttggatttctagttggccaagaaacatgagggtaaacaatttattttccctgattaaaaaaaatcccagcaagtctctagcaaaagcaagtctaggttatctagagcaaataccattttatatctttttaattttactaagacttgttatgcaattatagatgttacagatgttttcaaaaatagtgctttgtggattgttttccttttatgagtccatgtggcaattgactagcatagcagtaaaaagtacaactctggtttcagatacgagcatgatgattgatcacatagaagcattaagttaatattaacaaggatctattgccagaatatatttcattataggattttgaaattatttagctgaatggaccttaagagttggtcttttttcctttatagaagagggaacttagattcaaaggggttaagtgattcacattatttaaacatttaaaaaataaacctggattttactattcttctagttgtaggatgacaggttcttgaggcaaaatgtggaatgagagaagatagtgacatctgtttgctttgtatctgctgccttctctgttgctcatttattttacatctatgctgtttcacacttatctttggacttagggtattgggatgtgtcaaacagttgctcccttagtgtggaaacagacaagtaaacacagttgctacacaagttgcaggcatcatatgataaaggcaagcttagtgtgttgtggagggcatgatgggtgtgtctgttaagtgtccctgtttagagtctgtttacatacagagttgaatgtccttggcttctcatttcaatttaatatatattatattgccttggctgttaggcctttcttgcacttgtttgcctcccagccataagccagtttgaaggccatgatccatcaggtctagtgggttaatccatgtctgaccagtaagacctacctatcttgacagtcaccatgatgacagcatgtcttattttaaatagaaacctggttagagactaatataagaatagttggtcttgaatagatgtattccttctcttaagcgaggtaggttttattaagcgttgtattttgaaaaatcctgaaaggaaattgagaaacagctatcattttgttaattttggctccttttactgtattttattttgaagtatagccattcctaagaacgctagcacatgagttcattgttgatgttataacatattctgaatcttaaaacaaggtaccaaaaatacattcatagaacaagtagataaagtagcactactataattagggaaaaatggtagttttcttgtaagccctttctctttcaagagcttataattttctgtaaaaaccaaacattatcctttgggcacgtgtgttttattctttctcttgattctgtgttataaagtttgattaaaaaggaaagatattaactttttgtctcccacacaaagaatgttcataattgtaatttttgggtatgacttgttgccatacccttgagcctccctttgtttaaagagtaataatatatatattttttaatctataaagaagtatctttgacgtgtgtgtgtgtgtgtgtgtgtgtgtgtgtgtgtgtgtataaaatcaaaacggcatacctttttgagaatatttagtgattcctgaagactatattatagttgtataaagaattagatggcaggccaggcacggtggctcacgcctctaatcccagcactttgggaggcggctgaggcaggtggatcaactgaggtcaggagttggagaccagcctggccaacatggtgaaaccccgtctctactaaaaatacaaaaacattagctgggcgtggtggcccacacctgtaatcctagctacctgggaggctgaggcaggagaatcacttgaacggggaagcggaggttgcagtgaactgagattgcgccattgcactgcagcctaggcaacaacagtgaaactctgtttcaaaaaaaagaattagatggcaatagctttagcaatctaatgtggtaggtgatctggtattatctgtctctttggtcacatgaggataaggctgcccatctcggttatccatgtcctgggccttaggaagaaggcagccagaatcttagaaatttgaactgagaaaattgaacacaagttagcagcctaaaatataaaactgatataaaaatacaaccagattgtgtatgaattattgttttctcatctttattttgtgcagatcaagaaactgaactttgcaagtattttctgtgaaagggtgaataagctatccaaagtgagtgattttagcctgtgtagaaaacatctccagctgtgttaaatataaagctgtcagttctttgaatatctccttgcaataattaatcatccttctcagttaacagcacagacagtacagcacaggtaagagagtaggctctgaagccagtctaccaatgctcttgtgactctgggtacattgctttctgtctctcatttctcatttacaaaaagaggatagataacactagtacctacctaatagtgttgttatggggattaaattagttaatatatataaaacacttagaacattgcctcagagatagtaagcaccatgtatttactgtttgttgctgcatatctataatacgattgattgactgattgattgagacagagtcttgctctgttgcccaggctggagtacagtggcataatcttggctcactgcaacctctgcctctaggggttcaaatgattctcctgcctcagtcacctgagtatctgggattacaggtatgtgccaccatgcccaattaatttttgtatttttagtagagacagggtttcaccatgttggccaggcaggctggtctcgaactcctggactcaagtgatttgcccgccttggcctcccaaagtgctgggattacaggcatgagccactgcgcctggctgtataatacattttaagtggctggttttattagttaagttctctcagagagtttggcatttgaactggtccttgaaggataaataggatttgtaaaagtgaaacataaagaattaaaaatggtaaaagctatgtgaattaagttgttaagaggaagtaaagaatctttgtttccatttattgcatactagctatgtgcctgcctctgagcttagcatttgatgatcattacattatcttattcaatcctcataataaccctccaagataggtattttattttatttattttattttattttattgatacagagtcttgctcttgtcgcccaggctgcagtgcagtggtgcgatctcggctcactgcaacctctgcctcccaggttcaggctattctcctgtgtcagcttctcgagtagctgggattacaggcgcctgccatgatgcccagctaatttttgtatttttagtagagacagagtttcaccatgttggccagcctggtctcgaactcctgacctcaggtgatccacccgcctcagcctcccgaagtgctaggatcacaggcaagataggtattttaaattgtcatttaacagatggcaaatagccacagaaaagtaaagccactttttcaaactcacaaagtcaaatgtttggcctagttctgtcagactgtaaagcccatgcttttaattggtatctaatactgctttcctatcagtagactatcagattatcattcctaaagatatttaaaagaatgggtgctctagggttggagttcaaaacattaatagaattatactattaaggttgcatgtgatcactttgctgctgtgagagactctggatgctgtgtttgctggtcatttcaaaggctgaagagaaacagacatgcctgtccttgccaaatacattgtttcccctatcattctgtcactatggaagtacttgttttttctgacctgggaataatggtattgtggttattggcgtttttgttacctttcttactagaaattatgcagatatccccaattatatccagatgcacaccttatattccaaattttgttgcctgggattgactgagtacccttttgagttccctgcatcagagacgtgtttacagttgtgcttcccagtcttcagcatttatggtttcatgtttgtcaaatttgtttgaagtataaaaacgataatcttaattctgttactgatcattccttcattctctagctatttgtcacatcatctttcttttgaaacgtttagggaattaagaaattaataattttatactcattctttttccactcacatatctcactggctttgttcagaattaaattgtttttggtccctgtgtactatttccttctattaattaactgacggttgtttctctcttctgtgtttttgatgcttttttttttcttttactgtttaaaactttttcagaagatgtagcgagtgactcaggtgctagctagtgttactgatttcccccccatgttagttaataccatgtcaaatataactgaagaactctgttgtactcacagattatgcccctcatggtcagcagactattcagatacagactttcagggggaaggttttcaaaaaagtgtggctgcaatctgtaaatgcttttaacatctgcacattgcattactgttttcaaatgtttttgtaccacataattttatttaatattcacaactattctgtgagagctttattcttttatgttgtagggttttcttattttacagattgggaaactggtgtggagcggttaaatgacttactcaagattacatagctagttataagtggaaggacaaggatttgaaggaacaggtgtggcctcttccaggaaacagtataaatagtcagactttatgaaggataaattggtaggagagtcatttatctcacttgtctgtaaagaggattctttttctcaagtagagcgtgaagtagattatttactagaaaagcttgaaaatgcatttcagaaaattaaaactgctttgaaattaggtgcataataagaattgcttcagagcctggcatccgttggacattatacacatattctctgtcaatgaggtttacagttaaggtctcttcaatccttattttctgaaatctctttttgcttatatattgagactgaagttagcaattttcctccaggtgtggactttgaaaattaaatatacttattgaaacgtaggttgcgtttatatagtgctaccctccaggattcttggaaatttaaatgtattattgtatgtatgaatcatggaacgcactatagaatctatagtggttatcagttttgttttgggtgtagttcatggtgtttagttaagtctctaaagcagagtttaggatctctgcctttcagttatctgagtgctgtggggctacatacccactcagattctcttgttctaagtggtcttaacactcagttagctctatgtgttggtggtgacaaattttactatatttatgacctaggtctttgagtgggcactgtttcaagaatctaggaaggtactggctactattcaactcactgtcggtttcaattatggtcagagaattttgaaaacaaaaattctgaatgccctatagtttaataaaaagtagttgatccttttgttcaaagcactgtcccacttcacctcccctctaggtttgaagcattcctatgcagacagtttaccgacatgataaacaaaattatccattcatgcatcctaggattttaatgttaccatcgccctccactcaaaatgcaatatgcatttagtctgtaatagcatcactccattttaagtgaatagttgtttcagctttgatttgtaatcacaattaaggtaaattatccttgtttgcctaggactgtcctggttttaaaactcaaaatctcttgtccaaggaaccctcacagtcccggacaaaccagaacaatttcttaaaatactatttaggaaaactggtcacccgaacggcaaggctgtgttgttgattaggctttaggcatgttattgagactatagactaagctcagatcaatggttttgaagattctgtatgggtcaggattacctggagtacttgttaaacagactgctggctcccatccccctagtttggatggagtaggtctgtggtgggggtctgagaattactttagtaacagttgcctaagccatgctgacgctgctggttaggagagtgcattgagaaccactggcctagatcaggctgtgtgctgtgtgagtatatgatgatgcttggttcagaattgtggagaaaggggagctgtgtttctctgcctcacaggtctaagcaccaataacaccaaagggtatttgtatctgaactgtgctcatacagcacaagaagagacgtgctcctgttagaggtgacagaagtaggggaaggattaaaaacagtctagctgtcaaatccttcacagtatggatatattttgattgtttatagtatcttaggcaaactttgatttgataattaatttgagtcttatagtcacaacatctgaaatggatacttcagaaagcagatattcattattatagcagaactgattatagctgggtttagcagggataatggtacccatcttgcctacttctcagttatcactgtaaaaatctagttacataaaaggtgtgagcatgcggtacaaataagatgtcatggtgatgattaaagtgtactttgttgttggacagtatgtttcacagtgctttcatcttcatgttccatttggttgttttcaggtgtcttcagaattcggcaaagtagatgggactgcagacgttaccattccctgtgactcttgctacgatcttacagacttcattgtgctgggcttagatgtcttcagagtcaccaggtacttggttgttcctagatagtgggcctgcctgatcaggatttggtatttttcccactgaattaaaattgttttgcctaagcctcattttgtgtgtcaagaaaataaaggcaaaagagtaagtgctgtgctcctaatccacagctagctggtagtcagcagcctgggaggctgagtctctggtctcctagtctcaaccttctaggcagtgagcattgttaatcacagaacaggccctccttggactccttggcttgctcgtctttgtttctcccagggcctagcgttcacatccacacacatactacatacgtttctgcatgtgtgcatgtgcatgtcagggaaaccacaatttgttctcagctccttactcatgtgagcttagcgaaatcgtttctccaatctgtaccttcttcttcatctgtaaaatagaattatcatctgctctgctactacccttaaaagtagttactgcataaggatgagaaaatgtataaaaacactttgaagcttttgttacaaagggcagttagtaataatgagtaaatgataaataagccttatagaacaggaagccttttcatctttctgtcctaaacacccttctattttataaatttttcaagtagattaagtttattaatttagataatgttttctttttctttttgtctctgctctatttatttaacattggatatatagagaatggtaattattattgaatggattgaaaacaagaatagagtctctttgggagtatctgtgttttttgtttttttttttttccatgtaattgggggcattttctgctccatggtcggtttctggtggtttgtgaattcttgccttctgccaagtgttttctccctgtcaccaccctgctactactctttgtgtttaccttcccagctgccctgccttatttcagagttcagagtcaaattgtagccaaccatttctgacagccttcctagacatcactgaatttcagctaattaatagatttaagggatgcgaaatctaggccaattcagaattttacttcatttgagggttttttttccagaatatttatcttaagttacaaaatgttgtttcctgttaattgttttcttatgtattctggtaaaattttataaacccagtaaaactctcttacaacaatactcttgggagataatggcttgtattcgttctggattgtcacataggaagagatgtgtttaggtatctaacttggtttcagcattgtacttgagacatctgtggtaggacagaatctgtggcaaatgtggcatggcatacattatatatggatattcataaactgcttttgatagattgacaaacatttccagttactgaaccagtagcactgttccagtcagtagctcagtaatatccatttttttgtctgtacagcagattgtatgtatgcatgtgtgttttgcccatttttataaaaatgtgttaaaagtaaaatgctaatgctgatagaaaattgacccgcaaatatgtaatgtttttgacaaagatggaaatcataaagcatgccaaaaatggtaaacctttagcttcagctatcccctcattagactttaccttcttactgtgtattattacaaagattgtgtctagaagatactttataatgatagaaggtattttataatagggtttcttatcacatatacttaatattcaacttctgtacatttaattttcatgtttcctcaagaatatattatacaaagtcatagcatttgacaaaattccttcataactctgaagaaaatattctatgtattgtttgtgtgagttaaatacagtggctctgataaaaatgtcttttgatcagtctttaaaaaaattaaactgaggacaggaaggtaaattaaaggggagatttggagacttgtggtaactggtttattgcaacttaatgtgcagcatcctcattagtcaagtatcatgtgcctacctaggcatgaaatagctatttttttcctgatttaaatctggaaagtttcagttgtagtacagtttgaatagttgttgttgtaaatagccactggactttttaaaaaagtatttttcttcaaaaacagtgaaggtcatcttgtatccatagagaccacatgtactttcctcattatttccagcattatttatataatgggtagagttatttacaacattaaacaaaaagtatttcagagagcaaccgttaaatattatcacagggtaaatatcagcaactgaaatccttttctcatagtttctcaaaaaatttggtattaggaaattaatagtctctcagaatttgtatattggttttcttcagtagttattctgtagagtgtgtgtgtacatatgcatgctcatgtatgtatgtatgttcatttcttaaatcatttcataaatcactgtgacttaattgtggactttaattgttttcatagtttttttccccaaaagaaggttactttacatattttattttatttttatttttattttttttgagacagggtctcactctgtcgcccaggctgcagtgcagtggcatgagctcagctcactgcagcctccacctcccaagctcagggatcctcttacctcagcctcccgaatagctgggaccgcatgcaccaccacacccagctaatatgttgtatgtttttagaggtagggttttgccacttagcccaaggctggtcttgaactccgggactcaagcgatctacccatccacctgcctcggcctcccaaagtgctgtgattatagacatgagccactgtgcctggcaattttacatattttaaattaaagcaaatcttggtttttgatggaatgcagatttacttatatttcacttagtctttttcctttctttcagaaaagtggtgtggaaacaaaatggttttagtatattgccttataaacaaatttaagatcatgagtttcttttattatcctctttgttttgctcatttccttgaactgtacatccctaacctaaatcagctggagacaggggaagaaagtgttagattcttactcagtttagatcctctgccaggaaaacccactctattcattgtcaactaaattaacgcttttttaaataaaaggagtcatttttaacaataacgtcagggcagcaggcatccatgaaatgtatggtcactgatcattagggttatcattctaatgtgtttactattttgaaactctagggagaagaaaacttatttttgcatatgttggaaaaatgtatcctcatgtaggatatcagggtaatatctttaatgtttcatacttaccaagataaatttgtaatgcgtattttcttttaaaattagatttatttaggagaaattgcacttggtgaaccactttctctttaattattagcattaactttatcatttttgtttcaagatgtcacagctattgttcagcactagaaattatataaattattagctgaagatgatgactggcaacatttatgtctgttcctcctcttaaatttcttgttcagaaagtctgttgttgtaaacatcc

SEQ ID NO: 563 - DNA, 4383 bp, Homo Sapiens
agcaaagacgaccagccgaggatggctggcggaggcgtggggcaggccgcaggaccctcgaaggatcgtgtgagaccccgggcagcctcttgggaggccatttcgaggagaaaaccttgatttctgcctcaggaccctgggcctcagttttcctatctgagaagaagggcgaagagctgtgcccccgaccacacccgtcggtgatggggcaaaccgagggcaagcagaggagcgcttcacttttggtcatcccttgggccaccagggccttcccgtctccgtcttcccatcgcaggtcctggcctccttcacaccactccaggataccgcagcatctcccccagcgcagcagacggagggcgcttcacatgcccccggacctaagcccactctccccttcaagatctggactccacttttttgcaacactcttaacttctttggaagctgggaagcctcctactcccttgggcctctccaccctgccctcagctaactcgtcggcaagccccagcctagacattgcctgttttgtgaagacatctagatgctgggctgtctgttgagtgccccaccctgtgtttgagcagcaccctctacttcccctgttctacttgcatgtttatgtgctcgtcttcctcattataagatccacaggggaggggccatgtctatattattcatacttacagtccagtgtctagtatctggcacgtagtaggcactcactagctattgagatataaatatagatatttgttgaattgaaaatgaattgggccgggcgtggtggctcacgcctgtaatcccagaactttgggaggccgaggcaggtggatcactaggtcaggagttcgagacaagtctgaccaaaatggtgaaacccagtctctactaaaaatacaaaaattagctgggcgtggtggcacgtgcctgtaatcccagctattcaggaggctgaggcgggagaatcgcttgaaccccgggaggtggaggttgcagtgagtcgagattgcaccactacactccagcctggacaacagagtgagaccctgtctcaaaaaaaaaaaaaaaaaaagagaaaaagaataaaattaaaaaaaagaaaataaaggaacctcattcacatacacctccaaaactctgatttcctaaagttgggcatttctcattgctggaggtgttcagttagaggcatgccgcccccttgaagaaatgtttatttcatttgtacagtgggttgggattttacctgaatgctttgagtacccttttaatcctatgatgctagagattgatagacccatgcctattattcctgtcagttctccctgaaatgtcatcagttcttcatgttccgctatttctagctgttggccctactcgtttctgtgcctaaatgccctacctcccactccttttctgagaaagatcttctgccctgtcagttatgaagtaaagatgtcctaagattcctgctctttcttttttctttctttctttctctctcttttttttttttttcgacggagtttcgctcttgttgcctggagtgcaatggctggagtgcaatggcgcgatctcagctcactgcagcctctgccacctaggcccaccttggtctccccaagtgctggcattacaggtgtgagccactgtgcccggcctcctgctcttctttcaaccctctgctcagcatcttaggcctcattggtgatgtcccaccttgctaggtagcatctttcctgaatatttctccactaaacattctgatgttggctagatggcctagttaatctacacatttcattttatcaccttctccagatgtttttttgtgtatgtcagctgatacactctggggagaatgccttaatatatgggaataattaactcatggccaagaaggaaataaccaaggggacttttactctggacctaattcaaaccaaagagacagagcctgagagaaagcagctctgtcatccttgagttagtaacatccaggaagggaaggctagggtgggggagtgagtaaaacagatggcatttagggaagaaccaacaggactttaagaggcatggcagaggggctttgatcctggctaaaccatcagggaaggcaattggagctgggtgaacagatggggtcttattactgaagagaaaacggtaaggaggcagggggaaatgggacgtgtgctaaagcagagtgcctcattcagtggatgcagtgagagcagaggctgttggaaaagtggatcagggaggaccatgccaccaggtgggcatcagcagagtatcacccgagtattgcagagggataccaaataagtccacctgaagccagagctgaaaccctgtggaggtccgtttaccccttcagaagtagtgtaccaccatccatctaccactggaatccaatttcagttttggcaaattgttataaataggaaaaagtcagggttccacaattctggcagcacccagagactataacagcatctgcacagccaagtagagttaggaaacctggatcctaatcctgactttgcctctgattagatgtgtgatcctgggctggagctgttttttcagttgtaaaatgctgtttattggtgttaggtagcagctaataaggctggaggtggggctgggtgtagtggctcacacatgtaatctcagcagtttgacaggccaaggcaggaggattgctggaggccagggatttgagaccagcttgggctacatagtgagactctgcctgtactaaaaattaaaaaaaaaaaaaataactcagtgcagtggcgcatgcctgtagtcccagctactcaggaggttggggtgggagggttgcttgagcccaggagtttgaggctgcagtgaactatgatcaatcacaccactgcattctagtagcctgagtgacagagcaagacctgtctctaaaaaaaaagaaattttttttaagggtggaggtagggaaattcaaagctacttactagctgtgtgaccttgcctaaactacctccttggatttgcagtctgtttatttgaaaatgtcataagggataaatgagattccttatgtaaagtactttataaatattaagcacttaccaaatgttagtctgttttcacattattcttcttggattaccagaaattggtttgaccatgaataaacaggagataatttcttgggtaatctgagtttgaatcccctttctctctcttactaattgtatgactttgattaggttatttaatatttaattgttctgggtctcagttttctcatttgtgaaattaaaatgtgttcttcagaattgtgagggttaaatgtgataaaaggcctgactcatatgagaaaatgctcaatatatttgttttgtcatttttaaggggtggttttagggcacagaaccctaaaggaatgaatggaattctaaatacttcgaagctagagtagtgaaagattccaggggaacacagtgctggccttctcccttcttcttggggaagaaaagatctcagtgaagttccatgggtcttctcacaatgttgggagtcttcctggagtgagtcaccatgcattccacaaacaaggcagaaatgacagtggtgttattgccccacagttgggtggactcccccaagatccaggtgtgatcagccctggtcctagtgatagaccagcccttctcctactacccacggaagctgcctcatcattgccaccatccgctttctcaacaggagagacttgatacagaaggcatagtccctgctctcaaagaacctgggacaagttggggaggtgcagctgagttggtaaagaacccctgggtagcataggagagtgaattcatagattctatagacaaaccccatacccatacttggaagagttgaggagtgactggttgtccccctagggccaagagctgctgcctccctcccctcctccttcttttgcacagctttattgagcataattgatatacagtaaactgcacactttgatggatttttgacatacgtctgcccctgtgaaaccaccaccacaatcaacaatgaccatctccatcactcattgccttgtacccatggaaatccccccttgctgccctcctgccccactcccagtcaaccactgacctgctgtcagtgactatggattagttcacatattctagaattgtacacatgtagaatcatacagtatgtgcacttttttgggtctgtcttctttcactcagtgtcattgttttaaggctcatctacgtcattgtataaacagtttgttcctttctattgctgagtagtattccattatatgaatatactacaatttgtttatccattcgtcaatggactttg

SEQ ID NO: 564 - DNA, 4410 bp, Homo Sapiens
cgctaatgtgtttggtataatttcatatattagctttttaaattatattcatctaagtccagtaagttggataatatgttattttaatttttttcagctgtttcttctcatttcacccaagacctcttgccagagcatggtataaaagattcatttcaaaaagtgatactgagaagatatggaagctatggcattgagaatttacaattaaagaaagattgggaaagtgtgggtgaatctaaggtgcagaaagaatgttgtaatggacttaaccaatctttatcaactacacataccaaaatctttcaatttaataaatgtgtgaaagtctttagtaaatcgtcaaatctaaatagacataagataagacatactggagagatatcttccaactgtaaagaatgtgacaattccttttacatatcctcagttctaactccacttcagagaatccacactgcagagaaatcctacaagtgtaaacaatgtgggaaagcctttaggcactgctcatgctttcttgaacatgagacaattcataatgaagagaaacattacaaatgtaaagaatgtggaaaagtctttaaatccttcacaagcctttctaatcacattataattcatactggaaagaaactctataaatgtgaagaatgtggcaaagcttttaaccacagttcaaaccatgccaaacataagaaaattcacactggacagaaaccccataaatgtgaagaatgtggcaaagcctttaactggttctcatacctaactctacataaaagaattcatactggagagaaaccctacaaatgtgatgaatgtggcaaagcttttaaccagtgttcaaacctcactaaacataagagaattcatactggagagaaaccctacaaatgtgaagaatgtggcaaagcttttaaccggtgctcacaccttactgaacataaaagaattcatactggagagaagccctataaatgtgaagaatgtggtaaagtctttatatcttgttcaagcctttcaaaccataagagaattcatacaagagagaaatgctacaaatctgaagaatgtggcaaaacctttaaccactgctcagacctcaatgtacctgagaaaattcatacctgagaaaaatcctacaaatgtaaaaaatgtggcaaagcctttaatacctgctcatgtcttactcaggaccagagttcatattgaactaaagaattataaatataatgactgtcacaacacctttcacagaaaaaaataattttaccacagattaatttgttcattaatggaactttaattctgtggttttttttttttttttttggtctacataaatctgtccttatgccagtactatattgtttaattactgtaacattgtagtaagaatttatatcaggagtgtaagttactgaattttgttatttttcagaattcttgtgtgtttgattttctttatatgtttatatggattttaggaagagcttgtcaatttatattaaagaaaagctacattggaatttgcattgaatctgtagataaatttgttgggtattttgatcttcatattcagtattgctatatttgaatattgagtatatctcagtttattcagctctttgatttctttcagcattttaaataattttcagtgtatagtatgtgcagttattttgttaagttcatttctaatttttttttctaggatactattaatgaaattttaatttaattcttattttgtttattcctataatataaaagtactatctaaccttgtatgttgatcttgtggcattgatgaacttctatattagctcaagtaggtttttatttatttattactttattttattttattttattattatttttttttgagacagagtctcactctgtcacccaggctggagtgcagtggccggatctcggctcactacaagctctgcctcctgggttcacgccattctcctgcctcaacctcccgagtagctgggactacaggcgcctgccactgtgcccggctaattttttgtatttttagtagagacagggtttcaccatattagccaggatggtctcgatctcctgaccttgttatctgcccgcctcgacctcccaaagtgctgggattacaggcgtgagtcaccatgcccagcctcaagtaggtttttaatgaatttcttatacttttaaaatacaacattatggcaataaaagactattccacttcttttctaatctggagattgtattgatttttctagtgtaattttctggctcatacctccagtacaatggtgaatagtggtataagtagaaattctcgtcctgttttcaaacttgcagataaagcccctagtcattcaccattaagtatattagcttttggtgtggagtttttcatcttggctcactgcagcctcaacctcttaagctcaagtgatcctcccaccttaactgcctgagtagttgggacaataggcatgcaccaccatgcccagataattttttttttaatattttgtaaagatggggattccctatattgtccagaatggtcttgaactcctggctttatgcagtctttccacctcagcctcccaaagttctgggttacaggtgtgagccactgcgccgggccaattttggtttttcatggaggacttttagcaggtctcaaaagttttcttctaatagttttcttggtgttctatcattcataggtgttgaatttaccaaactttttctatttcaagtattacatttttactttgttcaagtaatattgtatcatattaaatgaacattgcattgtgaaaataccctgcttagtcatggtatgtaatcatccttatacctttttgtattctttttttaaatatttctgagaatttctgtgtctaaatttaaataggatgttgtttcgtaatcatcttgtgattcttttgtctcctttgggtattattggctaatagatgaattaagaaatgttacctcttctactgcttgaagtttttgtgagaaattgatgtttttcattaagtgttgatgaaatgtacaacttaagcagtttataacagctattctatctaaaaagatataatttttttgttctatggatataagtatattctattatatatataatgaaacaattcataggatgttttttcagtttacttttgtaatccatctctatcggtattttttatttcatagtatgtcatgaacaattattctaggcacttgacatggaataatttgaaaaaatagagaatgagtcccgtactacaatcaataaataactcaaaattttttccatttttaggatgaagaatatgaatatagttctgttacgtaatatttgtgtttactgtgtgagacaaatgagttactgaatgtaaaaataattagtaaaactgccctttgattttggaatgtatgaagcaggcaaatgcccctaccttctatttttatcaatatttagataaggcagacaaataaattttaataagatatacagaataatcttgtatttgaagaatgctatgaaaaaagatagtttggaggagtagttagtatttggctcatataatgtgttaggtaactattctaagccattaaacatttgtatgcttaatacctaagagtttaaagtgaagaaatcaaagattcattgaaaaagaaaaattaaattttaaaaaaattctatttttaattgaaaaataatagttgtatatatctgtctacagtgtaatattttgatatatgtttatgttgtaaaatgattaaatcaagttaatgtttataacctcatataatttttgtggtgaaaacatggaaaatagtctttatagcagttttgaaatacacattgtagtcaccattctgtgcaattgatcactaaatcttatttctcctaagtgaaacttggtacactttgaagaacatttcccctctttttattcaccccatctcctagcctctgtcacattttcattcatactaggtaacattaagatcattatggaaattaactttttggtgccccacaactaaatgaacataaataatgttaactttgttaggaagttatagtaattacgcataggaacaaacggcagctatttttgccagtaaacaaaggatgcgcattattttcaaatattagatataagtattttaggtggtaaagtcttaggcctaaaatacgtcattgagtttattaccccagaaacccagcaggtcatattttctgaacattgtaaataacaatagaaattatatactaaaatgttaccagcaagtactatctcaccacatgaaaattgcattgaaattttttaatctgtggttcaaatggaagactcaaagagattcttttatggattcagg

SEQ ID NO: 565 - DNA, 2032 bp, Homo Sapiens
aaatgtactactggtagtcatgtgctcactatctctgccttactcttgattcctgcctccagtgaacccaggatgaaggagtgtttcgactcatctgactcattatgccttctttgccctggatcttacacagaaatgctctccataccttgccactgctgctgggaaggaacaggggaggagtgacattgagattcaagactatttttcctacctcttcagtgcctctttcagccatatgaagttaaaaccaggtaatgggagaagaggagagtaaaagtgaagaagaaagaggcaaaacaagtgactagaccacacgctgaacaagttgtagctctcatttacttttcagagaatgtaaaatgttacaactgctttggataacagtttggcaatttctttaaaagttaagcatatatatatatatatatatatatatataatcatataatctagccatttcacacatcagaatttaccctcatccccaaataaaagcacaaagatgtgaatgcccatagcagctgcatgtgtaataactcaaaactataaaaaactcaaacactcatcaacagtgaataattaaacaaattgtttacattgcaaaaacattatcagttgaaaggaatgagctactggtagcagcaacaaggtacacaaatctagaaataattatgctgaggaagagaagccagaaaaatataatatatattatattatctcatatatattaaagaatagagaatgcaaactaatctatagtgacagaaaacaaatcagtggcaatctgggaatgagggtaaggggtaagaggaagggattaaaatggggcatgagtaaaattttggaagtgataagtatatttattatcttgactggttatggttttacagatacatacttaacggtgaaaactggcagattgtacattttaatatgcatagtttatgaaatgtcaattatatctcaataaatattaagattatataagaataatctagagaaataaaacatttttaaaaaaattatagtaagagttgttctctaaccattgtagttaatcagttttactaaagaataaccacatataaaaccttgttcccttatttacagaaagtttctcccgtacagtttgtacactgtctattcatgtgagctaatgctttaaaaattaacatattaattttcctatattatatgaacctagtgttttatcccaataaattaatcatcacattttctttataggtgtttttttgtggaaaaaatttaatcaacccatatcatttttgtgtgcgatctttccttagtgaacattaaatctaatcatttgttatttgcatttgaagtaattattttaacatgggctctttcctaagcactttgaaaattagtcctctaaagccttttgttgtatataactttctctcttgtgttttgtataattattattatatagtagtataatttaaaggggaaatgtgcaataaacccatatgctttattattaaaagtaggtactgtaagttttactcctatgccaattggatggaagatcaagagttgtgatgatcgggaggctgaggcaggagaatggcatgaaccaggggggcagagcttgcggtgagccgagatcgcaccactgcactccagcctgggtgacagagcgagactgtgtctcaaaaaattaaaaaataataataaaataaaataataaaaaaagagttgtgatgatcattttcagtttttagtttaactgaagataacagaaacagtccagaatggtcaaactttgacatttattaaaacatttagagacactaaaacatacaaacaatttttggtggttaagaccatgtgctctggaataagaaattggtatttaaattctttctatttactgttacatttaaggctttgtttaaatgtttatgtgtaaaaagatcaaaagcactttcatatatttctttaaataatgtatgccattcaatttttgccgaaagagataataaatcagagcagacaatgaaga

SEQ ID NO: 566 - DNA, 3923 bp, Homo Sapiens
aggttttcagtttcagtttcccagaaaggaggtgtctctgtggtgacgagcagggcttcatccagtgcctctgtccccaccgaggggactatgggagacatggagggtgtgtgagcaacaggtgagactggagccagctgaaaactgggagaccgacccagccaacaaacaatgtcggtctctgtcttggcacctgcaggaaacaagctcctacttccagaaaaagtgctcctgggactccaggataccagccttgtttcccatatgagtagactctcccttagctgggaaagcctgacgaacgccatctggccccttgatttacaagacattaagggctacttacccaacccccttcctcaaagagttaacctgcgtaagcagatcctcagcatttcaaaggagcccaattagctgataaggtactggaacaaacaatgtacgaagttcccaggattttgctcaaaagcataacaacataaagccttgagtctgtgtctggcatagcatccatatctaactcttatgaaggatttagagcccggcacctggttccgttgctttttttgtaaccatttgtcttttaaattgtttatttctctgtaaccatttgttttttgattcttgcatgtttttacttctgtagaattattgcatttgagctccgctccccttccgaaccaaggtataaaagtaaatcaagccccttcctcggggccgagagaattttggaaagtcaagccttctcttggctgccggcttaaataaaggactcttaattcgtctcgaagtgtggcgttttctctaactcgcttgggtataacactttgagcctgcgaggcagagtttgcagtgagccgagatcacgccactgcactccagcctcggcaacaagagtgaaactccgtttcaaaaaacaaaaacaaaacaaaacaaaagaaccctcacaatcttcctgcacccaactgatgaaatcaccattgcaaaagttatatcagtgagaacattagaacagtaagctaagctaacccaaaccccaccttacttttcccttaattattcctgggctactgggtcgagctaactttggaagacatttaggctatggtttaaataacaggccttgccaaaaactcaaccacttatttttttgagacggagtcttgctctgtcgcccaggctggagtgcagtggtgtgatctgggctcactgcaatctctgcctctgggttcaagcaattctcctgcctcaacctcctgagtagctgggattacaggcgcatgccactgagtagctgggattacaggcgcatgccaccaagcctggctaatttttgtatttttagtagagacagggtttcaccatgttggtcagactggtctcgaactcctgaccttgtgatccacccacctcagcctcccaaagtgctgggattacaggcttgagccaccgtgcccagcctgctttttttttttttttttccttgagacagagtctcattctgtcacccaggctggagtgcagaggcaccatttctgctcactgaaacctccacttctggggctcaagcaattctcctctctcagcctcaggagtagctgggattacaggcgcctgccaccaagcctggctaattgttttgtatttttagtagagatggggtttcacccatgttggccaggctggtctccaactcctgacctcaagtgatccgtccaccttggcctcccaaagtgctggggtgacactgtgcctggtctcaaccaccctttttttttttttcctctgtcacccaagctggagtgcagtggcatgatcttggctcactgcaacttccgccttctgagttcaagcaattctcctgcctcagtgtccggagtagctgagacgacaggtgtgcaccaccaccccctgctaatgttttgtatttttagtagagatggggtttcaccatgttggccaggctggtttcgaactcctgacctccacccgccttggcctcccaaagtgctgggattacaggagtgagccatcactcctggcatagaaagtttttctcatccattgtcctcctcctcttctttcttcatcttcctcttccacttttttccaggcaactttagcaggaccctttgcaccgtcaaactttcctttcaacttacagtcagcaacctcttcctcatatttcttcttcagctttgccgccttagtgacgtcaacctgcttttcactgtcacttcagctattccacatctcacccagagctttttttttttttttttttttttttgccacatctccaatagagatgccagggtttgcggatttgatcttggggtggaattctgaacagaacatgaagaatccagacagttggttgggtgtgatggctcatgcttgtaatgccagcactttgggaagccaaggcaggtggatcacctgaggtcaggagtttgaggccagcttggccaacatggtgaaaccccatctctactaaaaatacaaaaattagccagacgtggtggtacgcgcctgtggtcccagctaatctggaggctgaggcaggagaatagcttgaacctgggaggcggggcttgcagtgagccgagattgcgccactgcactccagcctgggcaacagagcgagactccgtctcaaaaaaataaataaataaataaataaattttaaaaaataaaataaataaattaaataaaataaaaaataagagtccagacggtggccttttggggacattaggctctttcttcttgcttcccctttagctgctctataatccttcatttcccgatcctagtgtactttatccgcctttgccatttcatcaaatttggacttctctttcactgacactgtcttccaactctcagaatatttcttggaaaattctgcaaaattgacagggacctctgggtttttcttcttcttcttcctttttttttttttgagatggagtttcactctgtcgcccaggctggagtgcagtggcacgatctccgctcactgcaactttctcctcccaggttcaagcgattctcctgcctcaggctcccgagtagctgggactataggcgcctgccaccatgcccagataatttttgtatttttagtagagacggggtttcaccatgttggccaggatggtctcaatttattgacctcatgatccgcctgccttggcctcccaaagtgctgggattacaggcgtgagtcactgtgccaggccggtttttcttcttatgttcttctctgtacatctgcacaaaaaaactataagcagacattttgccctttggtttcttggggtcaccattagccatcctgactgtattgtttgctagtctgggcagcgcaggacacttgttcgctatttttctaaacttttcccccaatgggtgtaaaaaagcatattattattattattattattattattattattgagacgagtttcgctcttgttgcctaagctggagtgcaatggcgcgatctcagctcattgcaacctccacctcccgggttccagtgattctcctgcctcagcccccttagtagctgggattccagacgcgcaccaccacgcctggatagttttttgtacttttagtagaaacggggtttcaccatgttaggctggtctcaaactcctgacctcagatgatccgcccgcctcggcctcccaaagtgctgggattacaggtgtgaaccactgtgcccggcttaaaagcatattattatagtaaatactttttttccctttctttctttcattttaaacactggggtctccttatgttgtccaggctagattcaaactcctggactcaagcgatcctcccacctcagcctccctgttaccctgttgccatgacagccctgataaaataactgggaaagttctct

SEQ ID NO: 567 - DNA, 2031 bp, Homo Sapiens
aaatgccttggaagagacctcagaggataccagtccgggtttaggatgcatttgctgattattacttaagtgtgaatcatggcaatacagtgaaagacagtgatttactgcttttgagggcgtgcatgtatatgattaacggatggaagtgcaggactccaagatttacttccttccctttccagcagaattacctgagacgagtaaaatctactggtggagtcactccattattcttatctgtggagatctagatcttgatttgaaagtttctgagaaaatcttcagctcagacttgagggtcaactttaccagctgaagtgactacatcctgcctgctttcagctccagtggaaaatgcattaatcccagagtctccgtgaggtttcctgtttgatgacataatcagaaaatcctcctcacattgcccttggggttgctgtctggatgttatgttgtcttggtgggtgtaactcagccatcaaaaaaatcagcacaggccataaactcaggacctgaaatgcattaatataatgttaaacgaaataacgctgtgggtatgtctgcagcactggtagggaatttcattaaactgcagattctccctggcatcagatgcattggctggtgactccggtacatatggcatgagctgctgcaatgccactagcaggaggtatttgaactgctccagtgtaagctgttagactacatctcgtggaaaaataacacacacccttgactaccagagtttggtagtgttgatttaagtagttcttcccttccattcccctctggggcagcctgtttacctaataacgttttgcctttggtgttgatcacaggaagctgcaaaaaagaaaactagtgggaagagtcagaaatagaagatgaggatacactttaaaatgagaaaagcaaaagatggcatctgacatgtagagtgggttttaaaagttttaaagataagatattgtgaggcagaaacttcagtagctgtgaatatagttggaaagaagaaaccttgatataaaagtagaaccaagagtaggatatttagataccaaagggcacgtacaattttacaagtttagaagatattggcataggaaattgagcatatgcttaaatatggatttcctttgctatttggagaattttttatattttttttattgttttggtaggctgccataaccctccatttggttgtcttggatggaatatctcttgccttggatcttggaaatccaagcttgattggcacttggtcaggatgagaacaaggaatgggcctcttaggatgttttacaagttctagaagttacctccatgatcctccctcctgttgttgtaccaaactctttcttgcatgtgtcttcctgggggtggagagaggtggtgagggagctggtgggagaagcaggcaagatacagcttgatagagcttcactggagagaagttaaagaggaaggagaggtctaagctctagccagttgaaagcctggggtgatgtcaccattcctacctccttatatcagaaatattcttgggttttccataatgtattccaagcagcgggacacctttcacagatgcttctcctgtgttaggggaatctggactaatataacactaggagggagaaaattgtgtttctttatcgctactgtgaacgttgttgttttttaaaatttacagctgactactgaataaactctaaaacttggagttctggatttcaggttctgtgatctgttttcttgtatagctctgtgatggttacgtgaccaagctgtgagcatttactctcaaaacagcttcatttaaaccatcctatgccttgtactagaataatgctaccccagagcgggaagggctctgaaagatcacatctaatgggtgaacctctttacccaggtgtgttgtgacaagagtgggggagactatgatcctttttattctagatatgtagcgcaggttggttgtgttagtgaatgtaccatctcacacatcatattgagctgaat

SEQ ID NO: 568 - DNA, 3955 bp, Homo Sapiens
gaccgcgtccgaagaccgccgaggcctcccgcagctccgcggtgacacccgggtcaggggcgcggggccgggcgccggggattgtgggaggcgcgggggggcgcgccggccgccttcggagccccccaactcgcgtcctgcaaaggccgccgggccctgtcgagaagacccgaccgcagatggcggggaggatgctcccggcggcgtgggaaccgggtctgactcccgagccaccgccgcttccgcaggggcgccggccccgggaaagtcaagtcataaatccctgaatctaaaactccattctcagagaaaaggcctccaaggacgggcgccgtgcgcggcaactgcctgcagttttgaagccctttgactatttcataacaaagacaaggccgggcggcttggacgcttaggaaaatcctggggctttgcaaaaacaacaggttaatctagtcgtgtgggatgatcaccaaaacaagacaggaaagaagaacaccgtgtcaatgctgaaaagccagcccctgtgagccccaaagtgcacgttttccacagtcccaaggaacacgtgactgtgtgtttccacacttgagaagtcaggataagaccccttggataatggaacaggggatgggggtgggagcaagcaccctacctggtcacctgcttaacttagaaaccagcttttaaaacctgtaactgcagtatgagctacgatcaaatttgtcttaacgtattttttttaatgtttttaatacccagaacacagggcttctactccagggtttcctcgccagggaaccccaaacacacaggacctggagaagccgggtagagctggctcctggccctgcgcttgggtggtcggctgccttaagaagaactgcaccccagagacaggctcgcagctgccgaccttatccactcgccctttctgctggagcccaggcccagtgctccagcaaggaggctgagaaaatgctgaagactgatgcccacgggggacagcttgggctaaggataacgtttgcaaaacaaacctttaaaaacccatagcaacctgtttcctagagcacactcttcatctctccacccccaaactagtcccgactcggatcctccttttcctatcctctttctcttgctctcccgtctcctattcacttttcttctcctttcctcttgattattataaacaaatgctttccaagtcttaccgccatcatatgtgtacatatgcaacccttactgttaccaatttgttgaagtcaagacaggaggaggcaaagtttaaaaatcagaagtattgcaggaaatgaaaatggagtgagtgttgcctgggtatcataattttttttttttttttaacagttcctctacttggctctcctccaaaggtacgcggccacagcaggcaggggcttggcagtgtgggaggagacaccacagaagacagggaagaactaccaggccttggttcatctccacactggcgagagaggacgtgcagttacctgctacctgttcgactcagtcttttacgttggagtaacttaacacattgctgcccttaactttgacttacttgcttttaaagatgatgaagctggccaggcgccgtgactcatacctataatcccagcattttgggaggcccaggcaggtggatcacgaggtcagcagttcaagaccagcctggccaacatggtgaaaccctgtctctaccaaaaatacaaaaattagctgggcgtggtggcgcgtgcctataatcccagctactcaggaggctgaggcaggagaatcacttgaacccgggaggcagaggttgcagggagccgagatcgcaccactgcactccagcctgggcaatagagcaagtctccatctagggaacaacaacaacaaaaagattatgaagccttaggaagaacagggatattcacctgctgctgagcccccctccgctttgatcttgtgagtctgcactctcctgctcccctgtctcagtctcctctagctcctgttccttctcctaccttgtgttctctgccaatgatatgactggggctactttcttttttccttctcacactctcttcttgctaatttcaaccaatttccctgcatcatctccacctgcaagctggtcctttacagcagagcttggggccctgctgcccagtagcactctggacaccctcacatcatcatcatcatcctatttttatttattttttggaaacagggtcttgctctgtcgcccacactggagtgtagtagtgcagtagtgcgatcacggctcactgcagccccgatgtccctgggctcagatgttcctcccgcctcagcctctggaataactgggaccatagatcccttccactgtgcctaatttttgttttttgtttttgtttttgttttgagacggagtctcactcttcttgcccaggctggagtgcagtggcatgatctcgactctctgcaaactctgcctcccgggttcaagtgatctcctgccccaccctcccgagtaactgggattacaggcacgcactactgtgcccagctaatttttgtatttttagtagagacagggtttcaccatgttggccaggctggtctcaaactcctgacctcaagtgatccgcccacctcggcctcccaaagtgctgggattacaggcatgagccaccacgcccggcctaatttttgttttgttttgtttttttgtagagacggggtttcaaccatgttgaccaggctggtctcaaattcctgagcttaagcaatcagcctgtcttggcctcccaaagtgctaggatacaggcgtgagccaccacgcggggccttcatcaccctattaatatatactttctgatacttaattgccaggcaataagctaaacccttttattcactgtctcactttaatccttacagggaagtatcggctgccagatagggagctgagacttcaagaagctaaataaggtgtccaacaccacagagcatggagcaaaggacacgggactgcaaatcttcctaactcgtgtgctcatctggctatctcaccagggccttaaatttaatatatcccaaactgaactcatctttaccccttcccactttgcactcctcaaatgtccttgtttaaaatagttacctttatctttcctaacccagaaactcaaaacctggcatcatctttgacttctctctttaccttcacattcaacagtttccaagacttaaaggctttatttgtaggatctctaccactgatcctctacagtttcacacctacatcccattctcgttcccaaatccccataactcctctcctggcccatcccttaacactgaaatcctggcttggaaaatatggtcacattcacagcagctgtccccaagaaggaagccaaggcaacagtatgcacaatgaaatcactctgggagaaactcactgccatgttgtgacaacactatggagacgcccaggtgagggactgaggcttcctgccaacagccacatgaataagattgggaacagatcctccagccccagtcaagccttcagatgactgcagtctcatgaaagaccctgtgccaaaaccacccagcttgatgaaataatctgtacaacaaacccccatgacacaagtttactacaacaaacctgcacatgtacccctgaacttaaaagttaaaacaaaaccaccaccaccaccaccaccacccagaaaaaacacccagctaagccacttctgaattcctaacctacagaaactatgaaataataaatatttgtattttcaaaattagctgggtgtggtgccatgtgcttataatcccagctacttgagaggctgaggcatgagaatcacttgaacctgagaggcagaggttgcagtgagccaagattgtgccactgcaatccagcctgggcagcagagcgaga

SEQ ID NO: 569 - DNA, 2170 bp, Homo Sapiens
gggcaatgaggggcacagaggacagtgtgtggctatctctgggtctctgttctcccaggtggaccagtgggggttgtggcgatgctgtccagggtgaggtccagctacggttgccgtcctgtctgtcagcaccagcacccagcacatctgtagggcctgggccccggacccagcctgagggttatgaggaggtttcctgaaggagaaaagccagagtggagtctggaatggagcaggggggaccatggcctgccctcagtctgctaggtggggctggaacctggggttttgcttgggtgtgaagaaggaagaggctggggatgcagctaggtgctggttcctcatagaccgagtcatgatttatggggaccctcaattatatccccttagcaggggccacaaagtctcaaatctgcccagaaatccacacctcggagctcaggtgaggtcttcttcaggttctccctctgcagtgcagatactgtcagaaagagcaagctacaaatggagaagtcaacaacactctagtgagaattaccctgccaattaattttctcagaaatcggggactcagggaccgcttgctgccgaggctgccacctcagctgcctgtctgtgaaatgggtccatgtgtccccatgccttggcccgtctcctcttccctacaacaggctgctgtgcagcctggggccctttccaggccaccttctccatctgctcactgaggagggacccctgagtcagcgaggctccagcttggctgcacccagctgaaaggttatcctgctgataccccaccacttatggaatgatggaccttttccccactggattagaatgtcctttttgtgtatcatcgaccctgaacaacccaagtttgagccgtgtgggtgcacttctacgtggattttcttcctcctctgtcacccgagacagtaagagccacccctcctcctccccagctgactcaacgtgaagatgacgaggatgaagacctttacaatgatctgcttatgctgaatgaatatcttttctcttccttactttactttattgtaatacatgaagcatacaaaatgtgttaaaacccgggaggcagagcttgcagtgagctgagattgcgccactgcactccagcctgggcgacagagcgagactccgtctcaaaaaaaaaaaaaaaaaaaaaaaaaaaagctggaactgtgtagtcccagttcctctgtgtagccccccaagtctgctctatttcaatcttctcttaagggaactccttccctccgtttttcttttcctccatttgatacatcacacttatagatagggcatcttccctaattactggcttcatcctcaattcccgggacccataccttcactggcttcctaaatttatttaataattctcatatacctttgagaagtttctaatgataggcaacaaatgaatattgactacctttcttattttcctttattcaccaaaatgatttttaggatgtagacaatctgtatgcttcaacatacaccaaacttaccatttttgaaatattttacaatctacttgaaaagacttctttagaccctatattcatgtattgtaatatttatcctcttttatggctatactcaaatgccacatcactatagtgccttccctcatcactgatagtataaaaggcaatatttccatttattatcatctgtgcttttcaaagaaactctgtgagtccaacagggcgataatagaagcaactgccctttctctccccctttaaatgcaacccaatgtcaaagtccgtagcatccccaaatgagtgtattaaaggtgagaaattcccaaagtcaaactcagtagcatccttataattgtttatagtagtatgttatgattttttaacttctgtggtatcagttgtaatgtctcttctttcacttctgagtttgttttcttttttcttagtctatgtaagaatttgttaattttgtttatcttttcaaaaaacaattcttatttttattgaaattttcagtttctattatattatttctgctctgatctttgttatttgtttccttctgctatctttgggcttgtattgttctctaattttctcgctcctttaggcataatattaggttgcttatttgagatcttttttttcttttttga

SEQ ID NO: 570 - DNA, 1770 bp, Homo Sapiens
aaaatttttagttcttcctggcaattgcatgtatatttttttctgcatgttatttggatgtgaggagctgtcattattattttaggaacaaatatgaaacaatctctggaaaatggaatttgattttgattcaacaacaggagaattctactgtttttctccagcagctccacgataaaagggaaccctgagcagaacacatgcacaaactcatgccataccctaagggacaaggttccccacatctacttggaaatctttgggatgctcaatggagaaaaacaaggagagaaaaatctaaacccagcagaagagaaagtttaagaaagcggtcgtcgccaataccaaaattagctatgatattcaggaagaaaaaaatggaaacacgataaccacagtcaataaagaccaaggccacattccattgaccagagctcagccacgcgccacacctggctaaagagactctggctgaagaattccctgaatattttaatgtagctctaggttataacacagaacaaccacaaggtggcagaagaactccattcttgtaaatctcttagttgcttctttatttcatcttccctattccatctaatgttccctgaattttactattttgttggtttgaaaatatgtgtgacttacgtcctttaaaggatttggttcgtaaggttttgaatagactggaatataaaacatttatagaaaagaaaaatacctacagtatgatgttagtgaactattaataatccaattaaataaaatatatttgctttggattaatacatattttgttttgatgtttgctaaataaaactaagcattaggaggccaaatagccacaatgaacattttcatattatttaataagccagtttcaaggcatacatgctaaatttgttcttaaggaaaagttgaatttttgctttcatttttacacgtgtaaatccaatgtgttctgaagtttaaagtgtcaaaggctgttggatttaaacagatcttgtatgactctctgtttcatctcttcagaggttgatagtaagcaactttggcagcaactcacagcttctgctgtaacatgaggctaataatgacgactttataaggttgttgcaaagagtcagggatgccacaagcaacgttctttatatatgcagaattttaaaaataaagtaaataaaaatattccttcctctattccccatttttctaacattatttgcaactggtgttttaatgcaagaccaaaggctaaaatatacatgtagctagcagaatcaaaacctagatcagatgttcaaaagcatcatgctgctaaaagatttcagagtctaaaacctgtgctcactcttctgaaacatctttccacttcctgtttaaaaaaaaacgtgatattctttgaagctcattttttgggcttcatgtgttgtaattatacatttgttatatagggtatatgatgacttacgctctaaggtattattcagtacattgtagaaaaaggagaataaagaatgttgtttgtcagtaggcagctctgtcctctttatccttgactgtaatttactaaagagctgacaaaattacagcacaggcagcaattcaccatattaccctgcagacagccaagagactgacattgagatgatgcgttttaacttgggtccatgtaaggaacctgatggggttatatgaattcttttctgtactatgaaaaaatgaagttgctaataagaaggaggtacaaaagtgtgtactctgcgc

SEQ ID NO: 571 - DNA, 2541 bp, Homo Sapiens
agacggccctatccctgtctcccttggctgactctcttttcggactcagcccgcctgcacccaggtgaaataaacagccttgttgctcacacaaagcctgtttggtggtctcttcacacaaacgcgcatgaaatttggtgccatgactcggatcggggtacctcccttgggagatcaatccccagtcctcctgctctttgctccgtgagaaagatctacctaggacctcaggtcctcagactgaccagcccaaggaacatctcaccaatttcaaatctggtaagtggcctctttttactctcttctccaacctccctcactatccctcaacctctttctcctttctatcttggcgccacacttcaatctctcccttctcttaatttcaattcctttcattttctggtagagacaaaggagacacattttatccgtggacccaaaactccggcgccagtcacggactcggggaggcagccttcccttggtgtttaataattgcgggggtgcctctctgattattcacccacgaccccactgaaaatcggactgttcaactcatctggcagccactcccagagcccctggaactctggcccaagcctctctgactgactccttcccagatcttctcggcttagcagctgaagactgacactgcccaatcgccttggaagccccctagaccatcacggatgccgagcttcgagtaactctcacagtggagggaacgcgcatgaaaaaaccaaacaaacaaaaaaatttcttttggtagcagaataaaaaaacaaaaaaaaggactttttcttctggactgaactatatttaaatctcaaaggatggacatctcacaaccttcctacagcaagtactgtgagagctgcatcttgtcccactggatggtcttcagagacaataatacataatggagctgtcatctcctatgataacaatgccttcttctggatacctcctgaaggacctgcctgaggctctttcactgttagtttttttttaataagtagaaggattacactctaaaataataagtgtagtatagtaaatgtataaaccagtaacataatggtttattatcattatcaagtattacatactgtacaaaattatatgtgctacaattttatgtgactggcagcacagtaggtttgtttataccagcatcaccacaaacacgtgagtaatatgacacaccatgatattctgacaaccatgacatcactaggccagggaattttttaggtccattatcatcataggcgaccacagttgtatatgtgatgtggtctgtcattgactaaaatctcattatgactgtacttagtctctaaaccttattctatttctttcttttcttatggctttttcctctataagaactcaaagggggagagaaaaagacgaaaaatatcttcaaagaggagaacaaatctgatctttctctacgtctgcttagttggcgtaactttaggatgtccataagttgtagctttcctgggaaaatttgattttacactggttatcccaacataatattaatggtatcctcttagactctcaatagtgtccggtttggatgacaaattctgtggtctttttagccaactgctactgaagtggtcagatttattgcacaaaatatatttttaaaaataagtagcacaagatgaaatatggcctcaaatttcttggttagtttccactagaaagttttaaacattaaaaagtacaaaattcattacatttattgaatgataaagtataacattgtatgaagttgatgactattaaaactatttgagtgtttaagttttgtcaggttctctttggtgatgtcagttaagtgtctttcattaattcttatatgcctcacttttcctgtaaataacttattaaccacccactactttttttctgactgattaaatggtataaatgtcgagaaaaacaacatgaatgacataaatgccaagaatcagttgaaatgtaaaaatatatttaatacagaggttctgtttatgactccttaaaacatacttaaggaagcacacagttaactaataacagcaattaactaggattggtagaaaacctttattttcttattctatagtccatttgtgaggagcttaatataagaaagttagtaggtcaaactaataatagggcaaagtactgttccaagaacttgtctaatgatgttccagtgccaaaaatgctctgaaaaattgagataattgaagtctttgatcagaagggtgtaaaataatgttggaaataatcaagtgaagatgtaaagctatgactcggtttcccatgctgagcatgttaacattcttcactgtttcttcttgcatgctgtacatggccgacatttttcaaagtaatgagaaacactatttggtgaagttcttttcatctttgctgtccacatgtatcactcccatccaaaagttgcagttgcatttagcagttgcaaaggaaaggattttctcacgtaggcatggatacttgaaggggctg

SEQ ID NO: 572 - DNA, 3084 bp, Homo Sapiens
tgttcctctccaccgtggaatggtgtgctggtggatctgcacagaccttgggtcatctcacttttgagggagccccagaacaaaaggctctggcagtttaatggcccctggggctgaggagaggagaaggagggcaggggataagtccctctgtgggtccgctttctccttctgtgaattatggatcatattttccacttcatgtgaaaatatcaaagcagttaacacacgtgcagtgatttttacaagcgttcgcgggaaatcttccatgggctttggccatcagcagtagtcatcttagcaatgctagggcatggtggcagacaccagatactcaaggggcttaggtgggaggaattcaaggctgcagtgaggtatgacagcattgcactccagcctgggcaagagagtaagaccctgtctgcgggggggaaaaacctattaagaatttcaagatggcaacagcagagtgttaaaccaagtgtgagtccctactccaatgtcacttccttggctgaaggaaaaatcagtcctcattgattccattctgtccacagaaccattcatcaatttatattatctttcctagataaaatactttaacaagtccaattactaagctgctgaaaggacatacataaatgtttgtaaataaatagaggtttggaagatacaagatgattgtgacaaatgtctgtccctgaaagatgataatcattgaaaagcattacatttattttgaggaaactggtttttttctcaacagaaaaaaacatatttgtagcagctggaataagaggtaggcatagtatgagaataatacctaatttcatagcaagtccgttttatttcttatgatttgctgttccattgtgattacagtttgttgactagtggccccttcaacctttttatgatttgttcttacaaccaatcattcttctctttcttctacagtgttgattcctcttcctcatgatagcatctcattttgatctagttatctgtttgagctttgctctactattttcttagcattttctcttaacatttctttgttcttacatcagctgttttgcatacatcttaaatgtggttaggtaaataaatgcacagagacctgtcagttttttgccaacagccaggcacctgttcatgtcagcaattgtcaactaatgtactgtattttttgttttttgagacaggttcttgctttgttgctggaatgcagtggcgtgatcatggctcactgcagccttgacctcctgggcttaagccatcctcctgcctcagcctcctgagtagctgggaccacagatgcctgcctgccacacacgggctaaatttttatgttttgtagatacaagatctcattatgtttcctaggttggtcccaaactcctgggctcaagtgatcctcccgcttcaacattccaaagtgctgggattacaggaatgagccactgcatccagcccactgtaattttcacatactcaccaatgctggctctcattgatcatatgaaattatgaaatcacgtgaaaacaatgcctagttcagtccaagggaagcagataccactgttttatagaaagagataatagtaaacctataatcatgtccaaggaagtgatgtacacagtattagctagatgagtgttttctgttacaggtaccatttctggatttgacgggtatattagtcatgcgaaatagtctttgctccagatataaaggaaagaatagaaggcaacatgatgcggtagaaaataatgagctatggaaacagataggcgtgaatttaaatttctgctttacttcttcctactattaagattggacccactgagcttcaatatttttacctgtaatatgaagataatgaaacaaatgtcacagagtattacatactagtttctaacttttttcttccttcgaatcaaaaaagaaaccacatgtgtttaaaatatgcaccactcaacattctaagatggaaatagcttaaagtaccaaatttgagattgatgtatattgggggatggagattattaaatttccttgttcagatgaaacataattaacataatcagtttggaacttttttcatgcctaattcactttctagtccaaaaataatgctgtgcaaattattggcacgttgtttcattttcatgcctaatttaaaaaaaaaaatcttttccttgtgctcaaatgcctatttagttccatttgggccattttctttgaactaaatgcaaatgagggaggttgcatgtatttcataatctccctttaatcaagatcactatgaagcatcagccccctgggtgacgggtgacataaatcatattaacttaattctgtgtgtttcattaaaggatttagtatttttatgaaccagaatatctgggtcactgccatagaagcttcaatcaagctgcagatcttatggagtcaatgatgtgttgcttatttgatgagatgaagatgaagtgcctactcccatctcatactggcctcattaacacatggttgctttaagagttcatgagttttggccaggtgcggtggctcatgcctgtaatcccagcattttgggaggctgaggcaggcagatcacaaggtcaggagatcgagaccatcctggctaaaaaatacccccccaccaaaaaaaaaaaaaattagccaggcatggtggcaggctcctgtagtcccagctactcaggaggctgaggcaggagaatggcgtgaacccgggaggtggagctagcagtgagccgagattgcgccagtgcactccagcctgggcaacagagtgagactccatctcaaaaaaaaaaaaaaagttcacgagtttagaagagacagttgggtcctggcctcaggaaacaaagaagaaatccagatcttatacaatgtgctggacataaaagtataacaatttttgattctcttccccttcaccattgaaatctatggtttctctatatgactgttttctcaacaatccaaaaaggcaaggttggcagcatgcaatctgctgaagaatcctgcctaaatacccttttccacttcacactatc

SEQ ID NO: 573 - DNA, 9203 bp, Homo Sapiens
actccctctattgcctctccagacccagacttcaccctcaggtcaccctcacctggactttggggtgccccacaccccgccccaggccctggcctctggaatatttggaaacttgaactgggccagaggcttaagctcacatctgtctggagcctcaactttctcctctgtaaaatgggctaacactgaaagaaccttgcagaatctcagcaacgtcacagaggacattgttagcacagccagcgggctcctgctgggctgagtttgtgggtaatccaagcctcggcaggtacagttcctccctcagcccagtgcagatgcatctgacttacgaaacttcagtgacacctgctctgtgccagacactgaagatggagcagtgaacagcactgacccagcctgtcctcctgttgcctgcaggccagaagcaaggtctcgctgtgttaccctggctggagtgcagtggctacttacaggcatgatcatagcatactgcagcctcgaactcctggactagagcagttctcctgcctcagcctccagagcagctgggactgcagacacgcaccacagagcccagcctgagtcattttgattctgtaactggcttcctctcggcgggcaggctcacaccctccacccccagctggagatggaaggaggatgctcaccgcccattcctcatgcaggccatcgatggaaatgtcagacagtgcgagtccacgcctgaacacttctggggtccgctctgggactgacactggcagatccatcggtgagctcccgcctgccacctctgggcctgcattgcggtgatagggccaagggcctgggccttcaattctccagacttgccaaaatgctcagcgcaggcctcgtcggcaactgcagacaagcagaggcagcacctgggctctgcctgtgcctggcacagtgaagcgagggtgggggcaggaatgagggtcctctccatgcaaggggggaagatagaagaacaaaatttcaccctaatgtagtgtctttagaccgtgcaatgttgtgctcctgttagtctgatatcaggggcttgcagcctggcaaaggaaaaaaaacaggctgaggcacatgatagaagacaggcagggatgccacaatcataaccatggcaaagaccaggatcagaaaggcccaccatctctgaccccaaatccctgggcagatggttccagaactcagaattttcccagttgtagaaagatggggccaggtgcagtgatccgcctgccttggcctgcgataaaattgcacagaagtaaatacacacacgtgaggatacggaaaaccggggaaacctgagcaagagcagtcagaccccggctgtgatggcgcccagtagttctgcgagatgttaccattggggaaactgagtgaaggcgggtacctgggatccctctgttttcttttttgttgttgttgttattttgagatgaagtttccctcttgttgcccaggctgggtgatccacctgcctcggcctcccaaagtgctgggattacacgcgtgagccactgtgcccagcctctctgttttatttcttctttttttttttttttttttggagacgctctgtcgcccaggctggagtgcagtggcacgatattggctcactgcaagctccgcctcctgggttcacaccattctcctgcctcagcctcccgagtagctgggactacaggcgcccgccacctcgcccgtctaattttttgtatttttagtagaggcggggcttcaccgtgttagccaggatggtctcaatctcctgacctcgtcatccgcccgtctcggcctcccatagtgctgggattacaggcatgagccaccacgcccggctgttttatttcttataactgtacaggaatctacaatgattgtaacaaaaatttcaattaaggccactctaggcacatggcctgtggggtagccctgctcaacaagaagccgtcaaaaaaatgttttttaattaaaaaatttcttcaattaaaaagcgttatcttcctctgcccggaaagggttaagtgagtcactgcagttagctccccttcccccacaaccacctagaccaggccagggaccagcgggcaattgcctggcagctggagttttcctccactgtggactgtacttcttgcgtcactctgaatgtctccagtctttattccagaatgttctggtcctctcccacttttccaaggacaggaattccctagtggggctccagaagaggctctggaggagaacaagaaaggcccttgtcatccattggcctcaggctgggaaatctcggttccactcccagcccagcctcaatattaggttgtcagtctggagtctgagagccatgcccccacccccttagtccttcacctccaggagagttggggatactggaaagaatgttgagtgtcagagcccctctcagtggctcacgcctgaaatcccagccctttgggaggctgaggcaggtggattgcttgaggccaagagttcaagaccagcctggccaacgcgacgaaaccctgactctactaaaaatacaaaaattagctgggcgtggtggcacacacctgtaatcccagcagctcgggaggctgaggcaggagaattgtttgaacctgagaggtggaggttgcagtgagctgagatcacaacactgcactcaaaaagtagttaattaatttagtttaattaaaaaagaatattgagtgtcaggcaatctgggtagaacccattgtgtttctacaggatagaatctgctgtgttctctagcggaacttccggatcaccttcaccgtatgactctagacaatccctgtccactcttcagttttagatgccccattcaaagaatgaaagaattgtcctagatgatcctttagggtcttccaggctgatgacaagggggacctggcccctctgctgctggccaaagaggactttacttcccattccgtgtggttgaacaagaattgctgggctccagtcctgcctttggcccttccctacatgtgaccttgggccctctttgcctttcagaatcaatacagtgagagagttaacacaagctcaggttagtaagtcattcaacaaacatttactgagcgcttatcaaatactgcatgctggagtggacactggagaaaaaggtgaggagaaggccgggcgcagtggctcgtgactgtaattccagcactttgaggggcagaggcaggtggattacctgaggtcaggagtttgagaccagcctggccaacatggcaaaaccccgtctctactaaaaatacaaatattagccaggcatggtggtgcatatctgtagtcccagctactcaggaggctgagcaggagaatcacttgaactcaggaggtggagcgtgcagtgggccgagattgcacctctgcactccagcctgggcaacatagtgagactctgtctcaaataaataaataaagtgaggagaaaaaaataccatctctgtcttcacagaacttatagtttgagaggggagaatcccacaagtaaattataaatctcagctgagattatgcaaagaagcaaaggccggacgtggtggctcacgcctgtaatcccagcactttgggaggccgagacgggcggatcatgaggtcaggagattgagaccatcctggctaacacggtgaaaccctgtctctactaaaaatacaaaaaaattagctgggcgtggtggcgggcgtctgtagttccagctactcgggaggctgaggcaggaggatggcgtgaacccaggagcacaggttgcagtgagccgagatggcgccactgcactccagcctgggcgacagagcgagactctgtctcaaaaaaaaaaaaaaaaaaggaagcaaagtgcccagctgggatggtggtttcagaggccacagtgggagcttcccagagaagggatgattgagctaagtctaagcaaaaggggtggtcagggcagcagctgctccaaaacaggggctgggggcttatgtggagagagaagacatggagagaccatgcccagaaggaggcggcggcttcagtgaacagtgcaggggagcaggtccgaggaggccgcctaccaggggaaggagtctcatctccatcctagacaaaaaaaggatcttttgagatgcattaagcaggggagtcacagattggatttgtgttttgagaatctcctgcttacctagagaagaagggcatctcctgggccctcactgttgccttaaatgatttttattgtgtattacttaaacatgtgcaagcataaaatgagatataaactccttgtagctcttatacaagcatcagaccaagacaaattgacccatcacgtacaaaatcgattcaaatcagattaattttatgtgacatgttattatgccttttgtctgaaaccctgccaccacccacagtgcaattatggcccaaccactgtggtgttctgaatttgtgggacagagaatattggccttttaaacacgtgcatgcatgcatttgcgtgtgcgcacacacacacatcccaaatgattttttcccactatatatgaagaactcctacaaaccaaaaagaaaaaggcagacaattcaagagaaaaatgggggagggcttgcattaaagtacttcataacaagagtacttaggaggccaacaaatacacgaaaagctgctagcttcatgactcatgggggtggcttggtcagttcaggatactgtaacaaaataccttagactgggaaatttataaacaacggaatttattgctcacagttctggaggctgggaagtccaagatcaaggcagcagtagatccggtgcctgagcccgttccctgcttcaaacatggcaccttcttgctgtatcctcacatggtggaagggggaagacagttctctggggcctcttttataagggcagttatccaattcacaaggatagagccctcatgacctaatcacctttcaaagatccccatcttctaacaccttctaacaccatcaccttggtgattaggtctttttgttgttgttgttgttgagatggactctcactctgttgcctaggctggagtgcagtggcgtaatcttggttcactgcaacctctgcctcccgggctgaagtgattatcctgtctcagcctcccaagtggctgggattacaggcgtgtgccaccatgcccggctaattttcatatttttagtagagacagggtttcaccatgttggtcaggctggtctcgaactcctgacctcatgatccgcccacttcgtcctcccaaaatgctgggattacaggcatgagccactgcacccagccgattaagtcttaacgtatgagtttttgggagaaactcaaacattcggacaatagcaaggagaatacaaaaccacagtgagctaccgcttcagacaccagagaagtttaagtgaaaaagactggcaataccaagtgctgatgaggatatggagcaaccagaactctcagacattgctgatgggaatctaaattagtataaccaccacgaaagcatccgtaaggtttaattgtgttgaacacaccctgccctctgaccaagcatttccactcctgggcatacaggcaaaagaaatgcatccacgtgttcatcaaaagatgtaacctgtgccaggtgaggtggttcatgcctgtaatcccagcacatcgggaggccaaggagggaggattgcttgagcccagaagttcgagagcagcctaggcaacaaggcaaaacctcgtctctactaaaaagtagccaggcatgatggtatatgcctgtagtcccagctactcaggaggccaaggcatgcagattgattgaacccggaaggtggaggctacagtgaattgtgatctcgccactgcactccagcctgggtgacagagcaagatcttgtctcaattaaaaaaaaaggaagaaagaaagacataacctggaatattcacaccaacactattcaggatagccctaaactggaaagaatctgaatatcctccggctttagaacagagagaaattatagactattcattcatacaggggatgattgatcagctttaagaataaacaaaccgtacacaacaatatagatgaatctacaaccttaatgtgcaaaatagttcacatatataaaggacaaaaacaggcaaaactactccatggtgttagaaataggggtagaggttaccctcatgcggcaggagggttagtgataggggatttggaagaggaggagcccaatggactgaacagctgagctggaaacagcaatttgttccttaaagttctgaacccaactgttatccagcatggagtctgtctggagaggccagatgtggggcctctcacaggggaatgagaagtgcctctcagggtcccacccatgatccccctttccttgcccacacaaccaccaactggcaagtagtaacccaggacctgtagcccccactggcttgacacagagcataatgcaagcttttcctgctccaggtcctggacaccactttgccctttgccccacacgtacagccccctgaccaaaagctgggtactctggcttgactagagggagctagactccaggaataagtaaggagctgggcttccacgctagagaacaagagcttctctggggaaaggggcttcccatgaagccctggggcactgggagattaatgggcagacctctggcctcagcttccagggaaggggagggtgtgggccaacatgcggtggctacactgaccacaagccgatgaccccagccagcctcaggatgtctcagctctaggcatggtttttcgttttgttttgtcgtgttttgtttttgagatggaacctcgctctgtcgcctaggctggagtgaagtggcaccatctcgtctccctgcaacctccacctcctgggttcaagcgattctcctgcctcagcctcctgagtagctgagattacatgtgcgtgccaccttgcccagctaatttttgtatttttagtagagatagggtttcatcatgttagctaggctggtctcaaactcctgacctcaagtgatctgcctgcctcagcctcccaaagtgcaaggattacaggcatgagccaccatgcccggcataggcatggttttgacaatctgtctctttgtgccctggctccttctccaactcctctttggaggaggcacaggaggaggggtcatttcactgttcctgaaaagtagacatataacctacatgcaactgccaggtgataagggccccatctgtctggcatgacgttggaggtccacaaaggctgattagatgaatgctcagctctggggcctccccacagagctcacagacaggcgtgaaggaaagcaggactcttattagaatatgttcagagttttcactgaagaagcctcctgtgtgggccaggcactgtgctcagtgctttgattcacagtctcatttaattctcaccatttacagacaagaattcagctaagatccttttcaatcaagtctggcaatatctgcctttcaatggcagtgcctagtcctttcatatgtaatatacttatcattatgggtgggtttaagttttatcatcttgctatttgttatctatttgtcccccctcttttgttcctcctttactgccttctatttggttgagacttaataaaatattttattccatcttctctacttactttttagctatgcctccttatatttttggttgctggagtgttacaatatgcattcttcaatatccagtctactttccaataatattacaccacttcatgtataacgtaagaacgttacaaaaatataatgccagggctgggcgcagtggctcacgcctgtaatcccagcactttgggaggtcgaggcgggcagctcacctgaggtcaggagttcgagaccagcctgaccaacatggaggaaccccatctctactaaaaatacaaaattagccgggcatggtggctcatgcctgtaatcccagctactcaggaggctgaggcaggagagttgcttgaaccggggaggtggaagttgcaatgagccaagattgcgccgttgcaccccacactgggcaacaagagcgaaactccgtctcaataaataaataaattaaataaacaaatatatatatatatatatatgtaatgccatcacatcttctccggcctttggtgttattgtggtcatatactttatttttgtatgtcttatagatcccagaatgcattgttatttttactttaaaaggtggattaatttttaaagaatttaagaaaagaaaaacagtctttggactgctggccacaaattctctgttttatttatccccaaatagttttatttttccattttgagagagattttcactgataccattcggagttaacagatttattctttcatcacttttcagatgccgttccattgtttgctgactttcattgattctatgagaagtctgcagtcttttgcagcgttgttttcctatgtataattgtctcctcccaccccactcaccccagctgctttccacattctctctctttgattttcagcagtctgcccatgatgtgcctaaataggactttctttgcattcatcttggctggggctcactgaactttctgaatctgtagattaattttcttttttcaataaaccttggaatattttcagcataatttttttcctgtcttcttctctctcttttctcctctgaaatgccaattaaatatatgttagactgctttatcctgccccacaacttactgaggcgaaatttttcaatcacttctctttgtgcttctgatgacactggtggcccatctggagtggccgctgccatcacaccagctgcagggggaggtgcagccaggctgcacattccatggagccagcaggaactgcagacaggtgggagccccacctcttctgagctagtggggcaggagctccctggatgcagccgcagccacccaagttatgcctgtggacccgggcctcccactgcatgaagcaggcagaaaccccaccccactaggcacagctgccacccaagttgtggctgcagacccagggctccctgggctcctgctaggggcaggagcaggcagaagccctgcc

SEQ ID NO: 574 - DNA, 1714 bp, Homo Sapiens
gagccgccgcgggctccgaggagtcggccgagctgctcccgcgccctggccggctgggtcttcatcctcattgtactcccttggcatctcatggtgacgtgacttagaaggtggtgcagagacgtttgaaactattgctttgctgaaaacatctgactgccaggctaggatgtgacacttaagggaccagggatcatttacatactgtggtcttgcattactgcgatgaaatcttccaccactcccaccacccactacaagagatggaattaattgaaactacagccttcaagagacatttggagcaatactcttccagttctttcttccacattttatttgtgggtacagcgtctcccaggatgtagtgtgctgtaattattcttccacccttttattttctgggagtttctctatctgaatagcacagaaatattagtggataggaagggaatataatattctatccatctgaaaattaacacccatgttgaacagaatcccttttcagtttcctgtttactacagggtccaaatctctgagctgagctgtgcagcagataataggagaagaaaaaaagatacctgctcctctttcaaggacgtggacttttctgttttgtgaagtgatacttggataggctactggatattttctcattcttgactcatcaaccttataattggtctaagtttttcccaaatttgtagctctggatttcctgtcactcctagttttctgtgttaaagttttccattttgatatgtatgatattgacaactgggagaggcagtgcccaggggatggtagccagatgccattttgtaccagaagtcttttattatctacatttaatggttataaataatgaatgcctttgttgggagtactttcatttactcattccaacaaactcttagaccaattttccttgagatcaattaaattcaatccctcctgtatgccagactttaaaaaaatgcccaatactaagtagaataaaaaatgtcttttgcttcagagtagtatgattaggactataacagagttgggttgaaaggtctatagtacaccagagtcaagactacgtttgtccttgggaaattggaaaggctactggagaatatgaaacttcagtgaatcttggggtatcactggatatttagaagctgggttgaggggccaggggatccttggcagaaagaaaagcatagtgacatgagagtgcatcatgagatcaggaagtcatgataggttgtaggcaattaagctgaagaggtttatgaggcccttatttgtgtggatagtggacaggtgctgggaatgatggatggcaggaagatctgatactagagcagttaaaattatctaggcaagtgagatggggaaatgaagtcaaacagcagcagcagggatggagggaaagtgacaagtttatgagtctaaactggagagagagaggatgagggaagaagaatgtagaatttgaagattgtttggttcttctggtcttccaattatgttcaagtatatgtgagatgcaatggtcaaagtaataggtacataataaataaaccatttctgttttcagcatctgtagatcaaactttagcttgccttagtttatcattcgtgtgtttagactatgatcaaataaatatattcattttcacactctatttttagtggtactaatatattttttgtgacgca

SEQ ID NO: 575 - DNA, 2824 bp, Homo Sapiens
atacgcccccggcgctgctgcggcggctggcttgggagggggtcgagggagcgggagcttggggtgggcttcgggagcgcagggaacggcgggagccgggaggtgacggctagcagcgtgagaaggccgctggctcctgagaaatccccctcctccaggtggttttgtccttttggaccaattatctaacctgggcctggactccatctaccactgtcctgcctggttcactgcagctcacttcatcttcctgtgccttctctgaaagggcccctccaaaagtttcctgggtatgtcccctcaagaaactctcaaacaactgagaaggtgcctcgacatctgatttgccccaaacctctatacactggacatcttctgaataaggctgtgttgtatgttgggacaagcaaagggatggaaatcaagaattctgggttttagtcctgactgtcactacatggctgtgttacttctgctttctaccaccctcgtgcttttgggagggcctgattcagatgaagagtctcctgagagcatggattgtctcagatgaagagtctcctgagagcatgaactgtctcaggtatccgtgtgttcctcagtgtctggcttggtgactggcacacaatcttgcactagatactggcttttgaattaatgcacgccgtgaaagagaacccagaaagtctgcacagctagagcttctcctcaccctgggttctttgtgatttgacttgctggtgatttctatttatcctgctaaactcaactcaggggagccctggaagcccctcctagtacgctgacactggggagatatgatcctccttatcacaaggtatccccagtacctgtccccccaggtggttctccccactctgagtgtctacatctcattcattcctccagtcccagtccttggcacagtgcttggtacagaataggtgccagtgactatttaatgtgtgaatgaggggctgaagctagtgcaaacaggagcttaaagttcaggaaagattggagaaagcgacacttaacaagctccttctgtatgccaggtatatgaaggacagcgcagaacacggcaccccaaaatatgctactttggcataggattattttgagctgacaaccattgagaagaagcagatacatgaaaggctctctgcttgccctctatttgcccaaaagcaagacacaaattttttttttttttttttttgagatggagtttcactcttgttgcccactctttttactcccaggctggagtgcaatggtgtgatctcggctcactgcaacctctgcctcccaggttcaaacatttccgctgcctcagccttgtgagtgtctgggactacaggcatgcaccaccacacccggctaatttttgtattattagtagagacaaagtttcaccatgttggccaggctggtctcgaactcctgacctcaggtgatccgcatgccttggcctcccaaagtgttgggattacagacatgagctgtggcgcctggcccaggacaccaatttgtaaaggtttctcctcctctcctctctaccaagaaggacagaagttaatcactggcgagaagtctagacctttataaacccagagagggcaccagaggaatacgtacgtacgtgtgatgcacatgttaatctatttttcgtcagttgaatttacagggccccagctggaaaatttaggagagtagagggaaaaagattttcttcccctacgcattgtacaaagtccttgcatactttctctcttttaatttttacaaccccttgaggtaaattctactattcccattttacagaggaggaactgaagatcagagctgttaagtaacttactcaaagtcacacagctcatcaaaggagggcctcctattagcgtccaaatataacgttgtgccttctactgcacagtgatgtagggtgggctggagtcagaacactcaattgtagcccatgagacactgctgggtataaggacccctttctttgcctgctgcttgcctgcaacattaccaccttcaccccttgaagccagtttgtctgcatattgatttgatttaggcttacaggacttcagggtctatttccattgtgcttctcaaggaacattttgcaatatttgtttcattcacttcaagttcttaagacttatgttttcccatttatgggtacatggaccaagaagctgatggaatcagtaagtgtattttgctgaaactcttgaccagtgtgtcttacagtgaaaactaagactaaaatcctaagcccccagtcaactgcatggacccactcttggtcaaggggaacccccgagacagccgaaaaacagactacctggccataatgggaaggagggtcagaccagcctcattatacccactcccttttggagtttaggcacaactggccagccttaatgttaaaatagagatcacaagactgacaaaacagattctttgtggcactaagattccagattttaaaccatgcgaggccagggtgaagtcatgcctgcaggccatcaattttgctatgtagcatccttatcttaatttaaaacattcttttttgctgacgccaaattttagacagagccttactcctttaaccaactgtaaattaaagaatatctgaatccacttataacctgtaagccctccacgtcaagatatcccgcctttttgggtcataccaatatataccttccatgtattgatttatgtgtttgcctgtaactcttgcctctctaaaatgtataaaagcaaactaatctgactgcctttggcacactttttt

SEQ ID NO: 576 - DNA, 1695 bp, Homo Sapiens
attctttgggatgaattttgcctaaaaaggcattacatattttctatagttctcaggtttcggtttgtgatgtttttgagaaatacttaaattctgaaactcttacagccctcttctgactagccttggggcaacttcagtagtaggaacattctagatgtaaattaaaacattttagcaaggtaaagctattcaaaataatgactcagtttggcagtcagaaagtaattctcctggaagcattcacactggggtattcaccagcaaatgagaaacacttaactagaagattgaaagggaagaatgaaatcattgtttccaattctcagcagctttcacttctattcttccttaactagtcagttcacaaattgttgtgagagaatatagtttaggttaaatcttcaagtcttacctgtagtgttatttaagtgatcttggtatatgtaataaacacacaattgagcagctaattgttgcagcataactccaatccaattgcacattcactttcaggtgccacagggtcttctaagccctggtgaatgctgtaaagcaaatacatctcatttatctctttgcatattccacaaattttaccatataacctatatgtaggaactctcattccatacttatctttagtctgtgtatagagacagaatattgaccgagaatagaaaaataaggctggttagattacctttgtcaagcttatgctacaccctaatggggttcaggacacactatcccaaaatgtagctagacaatgagttctctgagagcaggatccacctatttggttgtaatagttttgtttctataaatgttgaatgagtggatcgatttatcaaaatagagtttatgaacataaaaaattgccttatgcaaccaagtttgataataacaacatgaccttgatattaaactgaaaaaaggcatcttccagtctctactattaccacctctccccaactattatagccattcaaatctctaaccaggctgaatattaaataaaatggtttaccatctgatgttaaggtataaagataagatttttttttttctgaattaaaaaaaatagtccaaagaagaaggaagaagaaaggggatataatgagaatgtaagtatccaagaaatattgactgttttgatttatgtaatgaaattaaaaagtcgaaagccagttttaaagcatttcaaagtaatatcacagaaattaatttgaaggatacatttaatgttttgaatcataacctgtcaagcctggcatgcattttaactgagttttaaaaaaaagcattctgacgctattgtatggacattagagttttaaatacaacagaactacctaagaaataatgatacaatagaaatcagtttcctggctgtaataaagtatttcagttgaaatcatgataaatgttaaaggaaatattttgattatttaaataacaaaattggctgtttgtaaaacctggttaaacctgataacttctagaacaatatttctgattttaactccattctgctttccttaattttgtacagacacacacatgcacataagtttattaaattttcacaaactgaacacccctgtgcaaccaatacctggatctaaaaagagaacattttcaacccaccaaaagcccctgcgcccaggtgaaataaacagccttgttgctcac

SEQ ID NO: 577 - DNA, 5760 bp, Homo Sapiens
agtctcttttggagagctgtgaacgtgaccagacctattaattacttaactgaggtgctgaactttgaaaatgaaagttccggtggggagttctgtcctttccagcctggggagctctgtcagggctctcctgagcgtctctttcagcttatcaagctcgctcggggaccgtctctggtgatgtagggagaaggtggagccaacactcagcccactgcccatcagcagtaaggccaaaggaagaggaaattcctcacctattaacatggacaatgagaccatggggaggacagttcaagggtcttctggctttgcaaagggtcagatctggatcaccgaatacatgttggaagatggaatactgctttcctgttaagtccatgtatatggctctcatgcaccattcctgacaagggcagaccagtttttcttcagctaccacagtttccacctgagtggattcttcatagttgtactggaagaaatcttgaagagcattgagttcagggttcccttctgccccactatcagactggggttcctagataaacttgcccctctccaaattttcatctcagagaatggccatttcatgcttctagttgtttaggccccaaaccgtatttttctaatgcaccatatgatatggtttggatttgtgtccctgcccaaatcttatgtcatatcataatcaccagtgttggaggaggggcctggtagaaggtgacttggatcatgggggcggacgtcccccttgctgttctcgtgatagcgagttctcatgagatctgtttttttgttgttgttgttgtttgttttgttttgttttgttttgagacaaggtctcactctgtcatccaggctgaagtgcagtgtggtgtgatagctcattgcaacctcaacctccttggctcaagtgatcctcccacctcagcctcccaagtagctgggaccgcaggcatctgccaccatgcctggctaacttatttttgcatctttttttttttttttttttttttcgtagagatgagttttgccatgttgccagactgagatctggttgtttaaaagtgtgtagcacctcctccttttccccttccccctcctcccagcatgtaagacgtgcctacttcctcttcaccttccagcacaactgtaagttttctgaggtctccctagccatgcttcctgtgtagcctgcagaactgtgagtcaattaaacctcttttctttataaattacccaggcttaggtagttctttacagcaatgtgagaatgaactaatacaccatatctaatccaacagcacatcctgttggatctactttcagaatagattcagaatccaacaacttcttacctctgccactgcaataatctcttacatggaggtcccagtgggtgaatgggaactgaaacccaaccctgctccactggctgagctgtgtacctttctccaaggctgcacccacctggaagaaggggcacccttttctatatataccaagatgccctctacaggcatctagcaacttcccagtagttcgtgttacctctctgctcaaaaccctctcactcagaagaaacgccaaaatctcacaatggcagcactatggaacttggcccaggtacctctgtgatgccatgtccttcagccacactggcctccggcgagctccgcctttacactcactattccttttacctaaattggctaactttcccacatccttccagtttcttcacagggggcccttccctggattgtagcaccccaaccctggtgtgtccatctctttggccctccatagccacatcctcatctactgtgcctaaaattgtgtcccctaaaagttatattcaagacttaacgcctaagacctgtggatgtgaccttgtttggaaataaggtgtttccagatagaatcaagatgaggtcatacaatcaagatgaatcaagatggattcaggtgggcctaatccaaggactggcatcctgatctggaggctgggatgtccaaggcacttgtgggtttggtgtctaacaggagctcggtctttgtttccaagatgatgcctcgttgctaccagagaggatggatgctgtgtcttacgtggtggaaggggcaaaagggtaaaaatgggcctggctggttccctccagccctttgtaagacactaatcccattcatgagggctccaacctcatgacggaaccacctcctaaaggccccacttctgtgactactgccaggttggtgattacgtttcaacataggaattttgggggacacatttaaactgtagcagcaaggagcacaaaggattgcagaatccaccagaaatggagaaggagaaagacctggaacaaattctccctcagatccttcagaaggaatccaccctgctgacaccttgatcttagacttctggccaccgtaactgtgagacaatacatttctgttgttttaagccaccaagtttgtggttctttgttatattagccctagaggaaacaattaccccgtccaccatacaatatgttacttattaatttgcttagggtctgcctccccattaggagggagaggattctgtctgtgtttattgccacgtctcctgtggctggcatggggcctggcacagagtagatgccacaaatacttcctggaaaaatgaataaaagttcactcagctgaacctggtatgtgggtctcccagcacctcctgtggccatttctgatgcatcctccgccactcccacctgcagcgggtgactgactcttcagtgacagaggagctgcacacaggtggcgaaacgcatctcatgtggacgtctgaacctagtgcctgcccaggctgctagatacctgagactgtgatatggtttggctgtaatcccacccaactgtcatctcgaattgtagctcccataattcctacatgttgtgggaggaacctggtgggagataattgaatcatgggggacggtttcccccatactgtccttgtggtagtgaataagtctcacaagatctgacggttttataaggggttccccctttcacttggctctcattttctctcttgcagccgccatgtaggaagtgcctttagccttctgccatgattgtgaggcctccccagccatgtgcaactactgggaaagtgaggtgcagaggtattttgcaacgtgcccacagaaccccagcgagcccgtgttggagttacaactgtgcctcagggagcattctcaggcagcattctcttatgcttcaccgtctcacagatgataaggtttcattcaaggacttacaacagcaacccggagggagcattctcagtggctggtagatgccatttgtactgagcaggacaattaagcccaattctggaaaaattctgctttctctattcaatgcattttataaatgtcttcactcagcacatttaccctactaattatattttgctttgtgatcatggtatgtcatttgcattccttcagcacacactgactgatggggaagagatgttgggtgacccaggcaagccaaacaggattaaagcctgctgtctcaccaggtggataatccactttgaacacttgagaggggagtgttgagatcacaccccttcccatgggacatttttctgggaaataaaatcggtgacaaacaccacgcttgaacactcacattgactctagggtgcaggctgagctcatctggtgcaggggagtaatgcagaggcgaggcctgagtcagcgccaggcacaggaaggggatgcaggatgcaccacagcccatgcctcttaggagaaaatctgggccttctccatggctgtgtctctattaatttgctaaggctgcccaaataaagcaccacacatgggcagcttacataacaggaatttattctcagttctggaggccggcagtctgagatcaaggtgtcagcacagctggttccttctgaggactgtgcaggagaatctgttccaggcctctccctgaacttctgggggtcactggccatatttggcattccttggcttatagaagcaataccccaatttctgccttcatccgcatgtggcattctccctgtgtgcgtgtttctgtgtccacatttttcctttttataaggataccagtcatgttggaggtctaccctactccttgatgaccttatcttaactagttatatctgcaacaaacctatttccaaattaggtcacattctgaggtcctgggggttaggactttaacatatgaattttaagaggacacagtccaacccataatagtaactttgtccctctctctcttttgacacaataatgaccctatgcagggatatttctaggtggctactgtctgtgtgtgtgtggtagggggacttctagtactgttttggattactgttgacagacagcagcctgaggctaggaagcactttggggccatgacttagagcaaagctagtaagttttctcaggaatttgaacccagaatttcatccccatggcactttaatccagtacatttaatggctcagatgaccctggccttatcagcctggtgctctaagcagctgacctaacagtgtgtgcatgcgtgtatgcacatgtgtatgttatgtgcatatataagtgcatacacataatgttggacacagaaatatctctgagaactgtccctttatcacccttcagataaaattattctcagcttgcttagttgcagtgtttcttactttgcatctcctaacactttcatacatttctcccgaagtgcataggcaaggagcttcaacggaattcaatgtcaacctggtcatcttaccatgatttctaggaaaaaatgtgtgtaattggttcatgccctccttctgtacagattacaattctccttttttggcatgaaaacctccatctgtcttttgaaagcacatgtcacttatttattaaagtcctccccaacttgttcaggttgagtttcactagtacctttctggagtattttatacctatgttatagccccatatgttatactttggatgtctgtttacctgtctgtaagactgtctgcataattcatgggccttgtacaaaataagaattcagggactcttgttacaagaaactattaagaatttcaagatgggtcaggcgcggtggctcacgcctgtaatcccaacactttgggaggctgaggcgggcagatcacgaggtcaggagttcgagaccagcctggccaacatggcgaaaccctgtctctactaaaaatacaaaaatgagctgggcgtggtggtgtctgcctgtaattccagctactcaggaggctgaggcaggagaatcacttgaacctgggaggtggaggttgcagtgagccaagatcgcacggttgcacttcagcctgggaaatggaatgagactccatctcaaaaaaaaaaaaaaaaattaagatggagatagcagaaccatataggaagtgtggggtccttgtaagagtgtggtccataaacttggctttgtctgtctgcctggttcatggattgtgactatcctcagttccccagtgcccatcattcaacaaatgttagatgaataaatgaatcaatatgtgaatgactgtaagaataagcttttgatgaaaggcagccattttgtaagcaagacattgctgcttttaattgtccgcagaaagcctcacagaatcactgcggtgagaggaaaaaaagtgtctgcatgcaa

SEQ ID NO: 578 - DNA, 1997 bp, Homo Sapiens
ggaagcgtggtaggagaagatgcctgtgcatgccgctcatgtttccagcagggcaatgtagatgcatgtcaggaaagatgattagatagtttagaaccagatccttgtctgagatggaaactgcagctgctaattaagaagagtagagctcgaggaagccgccagctgccagcctggtgctgcctctcctgcaagtgtgaagtgtggctgcatccagaagcactgaaaataattgattagaaagagaaagagactgaaaatgtcataaatgaggagataattggagaaaatcattgtgaagaggtatgaatggatggcaacacaaatggagtaagacttaaagagatataagcctaccaaatgctgacatgatttttgtgagttgtgaagatttaaagaaatctgtttgaataacaatttttgaggctacctataaatttgtgttcattacttccactaagcaaggttcttttgattattctttgatcattgaaatgttttatattttatttaatttacagcaacaaaaataactcttgagaagaaataaatgtgaacctatggagataattatttagtaatgtttgaaatatatgatttagaacatttcattgcacttattaatgagtataagaatattatgaaaacagaaaaataatgagccttgtaagagttcacacaattattttatgtaattggtattctatattcaaggagagcttgaatgcagaaattaaagaagcatatgctcatttgaaaagagacaaatctagtagtgtaattaaagcttgtgccttataacacaataaaaatattcagaaggattttatccttaattgtgacataaaatgatttctaacctttattttttgagtcagaaaaaacggaggaagcatgggttcttctttgctatatgaaatcaaagtaactttacaaatttgaagtgcttagttatctaaaatcatatcatggaaagatatatatttatattttgattgttttatgtatgtaactttttaaagatcagagtgatctgggcaagaaaccagtgctatcagccagtattgcattttgtttacatgtaatagaaatccaactaaacaaggattttattttcatcatgttacagaaagttaggatataggaagtccttccttgtagttgctcaaggaaatcatgaaggaccaagtttattctagcttcctgctctgccacctttagcaagtggacagtccccctacctctcataggcaatgaacttcttcatatccaagcatgtgcttagggcagaagaaagggattggtgagaacaaaaatcacatgccagtgaagtctgttcatcttatattaggaaataatagctcctgcaaatgtcttacttgataggcttctaccactggaactgcctcacatgactaccactagatagaatggaatctggcttgatgagtatttttaagtggatacatttacttcctaaacaaaaccaatattctattaataaaagagaaaggaagaaagattcttgtaaggcagctaatatttctgtcacacagagaaaaacaaattgataatgcagtacaaggttgatattttaaggtagagatttttagcttgagcatttagcatccatttgttcttttaatgtaaatgtcaaacaaaatacaaaaatcgtatgtataattaccaaaaactatttaaaagtaaatttataattcactcaatagagtaatatagattaaataatttttgtaaaatttaacgtgtttttgctttcaaaaaatacaaaagataaaaaaagaatatacagctaaacagtctatatggaaaaaaccataaaagtgtcaaaagtaagatgatggcttatgaaaattacatttttacatttatggatgtgacctgaatgtaaatgtaagtaaattgtaaatgtattataaatgaatgtaaaaaccaaaataaagttgtttattggcaagattgatttaaaaaaaagaaaa

SEQ ID NO: 579 - DNA, 3547 bp, Homo Sapiens
atactgagactaaggtagaaaaagacacttccaaagggtgtcaatgacaagagagaaatagacatagagtggtcacttcatttaccaaccctggaaccgcagacctctgggcttcctgataaagaaaatgggtacggccaagaccatagacctagtgattgtcagatgaacaattagacccacagaaccatccaagctacagaggacgcattctgccttcccttggatcctgtggtttgaggatggaggtctaggaccgtggcaggctttttgtcccatgagggaaggccatggagctgaggaaggggaagaacacacacacctaatggaatctcgagagaaagttcagacatcaaaagacagaagcgacagagacccagatggagtctcacccagcctggagtacagtagtatgatctgcaacctttgcctcccaggttcaggcgattctcctgtctcagcctccggagtatctgggattacaggcacgtgccaccacgcccggctaattttttgtatttttagtagagatgggtttcaccgtgttagccaggatggtctcgaactcctgacctcgtgatctacccgccttggcctcccaaagtgctgggattacaggcatgagctaccgtgctcggccatgcctggctaatttatatatacatatatatatatatatatatttttttttttttttttttttttttgagacagagtcttgctctgtcacccaggttggagtgcagtggcatgatctcggctcactgcaagctcgcctcccaggttcacgccattctcctgcctcagcctcctgagtagctgggactacaggcgcccgcatgacgcccggctaattttttgtatttttagtagagacggggtttcactgtgttagccaggatggtctcgatctcctgacctcgtgatctgcccacctcagcctccgaaagtgctgggattacagacatgagccaccgcacccagccttatatatatattttttattagtgaagaggtttcgccatattggccagactggtctcgaactcctgacctcaggtgatccacccacctcggcctcccaaagtgctgggattacaggtgggagccaccgcaccctgcctaaaatgcaaaagattttgaatggcgagaatggcgacatgatgccacaagtggaaaattccacacctggctgcatgtaatgggttgaagtcaaaatgcagtcaaaaactttgtttcatgtacaaaattattaaaaacattgtataaaatcaccttcagactatgtgtatgtgaaacctaagtgaatttaatggctagacttcagttgcattcccaagatctctcattatgtatatgcaaatattttgaaattcaacctggttccacacattttagataagggatactcaagctgtaattaacaaataaacttttcacagtccaagcagccaaaggcccactgtccctgttccctcagctcacgcccccttccgtgcacagccttatctaatccttctacccttcgttgtgtttggacttcagactctttttttttaagacaaagtcccgctctgttgcccaggctggagtgcagtggcgcgatctcagctcaacctctgcccccaggttcaagcaattctcatgtctcagcctcccgagtagctgggattacagacacccgtcaccacggctggctaatttttgtatttttaatggagacggggtttcaccatgttggccaggctggtctcaaactcctgacctcaggtgatccgcccccatcagcctcccagggttttgggattacaggcgtgagccactgcgttcggtctggacttcagattcttgagctggctgcaagactccaggtcccctgtgaaccacactcaataatccctccctaatcgctggtccccagcagctcagattggctgctgtttgtccagtgaggaggtgggcaagggtgcccttggtttatgcccatgataaaaagaaaagcagctatggtgcagtagatgctcagaactccagcgcgcatcagcctctagagaggggcctggcctctgcttgaacagtgtatttctttctctccttcctggacatactgcaatcaaagcattttctaagagtcgggtgggactccacagatggtcttgtccaatagcctcactttgcaggtgagaacaatgcatccaggccaagcgttttttcattttactgcccgctactctccaagtgcagtctcttaacagtttctgagtctgaatgcaactcttgttaactgctcagtaaaggaattctgtcaggaaagctgcagtttacatcagtggttctcagccttgatgacacattgaaatcatctggggagatttacaagctactgacacctgggtcctgctcctagcggttctgatttatttttgtttgtttgtttgtttttggagtttcactcttgttgcccaggctggagtgcaatggtgccatctcggctcactgcaacctccgcttcccgggttcaagcgattctcttgcctcagcctcctgagtagctgggattacaggcgcccaccaccatgcctggctaagtttttgtatttttagtagagacagggtttcaccatgttggcctggctggccaggccagtctcgaactcctgaactcaggtgatccacccgcctgagcttcccaaagtgctaggattacaggcatgagccaccgcaccaaggctactgatttattttaattagggtgcagcatgagcactgggatttttttactccccaggtattcccaatatgcagccataattgagaaccactagtcaatatggagtgtgtgtgtgtgtgtgtgtgtgtgtgtgtgtgtgtgtgtgtacatttctaggtatgggtgatatttgcatgcagcacgtatctgtgcacatagacacatacacacacggaaatctggacttcccaatacacagagtaatacatgctgaggtcaccagcaaagcaggacaataaagaaagtgagaaaaaattttgagagccagacacggtggctcatgcctgtaatcccagctttcagggaggcagaggcaggaagatagcttgatcccaggagttcaagatctacctgggcgatatagcgagaccccgttctccacaaaaaggaaaaaaaaacaaagaaaaagtttttagaacatgatatttaagaaacaaaaaagtcatcatggagaaaataacattttttttttttttttgagacagagtctcactctgttgcccaggctggagtgcagtgacgcgatctcggctcactgcaacctctgcctcccgggttcaagtgattctcctgcttcagcctctcgagtagctgggattacaggcacgtgccaccatgcctagctaatttttgtattttcagtagatggggtttcaccatgttggctgggctgatctcgaactgctgacctcaagtgatctgcctgcctcaccctcccaaatgttgggattacaggtgtgagccactgtgcccggctaaaaatcacattctttattg

SEQ ID NO: 580 - DNA, 1728 bp, Homo Sapiens
aggtgggcagcagggcccttcctttccccacaggcagggaacacttgtgtttcctttgtttacttctttagcttatgtcttccgcgatgaaacggtaacttcctgaacgctctgcagttcatcgctacactcttcctccatatctagaacgtggcctggcacatattagatgctcaatcatcattttaaaataaacgagtagtgatccattcaagtaacgtggataaacatcaacaacaacagctgctttcaggaaaaaagggcagactctgaattatgaagaatgtgagaaacttagatcagtatcatgaagattgtgtacttttactttttagggcagctttattgagggacaaatcacccattttattttttagttttactgaggtatgattgatataaaaaatggcacacatttaaggtatacatcatcatgagttaagacatatgcatgcgcccatgatgccatcgccataaccaaaggttaaatatatccattaaatatatccatatctccagaaattgccttgtgctattttgtaaatcatccatttaaaatttataattcaggctgggtgcagtggcttacacctgtaatctctccactgagttcgaggcaggagggtcacttgagcccaggagtttgagaccagcttgcacaacatgataagactgtctctacaaaaaatttaaaaattagccaggcatggtggcgcacacctgcagtctcagctattcaggaagctgaggtgggaggatagcttgagccagggaggtcaaggctgcagtgagccctgatcataacactgctgtccagcctgggtgatagagggaaacccccatctcaaaaaaaaaaaaagtgctaatttctactagacttctcgttagttactgtatcagaagacatgtaaaaattatagggcagatcatgagtgttgaaactttgaataattgtatttccccaagtgtttatttttgcaatctcttgttataatttgcaccacttccttcccccagattatgtttgtgcttgtttgtactggagagcatggaagagctcacaggagaaattgtgcctccttcgccatccaggggatgttgtataggaatcaagagcttggtagacagaagtcttagaggcggagctgcctagattcaaattctgactctaccacttcctagctgtggcaagtgactaaacctcctacctaagagtcacgcgggctggagtacagtgtcatgatcacagctcactgcagcctcaacctcccaggctcaagcaatcttcccacctcagcctctcaagtagctgggaccacagttctgtgcattctgtggcaagacaacaaatagatgggatgatttctgtggaagtctacaggtgacatttaatcatggctacagtatttcatgtgagcacaaagaacaagccaagactcatttggggaaaaaattaatcattcatctaataaatgtcttttgaatgcctgtcataaccaggaacagagccaggtacgtgatgaacaaataggctggtccctgccctgatgaaagttataggctagtgtggtcacagactatgaacgaataaacaaatacatatagacaagtcatcatccctcatcaattattttgatatcacaaagactctgaaaagtatttttttaacccctttagcagtaaaacctaatttgtattaaaataaagcattatttatttgtctatcca

SEQ ID NO: 581 - DNA, 8508 bp, Homo Sapiens
aaacccccctgtgcaagttaccttatctgtgcctgttggctattctttggtttgaaagaattcttccaaggatccaccctaactgcctgcctgactcgtttcttcctttcccctctcagtaagggagatgtttcctattatccttgataatgtgccatgaacatatgaaaaaacatagaaacatgaagaaaacaagaagacaaaaatcactaacatctggttggctgtatagaaacaaagctgattctggtctcgctctataccccaggttggagtgcagtggtaagatcacagctcactgctgccttgacttcctgggctcaagtgattctcctgcctcagtctcctcagtagctcggactacagcttgcaaatggatcttacagacgttgtcacagagacaagaaaagcatataaaaaaataaataaagatgagctcctttcaaggtgactgactagaagcagctggtgtgtgctgctctcacaaagagaagaaagagtggtgagtggaccatccaggtggacacattgggattcatcaaggaaacaatacacagaaaacagaagaatgagacaggacaatcattcacccagaagtggcatagagccgggagatggccctcaccatggttagtaagtgagagtccccagggagtcacatttctgccacagacctttgcaaccctgggcccaggcgatcccccatgacacccgtgccccaccagggcctctggactgacatagacagctacatggagtgtgggcagaactgccactcaggcactcatgaaatccttggagcttttcatccccaggcaccctggtaccaatggctgcagctgcggcaatgggggaggacaggctctcttgcatgtcctcagaataggaacacaatccatggggctaagcagtgggtggactgtggggctcttctacacagcccgttgccagactggcctgggatcctagcatggtcacaaaagtcccacctgggctcttgaggaacagatctgtacttccctggcatggaactcctggaggggatgggcaggctgctgtttttgctgctccacagccctcactcctgttgccctcagtcttgggagtgagcacagtgattggggactaacatagacccccagcacagtgtacagacttgcagaaaagcagccagactcttttccacatgggtcctcacccctgctactcttcactgggcagcacctcttgaccttggcccccagcacaaccaacccgcccccacatgaacgctttgtcagtgatggctctgtgtttctctgaggagaaaaatccaaaagacaatccataagccttctgctattgcagctgcagtggtatggcccttactaccttcaggctggggaaagaacgaaggacttggtccttacactggcccctccagcacaccatcgccaccatatggagaagagcccagtctctcttccccgtaagcccccactcaccactgttcaccaggcaaggcccctagttggggacagcagagcagctgtcctacccccggatgagaattcccactgctattggctctatattttcctgaggtgggcctcccagaagcaattgacatcccctctgtcactgtcatggcagcagttctgcccttactgcactcagactggggaaagaacaaacagcctgaggtcttcactcacactcctagcacaacacagtcatgatatggagaggagcccagttgttcctcctggtgagcccttgacctcctacttttcatcaagtgaagcctccagcttgggctagcagcgtagccaccccacccactggctgaacattctcagtagcaatggcttgcgtttctctgaagtagggctcccagggacaacggaaagcacctctcccactgccactgcagcggtactgccttgctgcccttggactggggaaggggcagagaccttgagtgcttaacccacatgtccaggaagtgacagctgccctaaggagaggaggccagtctgtctcctctgtgagacccctgccacccttgcgcatcaccaggcagggcctccaggcatgggttcacaatgtagctgccccaatcccaagcccatctctccaattagtagtggctctgcatttctctagggtggagccccaagagacaagtgaaaggccctctgccacagcaactgccaaggtcccttcccctgttgccttcaagctggggagggaaaataaagccttagctcgcccctagcagcagtgtgcagcccaggagtgccaaggccagaccttaagccagcactggagtgggaaagggagcccacactttcagagcactgagagggagcatggctgcaatcatgaagaaatacagaggagccacgtggtggagcaagagcccacctactggccattacacttcagtgccatctactggatcatagcccaaactccaactccaaaaatgcttgctaatatacccccctctgtgaaaacaacgacaagatttcaacaacaaagaccctgcacaaaacctcggccctcaaaaaacattcaaaaaaggagtctgcactcaattacaccacagttaaaggagcatcagcccacacagatgagaaaaaactggtgcaagagctctaacaactaaactacagtgttttctttcctccaaataactgtactagttcccaaggaagggttcttaaccaggcagaaagggtggaaatgacagagagagaattcaaaatatggataggaataaaggtcatcaagattcaggagaaagtcaaaacccaatccaaggaatctaacaattacaataaaacaatacaggagttgaaagacaaaatggccattataagaaagaaccaaactgatctgatagagctaaaaaacacactaaagaattccttaatgtaattgcaagtattaacagcagaatagaccaagctgaagaaagaatctcagagctcacaggcaacatctctgaactcagtcagacaaaaataagaataaagaagaatgaacaaaacctccgagaaatatgggattatgtagagaccaaatctatgactcactggcatccttgaaagagaggaggagaaagcaagcaacttggaaaacatatttcaggatatcatctatgaagacttccccaacatcgctatggagaacaacattcaaaatcaggaaatgcagaaaatccctgtgagattctatataagaagaccatccacgagccacatggtcgtcagattcttcaaggccaaaacaaaagaaaaaatgttaaaggaagctagagagaagaggcagatcacctacaaaggaaacctcattaggctaacagcagatcattcagcagaaatcccacaagccagaagagattaggagtgtgtattcagcattattaaggaaaagaaatttcaaccaagaatctcatatctagccaaacttagtttcattagcgaaggagaaataagatcctattcagacaagcaaatgctaagggaattcagtaccaccagacatgctctataagagatcctgaagcaagtgccaaatatagaacagaaagactgttactgaccactgcaaaagcacactaaaaacgtagaccattgacactgtaaagcaaccacacaaataaagctgcataataaccagctaacagcacaatgacaggatcaaatcagcaaataccaatattaaccttgaaagtgaaggggctaagtgccccaatgaaaagtcacagagtggcaagttggataaagagcaagaccctggccaggcaggtgactcatgcctgtaatctcagcactttgggaagctgacacaggtgaatcaagaattcaagaccagtctggccaacatggtgaaaccccatctctattaaaatacaaaaattagccctggacatggtggtgctcatctatagtcccaggtactagggaggctgaggcgggcggatcagttgaacccaggaggcagaggttgcagtgagctgagatcatgccactgcgcttcagcctaaaaaaaaaaaaaaaaaaaaaaaaaaaaagcatgatccaactgtatgctgtcttcaacagacatatctcacatggatccataggcttaaagtaaagggatgaagaaaaatctaccaagccaatggaaaacagaaaatagctggggttgacagtcgaatttcagtcaaaacagactttaaaccaacaatgatcaagaaagacaaaggaagacattacagaatagtaaagggttcaatacaacagaaagatgttactattgtaaatatatatgcatccaacacaggagaatccagattcataaagcaagttcttagagacctatgaagagatgtagataactggacaataatagtagtagacttcaacaccccacagacagtatattacacagatcactgaggcagaaaactcacaaaaatatccaggattcaaactcaacattgaccaaatggactcaatacacatctgtagaactctccaccaaacaacaccagaatatatattctactcatctgcacagagcacacactgcaaaagagaaaacacaattagccataaaataatcctcaggaaatcaaaaacaaacaaacaaaaacaaaatcatacaaatcacactctcaaaccacagcacaataaaaatagaaattattacttaaaaaaccctcaaaaccataaaattacatggaaatttttaaaagccctgcttttgaatgacctttgtataaacaataaagtcaaagcagaaatcaagaaattttttgaagttaagaagaataaagatacaacataccagaatctctgagacacagtaaaaacagcattaagaggggtgtttatactgctaaatgccacatcaaaaagttagaaagacctccaattaataatctcacagcacacttagaagaactagagaaatcagagcaagcaacctcaaagctagcagaagacaaggattaacaaaaatcaaagctgaatggaaggatattgagaagcagaaaactgtacaaaagttcaacaaatataagaattgatcctttgaaggaatagattagatagatagacccctagtcagaataataaagaaaaaagggggaagatccaaataaacaaaatcagaaatgacaaaggtgaacactaccactaaccctacaaaaatacaaaaagcccctagaaactactgtgaacacctaaatgcacacgacatagaaaacctagaagaaactgataaattcctgaaaacatacaacctcccaatattgcaccaagaagaaattaaaaccctgaacagaccaataatgagttctgaaatttaatcagtaataaaaagcctaccaaccagaaaaatcccaggaccagatggattcacagatgaattctaccagacatattaagaagacctggtataatccctactgtgaatattccaaaacatttaggaggaagaattcctctctaattcattctatgagcccagcatccttctgataccaaaacttggcagacaaacaacaataaagaaaactacaagccaatattcctgatgaacaaagatgtaaaaatcctcaacaaaatattagcaaactgaattcagcagcacattgaaaagctaaatgaccacaatctcttaagctttattcttgggaggcaagaattggttccatagaggcaaatcaatcaatgtaattcattatataaacaaaactagaaacaaaaatcacatgatcatctcaatagatgcagaaagggcttttgataaaattcaatgtcccttcatgttaaaaactctcaacaaagtaagcatcaaaggcacatactcaaataataagagccatttatgaaaaattcacagccaacatcatccagaatgggcaaaagctggaagcattccgcttgaaaactaaaacaagacaagaatgccctctcttattatttttattaaacatactactggaagtcctaagcagaataattggccaaaagaaaagaaaaaaaagcatccaaatgggataatagaaagtcaaataatccccttttgcagacgatatgattctatacctagaaaaccaaatagtccctacccaaaacctccttgatttgataaacaatttcagcaatgtttcagaattcaaaattagtgttcaaaaagtagcattcctatatagcaacaatatccaagctgagagccaaatcaagaacacaatcgcattcacaatggccataaaaacaataaaatacccaggaatatagctacgcagggaggtgaaacgtgtttacaatgagaattacaaaacactgctcaaataaatcagagatgatgcaaacaaatggaaaatccccccatgcttatggataagaagcatcaatattgttaaaatggccataatgtccagagcaatttacagactcaatgcttttcctatcaaactactaatgacatttttcacagaactagaaaaaaaaaactattttaaaattcatgtagaaccaaaaaagatcccaaatagcaggcaatagtaagcaaaaagaaaaatgctagaagcatcctgttacccaactttaaactatactacaaggctacagtaaccaaacatcatgggtttggtacaaaaatagaaatgtaaatcaatggaacagaatagagagctcagaaataatgccacacgcctacaaccatttagattacctttgacaaagctgacaaaaacaagcaatggggaacggagtccctatgcgataaatggtgtgggataactgactagccatatgcagaagattgaaactggatcccttccttacaccatatacacaaatcaattcaagatggattgaagacttaaatgtaaaacataagactattaagatgctggaagataatctaggaaatagcattctgggcataggccctagcaaagatttcatgacaaagatacaaaaagcaattgtaaaaacaacaacaaaaaacggacacatgagacctaattaaagagtttcagcacagcaaaagaaactaccaacagaatgatatgatttgactctgtgtccccacccaattctcatgtcaaattatagttttctcagtgttggaggaggggcctggtgggaggtgattggatcataggggcaaacatcccccttgctgttctcatgacagtgagttcttatgagatctggtggtttaaaagtgtgtggcacttaccccttcactctcttcttcctgcttctgtcatgtaagatgtgtcttcttcctcttcactttccaccatgattgtaagtttcctgagacctccccagccatgtttcctgtacagcctgcagaactataagtcaattaaacctcttttctttataaattactcagtctcaggtagttctttatagcaacacaaggatagacaaatacatagagtaaacacacaacctgtagaatggtgaaaaatatttgcaaactatgcattcaaaaaaggtgtaatatctagaatcaataagaaacttaaacaaattaacaagcaaaaaacaaccccattaaagagtgggcaaagacactactcaaaagaagacatacatgtgaccaacaagcatataaaaaattcttaatgtcactaatcattagagaaatgcaaatcaaaaccacagtgagataccatctcacacctgtcagaaggactattattaaaaagtcaaaaaataacagttgcagctaaggttgtggagaaaagggagcacttacacactgttgctgggaacataaattagtttagccattgcagaaagcagttcagagatctctcaaagaacttaacacagaatgaatgaccagttgatccaacaattccattattgggtatgtactgaaaggaatataaatcattccaccataaagacacatttatgcataagttcactgcagcactaattacaattgcaaagacatggaatcaacctagatgaccattaatagtgcactggataaagaaaaagtgataaatatacaccatggaatagtatgcagttataaaaaagcatgaaatcatgtctttttcagaaacatgtatgctgcaggagaccattatcttaagcaaactaaagtagaaacagagaacaaaataccacgttctcatttataaatggaagctaaccattcagaacacatggacacaaggaagagaatgttagacaccaaggcctacttaagtgacgacagtgagagtggggaaaggattgaaaaactgcctattgggtactatgcttattacctgggtgacaaaataatctatacctcaaaacttcatgacatgctatttacctagataacaaacctgttcatgtacccttgaacctaaaataaaagtttaaaataatcctgaaagtaggtaactaaagtttagagaaaaactataaaggagatcaagagataatctagttaatggaactgaaataaaaagtattcaaaataactccacttatatattataaaatt

SEQ ID NO: 582 - DNA, 17978 bp, Homo Sapiens
agcggccggtcggattaaaagtaaccagactcgtccagaaaactgcgtccaggaaggaagtgacagaagacgaatgggaaaaggagaacagctcacagcgtttgaaacatcgcgtaaaaaagactgggggtggtgggggcgggggggattgaaggatactgggaggggaggcgggggtggtagggaagacggagcacgaatggttggggttctaagcagcacgtccgatgaaatgtcttttgcctccttttttccccctttatttaattttgtccttgcctttgcttcgcgctgcctttttctctccgtctctctctcccccacaatcccaaaccgttgactctttcctcgcgagctggagaaatcatcagtttcactcttgcaaaaggggggcgggactagacctcggagcattttaataaaacaaacatacagcagctccctcctcacccctccagtctcaactagattgataaattactccactacactactttaattatgtatatggtatgcagaataaatcactgaacatcagtacctcaatcaagcacttttaaatgataattgcatcttggtgaatcaatctttccattcctgacattttgctaattttagttttacggtggggtaatagcacatgccatacgcaaacctaatgacaattctttattgcacgaaatgaagacaacacggcgagctgcggctccctgctcctctcgcggcgcctctgcggaggacgctcggagagaacctagtctcccgctgcggcgcgctcgcttgctctccggggacgctgcgagccagccagcaggaaagtccttctaaagtcgggatctttcctctgaccaataggagcgcgaccctaatagttgctcttgtgacttttcccccttttggacacgcgttagccacttctctcttccaccggtcggtgcgctcctccgttactcacgcgtaaaaaccacggtccaggatgtctgcagcactcgattccagcgtgcttttcctgcacgcccagaagtcgcggttttcaccctgagaggttggagcgctagaaagcgagccgaaaggtttctctaatgttagtaatgtacgaaataataaaataattaccagtatttgagatctcgacttcatcgcggggccatgaactttctaatcagtttggaaatatttaccgaggaagcagcttcctcggagttccccccctccccccactctatcttttccacaccttactggacttcatccaggtcattaacatgtaaaccaaaccaacttcccaaatgcattaggctaccctagccgatagctgatgacttcacttatcctgaagagtttcagctgcacaggaagcagaaatagagactgataagggaggatacttatgttaaggttaaagcatgataaacacttttccttacaaaaaaaaaaaaaaaaggctttaatatttaggctactagagattgggcacctcccgccctaaccaactgttaatatataccatgcccaataaagccaaagataaaatacatcaactagtatagaatcatgaaaagacaagattgcatgccagtagaattatagattacataaaatgtttaaaccaaactattttttaaaaaatattgtgaaagcaagaagggaaaattaatagaacatggaatatatgagattagacaatagtatattgaaatatctagctaactaaagatttcctcactttagaaaattccttttagcactacgtttaacccaatgactagttgtatttcctgttaagttcagcaatatgcctccagatgactattttaatatatgaggacagtatggttcaaaaagcctcctgcttcaatgtaggaggtatttgatgtgagtagcttctctcagaagagtggcctcaacatttaggcaactgtcccaaggcttcacttgaaaggggaaggtttattttataggcaagtacaactagatctgaacaatcttcaagttccagctcatcattgtgactatcagcaaaactaagaccattccctcccttttattataggaatgcatcacaaactgtcacaaagcaaaaaccatctgaaatagtagtatttcttgcagattagtatttacaatgtattttgtttgccggtttttcaaatgttgagtttgccattaccatgaattcattttaataatatggcagagaacatctgtatcaggtttccattcaaagtacaacttctctgaaaatccaaaaatttaaagggcaaagatatttcgaatactaagatatgtctatatatggtggtaaaaataaaattaattttcttcaagattcacgaaggtcctgaaaaagcaaagcatttgaaggaccatctaagtttattgccataatacctaaaattaatgcagtgagttacaacagtctatttgacatgagcaaacacatagccaatacatgaatttcagccctgctgtttttaatgaattatagagggtatttctgtttaccacagtacacttcagttttagatgttctttcaaaaagaaattattttattttaccttttcatattttaaataattatttaataatacccattataacaaacccataattattaatgatactgcaagcattcaaaaataagtataaccccacactggataatttgaaaataatttggatctggaatgtatcacagttggccttttaaaatacaggattttcccctcagcagatttagcttcttaattatgtgtgacctaagttaatattaccattagttttcttcccatgagcctttacagttgaagcagaagagatatgaagaaatatacattagaaaatcacctgagatttaaaattattcatgagtaatccacaaagtagttaatccagagtgtgctttgtattctttaaatacttctggacttttggtttctgtttctgtttttgttttttctttaaaatcatcctgatccttgccatctaatgatacttggttaggatcagactattttctcatgtagggaggagcttgtactaggtgtcaggagacctggattctctatctagttcaaaatttgtgccttactaagggatttgtcctttctaggcttcagttcgcttatgtgttaaatgagttctgtaacctattccagttctatcattggaaaacagaaaatgtttctaccctttaaaccaattggaaggtagggtctatccagttaaataataggtgacaattcctttaaaagaaaattatgtctgggattgatgtactactgtaccagcttttatttttttctaatcaccaaatatttctcctacattaagttgtaaatgctttattgttaatgtaaatatagagtcacttgtttttccctcaaaagaattatgtttagcaatatatttaattaaagtgtcatagaagttacagagagcatgctcctcgggattttaactccagggaaagctaatattgcaatttctgttcagagctgcataccatcttactccaacctcctctcttcactacttccctacattaaagcagcggtccactaaagccctgtgcactgggtctgcctgcttttaagcctggcccacgctgggtgtagctcttgaagtgagctttaaaaattattttaaagtgaactggggcggttgccacagcaacccaccctgagatgaagaaaggctatagattaatgtaccccttaagattattcaactgtatagtatttgttcctcagccagaatacttttaacacaaacatgataagtgaacatggtggtttagaaaaatctaaaaagcagtgaaacacaaattccaatagcattacatattttaatctttgtctaattatagtattgatgatacacaggacttcccatgaaatagattaattttataagatacagtacttgcaaaagtaggccctgaaagatgacatgatctttaagcaaaatgatatgtcattgcttataatataaagtgtatggtggtcatttaactctttattattgttatacacgtctattctgtaaatacctaaggccaaggagtttggcagttttacctttatggtaactctgtggtaaatgataaaaacaaatgtgagcactcaccacatacacttctttactgccacaatcatttgccttccgttctttacttcatctcttcatagaagttacttcacagtttgcaactcttctttggcaccttcaaatgtggaagtgcaaaacagtatatagtattttgttaatgctgatatgaaaatactttcaaatagatttatttctaaaacttctaatctgaagtaacaatattctgattttaaaccaaagtgttttgaatataagacaactgaaattgtcatgcattgtgataataatctttaacataaatagtgccaaatatctaaatttcaaaaattcactaggtgcagcattaacccaagaagaatatacagcatgtggaatgtctgtgattgagaatttgcaatatacaaaggatttgttatttcaagacaaggtttacacatatctaaggattctatgtttatctgtatttctgtaccttcagttttatatctgatagagaattacagaagaatgtcaaatccattatatccgaagctaacacaatttgtcaaatcgggaaatgtttgcaatgcagttgaggttactgaaagggcttattttatgcattgcctaaaggccaatttaaaatactttgggattagtgatgtgtattcagtacggtttataaattctattaccaataataccttatttttccaagcagtgtttaactatactgagcacagacaaatgctcctgtgttctgatttctgttttagtctggctttccatgactttgtgcacacaaatgaacctttccttggcttcagactgaggctagtcccagaaagagaaccagccttgagacacatcagaccaggatggtcaatatctcttttcccatttgtaatagcaggaggactttgcatagtgaagaatcatttataaagcctctatatttgggttgacatctctgaggtttatttttaagttgcttcagagtcaaagagaaatgaaaaattttggccagttttactttatgggtgttagttgagtttaggtttttaggcttaggcccacagtgagtgagtccaaacttggtcttgtagtcactaccaagtgatttggtgagttctctttcttccagttgtgcttcattttacagtctattaagtgagaatcataatacacatctcccagggcctattcaccttatagaaatgcaatcttcatgaaataacatctgaaaggtatggtaaggttttttttttttttttaaacgacactacaaattatgatacatttctttcttttcctgtaatcagtatgtccaaataaggcttgatcagtaatttgcttgcaagtgtgtggctgattcaaaaataaccacatgcatgaataaatttaatgcgactttacctttacttacaaaattgttaaatgttgttcatcagaacattgattctatcccatttcttgaaatatcacagaaaccttcaattcaaggaatggattttcacacttccccttttaactgtttcttctagataccttactatgtgtgtgctttttcattttaaaaaatctttacccggggttgtggtggaagtggggattaaaaatctcgtcctgcgttttggtgcccacttctttgtttggaaagcagagcgctgggactcaatccggacggccctcaaagacccagacgagggacgcctctagtttgagcaactcactccgctgagttattgattgcaggcagcaacaatccctccggttgatttgtgtgaaaagtgaatccgctctggctgggcgttcagcagaggcgcaacagctgcaacgccatccaattattgccgatcctcccctccaacactgctctcatcacctatatactcttctctctgcccgtctctgcttccccccccttccccccccccttttctcccggccgacggagctgaaggggcgggggttccttccttggagtgtttctagagctcggaggctgctggtagggggtgagtgcgccacgtgcgtgcgccacgggcgagcaggaggcaggctctgggccctcctggggacctgctggacctgctggacctgggtgcgacgagtgggcggccacgctggtttggcgcggggaaggaagggggtgtgccgacttgtatttagttgggggttgtggaagtcacggctgggggaaaagcgtccggtggtttgttggtaaagagggtgcgtgatgggctctggggaatggaggagggcgcaacggctgtgggtggactgtggaaacgggcggtggcagtgccggggtagttgtcctgctggtctggttttgggatcctgggctggagaaatgcgatccaaaagagctcgggatgggctcagagcgacccacgaaaataccaggggccaagtaaaatgaacccaccctttaacagtgcacaaagcgctggcacacggtccacgtctggtgacgcaggctgcccgaagcgctccaaccattttgcaaacctgggagagcaagaggggctctgcaggtctagccgccgcccctgtcccactctggccagccggagtttttcacctgacagaccaataggaaagaacacgggccccaaactggattttatagtctgagctctcagcatctaaggaattatatttcaaaaaacaaaagccaactcatagctctattaagctaacgcgtgtgcgagttttggctaggaaaaagccacaaagtaaagcaagaagtagggtattcaggataaaacacacactttaaagacaaaacagaaaacttcctttccccttgtaccccctttatttgttaacacaggggaacggttctgggatgtcttacaaaaatgctgtcactaaatgcagatatctgtgctgttctttgacctgtctggcattgtggaatactcaattacatcgaaggtgtaaaaacgtttatgttatcatgttcttgaaacatttagcggctaccaagatggtagctatttaaattaattaaaataagataaaataaaaataaattctgtccctcagttccactggccatatttcaagtgctcaatagccacatgtggctagtggctcccttactggacagcgacatgtcaaacgtttccatcactgcataaagttctgctggagaatactgctatagagttcaaaatgaatgctggttaaaaaaagaaagaaagaaagaaattactttatgactgataccagccacattttaggacactcttggagtttctgttacttggcactagtgtgagaagctttaaagtcagactttcagtatcttcctgctgaaagagaccttggggaacacttcacccagacacctaatttttttataggcaagagaaatcaggcccagagaagttaagtgatgcccccaaagttatgtcataaatttggaaagaagataaggtcccctaacagggtccagtatactttgtgccagacaaggacatctttctaggcaaattcatcttacagaaagtcaacttgactgaaaattttaggcaagagtacccttttacaagaaaaaatactgctaagtattcctccaggaagaaattccatttaacaaagaatgaggagcatggggaataatactatctcccaaactaaaaatgtattattggtagtgtcatagattcatataatgccttttctaagaggctaattgggataacactgtgcttcattctactttaaaaattctgaggaaatgggattatcctcttaaagagctaaaaagcattcttaaggtcagggaggaaaggtgtcacctaaagtgaaaatttttagcaaagcataatctttctcaaatttgataaagatatcggagacattgattatgatataactaggatggaattggctcagaaatgttaataaccaaccaaccttttttttttttttttttttttgagacgcagtctcgctctgtcgcccaggcttgagtgcagtggtgcgatcttggctcggctcactgaaagctccacctcctgggttcatgccattctcctgcctcagcctcccgagtagctgggactacaggcgtccaccaccacgcccagctaatattttctttttttgtatttttagtagagacggggtttcaccatgttagccaggatggtctcgatctcctgacctcgtgatctgcctgtctcggccacccaaagtactgggattacaggcgtgaaccactgcacccggcccaaacaaaacattattacaaattacactatctgaaacatataaggcaacagaatacatcataaagatttagacaaagcataagctttcttattagttttattgttttgttttgttctgtcttttgggtttgttttgtttttaatgccatgtttgtattctatatatcttattgttaattaggagtgaactgttggtattaattctgctcttttatagtagttaccttttaacttaacacttagttaaggatccccgaagtgtccaaataagagtacttatgaatattaaataattttaaattaataacaataaattattttaaaagtgtagatttacatttttatttgaattattgtctttattgctcttcttaatttaccatttgcgtgtggttcagcattcttcccattctccctaaaatccagtatccttagagaaaatgtttcacttcttcaggtgcttgtagacatggaagaaggcctcaccttctccatggctgacaaccgagaaggctggtctgacttggaagaagctgtgtggccaacagccaattggctgtatcacatggtaactgtttgattatgcatatggtttaaatctccctttgcctcagtttcctcatttgtaaaatgtggaacaaaatgtgctatcctcaaaactttgtttaaggattaaatgagctattcagcataaagcacagggctggaaaagtgacaaactgcggtaaaaattagccattcttaatctaatgcaaagaatttccacttctataccattaagttctttattcacctatactggggttatcacagcagaaagaagtaggtcatccgagaggtgggaattggttcaggatgagatttaccttggaagaggtaaaatgttttaaaataccatgacttaagtgtacaggttgccttatttccctttcactgacatcatgcctctaggatattttttcttttttggggggatgctttattatacttgttagccacttggttgctgaaaaggcactgaaaactcagagtctatcctcttttcaccctggttgacctttggaatgctattgtcagccaagatgacattgatatcttcagtctccccctagcttgaattctttaggtcagagtccgctcagattgtctcctgatgtcattccaagtgtctgatggccgtctatggcaactgggttgggcaaaagcctgctgggaaggggtagcccacagaatgcctaatggagcgttctgttcaagaggacctagaagtagttctgttagacatatgatcaacactacagctgtgttaggggactgtaccatttcttgaaaaacagaagcatagtcattttgcatttttggttctaataaagtcccacctgagatgtttatgatttatactgattttatgattaagtatgtattacagaaaaaaacagacttagagaatgtcaataaaaattttatatctgatattcacgctaacactagttattaagtgaagaccccaagttaagacagaagagtttagaaaagaaggaaaagagctaccgcatggcaaaatgtacattattctatctttctaggtatttttctttttctttcttttcttttttttttttatggagtcttgctctgttgcccaggctggagtgcagtggtgtgatcttggctcactgcaacctctgcctcccatagagatggggtttcaacatgttggccaggttggtcttgaactcctgacctgaggtaatccgcccactttggcctcccaaagtgctgggattacaggcttgagctactgtaccaagccatttctaggtaattttttaaatgactatgttctacttatctggatcttacaaaattatttataaaatattttatttataatcctaaattttaaaccaagcaatataatagaaaatgttatgttttcaagaaggtaagatcatgcatagatctatatgctttcaatacgtaattttatagaaattgtggaacaaggaggcacataattatatcaatattctaatttcttaggaagaaacagaattttcactgggaggagtttctaaattattttgtaatatggtgagaattaaaagtaaaactcaataaaacttttaaatttaagtgagtgattaaaaccagtttgtttcaccaaagtactgattgagtcaaagactcaaacaaaaggccagatttcctacggactattacttatttattcatttatactaaatgtgtagttaaatcttttaaatcagtaatgttcttagtcataatacaatgatatctggagtatatatgcaaaaataatactatcttattagaatgtgggttgaaatgaatatttgaagtacctaacatttaatggccacatactatttgtcaggctctgtattaattgctttataaacttttgtttccttttattcaaagaacaaccttttagacatgtactattattgtccccattttaagattttacacactaaagctgtgagtgctgacatgacctgcccagggccacatagttcctaagtgccaaacgacataaaaccaatgtgtttgtttccaatactctacccttagctatgatgctatactgcttccttgtattcataacgtttgttcacttatagtgataatataatagatatttttgtcccaccagaaaatatttcagaaatacatatctaaaggcatgtcatcctctttaaggtagacactttagaagactattcatttatttcagtaatgttgtctttgctcaagtctatttagaaatctcctcagggatttgctacacagtcttaaaactggcctgattgttggcaaatccttatcattaaggatgaattttttccaaaagtaaatccaagccaaatgtagtaaacaggatgaaaactaagatttgagtataaagcattagattatttgatatttgtctcataaattgacactaattgaagatataaaagaggaatttcaaagtatttttgatatgattttataacctttaaggagacagttttgacaagtaacactcgtaaaaggtctggtatttttttaaaaaagtcattttcactaaattaatagttatagatcatgtataaacagcatgggaaatgttcttttcaaagagtataaaatgggcagcggagggtaactaggaaactctggagcagaatccacgtttagacactaaataattgttttgaccttaattttctaaatgccctttttgtaaaatggggaaggtggcaggaactacccatgataatgattttgccgagagaagcacatgaaattgtacttctgtggccacttagtgcctcgcatatagaaaattctcaataaatgttagctattatataccatttcactttcaagaaataccccatattcctggaaaacatctcaatgttgtagttatgtaatgatattttaaaagatgttttcttttctgtcagtttcatgcttccaaacagttattttatgtaaagtatttgatatataaagtaaatataaacatttatggtcgtatgtttattcagttaatatgtattatatcaagaagtcttacatgttggactgctaactatattatccttgtcagtgttctatataatattgtctttagataaacttttttggggtattcttattggatttcatcagacttatgaaagtaatgacatacccatttgcccagaatgatgctccaagattttattttttagttacctcagacatcttctaaattgtttattcattatataatcttaaatttaagggaactgagcataaatatgttgaattagtggcttcctattagatcccagtgaactcctcttaaaacagggctcttatctgtgtagcatatgcgcagttgtgatgttgtgaaagtttgtctttacatcactctcttccctatactcaccttcagcaggccctgctttcactttggcatgctccactcacccagcagcaatttttacaatcagtaatagctctttcacgagtgcttctttctcctctgggccttccactgatgcgacctacaaagtcctttcatccctcagccgcccctttatgtccgcggaattctttccaactatgttctatcagaggagccggccactacagccgcctaatccatgacacggtatcattgtgcaatcactttaaatgaacctctcttcaaaagttttctgaaaagaattcataatccaaaggagtatccatgcttccacagataccctgctgtgttggtcaggtggtgttttagggagcactttcagtatgtctcaggtccctcccaccagcagccacttcatttgtccacacagatctaagccttggatgcaagcaaatgggaaacctggcccttacttgaggaagcaattttgtttttgaaaatgttgggattggaagatgaactctctatcagcaaaatattaagatactccttgaaaatttatatacttaaaaaattgtacattgcattacctgttcccctggtctctttttctattccctctttgcaatatgaggcaggcagccactgcgtgtcccttgtaccatagtgactatgttgtcactcagacttaccctgtgtgctctcccttctgccccaccaaagccaccagaggtgtaattagtgattatttatccagaaatgtcttgaacagggtttaagaactctttgaagagaatatgtaccacttgttggatgaaagagagaatttgaaacggttggggagaggtttagggacagagggcaaatttcattctgccttctatctcctctattaaatcacagataaagcatcttcctatgtgcaaagacagggtacataaacaaatatttcccaacttagtgtagtcttaaatctttaaataaagagtatccatatcaaatggaatgcaattttatattaaaaatcatcactcaagattcaaaaggaagaaataagattctaagtaaaagattttgaacactactaaagtaagaaacattctacaactttcttattccttttgacccctttagcaaaggctaaatagctagccaacagatttcctcccaactattccatttaacttcctttcttccttccatctgtcattcattcattctttccttccttccttcatcttttctgcttcctcttttcattttcaagttgtaaattctttagtatcagttgtgaactcagtaaagctacacacacacacacacacacacgcacaactggttattaacaggatttttcctttgcgttggaaaattacattttctgtttcagaaccatagggtattattcttttttgatttatcagaatcacttcaaaataaaataccttcactaaaggagcttatttctaaacaattgatgatgcatgttatagataatatggtcatagaataacttctatgattattttttgttattaatcactgtaattactctatgattgcaatgatgattaacttacaatgaataaggtctgtgcttgtgttggttatatagtatttgtgaaggatttatgttcatgcatccacacagtctcatctcatccttacgtagccgtgagattctagtctgtgtagcctacggccgcaaaataaactcacccacaggagaataaagcctatggtttctctcacattatcagtgggctataagctcttaaactccacaggtcagtgatgattaactgagcattctaaaacttggtgaatgtgtatgctctacactctcatacgttccataataagcactgtctgtattgtttgaatgactgtcctgaagagttcgctcaagccgttttatcacatttcaagctgtattatttagcatcttaaacttaagaaaaacttaagaatgattttttttctggcttttcactagtatttgatgacacttattttccagtctacataagataattaaaataaatgaactactcaacacagtagtgtttaattatagcagacaatacattttaaaaggtaaagtctatacttgtgtgcatatgctccctttcatcttttgggacttgggatcactaaatgttagttttcctgttactgtagagcaggagaactgatcctcttcacaaaagagggctccttgtgaggatgttaacagtctagctcaaagaaccaaagtgcctcagaatcacccaggtgcatgttaaaatccagattcatgggccccacctcaggcccacttagctgcaatctcaggaatctgcattataacaggctcctcaggtggttcttccatagcacttatttgcatgctactctcttaaggtgaggggaagcataagatccacaggtccctctaatgccataatttttttttctctccgtttgttattcactcctgttctctccactaatgttcacaaattttgtggaacttttaaagtcatgagaacctttcaagatagtaagatgaatcttgattcaaaattgtaaacaagaaaaaaagacatgccacaaatattctgcctgttgaaattagaaaaccagttaagcaatatggaaacctaattatctcaaatttctgtacaattcttcatctttacttaattgagggatagccattatcttttcttggatggaatcggttcattgggtcctgatacctctgcaaaacctgtaaaatgggcttcagatccagggacctctaccattggtgataagtgactcccaaacattttcatccttcagtgactgccacctgctgtgagcctagactccaggaaaataggactggcactggtcatagtcacttgaggaatgtggcttctctgtaaagagattttcaatcaatgcagatgttccttgtgacctcagtaatcacctccatctgccaagcagtcataaagggcctgcacatctttgccaaccttgtcaacagagtgatccatatcttaggtctttaacctcttttgtattaagattttttaaaaaatacattaatcatgttttaattctgtcctcatgaacataaaaatagcaataataaatgattattactattgcaaaagtattgctttagtttacaagttttccttaaaaatattgaactccccagctgtatttatccattctttcattccatttattcatcatacataacctaaatacctatatgtagcagacatattgtactaggattcagatatttttaacactgtttcttgttccaacattttcctgacataaataaatatattatcatgctggcttacagcattgtgtgtggagaatatctttctaagtttaaaaattttcctgtcattctataaaattaaaaatattaaatgaccattcagtacttttttgtcaattcagccttatagtgcatactgaaaagttcaaagcttcgtgtcataacataattttgagaatgagactttttgtattatgttactagggtccccaagtggaaaaaataaggcctgctgctctggagtatattgcaaagtgattttgttttccccactgacttcacaggctagatagtgtgtcagttttaattacttggaatgcttacatggtgggctacttatagcaatagggatagggtggggcccagtcattgcagacaggaacccaccaataatattccagattccttttgagacttcctcacatgaaacagaggaaatatctttcattggataactaaaacttactttcctatgatttgtacaaaatggccaaaaaggcccatccattcattagcctcacagaggttaagtgacttgtttccagtcacaaaatgactttgcagtgaaacagagagtctaactcaaatcttcctacttctgctctggtgctctttgaagaacactctttaactctaatgaggaagcctctatgatccttcaaaagcagataccggacaagtcacttattttcactaaaacccctttgggatgcagggcaatgattaaacttgcctatctttcaaattgctagaaatggatgctatttactattttgcttgcaattgatttgcatactgttattacatattgttaaatggtttgttgattaatgactaatgttgatttggactaaatgtaatggaataagcaaatatattttcaaatttagatatacaatttagttgctaaatggtgttgttagtcataaaaatgttgattattttagatcaatcccttgcaggggaaccctagccacaatttccctccatattttttctcaatattttaagctttaccccatctctttttcttattaatttacatgtctgggttttaaagctaatacttcttataagcaagtactgttccaaagcccaggactaaaataaattcttataaattcagaatgtggtagatttcaactaaacagtttcttttctggagatccagaagacaaatatttggcttgaatattaatattttcatgaccttgaccagatcaatatattgcacaaatattatcaacaaattatataaatagaccatatttactaatataattaataattttggaattaatataagatagttatatatacacacacataagctagtcagttgttaagtcagttatatgaactatataatgtattatgcacttgatatatacatatacttatgtgttagtatattttgtatttttaattactcccaatcttaaaaaaaaccctatattccaacttatatttttgatttctacatttatcttctaaatatatgtattacctttgataatttttttatttctgctatttcatatacattcataaatatttccagtttggaaatccatttaaatggtaagacaaataaaaaacttttgtaccatagatgttttagtacatttatagtctttgtattttttagaactacattttaatatgctgtgataaaaatgtgtatttctctaacaaggtattaaatttggtgactgaaaagggttcttcaaaggaatataattcacattaattttccatgtgatcattgttacttatagtttactagtcaacatgcttaaagtctaattagaaaaaaaatccctggatattaagttgggaaacagacccaagtctgtatctacataaaggtcaccaccttggtgacctttggtaaatttcatttttgttctttgatttcattttctttgaaaatgagaagctgaaagctttaaagctttcttcccataactccgaaatagtttatgagctcaaaagaaaatatgactaaaagaaatgtgtgggcatcattacctggctgcccagtattttcatggacacagacttgtaacatattctgaaagttcctttaaggaaaataactctatagatatggacagcaagggaaaagggatcaataagaaaaagaaagggaaatgagttaatgacaaaggaggaatggtaggcagtagaaatgattccccacttacttgttttttatctatagtctagttattcctatttgaaaacctactggcaccaggtattatcaacagggatgagtaatatgtaatttttatctttactgggttacatttggcacatggacagttgacagctgtcagtcaggtggctggtcaatgaggagatacatataaagctgcc

SEQ ID NO: 583 - DNA, 21197 bp, Homo Sapiens
acttgctgagcgttcagagatctgtcagggccagaggcctctgggtagcctaggctaggagatgacacgcaaggtggcacgggcggttcccgtggggaggaggtggggtggtggtggggggcaggggtgggagcaagaggttgtggggcgacggtggagggtttgatgggaccaaattctggaacattcgggactgcggcaccttacggcgggaccaagatttgggtctgcgcaggcggcgatgggtggtccgacgggcttcaggacttgatggcgtaacccccttcttcccccacaggactcaggagagtgcagcttgctctgtgagtgggtgacaacctcttggcgactcaggctcagctgaggatggtgccagtgtgccggagacagccgtcatactgccggatagagtggctcacttgcatgtatttggaacaaaaaaaggagatgcctggcagccccgctctctgcagtaagtattcatctgcattcttttacattcctttatttcttcgaacatcagaaatgggtagatgtttattgagcccagccacctgctatgccttctccattcttctcccacacaccccacccttagtcctccagaagagaggactagattgattttctcatgctactggatagctgcagagaagctagaatttgctgttcagcccccacacatccccctcacatttgggagaagttgattttccctaaaatggagccaacagcctgtgtccctcagtgtggagtgttaatgggctgcctggaaggaccctgtgtgccctcacggcccccagccgggaagtgaggctccccattggctggcagtgggaggatggtccttgccagcacctagcatggttctctgccaagttctagctccacatctccaggctggtaggaacctagactatatatagcattgtgctaagcaattcttatcagacgtgtctgccctcccctgtgggagtggagcacttctatcagagaaccagaacctagagagcatgagccatctccaagggccttttattctgggaaggggtgtgtgtgtgtgtgtgtgtgtgtgtgtgtgtgtgtgtgtgtgtgtctgtctgtctggttcagggctgcttactttcctcctgtattgcagatgctgatagattgaaaggtcgtgctagatgaaggtgctgatgtgggatgagggccaggaagggctaatagctctgcgatggatattgagcttagagggagagaagctaggggcatgtgacatggctgagggtacagttgagccctgcctccgctttctcttcctggtttcctgtttgccatgctttgcctaaggatgtcttttgacctctctcttccttctttcggacctcttgcattccctgccttcctccaccacttcctcctccctttgattttctttaggatatatgagggcaaacacagtgactggcatcctgggtctgtgtctactcttcatccttacccatttggggtttctggagatctggctccagttgggcagagagggctcagctgtcctctggaggagttttggtggtgggtgagcatgttgtgttggctggttcagggcagggtgggttggatattcccctctttcctctcataggtgctgttgagccaccaatttttgtggttttgtgaccacaagtgctgactgatgcgacatgaccccagtcttgtcagtgaatcatcaccaggctgcttactggaaactggatgcagcaaggaaataggatttaaccgctctctgcctcccaggtaagtccagtgtgggctgctccctccagccttcccccatcctccttccttcccacgaacaccattttccttattccgccggggaatcctcagacgtctccattcagaatctcccaaacgattgttctcttttttgcattcttctccttctggcttttctgtgtggggttagtaaccagcacagggttgggggcagaatgggcagctgaagtggtcgggctgtgcggacgtgtgggagatagctgggtagtgttgctgggtgtggcagttggcagagcatttgggcctcccacagtaatagaaactctctttggctccagcatccagcaggaggttctgggtttaacccctcggtaatcctgggagccttcctggtgcctggggattctctcccctgtgtagtctcagtggatggcctgtcttaactctagatacattttgccttgagggggcttagtctaggttggtggtctggagtttggactgggctgagcagtgagctttgggactctccctaattttggggtttctttgaatgagccactttcttcctctaggccttcattacctttgccttaaaaaacaaaatccctggtccagtaagccattgcaaagcatctctaggaagttgacaaagaaatgcttttcttctgcctcacttgctgccgatcacagtaatagcaatggtgattaaaaatgaaaaatgatgacggcctgcagaatcagggaggtcagtggcatcattgatacaattcacaaagcagactctcggtgcccacacatcactaggaagtctctctcctatcgagtagatgactacagcattcttggccagtaaagccagttggaattagccaacagcagattggtctgggctctaaagataaaaggaattatgttgggtaattttcggaggtacctatgggatcctacctctggccacacagtggtcgcctctctctgctcatatgtttcggtgggggtggggggttcctcttccccatgctgctcccgttgctatccagggaagattggccaattctgcttcctgttatttcttcttctcctctgtccatttgaggtgagtctctaggttggctgtgaacagcctgaggaacccagggctgtttggaagaatctgatgtctcttccttcaaggaccctgacaggtctcagccctccagcagtactgcagtgagggatggcagggggtgttggagtggagagatatcgacttgggtgcagctggggagactaaaaggagtgagccaagtccctcaagaagtgttggctagagtctggccagccctggctgtagggctggagccagacgtagctgctggctgtgcttgggagtctcagccctcatatgtgcagtgtgtccctgggcatggctcttcgtgatccccactcccacgaatagccctgtccttggttagattgggaaaaccagggtgggaagtaaaggggaggttggttttgctcgtggtcatgcagttatctctctggcctctgatgtttccagaattgggattggtgcttccctgctgattttcctatttttgtccctcatctggttcttttcctccttgctcaccagcctgggttctacacacatgacatggggcattgtgtgttcccaatgaggatagcagaacagttggtatctcctgagagaggggccagcatatctggcacttttttcttgacctttgaatttctgaggtctgggagtcaggaggcagcatggggcctctccatccgggatccagcagaggttaacagagttggtggctctggagctgaggtggtgtggcttggctgggagttgtgggggagaggccctgccaggggccctgattggtcagtaccttctctattccattgaatcctggtccggtcagctctgtgaattgtttaatgcatatcttggctctgtcccctggctcgagtgtccctaaggctgcagccacagctttagagaggatctgtaccttgtgctggtcactttttttgggcgtgttacctccctctgagatatgtaagagataccaccctttcccaccagccggctgtctgtgggaggccctcattttgctttgcttttctgagacttggagtgactgtgaggaaagcatggactgagtttgctttcttgctggttccttccacaagagctgctcatgggctgataaagccagagaacacctccagggccccatggcctgtgcggagcctggtaccatagtgtcaagcctacagggatggactggggacatgggggcagatagagccacgtggggaggtggtatgtgtggttagatcacaggagcaagtccaggagggtgtgggaggacaagtccagtgctcagccagggctgcctgtcatggcccaggatggatgtgtgcatctcctgtgaaggatttgcgtctgagtgcctggtactgaaggtaggatggtgccccgatcagggtctataatgaggcatgaaggtatgagatgggcatcagagttgttggtccaagggaaactgacctttttaaagggctctcctctccttatctgatttcatcctcagaacaaccatatgacatagggatcacttcccttttatagttaaagaaacagattaagtgacttaacccaaggttatgcatttggtaagtgaggttgttgagatttaaatgcatgcacttcttattccaaagcctctacgttatctttactcttttgggctgaagtcagacatttttgtgaactaagattctcagaggactgatgtgaaccagagtgaaaaggcagacacccgaaggaactttccagtcactggggacggttgtgccgcattcctttagggggaggcagggcagacccaaatgccctttggtagccatggacaggcagagctgagtaaggccagtacatggcgtctgctgctgtgtacggagcctctgctatgtgccagggactgtgccaggcgctagagatacagaacttgacaaagccaactttccactttcatggggcatacattctagtgtggagagacaccgctaataatgatttttaaaaagaatttaaaaatgtacagggtagacatatatggagattgtgtggggatgaaaagggggaccccccacacacataaggaggagaattcagatgatggtcagagggttctagagacttaggacctcagccatctgaagccacatcaattgagctttccttcagggagttaggactgacacaaactaaccccctcttttttcctaataacttgggaaatccatccaaggtccccatggcttacaggaacttgtcgtgagtcagggatcaaggtggagtagatgtcaagcctttggtctccggcagactggttctctcctgtctgccatggttgctgttggccttctgcctcacaccctcccaggcaccagctgacttctttcctcagcctggtcactgtgccccacacttgtccatgcagcacagggaaacgtgcaggttaggtctttgccgagccattggtcaaatgttcctgcaggaggctggttctgaactcagcctgtcctgccagaacgagccgttcccagagctaatcgtctcacgatagggaagggatgggcaccaggcatagagaagtgacctgtgccagatgcttggttgagctgtgtcttgagaggcggaggcaggttggtggtgctggggacagggcaggcatgtgtcatgtgttcagcgcatgtagctccagggctcgggacttgtttacttggtggaagaggcagcggacctgcggagtcaggccatgtgattgttggctctttggctgatcatggacagctgacccgccggactgcacacactgccatctgctgccaggggtctgaagttgcacagggatgaggtagtgtagttgggggtgctcagggaggaggagggtcaggaaagtggggtttgtgttgctctgtgttgagtcagccgaccctgattctggtcctagctcttgttggtaaaaactcactcactttcctcctttcagctccagtttcattatctatgaaatgaggggatggaaccagaatctctttggaggttccagctgtatcctggggcctccctgaatgttcatggagatgttccttagccagtaattcaagatgaggaaaactaggcccaggtttccacaagagaaggggagggatcttgatgacctgtctcagagcggctgaagtggtactgttggaattagggtgggtgggtgggaggaggtagtttttaaagacctcccagaagtggaagcagagggctggaggtttcgtgaaggtgttgatgaggatccaccgggtggtaggggacatggctacgcgcttcccccgggaggcttgttggagatgggtttatgtgggagctgctgggggtgcctgctgtcctgcaaggggctgacccaagggaccctgctctaggaaagatgctccgtcctgtctggccctaaaccctggagagagaatgcagctgtggtttgagggagggtctgtgccccttgctgtcaggaagttttcctttatatttagccttctcttttcatgtattttttgaggccctcgactaaaaaattaaatttaattttaaaaaataacaatgaaaaaaataaaaaataaacaaaaatatctcagagccactggttccattttggctttttagtcttgagtcactcttaaaaagatagcaaaataaaacacatgcaggaaagccgaaggtcccaggcccagccagatgggggctaggagtggctgggactctggcctagcttctccatggcagcgttagtcccagacgtacaccacttctgcaaggctgtgtgggtaggagcccctggggctgagggggcacattgtgcaatctgctaagcagaatgtagagttttaaaatagctacctttctccaagacactatctgcttgccgctttgtgggatgtttacctgggattaataatagctgagtgccaccccactgccagtatggaatagcaaacagcgatctgggctaggactcaggcaggagaggaatggagtaataaccatcgtatcagctcacatagttcttttcatacttgctggctcatttggtcctcacacaaccctgagagggtaggtggtcttatccttgtcgttggtaaaactgaacctgagagtcaatcctgccaagatctgactgcttgtagccgcttctcgtgggtctcccatctaggtcctctgacttcagctgttatttctctgggttctgactagtggggcagggacaggagtaggggagtggagtctttggcagtttccttaatttctgaaggccttagagggcctagagatgccttttctatgtgttgaatgggaaacggaacctcagcatgtccaggttctccaactctctgattcttcagacttcttggagctcttgtgagaactggcttgcactttttggctgggaagccagccactcaccatgtgttcttggagaggtttcctgtatttggaagcttctggaatatgtgatgcatcaaaccactgtgacacatctgtatggcacctcatgcctatgcacacaggcatgcttctgctgagtgcagctcacttagagatgaggcccagtgtagggtttttgaaatttttccaacacatttgtaagagatgccctgagccttgcccagcatgcatgttgtgtgtatgctacctgtttgctggctaatgtacagcgcctgctggaagccttggctaatgtacaatgtaaagtaagggactagaaacactggctttagttctgagtgtctgcttcatgattgacttgaaaaagtagggcttacccacagagagaaaggtgggtaagagaactcgtgggtgtcagttttccttaaaggcagagcataatcccccactctttataagggctggtaaggcagagtattggacagcaggacttcttggccagttagccctcttgagtgacctttgtttaaatagacccagaacttgtatgaaggaggaaataatggtttatctttatttacagcggatttagccatgatggtttaggctttttctgggggtattcctttaggacagttgaggttggacaggggcagcatgcatatgtgtctctaaatgtctgtcctttggtatttcctgaatgcatccttggctcatactgaaaccctgtgatggggaatccacagcggaattgttttagtggataaagccttctgtagcttcatgtgtgaagatttgtcatgttggatccagttcattctgtccacttgaaggatggaaaagagagtgggcagaacttgcagcaaggagagtgatttgggctagacttctgggagaactgtgcatcacctctgctgagggttcctgaggaaagatgaagcctctttatttgaggtaggagactcggtgtcctccacaggatcctcccagtcccaagtctgtggcactttgagacagtccctggaacagcatgaggtttgggtgccaggatctagagcaggcatttctctccatctttcccatctgtcttcaagacaggcccaagctggatgcaattgaggggatgcatgggcagggtacaccaatgtggtcatcgaatctggaactttgaccttgtttccctttgcagagagaacttctggcactgatcttataggaactggtgttatttgcatataaaaaaagagaaaggcatgttgtccctcatcttttccaggaaagagtgctgagctgctctaatcctatggtggggagggaggagggccgtgtagaggacgcaaggccagacatggtttgctgggaagaaggtaggaggtgggagaggaacatcccagggcaggcccacaactctgggagccacagacattgcctgctatactaaaggcaaagggatgtgttcaaataggcctactatttagcggtaacccacagtctgaaataaatcagttaatggctaaatgagagttgtattaaatatggaaaatcatattttttgtgtgtcatcaccacctacagatttagcatcaacaggcctgaaaggctgaggatgctgaaatgggccctgtccgtaagatcatgcttattttataatgactttttgtctcttttcattactatttcccactcttattccttaggtctacgtgaatatttatttatgcagttgtgttatttccttggggtacagttcttccagtgtcattggcatcaatgaatatgtgactttgatttcaagtgtaaacaaaccactggttcacggcagggacaagccatctctgagacaagggctccagcagctgcctacagatgcccttcccccaatagccctggactgtttcggccagacgcctgagacgagagtcaagggtgttcttgcagggacctgcccaacgctatgtcatgtgtcctgcctggagggtggtgctcacacatgcatcttccagccttattagctggtactgcttttcagcttgacccgaggagtggtattggaagtttgagaccgtacatcccttgctaggtgagaagggggtcagagaggtcaggcacagacagagaagggaacgcaggctcctggccactagcctctctcaagacaggtgaactttgtgttaagcgaactcatttaatattttgggcctaatagaagttatttgtattttctctcctctcttttccctcctctctctcactcaccctccccccactccccagcctccaaagaatttaatctgctggacaacaaacaatactgttataaaactttgaaaacaagagggcgcggcctccctgacaaggagaagggcatgttgggtaacggcctgagggagcgtgccaggcctgagatggagccgggcgagagcccagttggctgggtacctgggcgcctgcccctgcatagcccactagccgcgccatccccaggccagaggggaaggaaccaaaacaaaatggggggcagagaaacgcttgaaaagggaagttgcacatgttcccctctctctgatctgatgggaatgcactagactgtgaaacttcctcctccacctcttctcccgagtccctccctccctcttaccctccttcctcctctctcctccctcctttctcctccttcctcctcctgctactcactgttcttgagtctggcagacagaggtcctgatagcagaatgaggctggaatagcaccataggtgcagctaccagctgggccagccaaagaggaaggagagaaagtgggcttgcagttggctttggattcaaatctaccctctgtctggcccagcctccctccattctattagggaagtggaactacatcacgccacagggtgtgcccagtccatgtgtgtggaccaggtgtgtgcccaggtactggggagaactgccactcagagattagttcaggaagcaccctgggcttcctggtgccccccttgggctgtgctctgctctggggagagtgtttgacttgttgaaatgctctctcctttgagatgctgtgctctccctccagggaggagcagaggctgtgctgcaagaggctggggcatgtctctggaggagctcttgggaacaggaacgtgcttctcccagcgagagcagccatgccgtcttgtgagtgtggtgcctggtaggatactgcatctgttagttacttcccagtggctgaaggaagtggtcaccagctctgcctgggggaggtgggggagctgggctttggggcgtctccctccctacctccagagttaggtttcacctgagactgtggtttcacttttgactccatcttcactgagtcaagcagatgatttaggaatgaccagggagcagcattggtggtttgcctttggatctgcattggtttggacccatgaactctgtggtgggcattgtgtttgtgtaatagaccattggtatgctcatttttcctcttgcagaaagcactagctttcttgaaagcagttcagggacatgcccatccttctgtgccagagctgagcccttctactgggggaacatggagacacgcgagctccagtcttcattccactcctcctccttccctttgccctccactgtctcctgctgtccccccagctcatcccaggggcagggtaaccttggtgcatcctcccatccagccagcagtcccgacccagggcccccgtgcctggactgagtctggggtttatgtcagtagtgttaagggagggatggaaaactgaacttttaggagtgcagctgcctaggaacatagacctccatacctctgacgcaggggaaaccagaaaaaccgatgctgggtccacgtaggcttggaaggctgttactttttgccttcttacctgaataggaatttgaggggcactgtgggtttggaggatgtgattcccacactggggctcagggcctgggaaatgcagtggtccctgggttctgagtcctcctttgaaggccaccctgccagaaaggaagagcctgatggaggtttctggggactttgggccagccggtaactccatgctccctctgctccacccttggcccctcatgtgtataccattccttttatcacccttccctctgattcacagcccccaccctgacagctaaagacagaatgcccaggctgctgcctagaatgacaggaagctggactgccctttcagtttatacatgcaatggcctgggactgtctcttgagggcaagacattccccttttacaaaagagccttccccaggcccctctctcaccaagatgagctcttccttgctgccaggagccctgaaatcagcattcccagaggaaagaagatggccatctgggcttggcttccggctccccccatctggctggaacacacatcagtcacgtaagtagctgtgactcagcacccagcactgccttggcagaaccttcccacgttctggatttgcacacactgtggtagcgcagcacaagcaagcagggttaggtaactggggaccagtgtctgtttgttcagtgggtttgcctatggatttcagaaagaaggattccctcaccttcccattttcctcccatgttattttttaggtaccatgctaggctttaaagacaaagcatcatttatagaatgaagtagaagctgtctttgcagtctccaaactatttttaaccaacagcctatagatggtatttaaccctcaggtgtgtttggcctgcacgggtttttgtttttgtttgagacagggtttcactctgtagcccaggctggagtgcagtggcacgatatcagcttgctgcaacctctgcctcccgggctcgagcagttctcatgcctcagcctcctgagtagctgggactacaggtgccaccacacctggctagggttattttaatgtatctgattttgcatgcatttagacaaaatatggcctctccagttcactgtatttctgctgcatgctgttgctgcttctctgtctcaggtttcctgcccaagccctccgagcatttgaatgtgctgtgagcagcctacctcagcctcctctctttacacatgaagacactgaggcccattcagggcaagtggcaggtccctgttctcagagttggggccaagcaggtattaaaaccattgtgttctgattcactgtgtgcccaagcagattaatgccctggtgtgaggtcgagaagcctccaggtagaatgtggggacagaagtggaccaggctagagtatagctcccacacctttcccatgcgtggcagcactcgtaagactgacatgcccacccttctggatgggtggttttcctccccagacagccctgccaaccctttcaccttcagccagtttgtttggagtcattaggctgaggtgggtaaaacccatcaccctccttggatggcagagctctcagcaggctgggattttcatgggctgccttcttacaggtctaggtggccttcaggcatggtgccagggaaagcaagccccttccagcccttaccaaactaactggctgcttcctagtagggaacagccaccagcttgtttcagcgaagagtcattgctcagctgattctgagaggagaaaactggttctgttgggagggctgagacctgaaggaccccttttatccagtggaattggaaaggcaaaggatttcaatactaacatgatttttttctccacttcttttagagtgtttaattaaagtgatgcattgttaatggcttcttatctcttcttccagagagtaaagagttaaattttagaatccaggagtggggacccagactgtggcttctgttaactccctcagtggcagtggcgtcctgctatgcacagcccctctgctgtactccgaatggtcccttacgggtagcaggagagacattaaataatcacactgatgaccaagtgagataagtggtttttgaaggaaagaacttgaggctggcgaggaccacttaaccttctagcaagggctggactcagggaggctttcctgagctgcggggaggatgacaggttccctggagtggtggtgggtgggggcggggctgaggggtggtagccaagggagggtgaaggagagtattccagaagagacaacagcttaggcaggcaggacctcgccatggaggaaggtgctttctgatcactgcgggacacctgtgtgatagctcatagggagggggtactggtaactaaaagttgataaggaagagtggctaaaatgaaaagcagaaaagtgagaatctcatcaaatcccctcatttgacaggatttggactcccagtagtaactgtccttaaacactcactcctgaccttacaaccctggctgttacctggttaacaagccccaggtgttggctacaggtgtcatcactgagagcccttgtgtgcagatctgccccagctctcccacctgtgactgaggctagcaagtcccccgtgggctgtagagcctagcgctggtgtcagaatcgcttgttgcaggttcatcttcagtgtctttcccacagccacatgctggggaaagacggcaaaggcgctagaggagcaggagaacaaagcaagctgccccagaccacccggctttcgcagaacccagatgatgctcctgtctccccctaagtataacgtgttatgtagtcagtatgatcccattcagtgcagaagtatcgcctaggaatttcctgccccacccaccctgttttgttcttaatgaagttcaagaacaaaatgagatgatagtcaagttatggagcaggctgcagtggatacaagggcagaaacacagtctttggagttagacctgggatctgcattgattggttgtgtgactgcagacaagttatttagcctcattaaggatgaatttcttcgcaaaaattggaataatacctgccccatacgactgttgtgagaattaaacaccgcaacttttgatgttcaaattctatttcttctccttctagcaacacatactgttagtgccaggaaccataaaaattataaggctgtatctagaggcctgaaaggaagctaaaatatacagtgtctactctgtctcttttctcttggttatggtatcagaggaaatacacatattttcttagcttcaaaccaccaaaaaagatgatgcagtaaggagatgggaaatctaatttggaatacagtgtgcaaatcttattttcaagcagactttgaaaataaaactcaattcttacgttagaggattatctgcttaatacaattatagggtaccagtttttgaagtcacatcggggttaaataagattgcaggttcatggggtcatatttgaatgttctgatacttacatatggggtgggaaggaggaatgcatgcttttctcaagttaagacacataaaagagttgtcctggcccaggtgagactcgcctttgtgtagcagctggagcttcattccacaggcagatagggtgcttgtgtcctgatgaagtaagagaatatatctggaaacactttgtgtactgtgaaatactatacaaatgcagggcagtacaaatgtaaatattaatgtattttagtaataattttagcttttatttcatcatatataataatttgtagtgactggtgtgaagttaaatagaattaacctagaattaatgagttttgtattgctctcatctatttgaagcatcagctgtgcctttcatgttgccttgtgcagccctgtgtaacctcctctgtgcctttcccatggagcactgtgtcatatcacaagtagaactacaagaagatatttctcctcagggcagaggctgggtcttccgattgaatctcccttctttcttcattgagatcctcttcttctggaagctggtttcacatggtggcttagatttttccatctttgtatctagcaccatttgaaatcagtgttttaggagtaagaattgcagcacagccaagggtggactgcagaggaactgctgctcatggaactggctcctctcctcttgccacttgagtctgttcgagaagtccagggaagaacttgaagagcaaaatacactcttgagtttgttgggttttgggagaggtgacagtagagaagggggttgtgtttaaaataaacacagtggcttgagcaggggcagaggttgtgatgctatttctgttgactcctagcagccatcaccagcatgaatgtgttcgtagggcctttgagtgtggcgattgtcatattctgttggataacaatgtattgggtgtcgattgtcatggggcaggggagagggcagtacacctggaggaccattttgtccacatcgacaccatcagtctgctcttagaggatgccctggagtattcggcgttgattgcggggcacccgaaatcagacttgccacctggactgtcgaggtgcagaccctgggagcaccactggcccatctcttacacaggctgaccgatttctcctggtgttcagagtctgtttttgtctagcaccatttgaaatcggttatgatgtagggggaaaagcagcagcctcgaagcctcatgccaactctgggcagcagcagcctgtggtttcctggaagatggatgggcagagaatagggaaggaagatcatgcttttccctactaacttctgtaactgcatgtatgatacattattgcagaggtaagagatagtttaatggatttttaaaaacaaattactataatttatctgatgttctctagttgcattttgctgaaatgtagtgctgttctaaattctgtaaattgattgctgttgaattatctttctgttgagaagagtctattcatgcatcctgaccttaataaatactatgttcagtttatcatgtctgtgtttttcatctattatttcccattcataattctgtgatgataagaagtgggtcctgaaaaattaattggctgtgcagatcttgcctacttcataaagaatttgaagtaggttacagccagccagacattaaaaatgaagcccattaagagaagaatgaaattctatgagccaagaaataaaatgagagaaaagattagggaagagaagaaatgttgaagatcaaggctgagggatgctccctactgaatgggaaaactccttagttccacatgggctgtagacacagcccttctgccagcaactgttcctgcaaggaactggtgctcaactaaacatactgtcacatggttccttgaaggggcacagcactgatttcacttgcattataaaagattgagtggtgcttttgactattagtttatgtcaacacttcaaaacaagatgagccagtttttttttgttttttttttttgtttgtttgtttgttttagacggagtctcaccctgtcacccaggctggagtgcaatggcactgtccccgctcactgcaacctccgcctcccgggttcaagcaattctgcctcagccttccgagtagctgggattacaggcgtggcacctccacgcccagctaatttctgtattttgtagtagagacggggtttcatcatgttggccaggcttgtctcgaactgctgaccccgtgatccacccacctcagcctcccaaagtgctgggattacaggcgtgaaccacctcgcctggcccagtgagccagttttgtaaagctattcagagattagccagatttgatttgataggggatcaagcttgtaggatcttcaggaaggcgggctgtggccccttgatcaggctttttgcacaggaggtgcatgactatgaactaccctcagtagaactcttttaagccagtggcttgcaataaatgatggcaaatcagccacctaggaagccatttctaagcccaaccccctgccacagtcttcctctagatggctgccctgcccagtgggctgagagtggggggcggaagtagcatttgctgggaagacttgccagtacatatgttgcaccccctcactgcagctgcagtgctatttcaggctgttgatggaagaacccatgttctaatccccaggatgtggtgggaagaccctaagtggtggtgttagttaagaccctaagttatattgttttgttcacttcccactgagataggctacaatagtattaaatacctataggtcagacatttttggggtctgttgtactacctaccaattaaacagtttttgatccgcccaccacgctcaaagctccagcctaggtgttgcaaatacagacgacagatttttgctctcaggaggccctgattccagtcctcaaacgattacagattccagaagcctgcaatcagctcactggactgcaagggccacccgccctctcagaagcgccgggagagaacaggttttcttgccttcttcagctgctagagctgcgttctttggcttgcacccccttcctctgtcttccaagccagcggggcagtcttttgcttcagtggccatgttgtcttctggcacagtcacatctccccctgcctccctcttagaaggacccttgtggttacatttagggcccccacctggataatccaggataatctccctatttcaattttcttaatctcatctgtaaagacccttttgccatataaagtaacattcacaggttccaggtattaggacttggatatctttagaggccatcatacagcccaccacaaacagctccttaggcactcattagaaatgcagaacctcaggccccaaccgataccttttgaatcttctgattctaatttaagaagatcaccatgtaactcactagcacactaagacttgagaagcacgatgctatgggaacctaaccaaagaattctcaagtcccaacttaaatacaaatttacagagtatttttcctaggaacgctttcaggtggaggagattaatcagacgatagataattttcctgaacaccattctgaagtgcttctctaagcatttgttcctgaattctctctcaatgaagccacaagccccaaacaccaggattactgtttacaggggttcctgtttacagtagtttagcacagggtttgccacactgcagcatattattatagtttagttttgtaaaaagctacatgagagaggtaaatcttataaatggaggtggagtctcctaacaccagttttaccacctctgtacaggtttccctgggctatgtactatcgaatcaggaatcaggaagggcggctttttcaaatgttatctatacttttggcaatttgttcaaacgttctgctggtatgtgagagggaaggaaaaattgtttattgaccacagatccacaatattatacttctcctatacttaagcaataagggacagcatttaaaactcttttaaaaatgttaatcttggctgggcacagtggctcatgcctggatccccagtaatttggaacactgaggcaggcagattgcttgaggccaggagttcgagactagcttgggcaacatgcgagagcccgtctctacaaaaaaaaaaaaaaaatacaaaaattatccaggcatggtggtgcacacctgtagtcccagctgttggggaaagctaagttgggaggatcccttgaacccaggaggttgaggctgcagtaagctgtgattgagccactgagctccagcctgggtgacagagcgagatcctgtgtcaaaaaataattttgatttcacggaaggagaagaggactagtcttataccatatcccaaatgaaattgaaaatgtcttctgggaatcacagcaatgactcaaacttctgaatagtgactaggtttgagctggtaaggaagggattgtcaaatgccgtgacagtccacaggagggcagcagtgctccgatttacaaaggattagtcatactagtgtaaccttttctgagtgagcctagaaattctgatgaaaacagtgtagtccaggaaaaaaaaaaaaaaaatctgtatgtacaatcactcaattttgaatcatttctggaagttattagactccatgttaaatcctacttaagtacaagtatgcaaaatttaaaaatatgcagaaaagctcattcttggttaaaatgttagctgaaagacattactaagttttagaataccatagagttgactatttcccacaaaccctaaaatctacttgaacaccacaaattcatattccttctaatcccaagtcccttcagcattcttacagatttattgttagttaccttacaaagtaactaactgtccccatgtattttatcccaatttaaaaaatacattacagtctcaaggtcacataagattttccaaaatgctctattcatagtcaatataattttcaggccgggtgcggtggctcatgcctgtaatcccagcactttgggaggccaaggtgggcggatcacctgaggttgggagttcgagaccagcctgaccaacatggagaaaccccgtctctactaaaaatacaaaattagccagacgcggtggtgcatgcctgtaatcccagctactcaggaggctgagtcaggagaatcgcttgaacccagaaggtggaagctgtggtgagccgagatagtgccattgcactccagcctgggcaacaagatcgaaactccatctcaaaatatgtgtgtgtgtgtgtgtgtgtgtgtgtgtgtgtgtgtatatatatatatatatatatacacacacacacatatatatataattttcacctagtgttttattaaacagaatgcttctgtatttttatgtttatttgagacaatgcttctgtatttctaaacaacagctagccttgttcagttagccaaacaacaaaaccttaattcaagtcttcaatgaaattttctgatttaataggctgaattaagaaagccataattttcttctataaatataagcctttaacttctatctttacaagtttatatagaaaaatttactgtggggcttgagatttactaatgcatgggttttcaaccttagctgcactttggaatcatttaggacgcttggaaatccctacacccaaaccacatcccagatcaattacactagaaatctctaggggtgggacccaggtgtctgtaaatatcccccggtgattgcaatgtgcagccatggttgagaaacactgaagcctgctctgagaaatttagcaatccgacttaattcaaatctgcagagagagcaacaatgatttttgcagaaacaaccaaatcctactagttacataaattttatactttgttaggacttgggtttttatttagctctacatatgcgatcataggatgcagaagatatatcttctactggacacgtatatatagatgcttaaatgtggctatcccaaggttaggtaataataaagactataagagctgggcagaaatcaggcacagtttcatgaagggtaatatctgagctgggccttggaagatgcataggatctcaacaggacagtaggtgtttcaagcaacaatgaactaggaatacagcagaaagcacaggggaaatggtcaggcttgactgagagtaggttatttgaagaagtgcaatagaaaatgcttggggaagaaagttgggatttaattgtaaaaggtcttcaagtatcaggctaagaaatgtggacttcatccagtaggtaatgtgatgtcactggatatctgtgcagtatctatgtgatgggttgggagtggagaagcctggggatacttaagggtctgagctaggagggacaggaggaatggctgtgggagtggaatggttagaagatgggcccaattagaaacatacttcaatttgagacaaaacccactagaaataaacacatcatcatgaaacatctccaaatgtacaat

SEQ ID NO: 584 - DNA, 4122 bp, Homo Sapiens
agtgtttcctagagccatctgctgacaacacgaacattgggcatctgacagaggagaaatatttataaggtttagctccagtatcacaggcagagcaatggaggatggatttggagctgcaaggcaataaactggtaactgaacaaaaccagtccaagaagattgtatataagagacacctgataatttcaaaatcctaggcccacttcctgagctgagcaagcatgcaacctcaaagagaaaagtttgaggaaatcacttcaaggacaaaaaattgcaatgtaaagagaattatttatctccaaattccagattacccccctgcccaacccctgccagcagcaccgtccacatggtttctcatttagttttgtgttagtttaacaaagtagactctgcaatctggataaaatagtaagtcacctcaggtaggtgccaataggatgctcctttggacattgcagattttaagtactgtctttttataatacaggaggcatgtacaagtctgtcatatgtggaaatgttgtgaacccatcatatatacaatgtgctgttttagaagatagattgtccatttaggtgtgttataacaacctagatgggaagttactttccggtgtgttcaaagttccttatctgattctgcagaggctgggatctgagcaggtcactctatctctggaggcctgttacttgatgataaatactaataaacatctcccgtcagacatctcatctttttgtggattcctgtagtactcttaccctttctacaaacatgtaaataccatccattgatataatttttttttttttttcttttgagagagagtctccctctgttgctcaggctggagtgcagtggcacgatttcggctcactgcaagctctgcctcccgggttcgcgccattctcctgcctcagccacctgggtagctgggactacaggcgctcgccaccacgcctggctaattttttgtatttttagtggagacgcggtttcaccgtgttagccaggatggtctggatctcctgacctcgcgatccgcccgcctatataatattcttatttaacccttggttaatatattggcatcagtttgttttaacaacaataacataattatccctaataatcagcattataaaagctatcataatcgcttacataactacaactattatctagacaataataggttagattaataagaattcagtgttattcaacacattgctaaaatgtttccatgtacttttatcttataagctaaatcttaggagctgttactcctggaatagaacaatatttcattaatatatttaaaattttaaattagtaaacatttttctgagagattctgattctatggagaaaaaataatgtgatcaagaatttctattgctggaaacaaactaacaaatcatttagttcgaaagcccctcttacaaatgcaggaactgagctgattgactcttcatttaatgataatactattaacaggtaatgcagttttgaaggaaagcacaggctgaatacagaaatctctttccaagaggtggtgagtctttacgacaattgaatacgtgttatttttattcactaaaatttggctaagattgaaagggtaaactttgtgggtctttcaggagatcttttactaaaataagtagggccttaatcactgctgaatgaactttgtacagaatgggcccacaggcctcatctgttgtagctgggattgctttgagagaagtggatttgttgaaaagtggatggaagaacacaggatttagaattggcatatttgactatagcttctgcatccacctatctctgcgctatagaaatgattaaagagaagtgggaaaaattcataaactttatgattatttttaattttaaggaggacatgggacctttattaaaaaaaatattcccatatatgaaagattcttatttctataatggggaaatggcgagactatgaaaaaaaaaaaacaaatatgtaattgaactttaatgtataataccaaaataaactataggtcacctttggcagtatatatgtttaaaaataatttcgacgtttaaaatgccttaagagaggaccattaaggtcagattgagaagataaaagaattgatcttttagggtgccattctactctatagctctgtaatttctatggttatgatggttctcttttgttaaataaggacttatagaaattatttattttatctgtttgtatttatttatttgcctgttggtactagtcaactgcttccccttacttccctccacttgctacaactaatcaaatgtcatattttaagattatttaccaaggttgctttaaatttttgtctcctttttaaagtgtgaaaattatttattttaaagttagcattcatttcattattccttctttaataaagtatttattggccgggcacagtggctcacacctgtaatcccagcactttgggaggctgaagcgggtggatcacaaggtcaggagttcgagaccagcctggccaacatggtgaaaccctgtctatactaaaaaaacaaaaattagctgggtgcagtggtgcacccctgtaatcccatctacgcaggaggctgaggcaaaatcgcttgaactcgggagacagaggttgcagtgagccgcgatcacgccactgcactccagcctggatgacagagcgagattctgtctcctccgtctcaaaaaaagaaaataataaataaataaataaataaataaataaataaataaataaattctttattgaatgatggaattcatgtacttccaaagttctgagaggcaaaacatggtgatggctgattctttgcctgtaatatcttgctatgttatcaaagcaagtcaaatatataattataatatagtttaagaagtgccgtaatagatgaacagtactactatgggaattctgaagaaaggaatgcaaatcggacagggggaagagaaaatgttttctgtttctgaatagccagggatatttatgacattggactgataaatgcagagatctcattcatgcctccctgagctaacatgtatgtttcccttactactatgcaaacttcaagaagggaaacgttttctacagtatctagaatagttttttgcatagagtagacatacatgaaacaatgatacacattaattactttctcagtaagcttgataaaatggaagatgctcaataacagttcagtttcttgtcccttgagaagtggtgcatgaattgtagcctgggtaagtttcatgtctttgtatgcttttgtttcttttttatgtctaaatagtaaatcaggaggaatttcttggatatgctggtggttaagacttgattctttggttttaataatgttaatatattgaggtttagttgtgactgaatataaaattcattgtttttaacttaaaactttaaaatcaaattgcagaagccttggccaaggaataattgtataaaatacagtgtctgaacttgcaagctgttcttttatctgatttgtgaacatttattaacatgaccttatgtattagaatgtcctatacaaacatgtcaaacaatcaaaattcaaagcttttcattttcaaaagctgcctaaaatgccactctctctagacaatcaccctggaagtaatggtctcttctctgaaccatcataattctctggttctttcaagaaagagttaaatgctttccagtagtttctttctgatcttgattgttctcaggggtctcctcagagttattttatatattttccttgaaattttaaagagttatttgtggatgaattctcatagaatatatttaattatggaggttctcattatgcttcatacatgggaagtaattctgaaacaaagaaagtaaaaggccgtaaactctctatgggctgctttattaatcaaaggagatatagaattaacccattagaagtactctactttctctgaggggaacttctttgttctgtagattggtatataaattgaaatgtaattatttgctcagttttattaacatatttaaaaagtaattgaatatttgcagatgagagagaaagaa

SEQ ID NO: 585 - DNA, 6708 bp, Homo Sapiens
aatgtgtgaggtggtgctatgtagcaggaacccctcttgctttgcaaatagttttttgtttgttttcctttttgcccaatagagccctgctctactgacccttcaatgtgcccgtgtgcctaaatattcctggtcgtgtgaaaagaacccaggtattagctgaactaaggagcacaattctgcaacattttggcacccaaacacggggcttgagaaatgaatgcaattggagaaactggttgttttaccaggcgttgattggaaatgtgtgcttccctttaagcagtcaagctcaacttgcagaactgatgggaaccccttgggaaaactggcctcaaatgtttgtctacacagtccacatacagggttcttaacctgcggtgagtaaagaatgtcactttccaacaggcccagatatcatatgctcttgggacctcaagaagagaggagtttacccaattcataggtgtgtgaggataaaaacctagggctgggctcagctttaaatggtcttatctgagattctttgtgaaacagattttcatgaaagccaatctagagggcctacgtagaaataattgtttttgctgcactttatgcacataatcaagccaattataagactaaagtctatattgcaagcaacacactcctattatgatttgtttttaacagaaatgaggacgagacagagagaaattatgtttcaaaacttatcatcattagtttctagacttattatttctttttaagtttttacctacattttagactgaccctgcttgtgcctgtgaaccaaccaacaatctctggctgcagctcagaaaggacaaaagagaatgggtaatgtaaaaacctggatcagtattttagttctgaacaattatcctgcaaatcctgccagctgatgggaataaataggatgcccatgatccggaggtttactttttgggaaagtaaaaccaagggagctaaccaaagtaaaaccccatacacccaaatctgagcaagcataactatagccaccagttatctgggtgtgtcacaagacactcttttctttcctttgttggaggagaactcatttccacagcttcactttagcattatggcttatgttaaggagtctatgcaacttccatgctgagacacgtttttggtcccaaagttaattccaagctttgtgtcaaaggcctaagaaaactggatcttagggatccagaagccagacaataatgaaagtcaaaaggcacagcacaggtgagcatgactaattcccgctgattaagccaagcttcctgtttcatggataaaggtcatgctagtatccatggcataaatgaggtctagagaactaaaaggctactgccagcaggggagatagggaggacataagacagggcagctattcccatcccctagaccccctgttaacatggatgaaagccactttgacacccatgggtggcaccctgtcacagttggtgggactcagcaatacagggacagaggaaagaaagaggaacaactcactttctctccctcacacaccctgagtatttgctagaaaaagaaaggaaccaggcacacatgctcccctatttctagatgagtagccattcatctttagtctgcacccttttagaacatgtcctgaacccctgggactcttctgaaaaaaatgccttcttttttcctttttcttcctctgtcctctattcactggtaggtaggtaatggtgtcccataccacagaacacttccctcagatgcatccttctaactgggaggagttaatttctcaaaccgtagactaattggcttaggattaggttcaggggaagggaacacagaaacatgacatgccagcaaaagggtaaaaggttttttttccccgttgggcttttggcctctctctccctgtgcaaactggtaaaaggcgtctggattttctagttgtccttacccactgcttgtttcgttttgatacatattttctaataacctgtttgtctcttctcacttttaggccatcaaactccagtctgcacctggagccttggatgatggccttttttactgggaaccctgaaataggcctctgagggaaatctgattgccattttcccaaaacagcttccctgacaataggaagcaattaagattggtcttcatccttatctttatccttattctaatggcagttagaggtacttctttagaggggggaatgagacagccaaatgcctaggcagataaaaaggtgtacctggaaaatttccaacccgtcacacaagtgtttacatcagatgcttttgtgtagatgagggaaacttcccagggcttgtctgggtatgcccacagtggactggagcccaaaatgcacactggaggaagtggatggagccacgtggatgtcatgccttatgcaggggaggagcctgctctcttcagctcctgtggtaatgtgggaatcgatctgtgaggaaacactttctgaaaatgtcagaactcttgaaaacatggatgaggaaaagcataagtactgctttatgcttttcttatgaattttaaaagatgtaatttaaagattgaaactcccacaactttggcagaccaactcctcagaaaacattattctttgacatcaatatgttttgcacaaaattgaatggcaagtgaaaggcatcaaatggtgagaatctagaaaatagtgcatgtacgggaaggctttgctcaatacaaatcacttgcatgggacagtcttctttagtgagtttattatatacgggaacagagaggtaatatgaaatggaatatggaatatggcactagcaagcacaaatattcaaatatgtggaggaacaactggatgtgataaaacactataaaaaaaatagagagaaaaatgacagtaggaaaaagactgtatatattttttgagaataaaagatagtttcatttcattggtggacatgagatgagttgatgcagcatgcaggtggataccatttttttcaaagaaaatatgaacagagtctcaaataaataacaaatgtttatatgtgggtttcaaggacagagaataataaaataaccaaatatacataatgttccagtaaaatgatccatcagggcttacagaaagcgtaactagagagagacattaacttgcagatgatttgtttctggctaatgttgtgacaggagtgtagcatttcctttcttctcagtttcctatctcacttaccttttgaaaagacatgattccatattatatttattctgtttctctctttctttattcatttaccctactttactgaaaaatctcaaacatcatagaaacatgcatgtcttggttctccaagtttgaaaggaaaataatgtagaaagctctgttttttttgccctggcatttatatactctccaatctcactactcccatatcactcttctacctctcttagagcaaaattgcctcttaaaaaaggacattgcacccagcatggtggctcatgcctgtaatcccacaactttgggaaattgcgccagtgcactccagtctgggagacagagcgagactccatctaaaaaaaaaaaaaaaaaaaaagtacattgctgattccatttcagcatcactcaattaccattctctaactgtctctgatttgtctttaccaaaagccacatctggcataattggcaaaagactttttttttttccccaccattccaatgaacacaaaaatgacattctcaacatcaaatcaaatgatcacatttttattcatattttactccaactgaaatgaaggatataactaatttgtccatttttctttaagcacatatctgtattcattttgataacccagcactcttgattgttcccttactgaatgtttgtctcttagtatcctttgcccattctactcctttaaaaaaactgttgcagtaaccaaagagttatttttgattccacttctttgtcaaactaaagtcagctctttgaggcttctggattttgatattaaatatgtgtttagcagttcaaattttatatatgtatattctagctcagatccagaaatctatttccttcttatcattctcacttggattcctcaagcaatttaacatgctctaaatatttcttccatgtttatttaggtttcaactctacatacagaatagactaatttaataattttatacaatccttggccttttactttatatgatcttctacatccaatagaaggttgttcagttaaaccttaaaaacctatcgcacactttttaattctctgaattttcatcaacaccacggtagaaacctcctcaatacagagttttgtaataattgctctttaaattcccaccatgatatgttactatatattctgctcagaatgaaaaggttcactataaaacatggtttaaaaaaacaaacattgatttctctgcttcaggagtttcctttcctatggtagatgaaactaggtacaataatttgttgtttgttttggagagctgtcaaggcatgctccatggcctctgaaactaggtagattgtatcacatacactccagaccaacatacttgctactttctgatttgattggattaacacgatgtcaacaatatagtggaacaatgtgatattcttgtcaggtacagtctctttggactatgtcagacaaatggcatgagagttaacatagtcctcgagctaattcataaatgtatattgttaccattttacataaatgtaatcgttgatgcccttattttctcagaggggtgggggaaaattgctattcccacattaatgtctgtatgttagtgaatctgagtgagtgccaatctacttgagcaaataaacatctggaatagcagctgtaattggatctatgattttcttgaatttgcattcatttacttttattctccagagtgcttttgtaagggtcacactggtaaatcaaaaagaggatgtaatgagggaatatcacctgtgtcattttttcaagaatatccaatctcatattttcccctgccacacaatactatattacttttgacacaatatgttgagtaggaagcagcacttattgataattctacttgcccttcttcactactgcagatctcaccctactaaccaaggaacaaatatgaacatttttttcagctgacagaatataatgtttattccaattatacatttgtgaaaaagggaagtgaaaataagtcttttgagccagtggacccattgtaagcccaaactatgctaggacattatttattacttgaagtctcattagctgcattcttaaaggtggatctctttgtatcaatcctcaaaatatcagggtattaaaacaataaaagttaatacttattctttgtatatttctactgctggtcctcaaggggctctgctcattgtaatcaaataggcaccaaaggtgcagcagtccccagcatctttccctgtagcctttgtggtattgggtatcagtgtttgtcacgacgaaggaggacaacttagagaattgtgcccctgctgttagacggagtctgacaaaatccagacacataactgttttatgagtaaattgccaatgccaatcacatgatctaaaattaatatggtgggtaccaaaggagaggcagactatgtgtgttagtgagatctgatagtgtctgccacaacacttaataatttttggagaattttaccatgggcttgacatttgaatattcaatttaaactacttatttatgaaatagttataggaataattaggaactttatggcaactctatgttttaattaactttctaagtggtgaaagagtgaattattcataaattacttctggaaacaggactcttctaaaaagcatgtaagggaacttgaagcagcatctcaatttgtgcaatatgataaagaaaaaaaactgtgggatccagaaaacaatacacaattacttttatttatggctaccagaacttcaggaaaccgactaatgtttgtgcacataatgtttttattatggatctatctggggcatattgaacatacagtgccctcaaaaatggtcagttttactcatgcccaatcccatatattttttagggtaatttttctggtccagttaagttagaccaggacattttcacttgacaaatctgagtaaacttctctggaaaaaattgtttttgaccattcgcctagaatgaatctctgggtaaggaagatgcatatagtcgtataatttactgtagttattttgacaccttttcttaacgacacaccacagatttattgctggatatttttttccttcctaagccacttgccatatagttctactcttctctagctctagggaggcttcctcatacagactaggtcaacagattccattccactggctcgtggatgggtttggctaccgagaagcagttaagagaagatcagaattatagggagcagggagtaggaaaaggtgaagaatttattttcctgcttccctgctgatcccctcccaggctcctacatgttggtcacatttctctaccaaatggtagttcctgtggggttcttgtaaattcaccttcctctttccatagagacaaaagctccctgctttcattcaccttcgagtactgcaaactttttttttttttttttt

SEQ ID NO: 586 - DNA, 2236 bp, Homo Sapiens
ttacaggcatgcaccaccatgcccagctaattgctttgactttagacaatttgactataatgtgctctggagaagaccttttgtattctatctgtttggggattgcttggtgtcctgtatctaaaaatccatatctcttgctagacttgggaagttttcatctgttattttgttaaataggtttttgaacccttttgttctcttttcatcttctgggatattggtaattcatatatttggtagctttacggtgttccactttccatatatcatgaaagctttgtttattcccttttctttatttttgtctgactgagttatttcaaaagacctgtcttcaagttctgagattctttcttttgcttgatctagtctgttgtggaagctttcaaatatgatttgtatttaatttaatgaattcttcagttttagaatttctatttagttctttttaatgacatctatttctttgctaaatttcttattcatatcctgaattgttttctaatttctttgtattgttctttggaattctcttgtatctcactgagcttctttactgtcaaaattttgaattctttttctgtgattttgtgaaattttttttattgagatctgttactggagaattactgggttcctttagaggtgtcatatttccttgcttttataagtttcctgtgttcttacattgataccttcatatttgctattattgtcacttcttccaattttttgtatttgctttcacaggagagaaatttttctgacgatgcattaatggtgttggtcaggtatggccctttggcttttattttgggtgcatactgtagtgtagtctctctgtacaatttctttggctgtaaacaatatcagtggtattcgtgatttccttggtggcttagggtatggttattagtggaggctctggtgagctttggctggaaacagagatgccagatgggccagtcttcagcctccagtggtggcagtggagggccaagcatccctgttcttggaccccaggatggtgtccactgtcaccagtgtcagcaggtccaggcaggctgattcttgggcctccagggtggcttgttcagatgctagtattggcggcagtgggttgggcatgtgggcaggttcttcagtccctgggaagaaagtatggtgtgtgtgatggcagttagtagtggcagatgaccctctgggtcctgagaagtgtatatttgtattggtgatggctcgatgggctgggcaggacagtccccaggctcctaggtagtgcatgtgggtgggtgctggcagtggtgttggtgtcaggttgggtgggcccatcttcaggttcctgaagggactgcacagatgccagaggtggtggaatgggtgtagtgatccccaggtcctaaggcagcatgcttgggctctggggactgggcctctctctgggctgcctctccagtcctctgcctgccactgttttcattgctatcattatttctgtttctctgaaggtagagaatgctgccaacctgctctgccctcctcagactctctcgtctgacagttctataaaggcccctccacccagcctctagcccatttctttctctggcttttgcagggtaacagaagacagagaagctacaaaaaaagcctccaaaacatgaattattgaaatgatcagatatggttcacaaaataacgatgctttttacatttatgaaataaattccaagcttaaaaacatccgtgaaaaggaaactctaaaatttaatgtgacatattaagaaaaaaatccaaaaatataatactcaaaattaagatgggcttaagagcaaatgaaatgtagctaacatttttaaatggaagacaagaagaaaacatcctccagaatgcagcacacagaaataaaagggaagaattggaaaagagtggataagaggcataagtggtcagtgacaagttgtagcccagaaagtgtgaagggaatgggacagatataaaattggaagaaataacagctctgaatttttcaaaagtaaaaacgatatcaatctacaactttaagaatctccatatatcctaagcaaaataaattataagaaactcacacccagacattgcagcaaaacttcagacaacaatagacagagacaaaaatcttaaagcatcagaaaagaagcagttactttcaaaggaagaacagttagactgagaactgacttctcaatagtaa

SEQ ID NO: 587 - DNA, 3630 bp, Homo Sapiens
ctataggagaacacgaggaaatatattttataaactgtaaagcactactaagacgtgagcagcggctgctgcatatccaggtcaacctttatgggcctgaagacaacctctccttcgtttgggcactgctaggagtcaaatctacctagacttttggtaaggaagatggtactcatgctcattgtcattgagacaattatctaatgcttagaagtcaagactagaaagcaaggcattaaccatatcagcacccaaacaagggaagacaagttacaagaaagccaaataaaacagcaaacatttgtttagtgctttatggttaacatatatgatctcttttaatccttacaatcctagggaaaaagtgaagctcaaggaggttgacacctgcccaagactagacagtaagtggcagagccaggtcatctgatcctaaatcccgcactccttccactatgataaaataccaggaaagaaaagtgatcaggatatgaggcacattctgatccatcaaagatgcttatatgctttgcctttctctagaaggaaaacggaccccactgaaggtagagatgcaatcccagactttcagagggggggtgtggccaattgctatcagtagtttaggactcacatctggcatttctgtctaccaatacatctattttgacactgcttgtgctgaggtcccaaatgtctattatctccaagtactgtggctttctattcctatctgtacctgtcccagggaattggtcaaggactcacattagggagaaatgaagtactgggtatctgttactcacgtcccttacacttaggtagactgccagtattagcagtagtggtccgcttccagtgaccgtcatattatctgttcagcttcctctggggaagccaatctgccccaatcttcatggttttgtgtctccttttttacccatatgaccatctctctccaccgtgtctccctcatcaaataaagagaagtttagcaactaagtacctgaggaggtgggaaaggaatgctactcattcctcagctctcctagttacctttccactcccttcatccccccacattccctcatttctctcacctggtactcctgcaccacctcctccaaaggcagcacgctgtgctgtttgtggctcctggattctcggcacaccacacagatggcctctttgtccacctcacagaagagtttcagggcttcctggtgtttaaagcacatgccctgatcattactccggtttccccgataaggagtggggcacatctggcgaattatctggaccatgttggccagctgcaagttgggacgaaagctgcgacgtgtaaagctctttcggcactgggggcaggtgaactgccctggaaggggcaaggaaggaggcgggtggatgtcaggatacagctcttcatcttcgtcctcatcgtatgcttccagtatttcttcttctcggtagacatcaattctcaggtcaggtctcaagcctcctaggtaatagtcctgatcttcctcttcttcttcttcctcctcgtcccacatatagtctacgttgtcccaattagttataccactgtcaccgagccagagttcatcgtcatcttggtcttggaacaactcttcgtcagcattcccccgatacaacacctctcgaatggagccgtcccatccatccatggcccccaccgcttcctcgtcctcctcctcctcccattcatcttcctcctcgttctggtcctcctcgtcctccttactccacagctgggtcacacaccctcggcagaagttgtgcccacagctgatggacacggggtccttgaagtaatccaagcagatggcacacaccgcttcctcctgaagggtctgcatggggctgggagtagtggcataaccagccatcttaatgcccgccggcaggtgtagatacgtcagcttggagctgaggagcggggacgcgcctgcaggcctgcctccaaactactctggtgacccgaggctgtcctcaaccttgctcttcttcctcggggccgcaggggagctttgaccccctctctcagggtgcgaacgcccagatccagactcacagcctctctctgggatcggtggggacagagcaggctgcagcccccagctgctcggtcctgtcacgtctctcgctaccctcagggtgtgccctacactgcggcgtccgcctcagatgcagccgctggctaccctgcccgaggcgacgcaaaatgacgtctcgctcctgcacacgctctggagagacgctctaggccggcggaggaccacgtctctatggtgtgccgggggccgcgcgggccgggagttgggtgggctgggggacaggcgcgcccgcgccgcccgctccagctgggctagtgctgcacattccggccagcccctcctcaagaccccattcccaagccccttctcagctccctcgggccggcagagcggctctgatcagtaaaatgctgttgaaggcccacgggcatgactgcacccctcactaattggtcattggtttggggaggacaccactgtcccagtggaaccttgagcacaccttggagccctcctcttcctctccggacctgtgccaaactgtgagtggcacagagcaaggactgtatgtgttctcttctttgttgcatactcagttccttgaccacagtgccaagcacacagcgagcactccctgtgtatctgctgagtaaataaacgaatgaacaaacccaacacatttcagccaagtcctgctgatgtttctcctccgatctagctcctcctttccagccttacttctgccactccagatttcacccccatcagcttcagactggataaaaggaaaccatttctctaaaggatcacttgctctctcatttcaggccatcctgcagccaccagaaccttccacatgaaatgaaaggctcaccacttcataggctttaaggaaattcttggccaggtgtggtgcctcactcatgtaatcccagtgctttaagaggccaagatgggaggattgtttgagccagctgtttgagaccagcctgggcaacgtcatgagaccccatctccacaaaaaaaaaaaaaaagaaaattggctgggtgcggtggctcatgtctgtaatcccagcaattttggaggctgaggcgggtggatcacttgaggtcaggagtttgagaccagcctggccaacatggtgaaaccccgtcactactaaaaatacaaaaattagccaggcgtggcggcaggtgcctgtaatcccagctacttgcgaggctgaggaagaattgcgtgaacctaggaggtggaggttgcagtgagccaagatcatgctgctgcactccagcctgggcaacagagtgagactccatctcaaaaataataaaaataaattaaaaaaattaaaaattacctgcgtgtgatggtgtgcgcctgtagttccagctacttgggaggctgaattgggaggatcatttgagcccaggaggtcaaggctgcagtaagcagtgatggtgccactgccctcagcctgggcaacagaacaacatgcaatcttaaaaaaaaaaaatcctggccaggcacagtggcttatgactgtaatcc

SEQ ID NO: 588 - DNA, 3751 bp, Homo Sapiens
agacctcaccctgccctgccgtgcgctcaacagccagatgctgggcccagacaagcgctcttccgctagtgtgccgggatgagcgggggctggacttctagaaaggggtctgcgggcgcaggagctggggtccgcggtctggggccgccaacacaagccatcagccccatgctcagctcccagcaggcagagcgttcagaagcgccagcgccatcatcttgggagcctgcagtccacacaccgctgaccttacctacttcctctttccaggtcgtagattacagactctcctctgggaaattgcccccagatctaacaggagtacaagaagctgggtagattggaaaacagcaccgaattcccctggaactgaggacggaagccttcccagtcctgcagccacctgcagactctcacaagcacggtgctcccgggagaagaccttgctaccccaggcccaaggcagtcgagagaaaacgggaagccctgaaggtttttcaccccgggggtgagagtgtatgatcgaagatatatttgagggtaattgtacagatagtcccaacttagcattgttcaactttatgatggtatgaaagtgatgacattcagtagaaattgtacttcaagtgccaatacaatcagtttttcacttttggtgcagtattcaataaattacatgagatattcaacactttactttaaaataggctttgtgtaagatgattctgcccaaatgtaaggctgatgccagtgctctgagcacatttaagggaaagctgggctaagcaatgatgttccacaagttaggcatattaaatgcatttttgacttagaatattctcaacttgcaatgggtttatcagaacatgacatcgttaatcactcaaggagcatctgtaccactaatgacatagatgctggttgcaggaaggcagccagaggagggcacagtgtggaagaactcaactttttaaagacagagatcagctttaaatattgctaagaaagaacttggagagagaagttggtgataccggagacagcaggcaacagacagagtgagaggcccgaagaacaagaggaggagggagtctcttctgggagcagaaggagtgtcgacttaaatattagggagccaaagatgaacctcgcagagaacctgcaaaacccagttgcagaaatacctgcccacacctaaaaactcagtcactgaaagtctgaagtcaaatgattatgtgaaatcttagtagtgggtacatgtggtttcattagattattctttgtatctatatttgtactatcttataagcactataagttttaaaaccatacaagaggctctatggaaaataaattggacttcattaaaattcaaaacgtgtgcatcaaaagacactgtcaagagaatgaaaagacaacccatatgatgggagaaaatcacgtatctgacaaaggtctacaatccagaacatattaaaaaactcctacaattcaacaatgaaagaccgccacccagttttaaaatggaaaaaggacttgacgtttccccaaagatgtgctcgtgacgaatgagcatgtgaagagatgctcactgttggccgggcgcggtggctcacgcctgtaatcccagcactgtgggaggcggaggtgggcggatcacctgaggtcaggagtttgagaccagcctggccaacatggtgaaaccccgtttctactaaaaatagaaaaaattagccaggtgtggtggcaggcgcctgtaatccagctactcaggaggctgaggctggagaattgcttgaacctgtgaggcagaggttgcagtgagctaagatcgtgccattgcactccagcctaggcaacaagagtgaaactccgtctcaaaaaagaaagaaaagaaaagatgctcactgtcattagtcataaaggaaatgcaaatcaaaagtacagtgagatgccacttaacacccactacgatgggtaatcataggatgggaaaaataaaataagtgtgggtgaggatgtggaaaaatcaaccctcacacactgctggtgagaatgtaagatggtgcagctgctatgtgaccgtctggcagtccctcgaatgattaaacatagagttataatgtgacccagcaattccatatatacccaagagaaatgagcattattcctaatagacaagggaagaaacagccccacggttcatcagcccatgagtagattaactaaatgtggcatatgcatataatggaatactgttccgccatgacaaagagtgaggtgctgataaacggtaccacgtgcagggaccttgaaaacagattaagtgagagaagtcagtcaccaaagaccacatattacctgattccattcatctgcacggtccagaacaagggagtctacagagatagttggttagtggttgcctagggcttggggaagaggtctggggagtggagaagtgatgggtatagtatacacggttcctttttggggtgatgaaaatgttctaaaatggactgtggtactggttgcttattttaatatatctgtgaatatattaaaaaaccattgaattgtacactttacatggatcagctatacagtatgtgaactatttctccataaagctgggggtttttttgtttttgtttttgttttttatttagatggagtctcactctgttgtccaggctggagtgcagtggcgcgatctcggctcactgcaacctccacctcctgagttcaagcgattctcctgcctcagcctcctgagtagctggaattacaggcacacgccaccatggccagttaatttttgtatttttagtagagatggagtttcaccatgttggtcaggctggtctcaaactcctgacctcatgatccgcccgcctcagcctcccaaagtgctgggattacaggcgtgagccaccggcccagccaaagctgtttttaaaaaaccatacatacagtgagatatcacttcatatccactagtctgggccatcatttttaaaatggaaaatcacaagggctggtgaggatgtggagaaattgtaacactcatgcaatgttggtgggaatgtaagatggtactgccactttggaaaagagtgtggaggttcctcagtaaggttaaacacagaattaccatatgatctagtaattctactcctaggtacatacctcagagaattgaaaacaggtgttcaaacagaaatttggacttaatgttcatagcagctccatccacaatagccaaaaggtggaaacaacccaagtttccatgaacagataaacagatcaacaaaacgtgctatgttcatacaatggaagagtattagctccaaaaggaagcactgatgcattctacaacatggttgagcctagaaaacatgctaagtgaaagaagccagacacaaaagaccaatgtatgactccactgatgtgaaatctccagaatggaccaatccctacagaggggagcagatcagtggctgcccagagcttggaggaggggaatagggagtcactccttcctgggcaccaggtttcggtttggggtgatgaaatgttctataaccagacagtggtgatggttgcataacattgtaaatatgcttaatgccactggattgcacaatttaaaatggttatgatggtaaattttatgttatgtgtgttttaccacgtacacacataaaacttattttgtgccattaaaaagaaaaagctctatgaagcacct

SEQ ID NO: 589 - DNA, 5758 bp, Homo Sapiens
accgaggcagctctctgcctcgaggctggagggcaacgcggtctgaggcagccaaagaccgggccaactcgctgccaaaaaggggccggattgcttccggatctaggaggcaagcgggacttctccctctccctactggacgcacaactcaggatcctgatggcttcttaccgccccgtcggctgttttttttctccagaggaaagcgtacacaagaaacctttcctggagaaggaataggtgataagaagacgggaagaaacaagcatctgttgctactgtccccattttgctgatgtggaaactgaggcttgaaagggaccaagaacctaatgaaatgttcccaaggttgaaatggtaataaatagccagaaatgaggaaaaggcaaaaagttatccaggctcgcaagtcaaagccatactggatctaagctaaactttcttatacaggatagtctacaaaaaacaataaggggacattaatttattcatattaaaaatacttactgaagacacactacgttccagtgactagtactgggaataaagaggcgagcaaaagagacttaccaagttcctgttgctaaatcagtaagactcaaggaagtagcaacaagttagagtagacgtggtaactaccttcaagaaatttacaattccaaacgagtcgttaggaaatacagtatgaggtgaaaacagttaaaaagtgaaagaaataaaactaaagataatgatgttaaaaaaaaccccacattatcaggcactgttatagccttcatatgtcatttcatcttgtcaaagaatgtctcaaaagacagccacaggaaagaaaagaaaaactttatttgcaaagctgcaagggagtgagacttccaaaaggactgattcaccaaatatgagacatcaagttttaaagattagttaaagtatagagggaagaaaagaacacagaattaaattgactttacatgcactgaaagggaatctaagccaaggaaagttggaatggtagcctgtaaggggacagctacagaaagggccagggaagaagaattcctaattgatgttttcctatgccatttcctgagttcgtgactgtggacgagttatctctccaaatctcattgtccgcttctgtgaaatgctggtagcagggatgactgcaaaggcttgtggtcaagattaaataacataagaaagtgctgctagactataatttcatgtgtgtgaaattcaaggggaaaaaggaaacaatacataatccagtctgtagcttctcatggatcgtgcaaagcaccaccaggacagacatctcaagcacatttgaagagctcctgtttcctaagtaagacagcagcagcaagactgcaatcatttctgggaaggcagtatcatcataatgcaatattagctactgtgatcttctatcatttccttcctggagagttatgactgtggcattgaagatttaagacctacagcctcaacactacttactacaaatctctcacaaagctgctgcaataaatctcgtggaggaaagtcattgcataaaaaaatcctcaactccagggagttggccatttattttcctagaaaaggggctgtgatgagagacactccatgctcctttaactccatggaacagaacccaacaaaacattcatcatggaaagttgactgatgggcccagtgagactagctggggaaggaagatggaaagagaagtgccccatccaaggcctgctccttttcctagctgcagcccggagggatttcctcttagcttgaggattgactttccatagaatcagcaccactgagggtaagcttccctgaagacaaactctgtcattggagagctcagccaggggtctaaaactggaccctatggactccacagatttatttagtctgcacagtgtttaaaaatgtttttagttagggccaggcatggtggctcccacctgtaatcccagcactttgagaggccgaggtgggtggatcacctaaggtcaggagtttgagaccagcctgcctgacatggcaaaacccagtctctactaaaaatacaaaaattagctgggcatggttgctcaggcctgtaatctcagatacttgggaggctgaggcacaagaatcacttgaacctgggaggcggaggttgcagtgagccaagatcgcaccattgcactccagcttgggtgacaagagtgaaactccatctcaaaaaaaaaaaaaaaagtttctagttagttcccaacataaaaaattaacaattttgcaaagaaagataaaatccagattttgggctcccctaaacaaattgggatatctgaaaacagtgggccacattcctacattcctgcccctgttgacagtatgcgcctgctctaattttacttccccttttaccctaactgccctgtagggaatggagtttgcaatccccatactaatccatcaccctgcaggtccattcccctcctccctgacctctgttctgataaggggtgagagaatgaacccccatatgtattgaatggaaaatacatgtattggccaggcacagcggctcacacttgtaatcccagcactttgggaggccaagatgggcagatcacctgaggtcaggagttcaagaccagcctggccaatatggcgaaaccgtgtttctactaaaaataatttaaaaacaaaattagccagacatgatggcaggcgcctataatcccaactactcaggaggctggggcaggagaatcgtttgaacccaggaggcggaggctgcagtgagccaagatcgcaccatggcacaccagcctgggcaacaagactgaaactccatctcaaaaaaaataaaaataaaaatacatgtattgatgagaaaatacaactgactaatcccacctaaaccatgacctcatataaattcagaagatctttctaacatggcagggaggcagcctagtataaagcaaagagcacatgctttgcgaatgtaaaccaaaaataaaagttgaaggccctcctcaccatatgaatggtctccttcctttgccagggcaccctaaaatttaactggttgaggccatgatgggtagtaggggttggacatgcctcattatacccttccagcagtaacatcaacacagactttaagtctgataagaaacatttacagtctattttctctaaagcctgctacttggagatataaaacctaggtctccacaacccctattgtaacccagccatttctttctaatgataataagtctttcaaccaattgccaatcagaatatgtttaaatcttcctatgacctagaagcaccccactctttgagttgtcccacccttccagattgaaccaatgtaaatggttcaattgattgatgtgttatatctccctaaagtgtataaaaggaagctgtacctcaaccatcttgggcacgcgtcttcaggaactcctgagtctgtgtcacaggtgtgtccttaaccttggcaaagtaaactttccattacttataatggcaaaaactgcaattacttttgcaccaacctaataaatggattgagacttgcctcagatacttattggtttatacctagaggcagaccttggctcaaatcccatctctcccttactctgggatattgtccaacttgctcagcctcttgaaacctactttgcttacagcaaaatgggtataaggggatctttcacccaagccttttgtgaggactaaatgtggtaatggacattaagtgccagaccccttgaatgtgccatcttctctcagcttctataatgtcatgctgtcagttccctccttttctttttttcttttcttttcttttttttttttttttttgagacggagtcttgctctgtcccccaggctggagtgcagtggcacgatctcggctcactgcaagctccgcctcccgggttcacgccattctcctgcctcagccttccgagtagctgggactacaggcgtccgtcaccgcgcctggctaattgtttttgtatttttcttagagactgggtttcacagtggtctcgatctcctgacctcgtggtccgcccgcctcggcctcccaaagtgctgggattacaggtgtgagccaccgcgcccagcctagttccctccttttcatggcttctttgcttcatcttttctgtctcctttgaaggtatgccttcctggaatataccataaatgtcagtgttcctcaggattctatcttgacctgactcccccgacccaactgctagcttttccctctgtctaatgctggtacagatacataaactgataggtagattacaacacaattcgattttctgttttgcttttttttttggcttattattacataaactttttttcattgctgccatacattcttcaaaataaacacttcggggggcgagctggcccagcactttgggaggccaaggaggtggatcacttcaggtcaggagttcgagaccagcctgaccaacatggtgaaacccccatctctactaaaaatacaaaaattagccgggtgttggtgcaagcacctgtaatctcaactgctcgggaggctgaggcatgaaaatcacttgaacccgcgaggcagaggttgcagtgagccaatatagtaccactgtactccagcctgggcaacagagctgcgagaccttgtctcaaacaaaacaaaacaaaacaaaataaacacttcatggctgaacaatatgccatttcctgaatagattgtaatttacctaatcatttctctaatagtggacacttaggttgttctaattttgaaaggcaggaataccaagaatgttttcttgcacatggcagattatttctcagtataggctcatcctttcgagtatatggcatcttttcttctttccctcctctctctcctcagaagtactcaaggccccggagatactttggctgtatccccaccaatctcatcttgaattgtagctcccatgattcccatgtatcctgagagggacccagtgggaggtaattgaatcatgggggcaggtctttcccgtgctgttctagagatagtgaatgagtctcacaagatctgatggttttataaagggcggttcccctacacaagttctctcttgcctgccactttgctcctcatttgctctctgccatgactgtgagccctccccagccatatgcaactgtgagtcaattaaacctcttttcttaataaattacccagtctctggtatgtctgtattagcagtgtgagacagactaatacagcccttatgtgtccagaagtactgactttcttggatgataccttaagtaaagcctaataaagctttagtgactgatacatttttaaaaatgaagtaattatttatgtgtaatgagacaaattatttatttcagagtgttatttgccttactctcttcccccagcaaaaggagtcctcaagtggccagccacattttctcatttctcctttcttcaaaaactgatgggatcttgcttgatgaagtcacataacaagtgaatacagcaaagagagagggaagggggaggaaatagccgttgggaatggagtgttgttggatgagctttgtgaagtgtgggaagagaaagatactagaggagaccgagacaaatggataggtgaagaaacagaattttagtaagtggtgctgtatgctatatatgtggatttgcctcaaagttttaaaaaatggcaagcag

SEQ ID NO: 590 - DNA, 1518 bp, Homo Sapiens
aacaacagaaattacccaatctgaacaacaaaaaaatacactggggaaaaaaaaagcgcaaagtctcaaggacccgtaggactataaaaaatgatgtcatggcactggagttctgcaaggagtgaagaaagagcagggcttaaaaagtattcacagaaatgacctccaaatatatcccaaatttaacaagctacatcaaccaggattcaagaagctgaacaagctccaaacaggataaaccccttcaaaaaacactctaagacaggttataattaaatttatgaaaactgaagaaaaaaatcttgaaagcagccagaaaaaaaaaaaaaaatgacaccttacccatagggggaaatcagtctgaataacaggagatttgtcattagaaacgatggaggctacctggaagtggcacaatattttttaaacgctgaaagaaaagaacagtccaccccagaaccctagactcagcaaaatgccaccttcaaaaataaaggagaaatgaagacattcttagatgaaggaacactgagaatctgtcatcagcagatttaccctaaaagaatggctaaaagaagttttctaaacagaggaaatgataaaaggaaccctgaagcctcatgaaggaagaaagaacacactgatttcctccatgtcttctatggaagattctgtccgtcccactggtttatggtttatggtggcgcctctccatatcagattatgctttcacgtgtcccaggtggatccagacagcctaggtgcaaatagtgtccctgtcacttagcagctatgtgatttggggcaagtgcctcgtttctttacatacaaaatgggacaatagcatctgcttcacggactgtcaggagataacatgagtttatgactgctcaggcctgcccagcacagggtaaatgcccatcaccgttgcctcttctctgttaggctagtcttatgctaagagccatgaaaatgttaatggggtggcttgtagttttgtattgataaggcaatctccattcattagggattgccttatcaatacgaaactactagctacccccatttttatttttctagaaatatagctattttcatctatttattattttatataaactctagaaccattttatcaagttaaaagtatcatttatgctttcaatatggtttgtgacacgtgaataagcaaatttggggtgaatgcacgtgtttaaaatattcagtcattccattcaagagcatggcatttcttttatcttaatatctcccagtaaaatttttttatttgtcctcatttctgcttcaaacttttctgattaggctggtagatgtaatggtgaaacagatgggttctaccaactctaccatgaactagctgtgtgatctactggcactgaagctattcaagtctcagtttcctgcctataaaatgacataggaggcactactgtatggattgctgtaaagcctattgatatatggttctaatcactacttaagcagaatagaggttac

SEQ ID NO: 591 - DNA, 3831 bp, Homo Sapiens
gccccggcccgcatacaacgctgtctgcaccgctcccctgccttcttccgggctcccagagcaccgctatggagatgctctcccggcatttgaggaagaattgattgtcctcatcctgcaactgtacttgcccaaccgatatttattgatgcctgcagtgtcctgggtgcctaccaaggggcacagaactggatccgacgcagaccctgcctgccttcaggttgcttgaagatgaacagagagatcggacctctgcatttggcactaccaccatctggtctgtatgtaatcctttacagtttgcaaggcacttttacatccattatatttaatttgattcttacaaccaacttgtgagataggcaagatgtgaagtcgatattttatagacaaagcagctgaagcataataggagcttaactggtgggatccatttatccattttctcttccatggagcatcttgttgtattcatccaaatccttgacagaaatgttgaagaggacctctagaggctaagcttatcctgaattcttaaatagcactgactgttacagtttaagcaagtcagtttcacctaaaagtgtgattatccaacccacatgttgcctttctgttcaaaaaggatggtaccaaagacagtcacagtcacctggcttactgacataaatattaatactaatcaaatgagtaaaaagcccatgaggattggctgccacaaaaaattttcaacctgtatctaccaagaaactatcataccaactaaggaagccaagtctctctctctttcaaaaccctcacggggccatgctttattataatggtctgccacaggtcctaacccacactgtatttgattatatacagtctcataattaagtcattcctctttatcacacccagcacttagtccactgctgcccatgtaggaggcactcaaattggtaaaagagaaatctatgcaagggaatgatcttctggaccccctccaaaaacaaacttgtgactagaagaggcaccagccatagccacattcctactaacagggctgatttaaatgccctttttattggcttggtcatagtctccaacaggtgccaaggcttttgctagttaaaccagttttcattggatcattttgttttctatgtgtgttttgaccaaaaacaaagataggttctctaacaacagggagagaatatatgaaataggaatatgtctataaaacgacagtctaccagtaaggaaaataagtgatccataaaacaaaacatctgactgtaggtctacccaaagaaaggaaaaaggactaacaaacaagaatatagtgctttaccatttacaaatctttcacatacattctcatttgaccctcacaacaaccctgtgaggtaggcatcacggacattctactcattaaacagatgaagacagtaaatctcagagtagttcactgataatgcccaaggctctacagttagtgagtgatttgtattaatatcagtctttggcctaaaaattcagcacccctcttccccttatacttgtcccacctacttcacagggataatgaagataaaatgaattcaaggctagaaaaatactttgagggagaaaagcactatataattatacctacaaactatgattttccccaatatatggctcattcctcttctcatctcagcttgtgtgtgaacccagagttgtatattgcctctgtcctgtgctcagtaagcaaataaggcaggcagggggtacagtgtgatcctgtttaaagttacataaattacaatcagggtaactgctattattaggcaaattgaaaaacagcacagaaaggccagtgtgcaactaggacccactaaagctcagaggaaagcaatgcaagattatcagacaggcatgattgcatagaaggaaaatgtggtgtcagagttcaaactggcacacacacacacagttatctaaggcaaagtggtggcaaagaagttatttgttccatgtcacacaaacaagagcagaagattcatgggaacccgtacaaaagcatcttgtgtcacacagatctctccagctgcctatagggaatatacagaacagtgtcaccttcaaagaatgactgtacctgtgttcatatcctgaactgcaccaaggaatagctccatgctaaactgtcttggctaaaatacaaccagtgccatcattcctaatcagactaataaacagaatgtcttttaaggtaatgagttagatggctgtgtttaggttttgttcaggatttactttggattctcctgctttaagacccaaagaaagttatattgagtttttattgatgattctatgtgtttttaacagagtgtgataggtgaattaaacatattaaaagagttctatagcatctgttcagaaaagattatatactatacaaactattcaagtcatacaaaaccatttttcattgtctttcaaactgagaagaatcctattcagcacgcttctcctcctgaggtggttcatactgagcaagctatggggcaaagacagaggaatttaggtgaattttattctaaattgagtaaaaaatagtaaaacaaggtaactgttatattcaacttagttactgtcagtaaattgtattaatatcagtttctataactatccattttaaatcattcagtgatttaagatttaatacaatcaaatctaatgaaagccctttttatataaacctttaaaattgctttgaaactaaaatttcattccagttcatgactgcactgttcaaatacttgatatgcaataaactatatcttcccaaagattcatttgcttataaggaactttcttcctctccagcaaaagtttactgaaaatacccactgaaaagtagataaagagttaagtgacatgtcttaacttaaccagccaataaacaactactaatgtctttgagttaaaaggttccaaagagttaactagcactacacattgtggaatcttggataatttaaaataactgcattttcttttatgctaagtgtggttccttgcaagaacactaggctaacattagggttctgccaactacctgttggagttgagaagcttattagacttcactgtgctttcgtttcctcacctataaagtggcttgtgtacttgtttcacttatctcacaaagttgttgagaagataaaatatattatgagaaatacttagagtaatgtaaaatacattatgtgattaagaatgtggtaagacctgaaagacttaagagttgactaatttgaagttcatgaaaattctcacaggactttgaaaaaagaaaaaactggctgggtgaggtggctcatgcctataatcccaacacttcgggaggccaggccaggaggaacgtttgagtcatgagtttgagaccagccagggcaacataatgggaccccatttctacaaaaagtttaaaaattagccgagcatggtggcaaatgcctgcagtcccagctactcaggaggcagaggtggggggattacttgagcctgggaagtcaaggctgcagtgagacatgactgcaccactgcacacaagcctgggtaacagagaacctgtctcaaaaaaagaaagaaaaaactttagcactagataaaattaagtcctaacaaatttacagagggccgctacatatggccttgcaaactatgaaccatacaaattctaagaagtgccatttacaaagcagtcgccccatattggcctacttaaaatcaactgcttaagaacctcagaactgaccatttacttataaagaacattaaccaatattctca

SEQ ID NO: 592 - DNA, 1560 bp, Homo Sapiens
taaccagaggctgagatgggtgcatgtggggtgtgggggataggatcaaggaagagaggttggttaatggatacaaacacaattagatagaaggaataagttctaatgtttgaaagcagagtagggtgactatattgatcaagtttgaataggataaaaatatttttactttttttttttgcaatttacatgcaagattttttaaatgtgtttttaatataagcttctctctctgccaccaggcttattactctaggcagggagcaagcctgccgtgggaaggcaagggaatggcctcaatctgctctgtttcccttttttcgtgtgggtctactgctccccctacaacacagttgggtttgatagaagggggtgtggggaaggccacagccatgttggtagggaaggtaacgggcagggagagttcatctgcctgttatgttgggacttggtttagcaacccaaatacatatgtactactattagatttggtgcaaaattaattgcggtttttgccattacttttaaatcacaaaatagtctataatgcactttagcactggcaatgtgatattatgtatgtatacattggttggtccaagctacacccaagaatagtaaagaattcatattccaggatggtcagctagcatttatgagaaaggccaaactccaaaagcttgcttcccttatctttatctcccaacaacacccaactgattttgctaaattagcagagtgaatatgaaaatgagatgccattgatgaaattattaccttgtttaattagcataatggatgttaaaaacgggttctcatgtttaattgtttatattaaaggtatattacatgatgttttgatattgtggttttgattttcatttccctagtgactagcgatattgaccaaactaattactaccttttcaacatcggctactcaggaggctgaggctgaggtgggaggatcacctgagccagggagatcaaggctgcagtgagctgcgacggtgccacttcactcaggagcctggatgacagagtgagaccctgtctcaaaaaaaacaatcatccagcaggggctctaaaaccctgtaaatattctctccttggctcatcccttctgagaactggcaaagagctgctctcccttactgaagtgggtcttataaacttagctttgcttgatcaacaggttttcaaggaatccacagtggtattcaagacaagtgaatgcgaaaatgagagacaaaaacattgttcacacactctgttttgtaagcatgatacaaatctccactctctatactttaagcttcagaacaaagggcatgaacaattcttttgtctgagggctaataagtggatagcagaatttgatctgagaatcaacttcattttaacaattaacttggcagaaaggttacttctaagctttggcaattacctgttgctaccaaactaaacccactaattaaagcatacccaaattggcttaggtcagtctgcaaaacaaggtactgcccaggtcttgattccaaccgtagatgaatcacccaa

SEQ ID NO: 593 - DNA, 7349 bp, Homo Sapiens
acagccattttacaactctatctgtgaaaagcacagaacgtattttgaccttttcaccgtgggatcctgaaggggacttaaagaacagccttcaggtcctgctggtcccttcctgggaagacttttattccctcggagctaagaaagacacctagatggtgccttcctctctcttgtgctgcttggaaggcatgggctttggggtcagctagaccctgggctagctcttggttatgttcccaacacctctgagaccttgggcaactgacttattgttcttggacatggctttctttgaaaaccataaaacttatagaatgggatgggagcattttaaaatacatttatgggaaattaacacagaagaccttgtttaaacattatttttagtggtcagccaatggcttcagcttaggaatgactgaggcaaaagcactaattaaggatggtaattttattcatctttgtatctgtttagtgtcaagttgtaggaagagagggtttaaaatatgagctagtaacccccccacaccccgagactctttaaaactatgaataaagttaagaaaactgtgcaagaactaagagaaggtcaaaggaaaagaagcgatggacattgtaggttcgaagcacaccaggcaccttccaggagaggagaaagttcaggaatgtggccctccctgcactgcaaatccctttgtggccccttcaagcctctaagctcttttacctcagctcatcattaatgctgatctccccaggtaggggagaggaggtggacttaggaggcttaactacattgcttaggattgtatatttcagagacactgactgatgtgagtcacacaattatagttctgagtcctcctctgttcttgagtatagagattggagaggaaagctgtgtttgtgattttagagtgcccgggtcaggcacttcctttttgtatgtgttttgggcaagccccttaccttttggagcctaacttaccacccctgggaagtgagggaactgaacttagtgctctctaaggccctgtttgagtttgcatgccattgactctggacttttctaaataaacaagtaaacttacagttaccatggagaatgtctgtgtccttgctgatcattgtaaatgtccctgatgtcaaaatgcaggatgataaaaagtgaagttgaaaaatgaggaaggagtgtgacagggagtgatcttaatcgttttgcagggtgtgcactttttaggctgcctaagggcagaattgaaatatatgccttctgccagcatatttcagagtcagccgaactacattttggttaggaactaccttgtccagaaagagaggggatgataatcaaagcaagggcagtcccagagctcagatgatccctttttcctggtgaaggatatccttggatggttgattttctattgagcctttaaaagagaacgctaggcttaacaaagggtcaagagtccacagctgaggaggccgagaggagccagggaaaggaagtggtttaaaagacttactgctattatattagtaataaattttttcgaatttattattgaaatttatatatatatttcaaaaatataccaaaatagagtgaagtgtatgatggatctctacattcctatcaagagtcaaccatcaattcatggccaatctagtctaacctgtatcttcatttaatcttgttttaacaaaattcttttgagacaaatcttgttcaatttcatctgcaaatatttccaaaggtatttctaaaattaagggcctttttaatttaaaaggcaaatgcaataatgttaaaacatctaaaaattaacaaaaaatttttaattgtattcactagcaagtcaatgtttaaatttctccaattgcctcatatacatatttttttaaaaatttgtctgaatctcgatcctaataaggtccatagaaagctattggggaatatgtgtcttaagtctcttttactctacaggtttccttccatctttctttctttctttctttctttctttctttctttctttctttctttctttcttgtgaagaaactaggccattttttcctgtgaattttctgattttgatgattaaatttctgtgttatcttttgatatgttcctcagtcttttctatttcctgtaaattgatatctaaatgtatgattagattcaatgagttttttttggcaaatatatttcatacatgtgtcatgtattctattaggagacaaacaatgcttgatagtctcttttttgtggtatcagtagccattattaatcattgtccagatcccttaattcattagaggctgcaatacaatatattcattctatgaatataattccttttaatctagtagttgtaatatttctagaagaaacttttcctgtttgattacactgaggaaatatatgttcattatattatctgtatgtaaaacccaggctaaatactggatttaacccctcatttccagtttcagcctattttgcagccttcttcagaagtgaccaatgatagctgtgtgtgttttaaattgtatttttttgaatgcatggacttaaaaatatttagcctggaaattttcgagtcagatgaatataggtttgagctctggccctgcctgttacctcagagagtctttccctttcttctcatggctaaagcctagtcactttgggctctcatgggtcttctgtagggaagctttccttaactttcctgagaagggcaaatgaatctctctgagactcagttttctcatctataaaataggggccatactactgatgccatctgacatagttgtgaagattaagtgagatagtgagtacagaaccatccattataggcattcaaagttctccacttttattgttattttgtatctaacaactttggacacttaactcctgtggtgaattgttttgctattatctctatcttgaaagtattgttggagaaacaatcatgaaaaaatatttttctacttctgtttatgaagatgcaaagtcacatggcaaattatcaatattttttatgaagatgcaaagtcacatggcaaattatcaatatctaaaatgttctgaaaggtggaagagaaagaaacagtattcaagagtcttgtcccaaggtgttgtgggggagacaaggtaataattgagaactatatataaaaataagtacaaagaattatatgaagcaattaaatctgatgggctggatggacttacttacgttagggaagggtgtctaggtacattggattcaaaagcggaggaagaaactactttggaggagtctttgtgagtggaagggaaatcctgaagttagggttggtctccttctcaaaaaaaggaagttgttgctttaggagggttgactaaataccctgacaatactcacttgactaaaaatatctcttccatgggcttgaagtcctaaagccagaaccagaagcgtagcttgttcctgctgcacaccgttctgtgttccacctccggaatcttgcccaggcttatccttcctcgggaatgtccttcttgtttgccttcttcacctgcttactcccacttattttacacgatgccaggagtcagggctttagagggtctttctcagtcccttcctttactgcaccattggggtagggcctcagtgacgttttcccatcttatcctgtacacgttcccatcacagcattcatcatactgctcatatccactgacttctctggactccaagcaccacaagggtagagactctcttaatcttctctgtaacctcagcacagtggccagcacatatgtgtgcttaagaaataataaatacaataaatttgtagctgggtgcagtggctcttgcctataatcccagcactttgggatactgaggcaggaggagtgcttgagctcagaagtttgagagcagcctgggcaacatagcaggaccccatctctactaaaaataaaaaaaaatcagctaggcattgtggcccgtgcctgtagtcccagctacttgggaggctgaggcaggaggatcacttgagtccaggagttgaaggctgcagtgatctatgattgtgacactgtactccccctgggcagcagagggagaccctgtctaaaaaaagaaagaaagaaagaaagaaagaataaatgggtgattgaagttttacccgtttatttgtaaatttaaatttggacaagttacccggaagtgtagaccagtaatgtgttaacacatgaacctaaatgagttatctggttgactcctttataggagcaggaacagggtggtggtgagttagcatgggccagcaagctggtttgggggcaggtaggcagaacaggctggctttcagtcctggctgaggcaggtttgaaagagcaaaggtgaatggcctggattgtattattcttattcttgttttcctagtactgcccttgggtgaaaagtgggagaaagtaagaagtgtttagggaacagcaattagccttttggattttcttggctagattgtggaaactgagcagatgcaaaccatatagaggttagatgggcctggatgattgctggggagctttggaaacacagccatgtgacaaggttacatgtagacatgtccatcttaggaatgcatagtagtctgtccaagaaaaagccatttgatattagtggggtgttttgtatatttgcacagaaaacttgctcatttatcgttcttaaagcactcagttatttgcctaaggaagatgccttttcacataaacaacggtctacctggtatcagaatttctcaacagataagacacccttgtgctcaggaagtaacttctgcaggcagatagcataccaaacttttattgttaatatgggaagaaaggcatgcatcagaataacaggaaaacctgctcttgtgtgtttgcacctgaggagggggaggggacaccatttttatcaggcacactaaaagcagccgttcattcttgcaagatggactgttctagattttgttgctttatgaaatttttggtacacaatttaagtaagtttttggcacaatttaagtaaaacccaggattatttcagacagttagaaatgaacaatagcatgtttatcattagaatcggactctccttgttatatttcatagggtttagcacttgtctgttaatacccatctcactaaatgtctccattcataacataggttttcttcccctgggtgaagggatggggaggagtgaatctttttctaatttctttttcttccatcatgtttatatgtataaaatttcacagaccaacattttctagaacctctgtattcgcggaacaagttcctttaaatacaaagatttctaagtgacattttgacttctgatttacatgaatcttagtaagttatgccaaataaactcttaaattatactgagtaagaagtctgattaagaagtttttcttctcaaaaggaaaataaatgttttcaattctttttaaaataagtttttgtgtttggcagtgccttggtctcacagcagtaaagagattaagtaaaatgctaacttgtagtaactctatatttttaaatttcttatcctaaaaactaatacagagataattcctgagaaacctcatttccctggcaagtcaatagcttactttgcttcttgttatttgcttttaacagtgacagggatttttattctttttttttccttttctttaatttgcagagtcaattaaactgcttaaccaaatagatcttaatagtgttgatagattcttattatattcctgtcataattattttttaaaactggcaggaagccttcagtattcaacatcatttacgacctcagtgaatggtcatgtaaatggacaatttgcagaaattccagctggggttaaccttagaacagggttgttccaatataaagctgctggcttcctttacattattatggatttctgtttgttttctttttatttttgggcaggcttcccctgagaagtttagatggacgatttaagggaggtgtgtttttaggaggacttagtggtgatattggaaaaatcttagtgaaatgacagccgaggtcattataacatggccttgagtctcataactcgggaggaagtaggtaggaggtggtggcagaaaggcaaagatactgaggtgtttctaacacgggcacaggaatatgaggcaataatagaacattactaaagttctcctctagaatgagtcattgacaaatataatttgaggctttaggcagccccaagaaaatatcaatttctatgatttttataaacttacactttggaaaggttggcaaattgatagacaatgaataaacgcatttagaattcaaagttgacattcatattatggcctcaatttagctaggtgagatatttagtgacacttggatgtctttccaagggtcagatttgttaaaacattatgctaaaacaatttgagagataactttaagtattctaggcttaactagaaagcaaattttgcattacagttcaggagtagatagtaactttgcaaacccaaatcaagaaatctaaccacattaaagaaatggattttgttgtaaaactaaaatgattacatactatatttcttaacttaatgagggagaaatgtacctctggtctaataagctccatattgttaaatgtcagtgttagcatctctcttcatcagtgttatccaaaatttaatgctaatattattttactgaatctgtgaagagattgtactatttttcttttctttctttctatttttggaggttggggtgtgtggagggatggtgtttcaaagtttggtgttgagattgtatgtatttccaaagagtaatactgaaataggttgtgaaattataaccagagttctacatcctcaactctttatattcaagaagttttgccatttcaaagaaagatgagaagttttaaaaaaaaaaattatgacaggactgtagtaagagtctatcaacactattaatatctatttgggtaaacagagaggcagataccttttcccacatgaactattttttgatcagtataaagtatgataaaatatgaaaaaaagcaaaattcaggatacttttgtaggtagacacgtcagatattatataaaattagcttaaatattcaaacactgtaaaatgagaggcagataggatatcgtctccaaagaggacatggtgaaaacgatactttgaaatgataaatagtcaaatatgggcataactttttcatattagagaaaacttattgcctagacaaatgtagtagt

SEQ ID NO: 594 - DNA, 5416 bp, Homo Sapiens
atccacagcgctgtgttcaaggaactcttattttacatggttataacccccaaccacaagaggagtgatgctgacaattcggatctgcctaagaaaagccataaagtccttcctttaagtgaaaagtgaaagttctcgacttaataaggaaggaaaaaaataacttcatgctgaggttgctaagatctatgataagaaggaatcttctatctgtgaaattgtgaagaaggaaaaagaaatttgtgctagttttgctgctgcaaaagctactgccacagtgcacggaaatgcctcttgaatgggagaagctgctgctcccccaaattgctggggaagaaagggagttcctgatctttcttattgaggctcatggagcttctgtcctggagattcagtatacttcagtaatggctctggagaagagaactcaggatcctcaagacccaatggctcgtgatgataaaagcctttgggtctaccgacattttccctacgtgctcagacatgtctgcatgcatttattggcatatttttccatactcaaagcaagttgctatgtgttagtactaaagcaacccataatagtaaaaacgaatttctgcaccaagagaatgaatcggcagctgagaaagtcagagtgaagaggccccagtaatatctctacctacttgaaggttaaatattcctaagactctaggaggaaagaggagagaaagtgggccctgttctttcctccaggatgtaaggtttttccaggctgctttgaaaagtctcaattactccaggctatagaagaatacaatcagaggtgagttccctgaaatcaaggacactgccttatctaatggtgctgggagtgcagcgaacttgctggggacagtttgaaggatcatcttaagctctgaaaccaggttgctgccacctgctacagatcacccacagccaatgtccttggctgagtgacacagcttccccgtgaccgccactgatccagccaccaagtatgcagcccaacctatgaagctgagcccagaagtggctcaaaaaaacaagccacaacccagaactgaatcacaacagccttttcctttaacactatacttgctctatttaacctccgccatggccaattcaatagattcacagaaaatatcagcaggacgccttggttctcaacaccaagtctggaaagctgggtttacacgccccacctgagcaagcctgatcggtgattgtgttgggctcattcctcacttggccccttcaagcagagataggccctgcaagaactctctctaggaattgttttctcaatattttaaaatccacttttcctatatcctatcaatgggcacggagtgagagtgatacaggcatgtggaatttcacaaggctagatgtgccagcttcaagactactgagctttaggtatacacttgttatggtttggatttgtgtccccacctaaatctcatgtcgaatcgtaatctccaaagttggagaagggccctggtgggagatgattggatcaggggggcagatttcccctttcctgttctcatgatagtgagtgagttctcatgagatccggttgtttaaaagggtgtagcacctcccccttctctctcttccccctgctctggccatgtaagacgtgcctgcttccccttcaccttccaccatgattgtaagtttcctgaggcctccccagccatgcttcctgtatagcctacaatagagtaagccaattcaacctcttttatttataaattacccagtctcaggtatttctttataacagtgcaagaatggactaatacaacaacaccgaaacacacatgccagccagtattcaccctgtcctgtcctcaacatggtgacctaccagtatcactccttccaagcccatttccattgctccttcatgttcttctttgcctcttgagtaaacaagtcaaatctatccattcatatccccacgtattcacttgcttatccaacattttctgagcaccttctctgtccaagccactggccaggtgctatgggggttggggggctcagagatgactctcagagcaggagagagccctgctaactcatctccctccccatctgctccctgcataaccagcattttggaagctcagacctcgctacacccttagccctagccacaatgacctggatgaaccaaaatcaaattcttcaatagggaaagatttagagaccttgtcctcttagagaaggtaaaagcaatgttcctaaaatcaacagtatggtgtttcagttagaaaaataaaagttcaggttagccaaatattgctgggtaccaggaaatctgtgcaggcagagaaattgtctgccgtgcctgtgccaagataatcttctgtccaatcttctgggaggtcagggcgggccaatgcactgactcaccagggagggctttctaagaaagaaggctggccaggaatcttctagggggaaatatgctgtttttattgtgtctggtctccccagctccctcctaaatctgttgaatgagggagttcatctgctgggtgtttgagagctcaaactgtccaacattgtagtaaacatcaggcaaagggcagtaaacagaggctccctgtcccagctgggaggagcccagatattgatgagcacagcggacagccacagacacacagaaacacaaaaacaagtgccaggagcagtggctcacgcctgtaatcccagcactttgggaggccaaggcgggcagatcacctgaggtcaggagttcgaaaccagcctgacccacatggtgaaaccccgtctttactaaaactacaaaaaatagccgggcgtggtagctggtgcctgtaatcccagctactcgagaggctgaggcaagagaatcacttgaacctgggaggcagaggttgcagtaagctgagatcacaccactgcactccagcctgggcgacaacagcaaaactctgtctcaaacaaacaaacaacagcaacaacaacaacaacaacaaaaaaccaagcaaacacatgcagggctgcccataacctctggaaagaaagaactctcctggtcaggaatctcctcttgggcatgagtgtgaaaataaggactcttgaatttgcttgccacatcagaggcagcattgcagggaggcctttacttcagaggcagcattgcagggaggcctttacatacgtatgtcatccagcctcatggcaaaatagataatagattgtattaccctcattttctccaggggaaacctgaggctcagaggtcatcttgcctacagtgactatttgcaggactgaggttggtatacaggtctgtctgacttctccttgtaggctttcccagaaatcaaagcctcacacgaccccctcctctaaggcatgacagaacccagttgtctgttcaggcagggggaaggagggggtggcccacctgggggatttcaggggtgctgccacctggaaagtaaccctcaggagctcaccagcagtgcctggaactcagaccaaaatcactctcttgggtgtttaaattgtaaatatgtttacctgtattcaatctcaccctgtttattgtttgcttctcctcagtccacaaagcattcaacactcaccattctaaaaataataaaactgggctgggtgcagtggctcatgcctgtaatcccagcactttgggaggctgaggcaggtggatctcctaaggtcaggcgttcgagaccagcctgtccaacataaagaaaccctatctctactgaaaatacaaaattagccgggcgtggtgacacatgcctgtaatcccacctactggggaggctgaggcaagagaattgcttgaacccaggaggcagaggttgcagtgagtcgagatcccgccattgcattccaggctaggcaacaagagtgaaactctgtctcaaaaaacataaataaataataaataataataataaaactggctaggcatgatggcttatgcctgtaatctcagaattttgggaggctgaggcaggaagattgcttgagcccaggagttcaagactagcctggaaaacatagcaagatcccacctctacaaaaataaataaaaataaataaattagctgggtgtggttttgtgcgcctgtagtcccagctactggggaggctgaggtgggaagatcgcctgagtccaggagttcgaggcagcagtgagctgtgattgcaccactgctctccaacctgggcaacagagcacaaccatgtctcttaaataataatgacaataataaaaccaaaaacttttcacacctctgcctgcccctctatttatatttacaatcttacctttgatgttccaactctttggaaaagtgggatcacagcaccactgcattttcttatcctcctataacaagttctggagttgctaaaacaacgtattcctaaggtgcctagtaggtgacttctaattgtcacctgtaatggtatctttcagtcttctgcttacataactgttctgtggcattcagtatctacaggccaccatttccttgaacagtcttctttctcaccttctgacaaattcgtttgttcttatttatttatagcattttgatgattccccatcttctttacctgcatgctagactgatctccaatttgcaatccatcccttcttctgtttctccctctttacctccctctcagccaaagatctctctttagaaaccatcacccaaggtagaggaatgaatctctatgctttgacacctccttctattcctcttttcctcactctccacattcattcctacaaagtctttttttgtttttgtttttgtttttgagacagagtctcactctgttgcccaggctggagtgcagtggcatgatcttggctcactgcaacctccacctccagggttcaagcgattctcgtgcctcagcctcccaagtagctgggactacaggaacccgccactacgcttagctaatttttgtatttttagtagagatggggtttccccatgtgagtcaggctggtctggaactcctgacctcaagtgattcacccatcttggcctcccaaagtgctgggattacaggcatgagccactgagcccagccacaaagtcttataaattctgccttttaaaattcatcctgccgcctccattagatctgctcatgcccccttttaggtcacttttaagtagaaggctcctagctggtcttcctgctcacaatatttccccaacctccacatggctgtcaaagagatgttttagaagaacaaatacagcaaatacagccacgttaagacataaatgcaagtctgtctgactcctccttacttactgtaagttcaggtctgaatgcttcctggctagtgtgtaagcctcttttt

SEQ ID NO: 595 - DNA, 5499 bp, Homo Sapiens
atccacagcgctgtgttcaaggaactcttattttacatggttataacccccaaccacaagaggagtgatgctgacaattcggatctgcctaagaaaagccataaagtccttcctttaagtgaaaagtgaaagttctcgacttaataaggaaggaaaaaaataacttcatgctgaggttgctaagatctatgataagaaggaatcttctatctgtgaaattgtgaagaaggaaaaagaaatttgtgctagttttgctgctgcaaaagctactgccacagtgcacgatttttaaagaccagatctcccaaagagtgaatctgccagagaataaaatctcatcggcaggagaacaagaacagcatacctggaaatgcctcttgaatgggagaagctgctgctcccccaaattgctggggaagaaagggagttcctgatctttcttattgaggctcatggagcttctgtcctggagattcagtatacttcagtaatggctctggagaagagaactcaggatcctcaagacccaatggctcgtgatgataaaagcctttgggtctaccgacattttccctacgtgctcagacatgtctgcatgcatttattggcatatttttccatactcaaagcaagttgctatgtgttagtactaaagcaacccataatagtaaaaacgaatttctgcaccaagagaatgaatcggcagctgagaaagtcagagtgaagaggccccagtaatatctctacctacttgaaggttaaatattcctaagactctaggaggaaagaggagagaaagtgggccctgttctttcctccaggatgtaaggtttttccaggctgctttgaaaagtctcaattactccaggctatagaagaatacaatcagaggtgagttccctgaaatcaaggacactgccttatctaatggtgctgggagtgcagcgaacttgctggggacagtttgaaggatcatcttaagctctgaaaccaggttgctgccacctgctacagatcacccacagccaatgtccttggctgagtgacacagcttccccgtgaccgccactgatccagccaccaagtatgcagcccaacctatgaagctgagcccagaagtggctcaaaaaaacaagccacaacccagaactgaatcacaacagccttttcctttaacactatacttgctctatttaacctccgccatggccaattcaatagattcacagaaaatatcagcaggacgccttggttctcaacaccaagtctggaaagctgggtttacacgccccacctgagcaagcctgatcggtgattgtgttgggctcattcctcacttggccccttcaagcagagataggccctgcaagaactctctctaggaattgttttctcaatattttaaaatccacttttcctatatcctatcaatgggcacggagtgagagtgatacaggcatgtggaatttcacaaggctagatgtgccagcttcaagactactgagctttaggtatacacttgttatggtttggatttgtgtccccacctaaatctcatgtcgaatcgtaatctccaaagttggagaagggccctggtgggagatgattggatcaggggggcagatttcccctttcctgttctcatgatagtgagtgagttctcatgagatccggttgtttaaaagggtgtagcacctcccccttctctctcttccccctgctctggccatgtaagacgtgcctgcttccccttcaccttccaccatgattgtaagtttcctgaggcctccccagccatgcttcctgtatagcctacaatagagtaagccaattcaacctcttttatttataaattacccagtctcaggtatttctttataacagtgcaagaatggactaatacaacaacaccgaaacacacatgccagccagtattcaccctgtcctgtcctcaacatggtgacctaccagtatcactccttccaagcccatttccattgctccttcatgttcttctttgcctcttgagtaaacaagtcaaatctatccattcatatccccacgtattcacttgcttatccaacattttctgagcaccttctctgtccaagccactggccaggtgctatgggggttggggggctcagagatgactctcagagcaggagagagccctgctaactcatctccctccccatctgctccctgcataaccagcattttggaagctcagacctcgctacacccttagccctagccacaatgacctggatgaaccaaaatcaaattcttcaatagggaaagatttagagaccttgtcctcttagagaaggtaaaagcaatgttcctaaaatcaacagtatggtgtttcagttagaaaaataaaagttcaggttagccaaatattgctgggtaccaggaaatctgtgcaggcagagaaattgtctgccgtgcctgtgccaagataatcttctgtccaatcttctgggaggtcagggcgggccaatgcactgactcaccagggagggctttctaagaaagaaggctggccaggaatcttctagggggaaatatgctgtttttattgtgtctggtctccccagctccctcctaaatctgttgaatgagggagttcatctgctgggtgtttgagagctcaaactgtccaacattgtagtaaacatcaggcaaagggcagtaaacagaggctccctgtcccagctgggaggagcccagatattgatgagcacagcggacagccacagacacacagaaacacaaaaacaagtgccaggagcagtggctcacgcctgtaatcccagcactttgggaggccaaggcgggcagatcacctgaggtcaggagttcgaaaccagcctgacccacatggtgaaaccccgtctttactaaaactacaaaaaatagccgggcgtggtagctggtgcctgtaatcccagctactcgagaggctgaggcaagagaatcacttgaacctgggaggcagaggttgcagtaagctgagatcacaccactgcactccagcctgggcgacaacagcaaaactctgtctcaaacaaacaaacaacagcaacaacaacaacaacaacaaaaaaccaagcaaacacatgcagggctgcccataacctctggaaagaaagaactctcctggtcaggaatctcctcttgggcatgagtgtgaaaataaggactcttgaatttgcttgccacatcagaggcagcattgcagggaggcctttacttcagaggcagcattgcagggaggcctttacatacgtatgtcatccagcctcatggcaaaatagataatagattgtattaccctcattttctccaggggaaacctgaggctcagaggtcatcttgcctacagtgactatttgcaggactgaggttggtatacaggtctgtctgacttctccttgtaggctttcccagaaatcaaagcctcacacgaccccctcctctaaggcatgacagaacccagttgtctgttcaggcagggggaaggagggggtggcccacctgggggatttcaggggtgctgccacctggaaagtaaccctcaggagctcaccagcagtgcctggaactcagaccaaaatcactctcttgggtgtttaaattgtaaatatgtttacctgtattcaatctcaccctgtttattgtttgcttctcctcagtccacaaagcattcaacactcaccattctaaaaataataaaactgggctgggtgcagtggctcatgcctgtaatcccagcactttgggaggctgaggcaggtggatctcctaaggtcaggcgttcgagaccagcctgtccaacataaagaaaccctatctctactgaaaatacaaaattagccgggcgtggtgacacatgcctgtaatcccacctactggggaggctgaggcaagagaattgcttgaacccaggaggcagaggttgcagtgagtcgagatcccgccattgcattccaggctaggcaacaagagtgaaactctgtctcaaaaaacataaataaataataaataataataataaaactggctaggcatgatggcttatgcctgtaatctcagaattttgggaggctgaggcaggaagattgcttgagcccaggagttcaagactagcctggaaaacatagcaagatcccacctctacaaaaataaataaaaataaataaattagctgggtgtggttttgtgcgcctgtagtcccagctactggggaggctgaggtgggaagatcgcctgagtccaggagttcgaggcagcagtgagctgtgattgcaccactgctctccaacctgggcaacagagcacaaccatgtctcttaaataataatgacaataataaaaccaaaaacttttcacacctctgcctgcccctctatttatatttacaatcttacctttgatgttccaactctttggaaaagtgggatcacagcaccactgcattttcttatcctcctataacaagttctggagttgctaaaacaacgtattcctaaggtgcctagtaggtgacttctaattgtcacctgtaatggtatctttcagtcttctgcttacataactgttctgtggcattcagtatctacaggccaccatttccttgaacagtcttctttctcaccttctgacaaattcgtttgttcttatttatttatagcattttgatgattccccatcttctttacctgcatgctagactgatctccaatttgcaatccatcccttcttctgtttctccctctttacctccctctcagccaaagatctctctttagaaaccatcacccaaggtagaggaatgaatctctatgctttgacacctccttctattcctcttttcctcactctccacattcattcctacaaagtctttttttgtttttgtttttgtttttgagacagagtctcactctgttgcccaggctggagtgcagtggcatgatcttggctcactgcaacctccacctccagggttcaagcgattctcgtgcctcagcctcccaagtagctgggactacaggaacccgccactacgcttagctaatttttgtatttttagtagagatggggtttccccatgtgagtcaggctggtctggaactcctgacctcaagtgattcacccatcttggcctcccaaagtgctgggattacaggcatgagccactgagcccagccacaaagtcttataaattctgccttttaaaattcatcctgccgcctccattagatctgctcatgcccccttttaggtcacttttaagtagaaggctcctagctggtcttcctgctcacaatatttccccaacctccacatggctgtcaaagagatgttttagaagaacaaatacagcaaatacagccacgttaagacataaatgcaagtctgtctgactcctccttacttactgtaagttcaggtctgaatgcttcctggctagtgtgtaagcctcttttt

SEQ ID NO: 596 - DNA, 1881 bp, Homo Sapiens
gagattctggaattcctatgaaaatgggatctctaagaaagattcctaacaactggctttggagacgagtaagtgtgtattttcacctttaagtccatgagctgcagggagccacttcatgggaggattttgatgacattttactttgtgcatgctcattttaactgtatgacattaaaacagcaattacacatatcaaaagagagaacggatagcactggggaccaaaaggctcactttcccacaaatagtcccttcttctggatttcatgggtacccattagtaccagaatttcctgggtttggctatggaaagtttcaagtatatattacatatatattataagatgaggacaacttgaagccactacctgtcgtcagtgtgtaaggagggaggtagtttttcttgggagggtggaggtgggaggtagcccagggaaaggcatgaagggcaacaggctgggaggagggaggaagtgcagtcagccttggaaccttagacagactgagtgctgcatctgggcacaggcggtcagcctgcactgactcctgaaggcaaagcaagggaggggagaagcatgtggctaaacagagaaggggaggattctagccagaacacactgtttgcttttataaatgccaggggtggtgcattggtaagcaccctgcacagaagaatggggtgggagggctggaggaatacctggtccagtccatccaggagtcctcccatacctgcattccctgcccatgatgcgatttgatgctcagcctacatcaaataacactatgtgctgaatgggaaatgagaggaaaatacgaggaggccttattattcttcacaattttgcctatgtccaattccattcagcatgattgcttttggtgcccagagaagctgagtttctatcaaaaacatgtatatataggtgagtgtatctgtgtgtttgtacatgtatgtatatgtgtgtgtatacatgtatatataagtatatgaagatggtggtgttcctgctggcatcctatggccaacttgacttcagagtacccaggggaaggcctggctggccggatgcccttgcagatgtcagctccagtgtggacatggtgcaatgacagccaggggtgtgggagcatcctgaatgtgtcccgtgggagggcagggcctctgaaagggtcctactcaggatatgtctcctgaaagccaccagggggtggagagagaagtaggagcccaacaatggctccatccctgctctgcttttggcggttgtataacatccctgagtcccagattatttgtctatcaaaaggacaaatgaggtggctcatgcctgtaatcccatcactttgggaggccaaggtgggcagatcatttgaggccaggagttcgagaccagcctggccaacatggtgaaaccccatctctactaaaaatacagaaattagccaggtgtggtggtgcatacctgtaatcccagctactcaggaggctgaggcagaagaatctcttgaacttgggaggtggaggtttcagtgagccaagatcacaccactgcactccagcctgggcagcagagtaagactccatctaaaaaaaaaaagagataacaatatcccctttgcagaatggtgatgggcatcagacatgacatatgtaacatgtcccatgcacggaagggtgctccatgactgcaaacctggatgatgatgacaacgacgatggagatgactaagactgtatttaaaaatggaattgctgttgtttcctggcttcctgatggtcctgttttttaccttctgctgctttttacggatttattttttcttgactgattcgtacctttttgagcaatgggaacctttggtggtgtaaagcct

SEQ ID NO: 597 - DNA, 2352 bp, Homo Sapiens
ttatgacctgggagctgggcccattttatgaccaaggagatggggagttggaatggtggtactaagaggcataggaagttgagtgtgaataccattggtgatgggtccaggagaactagactatggttcttgaatatctgtccacaaagaatatactaacttttgtcaacttctcagaactcccaactggagtcggtgagacctaggattttctgcacttccacacatgcctgttccaagtgtggctgtcagccagtcaacaagtttgtactatggcccattctctgatcaccaggattacaggaactcacacactcctcatacttggcctgtagtcctacttcttgttagaagtctccaagtctggccagtcacatgaccaagtgttgatttttctggaggaaaaattttatggaaatgatataggggaaaggtgggaggagatgaaagaacaggcaagagctgtcagggttaaatccaggcccgggcatgagaatggaagtgatcagggagactcggtccttgttccaagtctccaaagaagaccaaagtgggtcccttgagcaatgaagaatctgagataaattctcttcaagtatcatgtacaaaatctgtgagccagagattttgacttgagcaagccatggaaatgcatggagcaagggtgacactctgtggggagacagaagaatttcaactatttaatgtccattttgttgtttttaccctttcttatccaatagatggaatgcacatgaaatgaccatattaagcctctctctatttacatcccaggctcactgggatgtgatctactgcagttacattttcttgtaacggtttctggattagaccctagggaaagtgagtaaggagccagtttctgtttaacattctagttttactcattttaggaaggctgtgagtgaggcttgtctcctttaaagtttcttctccaatggaaaccaagaacagacaaaatttagagctcagctgtggtctcttctcatcttctgctcttttgctttgaccacagtttttctactcttcccatcaacactagagcaatggctgtgcaaataggaataggaaatactaccacaatgatagaaatattatccacactatcacgtagggaagaacaatatcctgaaagagaataaaacacgaataaggtgatgtacccacattaatctgtgggtttgtggaatgagggttgcaaagttattgggaaaaggaaagagcagagttcacccattcaaaaaaaaccttttgtctactaatctctagtgtaaagaaaatgtagttcagataccattcattgtcttgggtcatgcttagtgcccccaagaagacaaacatatttattcttgggattctgataggcttcaatatgcaaaggacaatggaaaagtttagacactctattttcaaaattttataaacttgttttattggggaaaatgtccaaattgctagacacattctaagttctgccttggagaatcctactttgtctgagattgaggcagaggaattgttatcctgggcattactcagctcaggaacatggagcctgtggttcatgccagtgtgtgtcttcatgcagtctctccacaagagcaacagtaagaacatttctgttttaaatttcattttaaaatattttattatctgcaattcaccactgctctgggaaagcaaaaggaaagttcctgttgtgtgtgaagagcctcttaggctataaggcttcccagccatagtcagctatagctattcagagacagcaggttcttccagtctttgttcctgggacctgatgttttgagcaactcaggtcactgataaagtggaaggactaagacactgtggtcacagatcccagcaacatcaactcacactcaatccatgtggtggtccacattctgctactcttatccacccatgtggtcattgagagcctttctcagagactcttctgtgtgtttgattgtgcccaggtggcccagggctagctggctctaacaactagcatgacagcctccaatcagaaaggcaggtaaggggacagggtgaggagaatgggcagatactgacagaaattaaagtaaagggattgtgaaagtaaagagctcttcctgattctcatcttctcttttttctattacaaggcattgaacttggcacttcctgtattctttgtgatcactattgagtgcattagttaacacccaaggggatggcttgattgggaatgtagtgaaaggagctgatctactgtattgtaatgtaaaacagctacagccagttattttgtaagattataagttgttcattaaaaaatcagcacac

SEQ ID NO: 598 - DNA, 1531 bp, Homo Sapiens
acccaacatgctactcagcccaattcccaaccctttgcaccaggtttggcttctgtttttatttttgcaaagtctgttcctcttggctccaacttccgtctttggagttgttaatggagaagttagggtgctatgtagattcaccaggcgagttcagtactactaccctggggatgaatgttggtgagaagccattccagatagacccccaacaactctgcttcgttgaccctcagaacagtaccctgtgggactcctgagccgtaaggagtctccctggtagcgcgcagcggggccaggctctgtgctccggcccccgtgcggtgcccagctctgcaggttcccgaaagtgcgccccggggtggggttgcaatccgccccgtgacggcataataaataattagagggtttaagcgtgttagccacagctcatgctaatgagccagataagggctcacgctaacccgaagtgacagtttgcatataggagggaagaagaaaaaatcctgcttccccccccacgcacaaacttgattgctccttctcaaattcatgtccccaaatcccttcccccattcctcggacttccctcttctcacatgcccccacttcagccacaacacacacactatccgtttttgacccttcctttgcctttcaccgggtcagacggcattgtgacgtcacaaaacccctgggtgcctatatctgacctgcgcggaaagttcattctgagtgcgtcctggcgagtctcagcccccaagcgggtggaacgcaccaagggtctcatccgcgaggaagggctttaacgctcagggtcaggaacctctgagagctcttggggacttgcgcgcccttggatgctcttgcgttcaacagggctaggagactaccggctggggcgaggaatgcaggcgcctagagccttggagctcctgaaacgttcctgccgcctccggaaagcaagggcagtttaccgaagtgactgaggccaagtatttgcagcacgggcagggaccagtaactgattttcaggccttttgagaggaagaggaagagagaggaagagaaggatttctaatagtagatattcactctcatggactctttaggaaacagcaacaaagacaagattaagaacaccaaattgtgtgactatccacacaaaaaagcatcttcataagaaccaaaaatcagagggcaaggaaaaaggctgaatgcaaaaccagaatgtcaacagggtgctaacggagaccaatggaaggggcaactgactctccccagggaaggtaggcaaggagattgagggaagtagcaatgaaaggagagcttgcaaaatgaagtcatcagagctttgcataagaaacaattcatggaccttagatcaagtagtgaggattaaaactatgtctatgtgaggctttggctagtttttctacctaagacatccttacctctcctttccacttgggaatcatcttcctttcctaaccatcatcatcaaccctcaaggcagtcaggggcatctgtg

SEQ ID NO: 599 - DNA, 1759 bp, Homo Sapiens
ttttttaaatttttttcagaatttcaacctttattttagatttagggggtatatgtacaggttggttacaagggtatattggtatattgggtgatgctgaggtttgggatagaaatgaatccatcactcaggtagtgagcatagtacccaatagttagtttttcaacccttcccctttccccactcctccttctagtagtttccagtgtttattgctgccatctttatgtccatgagtacccaatgtttagctcccacttataaatgagaacaagtggtatttggttttcggtttctgcattgacttgcataggataatggcctccagctgcatccatgttgctgcaaaggacataatgtcattctttttatggctgtatagtattccatggtgtatatgtaccacagtttctttatccagtccaccactgatgggaatctaggttgattccatgtctttgcgattgtgaacagtggtgcaatgaacatatgagtgcatgtgtctttttggtagccgtatttactttcctttgggtaatgagatttcagggacccagtaatgagattgccgggttcaatggtagttctgttttaaattctttgagaaatctttaaactgctttccacagtggatgagcgaaattacatttccaccaacagtgtataaatgtacccttttcaccacagccttggcagcatctgttgattttcgactttcttataatagccacctggctggtgtgaaatggtatctcattgtggttttgatttgcctttctctgatgattagtgatgatgagaattttttcatatatttgttggctacttttatgtctttttttgtgaagtctctgttcatatcttttgcctatttttaatgggattatttagtttttgtttgttgaattaagttccttatagattctgcagattagacctttatctaatgtatggcttaccaatattttctcccattctgtaggttatctgtttactctgttaatagtttcttttgctgtgcagaagctcttcagtttaattaggtcccacttgtcaattttcatttttgttgcaattggttttgaggacttagtcacgaattatttcacaaagcagatgggcagaatggtgttttctaggttttcttctaggaatcctatagtttgaagtcttacatttagatttttaatccatcttgagttaatttttttatgtggtaaaaggaaggggttcagttttattcttttttaaatatactttaagttctagggtatatgtgcacagcgtgcaggtttgttacatatgtatacatgtgccatgttggtgtgctgcaccaattaacttgtcatttacattaggtatatctcctaatgctatcccttgcccctccccccaccccacaacaggccccggtgtgtgatgttccccttcctgtgtccaagtgttctcattgttcaattcccacctatgagtgagaacatgcggtgtttggttttttgtccttgcgatagtttgctgagaatgatggtttccagcttcattcatgtacctacaaaggacatgaactcatccttttttatggctgcatagtattccatggtgtctacgtgccacatttccttaatccagtctatcattgatggacatttgggttggttccaagtctttgctattgtgaatagtgctgcaataaacatacgtgtgcatgtgtctttatggcagcatgacttacaatcctttgggtatatacccagtaatg

SEQ ID NO: 600 - DNA, 10568 bp, Homo Sapiens
acagacaaacaggtactggcaagatagactatgctgatggagtaaccaagtttgtgagtatatgaaaataacgagggatgacatatgggaatattacacaatgataaagttggaatgtcacaatgaataaacaaaatctgattcagagactatgccaagccaggtgataagatcttgaagaaccaagatccagagagaagtgaaaggaatcagtgttccatggaacggaagtgcatcaggaaaggaaagagaaaacagattcagactaaagcacgtgcctgacaatgtgtctgctgcattgcatgaggcagccttgctgcagccaaccatagtggggtccaattaagaggcttaattgaagaattccaagttagcagactgtcctggcactcagaggatattgtgcctggtaatgatagtgttgaattggacagaaagaatattcacaaaggtggctgtccatatccatgggttctgtatccatagatgcagaattcttgaatacagagggttgactgggagatctgacatctgcaggttttggtatccgtggaaggttctgcaaccaatctctggtggatgtgagaggtgattgtacttaagcttcaagaaaggcctcctctgctaaaaatgctctctgattagccattcactgcttcctgaactatgaagacatcttctaggaatactcaggatcttctgctatgtggctttaatttattttaagattaattcctcattaccttcttacacaaagccaccattagcatatcaagcacagctgtacaaatttttaaaaggccaaaagatgtatctgccaattctaggaggatataaacctgaaggcacaaatctgggctggagcacatggtttcccttgtgagaagaaaaagtctccttcctctgaatggacacaccttgcacaccagggcacaaggtttgtctagaagagcacagctgaacatcataaagtgcagaaccacacacctggcatccttgtccctacacaagagaagccagaagttgcagctcaatgcaccatgaagctgagacagaaatggagatcccccagccccacctctctggaacaggaaagatgaatgaggaagaaacacagggcagtatggggaagagggtcatggcggacatgggggtagtgggctggtctccccaccttctcatattatgctaacagggacaaagacacattcagactcctttaaatagccttttcccattctgtttcaagatgggtgacaagagacatcagacacccaccctccccggtaaaagaagcaaaattataaatgcataatcatatctctaatagaacatctaggatggaacactagagaccaatgacaaagtcatggaaaacacccaagacacagaaggagaaaaaaagcaaggggccagcttggctgagattggctgggagcctgaaggggcttggtattgtgtgaaaagcctcagtgaaggagtttcagtggttcacatacccagtatggacttctgcaatctgaaccatgggaaaactcctttaacctaatgaactgtgacactagcatgggtggtgacttggagaccacacaaggccatagcatcagagaacttatacagggttactcaaccccttgccaagacctgagtgctgtggcaaggcaccacttggggagcacagccatcacaggactacatccagcccccttatctccacatcctagaagatcctgctgacatttcccagtgtccacctggaggactatagtggcattgcactggctagacccaaagatgttgcatgtccccaggactctagctcacagggattactacccactgttgaaaggacagtgcaacacacaaaaaaatggtagcccatgggacaagggaaaccaaagtatgtgcttcccagagtctgagaggtctctgtctgggactatgagaagttactctgccctcaacagttgcacaaactctgtgcccagttttataagcagagagtaaattctcctaccactggcagagcagcctctgcactaaggctcagaagtagagaagtagagactaggacttctccgcctcaaaacacccaactagtgtctctgccagatgctttagcaagtgagctggagggctgcctatttggggtgccacagagagcaggagctctgtgtcctgcagcatgtctggagttgtgggcagtaaccccacactgcagccaccacttaaatcagcctgcatcacttgggtccaagagggtcataccaccactagcactgctgtaacccacaccatgctggctgcccagggacctgagcaccagcccacccacttggcccaccaccgccatgactagaattcatgcaagccacctggaatcagcccactggtaaccaccaacacaagttctcctgtgcactgcctttgggcacaaagataggcatgctcaggccacctctgcaaccaccaggacctgaagactggaccacgtggcttcctagtccttagcacaaccttatcatagccttcaataataaccacactctaaccctctgaggaaatcacagaaagcactaatgctgtttacagctaagtacatcttacagagactgtaccagtacagacacccagaattaaagccaaagtgcttaatccaaccaacaccaccaatacatcttcagaaaaatgtcctctatgaaagtaaattcagaaacaagaatcaactgttacactagatatgcagatatcaatgtaaagacacagaaaacattttaaaaagcaaggaaatatgacacttccaaaagaacacaatgattctttagcagtaaattcttaacaaaaaaggaatttttgaaaaacaattcaaaatatgaatttttaagaagcccagtgagatataagagaattctgaaaaaaaatacaaataaatcatcaaaacgattcagtatatgaatgagaaatttaacaaagtgatagatatttttaaaagaaccaaatggaaactcttgaactaaagaattatttgaaggaaatacaaaatacacttgaaagattaaataatagactagatcaggcagaagaaagaatcccagaacttgaagacaggtcttttgaaataattttgacagacaaaaataaagaaaatagcttacaaagaatgagcaaagcctttctgacatttagaacaacataaagtaatttaatattacaattattgggatcactgagaatgaagagacaaaggaaggattagaaaacctatttaaggctggacatggtggctcatgcctgtaattccagcattttgggaggtcaaggcaagccgatcacgaggtcaagagatcaagatcattctgttcagcatggtgaaaccccatctctaaaaatacaaaaattacctgggtgtgagatgctgcatgcctgtagtccctgctactcaggaggctgaggcaggagaataacttgaaccccaggaggtggaggttacagtgagctgagagtgtaccactgcactccagcctggcaacaaagcaaggctctgtctcagaaaaaaaaaaagaaaaaaaagaaaacctatttaataaaatgatagatgaaagcttcccaagtttgcaaaagatttagaaattcagatagaggagtctcagcaatcttcaggaatatgcagtgcaaaggccttctccatgacacatgatagtcacactgcctaaagccaaagataaatagtgtatcctaacaagggcaagagaaaaatgtctaatcacccataatgaaaacctatcaaactaacagtgaatttttctgcagaaactttataggccagaaaagtatgagaggatatattcaaagtgctgacattaaaatcaaaacaaaaatcccagctagcaaagaatactagatccagcaaaattatccttcataaacaaaggagaaataaagtctttctggacaagcaaatgcagaaggaatttgttaacgctagactggccctacaagaaatgctcaagggagtcctaaacctggaagtgaaaggatgatatgtgccataatgaaaaaaatacaaaagtataaaacacactgataaagtaatcacacaaaggagaaaaagaaaggacactaatggtactactacagaagtctaccaaaccacaataacaatcaataagataaaaatgaaaggaccaaaaaatacatactacaactccaaaacaatgaacaatatgataggaaaaaagcctaacatatcaataataagcctgaacataaatgaattaaattatccacttaaaagatatagaatggcatatggattaaaaaacgtgatccaaacatgtgctgcctacaggaaactcatcctaccagtagaggcatgtgtagaccgaaagtaaagcaatggaaaaagttaccccatgtaaatacaaacaaaaagtgagcaagagtagctaaacttagatcagacaaaacagactgtaagttaaggacattagaaaaagacaaaggaagtcactatataataataaaagaatcaatctagtaagaggatctaattctaaatatatatgcacccaaaactgcagcatccagattcataaagcaaatattttatctaaaaagagaactaaactatgatacagtaatagcgggggattctaacaccccactgtcaacattagaaagatcatctagacagaaaataaacatagaaatatgggatttaaactggactttagaccaaatgttcctaacaaacatttacagaacatactatatacattcttttcatcaggacataaaatattctccaggataggccatatatttggccacaaaacaattctcaaaaaatttttaaaaaatcaaaatgatatcaaaaattgtctgagaccacaatggaatggaactagaaatcaataccaagaggaactttggaaactataaaaatacatagaatttaaataacatgatcctgaatgacctgggtcaacaaaaaatatgtaaatttaaaaaacttaaaacaaatgaaaattaaacacatacaaaaacccattgcatacagcaagagcagtactaagagggaagtttatagcaataaatgcctacatcaaaaaacaaaaagactacaaatttacatctaacaatgtgccttaaggagctagaaaacaagaaaaaaccaaacccaacattagctaggaaaaagaaataatacaaatcagagcagctgtaaatgaaatagaaactataaaaatataaaggatcaacaaaataaaaaggtgatttttcagaaagatacaactgataagttagtagctactaactagtctaatcaggaaaaagataagagaagacccaaataaagaatatgagaaatgaaaaggagacattaaaacagatatcacagaaatataaaatatcaccagactattatgatgaactaggatactgacaaactgaaaaacctataggaaatggattctttcttggagacataccacttaccaagattgaatcaggaagaaatgagaaacttgaacagagtagtgagagtcaataatgagtagtgagattcaatcactaataaaaagtctccaaacaaaaaaaaagtccagatgggttcatagccaaatactaccaaacatgcaaaaaagatgtaatgctaagcatccagaaactattccaaaaatgaaagaggaggaaattctccccaactcattctatgagaccagcatcaccctgaaaccaaaaccagacagtcacaataaaaaaagaaaatttcaggcaatatccctgatgaatatagatgtataaatccttgaaaaatattagcaaacacaatccaacagcacatcaaaaagataattgcctgaatagccaaagtaatcctgagcaaaaagaacaagctagatacattacattacccagcttaaaaatttattgaaagtctatagtaaccaaaatggcatggtactggtacaaaatagatatatataccaatgaaacagaataaaggacccagaaataaagccacatgctttacagtaaattgatcttcaacaaagctggcaaaaacttttaatagggaggggacaacctctttaataaattgtgcttggaaaattggatagcaacatctagaacaataaaactggacctgtctcttccatcatatacaaaaatcaactaaaagtggattaaagacttaaacataagacatgaaactacaaaaattctagaagaaaatttagggaaaagtcttctgattgttggtcttggtaaatacttttttcacagacctcacaagcacaggttacaaaaacaaaaatagaccaataggacaattcaactaagcatctgcagagcaaaggaaataatcaacagaattaagagataacctgttgaatgggagaaaatatttgcaaagtgctcatctaatagtggactgttatccagaatacacaaggagctcaatccaaaagaaaaaaataccacataataccattaaaatgtggacagagaatacaaatagatatttctcaaaagaagacatagaggtggtcaaaagttatataagaaatgctaaacatcactaatcatagaagaaaggcaaatcaaaaccacaatgaaatattctaccccagtcaggatggctattattaaaaagacaaaaaataactcatggtttggatacaaaggaaaggtaactcttactcactgtttggtgggaatgtaaactagtacagctacaatggaaaatagtatgaagatttctcaaaaatctaaaaatagaattaccatttgatccagcaaccccactactttgagtctactcaaaggaaaagaaattaatatatcaaaggcatacttgcactacttgcatgtttattgtagcactgttcgcaagagcaaagatatgaaatcaacctaagtgtccatgaatgaatgaagaaaatgtagtatatatatacacaatggaatactatttaaccataaaaataatgaaatcatgtcatttgcagcaacatggatggaaatagtgtctgtattagtttttacactgctataaagaaccgcccaagactgggtaatttacaaaaaaaaaaaaaagatttaatcgacccacagttttgcaaggccatatcattatcttaagttaaataagccagttaaataagccaggcacagaaatatatttcacattctcactcatatgtgggaactaaaaactttgatcacatggaggtagttactggaaagactataatagagactgggaagggtgagtgggggggagggagagaatgtaaagaagtgagttaaagtttatagacacacagtaagctagaagtaataaattcaatgtttgatagcagagtagggtgacaattcttaacaaaaatgtattgtactcaggtgctagataccctaaatgccctgacttgattatatacatgcaacaatttttagattgtataaatgggagaaagttcaaaagcacttcatgtatttgaaaaagcttttgccctatatattctcgtagtagttttacaatttctggttttacatttaggtttttaatccattttaagttgatttttgtatatggtgtgagatgagggtctaatttcattattttgcatgtaattattcagtttttccaacatacttttttgaagagactttttcccattgtatattcttggtgacttgttgaagatcaattgaacatatatgtttagatttatttctggactctccattttgttccacaggtgtatgtgtgtgtgtatatatatatatatctgttttgatgctagaactgtactgttcagattactacagctttgtagtatattttgaaatcaggtagtgtgatacctctagttgtgttcttcttgctcaagattgctttggttgtttggggtcttttgtcattccatattaattttagattttcttctgtttttttaagaaatgtgattggaattttgataggaatttcatggtaagtatcttgtatctttgggtaatatggacattttaacagtattaattctgatccatgaacacaggatacctttccatttatttgtgtcttcttcaacttctttttatcaatgtttactagttttcagtatatagatatttcatctccttgattaaatttattactatgtgttccatttattttgattttattgtgaaaatgactgcttgcttaattttttggtcacttggaattccagtaatatactaaatagaattggtaagaacaggtattttttttttttttttaatcttagagaaaaagctttcagcttgtcaacattgagtaggataatctttttaagatacagtgctggaacaactggacatccacatgtggaaagatgagtctagacacagaccttatgtcctttccaaaaattaactcaaattgaatcacagacttaaatgtaaaatgcgaagttggctgggcgcagtggctcacgcctgtaatcctggcactttgggaggccgaggcgggtggatcacgaggtcaggagtttgagaccagcttggccaacatgatgaaaccccgtctctgctaaaaaatacaaaaaattagctgggcgtggtggcgcgcggttgtagtcccagctacccaggtggctgaggcgggggaacagcttgaacccaggaggcagaggttgcagtgagccaagatcaagccactgcactccagcctgcggacggggcaagactccgtctcaaaaaaaaaaaaaaaaaaaagcaaagttgtaaaatggctggaagaaaacacaggacaatatttagatgatcttgggtttggagatgtcttttagacttttagaagctaatctaaaagaagctacacacggccgggtgctgtggctcacacctgtaatcgcagcactttgggatgctgaggcaggtggatcacctgaggtcaggagttcgaaaccagcctaaccaacatggtgaaaccccatctccactaaaaacacaaaaaattagccgggcgtggtgacacgcgcctgtagttccagctactccggaggctgaggcaatagaatggtgtgaacctgggaggcggagcttgcagtgagctgagatcacacgactgcactccagcctggtgacagagcaagactcggtctcaaaaaaacccaaacaaacaaaaagaagctacatattatatgattccaactatatggcatcccggaaaggcaaaattatggagatggtaaagagatcagtgattgctgggggctggggagaggaagaaatgaatacatggaacacagagggtttcagggtcagaaaaactactccttgtgtgatactataacggtggatacatgtcattatgtatttatccaaaccaatagaatgtacaacaccaagagtgaactctattgtaaactatagacattgggttatatcgttgtgtgctatggtctaaatgtttatccccaccaccactaaatttatatgttgaaatcctaaccttcaaggtgatagtgttagaagatgggaccttttcgaagtggagccctcgtgattgggattaacacccttatgacagagaccacagagggctggctagtccttctatactgccatgtgtgtacagtaaagagatgattgtcaatgaaccaagaagcgggccctcagcagacactaaatctgctgacaccttgattttgacttcccagtttccaaaactataagaaataaatttcttttttaataagctacacagtttatggtattttgttatagcagcctgaagagagtaaaaggatgtagaaatataggttcagtaaccataacaaaagtaccactctgtggaagatgttagtaatgtgagaggctatgaatgaggtggcgaggaggtggtatatgggaaatgtcactttgttctgttcagttttgctgtgaatctaaaactgttctaatagataaagttgaatacaatattaaaacaacaacatgttactgtctttgtaactattcaatgacatttaggcagggcagaggctattggacattatatatatccttaaagtctccctttatatatatacacacagatataaatatataagtatagataaagatgaagcctaaaaacctagtttaattatgttaaatttcattagggaatatgtaattttacctctcgcttttattataatggtcttgacttgagctggccatgcacattttcaccatgctgaatttaaaattgggctactttatagagttttgaacaaaatgctgattcccctcagactctttacaacattgctctgaatcatatgaattgcccttaatcaataaagcagcactcatttgactggccctgtaatgtgtaaccttctatttccaaatatggtaaacatagagaagccatctatgtgagaaggtttgagtaggctttactcccatttaccctagtattgatttctatatatggcaggaaggaggaaaagggatgttttcatcccttctcagttcctatccctaaatttttatcttaccaagaactcaaatgctgtttcctt

SEQ ID NO: 601 - DNA, 3729 bp, Homo Sapiens
gaggagcccgaagtcggcgcgccgagtgcggctgcgcgggccccgccgacggagcccgcggccgggaccccgaacccccgcctcgagcccgccgcgccggggctctctcaccggaacgcgagtccccgcggggccaccggcgcgtggcggctgagcggccgcgtttggctcccggagcgcccacaccctctcgggcttccggctttctcccgaggcccggctgcgcctggcttgtggtagcatccgctgtggccaggctcggagctacactcaggaaaagtggagttaatggaggttcctagagacactcacacaattctcaatccacatttcaaaaggctcccctgagacgcaccctgtcggcccctttccgaaagcacgcgaacttaaggctggcaggtgctttaaaagacactcctcccaaggactaggaagcctctgaaatgggcttggaagtttctaatcccaaagacttcgaacccaggatctggatagcaagcaaaaatatttagatatttactcagttgaaaacgtggggggtggcttcgtggtctcttcgccagccaaatcgcgtggaaaaccacgacctcaatttttacaacagcacgaagacttacaagtgagcgtagcagcgacttcctggaacctcaaacaatgtgggacgctgcaataatgcctgagggcttttgacttacagttgccgccggagacctggggagggggtagtacttgggccggtgagtccagcctcaggaactgtcctttcaaaaatggtgatggatgtaacaagttgcatgtctgggctttatttcagtgtattaattgtgcgatcttttaaaatagctgtatttttaaaactgttttacagaaatctctttaaaatgtgattattctctatattcttaaagaatacaatggctaattaaatcctttgttgataactgactctcaaaccgatatcttggccatacgtttaagtcccagaggattgctgcggtgtatagaatccctactttggtgctctctttttttccctctttggaatgttctcatcacctcttctaaaatccttcactgcttttcatctcctcatctgcctctatccactctgatccttcctcttattctttctgctttactgtttatttttcattcttctctcctttctcggctggttttctctgcggctccaggtgaagattgatgggatgtttatgtccacagccagctaatgagaggtttcttttcttctggttgtaaatagggcagtggtatcttgagatattttcattgctcttcactatcagaagttctttccctgtgagagatgtttccttttcttaacttttggatttggccctcttcgagacagctggcaagttgatcttggaataattgaagtataactgtatattgtttcaaagtatgaggattttatcagagtgtgggcgaatggggtggcttccccatcttactgcccaactatgcttggtctgagactaagatagtggtttccaaacttaccgctaagctaatactttcctactctgcttcctactcaggagctttttgaaaatacagaatcctgcaatctaccccctcaagattctgattcctttgtccagggagaggccaagacatggcacttttaaaaactatatttaaaaaaatatgtttgggacatgcctacatgtaaaggcagagtaaagaagatcagctgtttttgaaggagattaacacataatttaagaatgttattgaagacctagagattgtagtcaataatatgcaatgcagtaaggtgaagtaaagtgaagaccaaggaatttatggcctttggagagaagaaaacccacacataaatgaccctagcatgtgcaccagtatgagttctctgggaacagagagagggtcaagaaattatgttggctttgaacaagttctcttctcaatgcttcactttttttttatcaataaaatgggagccattttcaatcctcatctttcttggcctctcaacaatactcaacactttgaccactattctttcttaaacatttcttcttcctttgacactgcattttcttggttttcctccttagtttcctaggcactgcttctctgattcctttgcatattcctgctggtctccctaactattaaatataacagtaccttaaaattcagttttagattcttttctgttttcattgtaatctcttggcctaagcagcatcacccacgccaatggctttagttatcatctatatgccagtgatctccacatatatgcctccagcccagacctttcctctaaattccaaatctgatccactagtcaaagtttgaccctacctctaaattccaagcttcactgacatggccacttaatatctcaaagttgcaaagtttagtccaactgagttcatgaacacttgttttccttatcccccatctctctagttattcaaatcaaatatctagtagtcagtaaccgctgatgtctccctcacctccattcttccattctccatatttgttgcagcactaactcctggcaattttatttctaaaatctaattggtctacttctttccaatcaccaccaatctaattcgatctcactgtatacaatctgggatcctccattcagtctccattttgcagccaaaattatcctctaagaaagcaaatgagactatgtcactactccaaaaatctccttaaacagtttctcattgctttaggataagtctagaattcttaaggcagcctaaaagaccatacgaggtctggccttacctgccttttccagcctcatctcacaccattttcaccttgtttcctgggcagacttcctggtcttcttttagtttctcaaaaatgctatgatcccaacaaccaaaggctctatgtacatgccattctctcctttagttatcctatctcttactcatccttcaggtctcagcttgaaagcgacatccttgggaaaaacatttctgacctcccagatacattcaagataccttgttatgtcagctctcttaccaccatataccctcccctcttatgacttaccacagcttgtaactacattttggtatgtgtaactactaggttaatgtctgttgctccccacattaggataaagaccatgtctatttgggcctgcacagtgcctggcacatagaagctacccaataaatatttcttgaatgattattgtcctatgagtttatttctgggattctagaaggttgttagatcgggaaattagatcactgatcattttcaagagagcaatcttctgtatgactagtgggaagaaatgcagaaatgtgctggaagacaattctctgtgggactctagtatttctgcatgtcttgtgagcagaggcactaacagcttttgttttagactatattttcaaggatttttttttttttttggtcaaactgccttggaaaatatacatagtgtcccctgccctgctccccctccccgccaagagcaggggcacatttgtttaccatccaatatagtgaagataatgtctttggaggtaaaggtcaagcaggttttcttgcagcctattataaaaagattggggatttcctaagcttagatagagtttctcagctgtgaggcaaacccactgcaggtgcatcactcacctgaaccacaccatgtagctccaggtaagacctgggggcaagggaactgac

SEQ ID NO: 602 - DNA, 3088 bp, Homo Sapiens
aaatccttaatcatgccaaaacgccattctcctgcctcagcctcccgagtagctgggactacaggcgcccgccaccacgcccagctaattttttctatttttagtagagacggggtttcaccgtgttagccaggatggtctcgatctcctgacctcgtgatctgcccgcctcggtaaataacaaacattggcgaagatgtggagaaactgaaacccttatgcactgctggtgagaatgtccaatggtacagctgctgggtgtatatcattttttcttacgtgcttcaaatagtaacatatctattccctcaccctatgacaaatctcaatacaatgctgatgtcaatctttagtcttctcctctccaggccaaacaatcctagttttctcatggcagtgtcttgatcattcactaccctaagtctcctctgggtgctttctaatttactcctaatgttctttctaaaatgctcacctaaattctgtataatctggacaacacatggtacagtagaactattttttgcccatgctcttactgctgtatattactcttactgctggatattaccataaaacctaacattgtattaggcttcaattagagttcacatcagagtgttgcttcatatatttaaaagcacagattttatagcaattaattaaatgaacataatttaaaagagttgctgttaactataaacttagaaaagtctatacataaaaatctttatgaagaaattcatcctcagataccgtataacagcagaatgtgttatatactattatgactgtaattcacagcatacatatactatgtggcattgatataattatggtcacagaaaaggtatatttgttaatacttattttatttggatataaaaacttaataaacatgtaaatgaattcaacctttaattgccaaacctggcattaaagaacttgatatgaaatgaacacataacttcagaaaagagatcttgagtactaaaaatccaatgtgaacacactttagatttaagcatttgaatgactgaattcatttcaattgacacttaccttgaacatttagcaccctttctacattaacatcagataatctcttttttcgaagttcagcacgtattctaaacacttgatcagcatatggagtcaccacaccaatactgccatcatctaacttcccccacgctactggccacttccttcttaactcttctacacgttccaccacttcaaacacctttaaaaacaaacacacacatacatattaaagttatcaccaatgtttggagaaaataatatcgtaactaaaactgatttataaaggatcccattttagcagatgtcatttaaaaaaaaaaaaaaactacccctaaatgggagtaatgctttgctgatgtgaactgaatgagaatataaatttttcatttacattttaaacagtaaaattctccaataatacaaccagtgaaaacatgaaaatcagggacaatgctattggcccccaagttcctgtgtagggaggaacaagctcaagttcctgtgtgggaaaaagacaggccatgattctagggaaggcaagttctcacagccccagtaattctcagtccactctctccagatcaggccaatgaaactaaccaaccaactagaagcttcctgtcatcagtgacatcactaagtcccagcagtacaaggtctaacattgtccccttcctcactgatataactaagcagaccagccaacagccaccaattgacaacaaaccacagctgggactaggccacatttggatcacagagaaagactttcagaattcactgcctgctagtggtacaagtccagccaagccatttcattaaccttgcaataaagcaatgccacagtttatgcaactgaatttttcagaccccaattactggattatgatagggtttttaggatagtttgttctattttaattcaatgaattgatcaaacagtttcaatgtctggcacagtggagaaggtacaaaagttaataaaacatgttccttgcccgctacttactgagaagaacttatggtttatttagaaaagagagtcataataaaaaaaatatataaggcaagcacaaatagagggtcagtcaagagtccaggggcatacagaggaaggaggtgtgttttcaaatgtctttaagtacatcgtttctttattatttactaacagtatctattttaatttataatattaaatatatttaataaaaattgacaattttcatcctttgaaaaacttgaggttactgactacgaagcagttcccatgtccagatacaaattcagtgaactacagaggtaaggactacagtcatcctatcgttattatgatacagcagcaagtgtatcacatacacagactacccagggaaggtgaagagcaaactggactaaagacatggcattctcactatcaggaaacagagtagacatactcagtctactgcaataaggaataagaaaaagttatctttacccatgtggttagatgtggggatagatgagttgggagacacctctgctgcgccctcccaccccacagagttcccacctctaagcaacacacaaccatttctgcactttatcctcctgtcatgtagtcaaaaaacagacttagaatgatgatatgagtcattctgggaaacctctctcccagaaaaacatcttctaagctggtcaaaattagcaaagacaatcattcaaagtctctaaagacagatcaaagaggttacaagaaattgagaagcatccatctattcaacaaaacctgtaaaaactcactgagaacagtggaaggttgaggcctacaagctatggactgccccctttcccccacagctcttacagaactgttttaacggccaaggggcaattcccatcgccctagctccctcctattccaggtacttttggcagctggtaaacattggcagatttcatttttcacagctttgtgctgcagaaggcctatgataagcagttggtagtagtcaggtggtacccaacccccatctcctgctacatagggagtgggacagtg

SEQ ID NO: 603 - DNA, 2339 bp, Homo Sapiens
gctgtcaataagacgtggacctgcgagccggggcaaaagggcttccggtctgcgggaaactggaggctagcggtgggcgtggaccgtcgaggtgactggcggttgtcggatctgctgttgtttgctgaccaggcagccgtaggtaatgacggatgcccagaccctgtgggcggagtaaaggaatcatgcactgatacacgcacactcaccgaggggcgcgtccgtctgcgtgcccctcatctcgtagccgaaaggagcgcgttccggggcaggcctccgggtacttcccgcagaggaccgggctttatactctttgctccttttcctcccctagtaagtcataacttattttgggagaagggcatagttatttgtctctcgtctccatgctacagcactttatgtgcttttcattcaaaatcgttcctcgaggacgaccaagtaatgtgatttgggggacagttttcataggaagggctttataagtttacaccaacataaagaaaacttaaaaaccttataaccgcttatttttcagaagtattatttttcatttaatctaaaaccatacttttagaacatgaaaccaagccaaacagatctttgcagattgtgcaagcgaacttttttttttgaatgaaagtggtgccatcaatgcaaaagcaagcccatataagtgccgaaaggtactcgtcataaggaggagttgcttccctattctgaatttttatttatttttatttatttatttatttgagacggagtctctctctgtcacccaggctggagtgcactggcatgatctcggctcactgcaacctctgcctcccgggttcaagtgattcttctgcctcagcctccccagtagctgggactacaggtacatgccaccatgtctgcctactttttgtatttttagtagagatggagtttcatcatattggccaggctggtctcaaactcctgacctcgtgattcgcccgcctcatcctcccaaagtgctgggattacaggcgtgagctgccccctgaatttgttttttttaagcaactctttttaaaaagagagaaaaaataatctctcttgagtgtattagttattgagctattccatttggaggtggcttaacccaaaacgtgtatggatgtggtaagattacaatggacttgaatgttctagatgaaatctgggccgagagtaattgcataatagttttccaaaggactgtcagatggtaaactcctttcatttactttgaactgataaacgataagatggatttttgttttttgacctttttatctacatttacttctgaaaattgaaaaagaatctgaattccaacaaaatgtttctaggcaagtatttgcatgatgcttctctaacatttcctatatcttagtgttttctctaatgttttctgtagctttcaaatttcactcctgtaagtttttacactaccagtaagaaagatctgggccaattatacagaatggacgatgatttttaaaagaatagagaaagcattcagaaaagagacaataatttgaaaatgttctgacatcatgtatttccttaaagcaatacaagtcctgtatgtccagttcatgtctactccaaccgagcttttttcagacacttagaaattgccttcaagaaaatccttatggaacattgtaacctagaggggcatttattttcgtttaaatatgtattaattgcaagtagtgacagaacctaaaaagcaaaaaccatatagcaccagttccaaggttcctatatctaatgcagttactcctactgcagtacaaggaggaatataaaatccctaggagaaatacaaaaggccattgtcttctttgaccagatttgaggaaagttttcatggaagatgtggtctttcagtgggcgttgagggtaaatatgcagatatggttagcctgtgcattctggtggaagctcagagttggaaaaacatgaaacagattgcagagtctggcatgtacaaagaggtatggtgagacatgtgagttctaaacatcaggctcatgaatttggactaaatttttgttatggaaacatggaaatcctaaattaattgatgccagaatataaattggttaagaacatcaagaaatcataacaactgagttattttgaagttggtgtaatgtggtcaatggaacgctggtgaatgatccttgaaacctggattgtattttagcactaagacagtatgcgtgtaatcacttgcaataaattcatttttttaggctttcttcttttcatctgtaaaatgagagattggtttagatgatttctgaggtcttttttatagg

SEQ ID NO: 604 - DNA, 1517 bp, Homo Sapiens
tcaggtgtatatataaaatgaaaagcaaaatgtaagtctaagacacagaaaattttggaaagctaactttgatttcaaattcaacttcctaaatatgatttgggatttccttagtgggtgaataagggcaggcaattaaggtccattctcttacttttcaagagcttcagttctggtagtggggtgcctcggaggcagatagcaaaagtgtatgcattaaaacaagttttgtgtaaaggatttgttagacaaaaaaccaaatatttgtgggtgagttcttaatactaaataaagatagttgtatattgttttaaacaaatttagatttgccttttagatataatcacatgcattactataaattattttttccttttaatatagtcaggaaaaatccacagcatttagcaacagcatacctttggataaaactgcttatagttatatgtttcgtttcagcatcagtgagaaaatatacattattatgccaccgtttaaaatgctggtgctcctttattttatatagtgttttattgcttcatatgtggaatattaaaatcaccttaacagctagccggatgagataatcacactccacgctacagctccctgactacagctaaaaactctgcataaaatacggcaggtttgaaggtctctgcaagggctctgaaaagtggataagaataagaggacttacacgaaagccagaaatagaggggagactgagcagtacatttcctggggttttaatttatattttgtatataccaacaggctccagatcagtctaagctgcagagctttgaataggaacacaccaaaaaagctccagaaaaattcacttcctctggccagaagatgggagtggggtaggggtggggaggctacagaaaagcctttagactcttggccatctccatccaagtgtcagcaaagaactagcagccctcccctccctctcatgggggtggcgttggggatggcagcctcagtggggtgaagtttttgttatcttttactcttgcccccctcagctagaaagacaatctcagaccctgaggggtgaagcccatggtaactgtcagtccagaatcctctacctagcaaaattaaatctctcagaaatagagcaaactgggaaaattatcaagtgaaaactaaacaaattcatcactagtaggtctacttaaaggaaatactaaaggaagttctttgagtggaagggaaatggttaaaagggggaaccagctggctgtggtggctcatgcctgtaatcccagcactttgggaggcagaggcagactgagcacttgaggtcaggggtttgagaccagcctggccaacatggcaaaatcctgtctctatcaaaaatacaagaagttagccaggcctggtggtgcacacctgtaatcccagctacttgagagtcttaggcaggagaattgctttaaccagggggacagaggttgctgtgaaccaagatcacaccactgtactccagcctggaagacaga

SEQ ID NO: 605 - DNA, 14910 bp, Homo Sapiens
acacctcggccggcgcagcgccccgagtagattacagcgcggcctttgtcgggcgggcctggctcccggccaggcgcccaaacaataaacaatcccccgggtgcgggcagggggtttcgccggccgcagccaggctctaggtgtgcgctggcgaatatctctatcaaccgcgaggagggaccgggccgggggcgcgggcgccgcggcgggcgctcttaccttccacccacagctcctccacgttggtctcgaggttcgctgcttttaatcccaccgcgaaggccccaaatatgaggaggcccacaaccaagaacttgccgcagtttttttgaatgtaacaacccagtttaaataagagtctctgaaacttcgctctcagccacagcggcgctttccggccagtagccttcccctggggacgaagcagaagggaggagtgagcgccggggagtcgcggcccgcgcgcccacgcccgcttgcgcgcacccgcccggtgagcccccaacagccgtgggggcgcgggtggccgcggcacacggactcgccctcgagactgcagccccggcggatctgagcgtcatggggggctcggtcataaagccgggccgcagcgtgggagctgcacctcggggacatcagggcgcccccacccgcgggatccctgagcgacttggggcactggggctgcaatacagaagaggaagccgaggtagagaggagagaaaccactcgacacagacaatattcaccccagagctgagaagggaggggctgcgtaatcccagcgatggagcccaaggttcaggagccagcaaaccagtcctgctctgtccatcaccctcggggacgggcgctaggggcgagcgctctttggaacaacatattgcgggttcccccaactggacccccgccgagaatggtagtaagtggggatccacgtggtgagcgcggccgccggagttcactcccgacgcatttccatagcgtggggagaggctgtgtgagctgaattaggaagtggggcagccagctgcaacttacgacaatatttgtgatcggaagagggcagccacatggatctttccctcctctcccttcctttctggttaaacgtaaaaaacagccgagtgcaaagggaagggctcaggccggcgcaggctgctccccggcgcggcatttccccggcgctggccgcggccccggcgggcccccgtctgggtgctcgccttccctggattccacacatttcagcgagcctcgtaaacacaatgaacccggcagctccgcagactcgcaccgcgaatttaaggtggcaatttgtttacaacttttcctcccccgaccaggccctaaggagaggcggctcaaaacctggaaaacgggggggatatctttttccgagaataattttttaagggagcagagatttcatgctcaacaaaaccaaaactggctgccaaaaaaggaaaccacctttatttcggctccctccccccttcctctctccgcctctctccactccgcctccccctccaagatgttaagaaatgtggcagccgtacaggagtttaggctgcaaataggggcaggggcgcaggaggaagaagttcagggcagggggcacggggcaggacagtgccgcggccgcccttgaggtggtccgccgtggacggctttccagtgctccggaaaaggcacaccagggagggcgtgtgtatacacacacacacacgcacacacacacacctccaccccctgcggacctcagacagccctttcctcccaggaccagagggagggtttgaatttttcaatccccatttgtctgctgcttttcctggagaggtgtgagtgagtgtgtgtgtgtgtgtgagagagagaggaagagagtgtgtgtgtttgtgtgtggcgggggcgatcccaaagagttagaggagggaagagaaagtgggaggagagagtctgaaatgcaccttggaaatctgctccagagcgaaggcggcgtcgcagtagctgggccggtgcagatagtcccggtccggcgcggcagcacggcgcagcccccccgtccgtctgcgcctcccgcctccagccggccgtcccggggcaccgatacagccgctgccgccgccgccgcggtcctggggctcggcggcgttaccagccgaggccatgttgccgccgccgccgccgccgccgcggggacggaggcttcccgggcggcccggcgcgctgctgccgctgctgcgggctcctggcgcgcctgggcgctcggcttgcgaggacgctgctggccgcaggctgctcgggctcgggctccggttgacagaccagccgctgctgctgctcacacggcgggcgctgctgccgctgcggccgcggccgctgccggggagtcagaccctgcgccttccattgccacattgcgcgggggtcccgaggtctctgcggccgccgctgcccacatccagttcgcggaagagcgagagccggcgcgccgagcgagcctgtccttcgggcgcttccgcggcactccttgcggtccccaactccccctacccgccccccgccccgcgccgcgaccccttcactgcagaaagagccagcgaatccccgctgctcccgccggccgcgctggctctctcggcgcctcccgggtcgcccgagcggccgcggagggcaagcgcagagccgccgccgccgcggggtccgagggtgcccggcgggtctcagcgctgccgggcccgggcagccgcagctgccgctgctcccgcggtggctgctgctggcggtggcggctccaggagctgctgctcgggctgctcgggctctggctgctgggttcgcggtggctgctcggtcccggactctgctttcttgtgctcctcggcaacccgctggaccattctgtccccgtgcagcgcgcctctctcgctcccgggacctggggactccgctctgtgtgtgtgcagcgggcagcggccgcagcagctccttgattcaatagatgagatggaagaagaaaaaaaagaactctctccatttggagaaagaagaggaggaggggaggggagggggtggagggggagagagcgagcgaaagagaaaaaggctggagctcccgcccccggggctgtcagatggcttgggtttctgcgacgcgattggctcgcggagggcagaaattactcagcaaacatgactattattagctgcttagcaacagctcaccaaagtagagagaccacccaggtaggcaacccagtgtgtgcatcctcggcttcggggcagcctctgagagcgccaaccttctcgcatgcaatacttccattaaggaatgctccccctcctttctctcttattccttttcttttcaacagtgtcttctttttgtgggatgcctttgcgcgcacacacgcgcgcgcacgcacacacacgaacatttgcctcgcggtagacacggggggaaatgtaatatttttttaagcgcttaaacaatttctgaaattcctcaaagaaaagcctttcagaggcaccttggcctcaagctgcagcaaatactgggaggtccggctcgcattcccaggcctgcaccaataatgacagcgtgctggatagtgcgccagtgtgtgccagatttttttttcctcttctcttttcttttataactaaagggaagacttaggctcttgcagggaacaacgcctcgcattaagataaacagaatggaaagttaaagaggaaagcaaggacgttgggaaaagccatctttcttaaaatccgtctgccccccagccgctttctccccccaacttaaaaaaaaaaaaaacacagtcttggtttgaaggagtcagtgttctataaacgtggaatccagacaccgaagcagtcttgtagaggcagaggcgtttttatttgaatctcgaatgtgacataagtaaaagagaaacaacagaatctttttttacaacttagagaaacggaattgtttccttgagagagtaaagttttcctgattattttgggttcatttgtacacccctttttattaaccagatgtttatatagtcagtatttttttttacaaaactcggtatgcatgttatatttaataatagtatgacgtaggagattataaatgccccgatgctggattcattgaaaacaaactgtgcgcggatcgcgaggattcgtcccgacaccgcgtccagtgtcaccaaggcatcccggggattcgcttcccgcggagggggaaaacacgcgaccctttgaggtggattctggagccagacacgtctacacaactaggctttttatttaaaaaaatttttgttttcggaaagtggaatgtgtttttcttacgtttccaagttattacgttcctccctgcggtaggaacccgacccgcaaacccttgatttgcttcactttatttttttttttaaacggggttgaactgcagagggactggcagtagcgagaagtctagtgaagtcgtgaaatggggcggtgtggctttaagatgcgcacggtgtatgttcattgaaaaaaaaagaagaaagaaaggaaaggaaagaaagaaacccagatggagggaaagggggaggagcagggagaaggcggagctccggtggccacgtgaccccgcgccaggaggcccggtgcgcgcgcgcgcccggctcccggactccccgcgcccgcgcggccggggcagagtaggtagggaggcggatgcgccgggccggctccgggcctccagcgcggtctcccgagagcccaggcgaggcgcgcgcccagccggcgcggacggacgtgccggacgcgccgtagtacattcctgaaggcggaccggcccccttacgctgcccaatgcccgcgccgcctccccgcgaccggccaatggtcgcgctcacgagtccctgcccattcagcggccccgcgctggctgcccgggcgcgctgggggctgcggcggggcgcgccggccaccggggcggtccacgcggctcccgcagggggcccgtccgccggctctccccgcccccttccttcctccccggcggtttcccctccccgcttccttccttcggcctgcgccttctccttcctccctcgccccgctccctccctcaatctcccctcccccaccagcctggccaccttccctccagcctctcctcctccccggcttcagggggaggcccttcccccgaccccctaacccgcaaaccgtatgcggtgccggggtcagggcgggatgtcccgaggaagagagggagacggggtggaggtgtttgggggcgttcgcgggatccggagggggacctgagcaccgggccagcgcggaaattcaaaactcagaccgcttaaggagcacgtgattttgtgagtgcctcagggaagggctgcggaaactcggaaagcaggcgggcagcatgcgaggaaaatgacactgagttgataaagagctcagacggctccacacattgccagtttcatctttgagtacgatcctgatgtttattaggtttgataaatagcacaaaacaggaaaagaggtttactattctagcttttcttactgaatggttatgccgacacttcaagtcgaaccattgtgtgtttgcttctggaaattgctttttaaaaactgggggaggggggtagtacccctagttttgcatgttagcctttttatatttcaagcttgctggagggcaaggaaccatatagccaaagacacgttgctatgtttgtcttttcaaacttctccaccacgttttggcccaaaactattagtgtttcgtctcaatcttttactagagggatttcagtatagcttgtttggaagaaggaattctggaaggaaatggtaagctgtgtgcccgtaatggatccgcctcactctccgcacgcggctgcatgtcctctggttccggcggctgccacatgcacgtcatttcagtggcaaagcctcttccactcaggcccatatcccttagtttgacttaattcctaaacgttttgaacattgatccccggagctttcagtgccctgagccccctcgcccgctgtttgatgggttaacttttcagcatctcagacaatggtcccggcctgtaaattctacccgtgggttccaggacgcactccggagcctcggctctaacgagcgctatcttaatctccccaccccccacccgccgcttcccctgtggtctgcttttttcatacttagagatgaattactttgaggatctaattggccttgtttctgtaacgttttaagaaagggaagaggagccagtgtaaaagcctgctcgacttgggtggtcagggctgaggctgcccccaatttgcctcattgctgatgcatgcgagtgcgacattcccagcgataatgttgttcctaatcaatctgcccttatttacatttgtaagcattgtcggctttaatatgcatgccctgtgcaggggactgctgtgccacaccgggtttgttaacttcaactaaccacaaggattccacagatctgagatgcagactggggcagccagacctgctaaggtgtcctccgggaagacagtccctttaaatggcccttctgcctctggcaccccttgtgacagttaccaaataaaaataagtgagaacttggggccttatcagccagcaggagttgccagcctttatgaagcaacagctgagtgttccatttcccctttccaagtaaagttcatctcaatgcataaattgtcattttggtctcccagtcatgatccaagacttctcattggagtgtgtagttttcaaagcagatgccttaagctctccggattccctcacatctcctcccttctctgttccaatactacaaatatccatggccacaccacacacatttcaaaaatgacatcagattatccaaatgatgacaatgaaataaaacatctgccctttgtgttgggatgttccaatggtaagcaattgtggaagccagacttggtggagttatgaaaaaccacagtgagatttaacttttcactggtttctcagatcaaaccaaatgagtctttaaaatccaatgtaatttggcaagttttgcagagtataaatgaataaaggggttaatgtattccagtaatttgaccctggggccatttataattttgtctactgagtttaatactcttccagaaatacaaggaattgcaaacatgattttaagtcctacagtatttttgttgagagggtcggatggagagaggaattggggatttgatgcaatattcttttactgcatggggagcccaggatacaggatgtgagtgatggtcaaggcagggcttcagcagttccaagcaggtaccttgaatatgagttgagtcgactcaactcaagccaatgtgccaccatccaccacattttcttggctccctaagaatgccttactattttctcattggcagcttttgtatattcttaaaaggtgatggtagaaaatgagtctaaaaggtttcagggaagtcggggacggggtggggggagattcagcagctacaaaatttaaaactactgggcttgactcccctcccctactcccttccaccttctgtttcctccccttatttaccccctccccaggctggaggaaagggaacagctctagccaacttgtcaaaataatgctgctaattacccctgatctcctttaatgggaagctgctcctaactccacaaaggagtaaatgaggggtctacagcacaaacccgggagcactggcattttttgagcttacagtgagctgggggtggggaaagcggcagaggggagtgtcctgagaaggtcccagaaatctccacattgattactccaggtctaaatactagcttgaaaggggaattagactttatgtattgccaaaagctattggtattctcttgctaagcatgtcaccaactgctgaatgttcagagcctactatgaacttgaaagaaaacagagcattgacccctgcattgatccctctctctccaaatatattcttacccacattgctttcctctcatggatagagatgtattcctacaacacccagactttgaacatgttttgcatccttccctctcctcgcctctccctgtctaatatatctctatcaagctttgcgtttgctaggaggcacaccattcatttcagtgatctctgctattgggtcctgcatgaaaaagaagctgagcaacatgatccctttgacccactgctggagcaacaaatttatcagaaatataggcatgagaaatgaaagggaagtaaaacaattccagcttattgtgtgtctttctttcatactgctaatccggtttacacatcacgcctacacgtctcaatagggcattatacactgtggcagaggctggagaaaataaaaggtgtgtgtgtgtgtgtgtgtgtgtgtgagagagagagaggaatgaggataaaaacgggagacatattttaatccacattgattaacctcatcagtttatctatctgtagaaagttgaagataattttgtaaaacagcctttttcttttcagaaaataattccaaatggttctaagttttgttcaaatagcttcaaagattatgactactttataaccagaaattagatacaccactcacagtgagtttgaaatgaagctaataccccaaattgagaatggcggggcctattgatgtctaccttgattcaacattttaattgaaacagatcatggactcaaaggcattttatagccttgtggaaggaagctgggtgacaactggaacacacataaactcacaatcgaaagccccttgttttacaacttgggcactccatgcacctgaggcaacaatttatccggagtaccacccagaaattttaagttgcaataacaaaggatgacaccataaagcattgtctttctttgtggaggcgattaattgcatgctgaactactgtcgccaataaacacagaaataaataaaaacctaaaagaaatgcacacacacagaatgctgaaaaaggactattgtggtagttcaagacctcagtgatccaattatcaaatatttagagccacccattgtggctctttattatttatgtctagttcttttgtatttctcctccccagggaggaagaaaggataaaaagggaggaagacggtcttctctcccaggtgcaggaaaacaggtctgtgggtgtcttccacagccgcccacccatatggttcttcttaggtgatggaaacagatcagtttccctgagagtgtgctcatccacacgctagcatcattttaaacatgaacgtactaaatacgtggagacacagcgcatgtcacccagaggcacagtttctgggggtcttggggttcagcgctgggcccgggcctgtaaagtgagaatcggtccggcccgcccccgggctcccctgaggccgcactctgcactctaagcactgggctggtcgcccatctctgtaagggtggcagccacccaagcgcctgaatcggtgggcataagagtcacacacaccacctctcttacccaccgccccttccagaactccaaaagcctctctggcccttttcccgcagcatgggaggggaggtgggtaaggtgcgtctcttctagcccgggtgtcccgcacccctaggcgtgcgtgcgggctcgagagcgggtctgcggggcgcgagcgtgcccttccctgcggctgcggctgctcccgcgagctggcggcagcggcttccgcgcgcgcgctctgagccccctcccctcggcgctgtcactctccgcaccagcccttccatcaccagctctgcctccgctggcgagtcagtagccaccaccaggctgatgagcggaagccaaggtggcgaccctttcaggcgtgaaaatgggagctccggcgaccccctccgtgagaattccccccggagccgttcctcagccggggcccgccgcggccagccccctccccgccacgcggggctggcctcgggggcgggggcccgggcgtgcgagcgagcgtggaggcgcgggacccgcgctcccgcgcccaggcggcgcagcccacccggctccacggccccggcgcgcggcccgcccctcctgcccggcgctcggggctcgctcctccgtccgccgcgcggggcgtcccgcgtccccgtgtccccgcgccgcccgaggagcacggcgcgcgaggcgaggtggcgtcggcggccgccgcgctggctgcactcaccatagccggccgtcaacccctgctcggagcgcgggtgccgatggcgcggacgctgggcttggatttcacatcaattccttttttttccctggcccccctttcctcgtcctccgctcctccgtcttctcccagtcttccctcgtctcccccttgccttgtcgctgcgggtctctttgtctcccctgtcgtctttttcttctcctccgttttcttcttcttcttctcctcctcctccgtctttacaaaaggaacggaaagtgtaaaaaccccggcgcgctgggccgccggaggctttcggcggagtgcagcgcggactcacaattacaagcctgtttctattaagcagttccatggccctcggcgtgggtggtctgccgcgccataggcaggacctgtcagggtcacgtgacggatccgaaaactttacccctttacaataaactcaaggaaagcaaagtaaactcgaggaacgtgctatcagcacagccctcctgggtaaacaggcgctcccctccccgccttcctgggaggcgccctgcccggcgagctcccgcgagcctagccaccctctccccgccccccgcggccgtgtttgcggggggccgccgggctgggggtctccgcgcgctcccgcggcttctccaccttgtgctcggctcccccgcccccgcacacattatttgctaacatttggccatcttgtcccaacgccggtcgggggaggtgtggggaagcaaggaagctccttttagcatcctcagcggtccgggaagtggggggttcccagaggactgcagaagaacaccacctttcatgcttgcattctcaaagcctttccttctcgcattcccacggaagcgcggaaaagctgggagccttctagatgacaggcctacgggccgccagaggggcggggagcaggaaaaccggacagatcacagcgccttcccggggaaatttcagcacgagatgtgtgcggattcgtgtcggtccctcggaagccgtttcttctgaaagagaccaaggtggcgtcccttggaaaccaagatttgtacctggtccgaagaatcacggattgacatttgctccctttctcttctgattcctgtggtttctggggtatgccacccaaatgctcccacctactgtgccgtcctgtgccaggcggccttgggtgactggcctaggagctggtgggtcgcgcggataaccctgctctcgctcaagactgaagcgttctattcgggagcgcccccgctacaatgtctgacattttatctgctcaaccccgccgctggtagacggtgtttcacacactgcgactttaaatgggccacattatgaataaagatgaattacagatacaagggcagggtagagggagtgagaacatttactgcagctctgaagagctgactagctggtcttgaaataaagccagactcttctcacttcattctgggctgacagtgtgattaggtgtgtgtgtgtgttgggggcggggggggcggggcgggggtagaagaggtgccccatgtgttattaaataataataatcatcctaggagttttgggatctccctcccacaaagatgacgtagccattcttgagcagagtcatttgagtttccagaatgtatgtgtttgagacacgttaagtaattaagcattagaaggggggcagccctgtgaatttggctggtccagaaggtcattttcataccagtgacttcagtcaaaaatggactcaaatgcatattggctgaccatggattctaaaagtcacaatagttgtaacaacaacaacaaaaaacccaacatttcccttcgaaacacttccccctgtcttttggtgtcatatcaaagggccctgtttatctataaatgtgagtggggttatgaacaggaaggtatacataatctccaaatagaggggtctagaatatgagggagaaagggggataagaaaaaagagaaacagccgacaaagggcatttaaatggcccacaatatacagttgctaggaaaattacagcagaacttgaggagtttgctttttctagttaaaatgaagaccctcatggaagcacacttggctacatgctcctgctgagttgtggccaaggctgatactcaagagtggacactagttttgtgtggcctaggacttaggcagctttcagagtgaacggggagtggggagcttctttagcaactcaaaactgcaaacacaaaattaagtacagggccttgaagtggcctgggcagggaggagccctaaagctacctgggcttctaggaaatcgcctttcttgagtgtgcagacaggaggacgacagaactacccagtctttgtggtcctggtggtctacgctgtcccttagttaggactgaatgtgttcatatgagtcttatcttagtccaaggctttacaattgggagcaaagacaagtttgttttgtacaagagtgtaagtacttagagttgggcaggagtggcataatgaggcagggagtagaaaatctggtgttaaaacgtacaagtataggaaggagggaagcccctggaaatgttctctcttgtagaatgtaaaaagttcctcttcaaagtttccccttcccttcttgttaaagaataaatcataagtgttaaaaataatagtttcttttaaaaactaacttccttcaagcctccttgctttgtgctaataactctttgttaagccctatcgtatgtagctgttaaacatgctcacaggcacatagtacattctatgtccttgtaccttaaccaagatatttatgctggacatgctcacaggcaagttccagctggcagcctatggcccttccctgtatggcacaagcaacttcctgttttcctttgtcttttcattacttttacctatttagaaaagttttaaactgttagccaatctggttttagtttagattgtgaggtctggctccagccaatggagacaggacacagtctcaggaacaaactatgtaagggataaaaattgcttccctcctttgttcaggtgtgctgtcacattgtttcatctctgatgagcaccctttctgcagaaagtaataatggccttgctgagagaattaaatttatgttcgagtgctgtttcttcgagtgctgtttctttgcagcaccagggaacaagcattctgtttctaaataaacattttccatgtaacgtctcccaaaagcaacctgtctttcttttccttcctttgaaatcaatcttcgcagattatgtcagtgctgtgcctctcttctctccactctcagatgctagaagcattaagtcaatgatataggttctggttgggggtcagggactcaacacccttatgtgttaccttctagtgcttctctgagactcccaccagggtgggccctctctcatcaaacagctgcctccacacttctaaagttgcttatgtctccccacttcccaaaaaccagctccagtgctgcccaatctaagtcaattggcatggaggtgttaatggcacacaaggctaccagacaacaccgctcagctccaagtcttcccagtctgataagccaattggcatccaggtgttaatggctgatgaggctactagacaatacttttgctggttaacttggacttttggagccatacacagaagaataattccaaagctgaagatttcagggcagggccagatggagatttagggggcattggaagacaggacaataggacttttgaaacaggcctgaaaccgactgaaaacagaccacaatgagtatgcataggcgaggttgtctttctgaatattgttgctactggagatacagtgttactctttgtttttgtttttgttttttgagatggagtctcactctgtcaccaggctggagtgcagtggcacaatcttggctcactgcaaccttcacctcccgggttcaagcaattctcatcctctcgagtaactgggattacaggcacacaccgccacaccagctaatttttgtatttttagtagagatgaggtttcaccatgttggccaggatggtcttgatctcctgaccttgtgatccgcccaccttggccttccaaagtgctggaatcacaggtctgagccactgtgcctggcccagtgttactcttgtaccatcaacatacacacttatacacacacttgcacatgcatacatgtgttcacacattcttcattttaagctcccctcttctctggctcccaataaaaatgggtgcctaagagtttccattcatctcctccctcacggtaacctccagcaattggaaggctttcaaatgagtaactgagggttcagaagaaacagttgcccacatttaaggagctctccacctcaagatgaatgctgctcttgcacatggtcagtggccataccacactggccacaccttaggcgtggtcagtctttgattctggatcagacagatcctcacaagctttcataaaagtactcttgctcaatgtggggatttcaattctaaaatgactgccccccctcactccctatcctggcctcttccttgtgggaggatattcacaagccaaatcaactctcagaattagggctttggggactgg

SEQ ID NO: 606 - DNA, 667 bp, Homo Sapiens
cttctgtctagcagaatatgaagaaatcccgtttccaacgaaggcctcaaggaggtctgaatatccacttgcagactttacaaacagagtgtttcctaactgctctatgaaaagaaaggttaaactctgtgagttgaacaaacacatcacaacgcagtttgtgggaatgattctgtctagttttgaaacgaagatatttccttttctgccattgaccttaaagcgcttgaaatctacacttgcaaattgcacaaatagagtgtttcaaatctgctctgtctaagggaacgttcaactctgtgagttgaatgcacacaacacaaggaagttactgggaattcttctgtctagccttacatgagaaaaaaccgtttccaaagaaggcctctaagtggtcaaaatatctacgtgcagactttacaaacagagtgtttccaaactgctgaatgaaaagaaaagttaaactctgagagttgaacgcacacatcacagagcagttactgagaatgattctgtctagtttttatacgaagatatttccttttctgcctttggccccaaagcgcttgaaatctccacttgcaaataccacaaaaacagtgtttcaaatctgctctctctaaatgaaagttcaactctgtcagttgaatacacacaacacaaggaa

SEQ ID NO: 607 - DNA, 1733 bp, Homo Sapiens
gtctcttcactctgctgattgtgtattttgctgttcagaagcttttcagtttgatacagcctcactcgctcattcagggcccccgagtagaatgggagagctccagatgcaactgactaactgaagatgtcacaaaggctgaatcttctatgctacactttggatcactagaaggaccagagtgtagtcaacgatgtgtaaacaactgagaaaaacttttctctggaaacaactgtgattttgaaattcagtggtttcttctttctagctgagaaacattgagcaagtcactgcaataacatggaatccagctgctttatctggtgaattaggataattcatagtgtacaactaggattacaattaatttatcagttaatattgctgcaaagaaaatcattctataagttaatggcttaaaacaacgattatttaatacactttttctctgtgggtaaaccgtgtggtttctctagtctgggttagttagtttgggcttggatgacttagaatgttctcagtcacacatctctggcctctgctggggtgtctgggaaagctgaactccttgttttcatgggctgtcactccgggagttagcttaaggttatacttatgatagaaaagttcccagaagcaaaagcgagtcagccttaatgtgcaagcacttcttagcaacctgcttccattagggttgctaaaatcccgtaggctgaagtaagtcataggaccaagcagaaatgaggtgggaaaataaactcattttcttcacaggagcagcctcaaaaagtttgtggtcacaaactcttcactttttttttttttttttttgcagtttccaacagggtagatttgagtattagtgaaaatgaatgcaaagtgtttgtcatgtagtaagaactaaatacattttataattgttaatgtgttttaccagccatactttttatcatcctatgatttaacaaacatgcattaagaaaatgtgtgggtaaggctgcttcaattataatcacttgagtcctttaaggttctgcttatgttatacaggatatagaaagtcatcccaacatactgactgtctcaaatgtattttgttttggatttcccaactatatcacagcctgttacgaacacttagttacataagtacattccatcttatgtcttcatttacttatttcatgacttaagttttataccaactcctccctagttagattttaatcccgttgagtaaaaagagggattatatttatctgacataattaggactacctagtacagcattggatctgaattttagattctaaacaagaatattaatatcaacttcccaactctattatatataccactgcattcaatatataccaatctagtacagttaacatcgtaggtagcattgtgacatgagccctcaaataggtagacaatcctgggattgagtactgggtctatgaatagctttgtgaccatggacaatagtaagcttctctgagcttgttttctgttatagcaagaagaaaaatatattttataatgataatgttaaaacaaaaatgtcttgctaatatggattggatttgtgtccctgcccaaatctcatgttgaattgtgatccccagttttagagaggtacctggtgggaagtgattgaaggggaacatcacactctggggtctgttgtggagtggggggaggtaaatgatgagttaatgggtgcagcacac

SEQ ID NO: 608 - DNA, 6939 bp, Homo Sapiens
aggtactaggcgtgccatgtgcaggctcttgcagcccagctgttgccctggcagctccatgaccacacctctgtgcccagacatggatcagaactgggagaaaaagagaaggtggtaccttctatccccttcaccctgggtctttcaggatctgccccaaggagcagaaaacgggtgcgcccagagcagcttactcaggagacgcttgctgatacagagatgagacagtgattcctgtcctcaaggaggttacattcgcatggggagagacacatagcaaaagagaccaccaaggcaagtccgccgagagatgatgagagcccagagggcatatcactaagagaaggccaggaatgatctcacggagcaaatggcaattggcttgagttttgaggaagtagaagtttggtcaacaggctcacccttgctgatgctgagtaatctgcaggctgcaatctgcccgtgaaagaactcttgcaacacattgtgtgaggatcccaggctgccctgtccttccctgggaatcaggtcaagagccctgctggcaggtgtcctagagcatgaatcaggcccctggcaaggagaaggcgggagatcttggctgagatcaggtaggaaggtttattggatgatgtgtctggtcaatagccaatctattaaccccccctgagagaattaggaaccttcatatgatgggtcatctctttgtgggagaagtttagataactggaaaccacattttggtcaagaatgactcagttaatttttccatgcctttagtgaggatttaattttgcacgggtaagtgacttcagagtggttggtgaaagctggctggctgtcattttgtctggcagtgcagagtggcaatttatccctttaggtggcccaagatttgggtggctggactttccaaggcaatttaatttaatttatttgtttatgctgagccttgggttaatgctttcaaatggtttatttcagagatctgataacctgcggactgactttctccttctagacttgtgttgatttgattcaacagaccctcatgactcatgaagcacctatatgtaccagtcattgtgataaatctggggattagacaggggcaaaactcagtccttgttgagttagctcatggtgcaatactggactcagacataaacaaacacacagaaatgataggtttgtgtggcatgctgaaggcccaggtaagaaggaattcattctgttggataaggcggggactcaaggaggcttcctggaggaagcgaaatcctagatgagtctgaaagggtaaataggaatgaatgctctccaactctgatggagttgatgatctcagggttggcctcttttcatactggttttgagtataaatgattaatttgtttgtaataattaataaaaagaagaagaatgcattcacaagcatcacaagtgaatccatccctgacttcttagtaatttccccttttacaccctgctaatatgatccctgttttttgccctttatgaagtggtccacagtgtgaaaaatttgaaaggccccaaagaatgaatagttcttcagtaaacgaattggaacagcatattgggcatggagtcaagatgttgacctatgtaattcttttgacttttttattttaaaattactatgattccttcagggcaagcactgctttaataattcatctttctgtcttcaaaagtcagcccagtgactgtcccttattccacagatgtggaaccaattcaggattgtccttgtgattctttttcctaagtggaatactgagcctccagcttgtgtgtcatatgtgtggacttttcagcatattcttctctggcccagaagtctggattcttcttgtctgttgcaataatataaagttattcagagctgtacatgaagagaagtcccacagggaccctgggatcagaagaactctgggaaatgcctggcccagccagtgctgttctaaagatcctcatcctcatggagataaccatttttaaggaagaaaagaggatctggaccctacccatctcagtctccatcagatcttatggatgctccaggaattggccatgattctcctcttttctaccatcttgtatgttgggctttgtagaggatagatgttttctagaagaatggcagataaggcaaggtctgcagcttgccattgatagtgtctttatcaacagatctgtgaggaattgtgcagctgagaggggagaagagaaatcagagagtggatggactgccacagttcaacatatactggtgctttcaatatagaatccacaaggcaacctgcatgctgggctctgtgctaggcactaggggtatatctatgagatgccaccccagctcccacagtcttacaatctaatggggaagagagatatgtcaatagacaaacgcagcagatggcaagtgctgggatatgaaacagtaagcagaagccacagtgttctctgggacttctgagctgagtcccaaagtaattagattaatccgtcatgggaggtggagtgggtagggggagctcctggaagcatgatcaaaagtggagagctaaggtgagggagaagaaagaaatgagattcagcaaagaggaggagagcaatgaagggccatgtatgaccaggcgaaggcaaattgttcggaccaaacatgacagtagggtgggtttttgaggggtatccactgcacttacagaggcaagattctctatggtgacctttcagtgagggtgggcaaatacactactttttgagtcagccatttttcactactgagcacctctggccttagcaagttctgagcatgaatactttcttctgtttctaagccattcaacaaatatcaaagtgctttcccatgtattggtcatcttaggcaaactgggtggacatgtagagcaagacgtaatgaggtaagcactcactagagctaggtcatcttagaaaagtcacttagcttcactgagcctcagtcttcctatctgtgaaatggggataatgacccttatgtcacctggtgggcaaggtctaaataaaatcattgtagttagatccatagtaggttctttctgacctaccactgtgcacctcacgccgttgctattccagtgggatatatccagtggggttacgggtatgacatttcggaaccccaccatcacttgtatcagcaggtctgtcctaggttccccaactaagcttcctggatgaggcacctagtggcgtcccctagtttgagtgtggggggtttggtaaactagtccttatgtatgcttgtcagatggagggtactgtctttaagatgggctcatagctgaatctggaaggtaagtgctccaggccagtattgttttctgcaggattcaaagttcccttgctatttctgctgactttgcttcccctctcgtgttctatatcccaaacctattatcttcaccagcgttaatttgcctccacaactctgtttttgcattttgaaatggaatttcccttaacctatattcctctggttcccaaactccacctgcttcagtttttttttcaatatcatctacatttccttcactagattatagccttagtcatttgtacccttagaatgaatatttttttctgtcatatctttgtttgaaccttttcacatttgacttcagacattacccatctccttcatctgaccactttcttcacttttctcatctttccattttggttgtatgtctactgagcaaggggctctgtgcagagcattcaaagatgactgagatgtagtcttgtgggtagagagagacaattagaatgcaccgtggagagtgttaggttgagggaagcggagattacaggagtccaaatgtcttatccgaggatatgggataggcttgagagaagatgctgagctcatgtaggtgaggtattgtcctacgtgaaggaaaagaggcaggagatggcagcttggaggctatattactttctctggggctgccataccaaagtaccacaaactgggtggcttaaaacatcaaaaatgtattttctcacagttctagaaggtagaagcccaaaatcaagatgttggccctacagctgtgctccttctgaaggctttggggtgaatgtgtttaatgcccttttcttagcttctgcccttttcttttctggccttcacagaaggccaaagagcaatccttggccttccttggcttgtggatgcatcgtttcagtctctgcctctgttttcacatggccctcttccctgtgtatctgtctctacgctgcttctcatcttataaggacacaagtcagattggaataaagcctattctaattcagtataatcacatcttaacttgattatgtatgcaaagaccatatttccaaataaggtcacattttcaggtcctcggggttagagctttcacatgtctttttgggggacatagttcaactcataatagaaacctcgcagataaatcattttggccggtgcacagagttaagtggtggattatcaagaatatggaattttagaattttagcttcttggttgatttttgggaattaacatacaggagagcaggtttagaagtaacaataacactttgagaggccgaggtgggcagatcatgaggtcaggagatcgagaccatcctggctaacatggtgaaaccccgtctccactaaaaatacaaaaattagccgggcatggtggcaggtgcctgtagtcccagctactcagaaggctgaggcagcagaatggcatgaacccgggaggcggaggttgcagtgagccgagatcgtgccactgcactccagctggggagacagagtgagactctgtctcataaaaaaaagaagtgacaataacaataacagaggctggtcttctgggaatgatgcgatactcttcagccagcctttctgttttgagcgaagccccaacctggagttcaaagagagtgagggcgcttcctgtcttcttgtctttctcctctctcctgctacttgttatgaaattcagaacaattagagattttctgtctcatccctggaatggtgtttctcctgctggccctatcaggctggtgtgttgatgttatcggggagaggctgtagttactaggatgaagaaggcaagagagaaatggaattcacgcagatcaaacatgtgtaatcagaagacattactgaggcttgatgatgctgttcagggtgtatttcccttgaaacgcttcttaaaagacagcagcttaaacaaatgggcaagatgagattcacagaggtaacatttcagagagaatgtaggtacagctaagcagagctaagcagtgacagaaggagaaagtgtgtctgaagaaaaatcttcattacagatttgaaagaaaaaaaacccatcaaatccctctgccttgtgggtctcacaggaggcaaactttctttacaaactgtgtgtttgtgttttgagtgactaagagttcagggacaagttcaaacacacctaagttcaatttaaaagtaaatgagatgacattggaggaaatttataataaaatgtcactctttacctaacaccattttctctggaattcaaaatatccattgtttaaaagtgacacagtaactaccatctagtttgctgaatgaccttctttatagcgtcatggtattagaaatggcttcagaaggaatcactcaactgcatttatctggcaggagaaaaatgcaggtagtatttattttggggtgtggtaggggatgtcccctagcaaggatcctagaagtcagtgtcaggtatgagaacaagaaacattcatttattgcatgcatactcattgagtccctactatgtattggtattatgtggcagtatgaatattctcatttgttaaataaagatacttgagtctgctttcagtgttgtgggttttgttattaagagtaatacagtcatgtgttgcttgatcatggggacttgttctgagaaatgtgttgtcaagcaattctgtctttgtgggaacctcgtagagagtagggtacttacaaaaacctagatgggatagcttaatacgcacctaggctgtagggtaaagcccattgctcccaggctacaaacctgtagagcatgttactgactgaatactgtaggcagttgtaacaaatcactaggcaacagaaactttgcagctctgttattatcttatggcaccactgttgtgtatgcagtctgttgaccaaaacatcatgtggttcatgatcgtacttatagtactaagtgccaggcattgaactgtgccaagtgtcagggctgaatgagctcattcaatttttctaataagtctatgaggtagttactgatatcgcccctgctttacagatgaggaaactgaggcacagagataaggaatttggataaatttttataacaggtaggagataagtgatgaagagacactgaatgattgaaaactcacttggtttgatttgcttatgtgaaaaatggatttaaggaaggcagcggatgcaagcacggaggcagggaaactggttgatgtgtggattgagtgagttaatgtgtgtcaaatgcctagaatggtcactacacaagtatttgctattgttcttatttttgttgtaatcagtcagaatggtctaagtcagtggtcagcaaactttttttatgcagagccagatagaaaataatttaggctttttatgctcttaggtctctcttgcaattactcaattctgcccttgtagcatgcaggcaaccatagtcaatgtgtaaataggaacgagcatggctgcattccattgcatgtagtttataaaactatagcccacagactatactttgccaattcttggtctagactatgctgtagttataattcccaaaccctattggtt

SEQ ID NO: 609 - DNA, 1587 bp, Homo Sapiens
accactgggccctgatccttcctttgtcttccaggccggagggactcgccggctgttggtgccgtatctgctcctgggaggggcagttgggtagggggagattgcctcttgcctctctctgctcaacccttttgcctctcccttaaccccgttgcttccaaagccacttcgggccccgttctacccctcagtcgtccggtctcctttcagtccattaaattccagggatgcttttactttggctgggacgaagagaaggaaggaaaagactgggaagaatgttgcgaaaatagaaatagtgggggtatacagcgacattcctaccagcctcatgaaaaggacgtggcctccatcagatggaggttgacagcaggcttgactgggtctcaggcccctgctcctcagggccacttgatcacccgcagcgtccactaggggggaaggtcttggtcatgtggcgtcaggaaatgccctagagggcctgctcacaggggcctgttggactaagcatgtcagttgtttgcacttactggacctgagttgcttagattccaaatttctcccgggaaaataagtataccgtcaactgatggaataggaaatgtagcattttttattttaattgtttatgctaaaatccagagtgctctatttcccattcctcattaacttgcatgtggttatttgccaaaatattaagccagtctcccatctagttttagaaatttcatagtatagctatcacaataagaaagatggataaacaaatagatcgtgtttgtgcttactctttcatattgtttattcgtgccaattgaggtttactgatcttagtatttaattttaattcatgtaccctgaattttgggcttctttcctaaaacacaagcaaaagaggcagagtataaattctccagaattagggggatgaaaattgatttttaaaaagctacaatttttatttatttttgcctaagctgttttaattcccacttagcttgtttgccacgcagctttatagtcattgaacaggttgactccttcagtttcatggttgtaaaattttatgtttagaggaaaatttaaatgagaaataatgtatatcacattatcatttctattaagccgtttgctaacacaataattaaaataatttctgcccagtagagaagttaccgaaactttttgtttagtgggcctcatttatgataactaagcagtatcatggaatgctgttttaaataacatcagctgtaactaagctgtaattaatcttcagacctatttagaattttgttttttgctttaaaatttatttcacattttatttttattgctttttgctttttttaatagaaaacccttaacagtgacgtatatgtatatatacacacatatataattttatgaaacttctttttatcaattacctaaatgttaaacgtggcataagcagaatacttactcttggtacatattcacatactttaatcagtttcttagttgtattttctccaataccagatactcgcatttttccaaagaatgcaatttttttcaatgtggcctttcttatttttaatttgt

SEQ ID NO: 610 - DNA, 4929 bp, Homo Sapiens
gacggggggcggggcgcgcggggtagcctgggccaagggcgcgcgggcgcggggagcgggggcggggcaggcgcggaccctccctccccaggacccgccagacgcccggggcccccaacggccagcacggtccgaatcgaccccaagcttgacccgagggcagcggggcctccgggaatgcctggccagggcggtgtcgccgggagtgaatgggggagggggcggccggggcaggacccgggtcagggccactctggtagtctcctgcccacccctccccaagccgagctcccggcctccctccctctcccccgtccagggctgaggactggggaagctgagtcccgggacgggtatgggggggttggggcttgggatgcagccggacctccgggaacagcagggggccctggagccaccaggagggagaaggccccgtccctgagccaggctcgcaggtaagacccgaggccgcaaaccccggctgcccccacccccagcccaggctctgatctggccccacactggcgttttgtggaggagaccctggaagccaggggagatgtcagccaagccgcgcagcacaggggcccaacttccactggcagaatgcaagcacccaagaggcaggagtttcacccaaaggcagggttcacccctgtgttcccagagattggacacatagctggtgttcagtaaacatttgcgggatgagtgaataaatgacggagcatttattaagagcatggctgtgcttggctctccatacagagatgagtaaggcaaggggcttcacagctcttggctgtgtgtgtgtccgtgtgtgtgcatgagtgtgcatgcatttgcctctgtgtgcctgtgtatctgcatatgtgcatgtctgtgttgtcagcacgcatgcatgtgcatgtgtccacgtgtttctgtgtgcatgtctgtgtgcccgtgtgtgcatgtatctgtgtgtgcatgtgcctgtgtctgtgtgcattgtctctgtgtgtgttcatgcgtgtgcatgtgtctgtctgtgcctgtgtgtatttgtgtatgtgtctatgtatgtctgtgtgtgtgttcacatgtgtgcatatctctgtgttcatctctgtttgttcatgtgtgcatgtgtctctatatctgtgtgcatctatgtgtctgtgtttgtgtgtccatgtgtgcatttgtctgtgtatctgtgtacgagtgtctgtgtgtctgtgtgtgcatgtctgtgtttgtgtgttcatatgtgcatgtttctatgtatatatgtctctgtgttcatgtgtgttcatgtctgtgcatgttcacatgtatgcatgtttctctccatgtgtctctgtgtgtgcatgtttctgtgtatgtatgtctgttcatgtgtgtggtctgtgcatgttcaaatgtgtgcatgtctgtgtgttcatatctgcatttgttcatgtgttcatgtgtctatgtgtgtgtttgtatgtatatctgtgtgtgcatgtgcctgtgtgtgtgtgtctgtgtatgcacatgtgtgtagggggatctggggggttctggctctgagcttagtactctattcttcaaatatccgtttcttggcatcgggcatgacagcctatccagcttggaggttttctgccccttggctgaggctgggcgagccgaacacccatttctcctttctttgttgagccattcttttcttcctcaggatgtttatcccaggaaatccagaggatcagaaccaggcaggacccggcactgggacggaggcagctgtctgcggggcgtttaccgtagatacgtatcacctgttctgagacagagcctgggaggctgtttttaatcatccgggaggttgtaaaatgtttcccgacgttacgaggacagctgctggaataatgatgcaggtagctggcacacacgcagtgcaaaggtttcaccagacatggtcttctatgcctatcacctggtcaatacgagcagcagccacgttaaggtgtaatacacactggcgtcatctaacgttccatgtgaggaaactgaggcacacaaagggcaactggcttgctcaaggtcgcgtgaatggcaaagcgtggatctgggattcaagcccagacaattgggctccagaattgactttattagtcatgatcactccagagaaaacatcaagcacttttcattacatgtttaatgaaaatgatgttaaagtggttttgtaggagaaaacatttcattcatgtaaatacattttactgcattctaaaatctagcaggaaaagatgtggcctaactaccgtcaagatctgggtacatttcattggaaatacaagcacattggacatgggaaaatactggggaactttacatggaagagaatgcatctgatagtctggcgcactagcatttgctggatttttaggacatatgggaggccgggtgcggtgacctcccccagcaatcccagcaattggggaggctgaggccggtggattgctcgagcccaggagtccaagactagcccgggcaatatggtaaaacctcatctctatgaaaaaaaatacaaaaaattagccgggtgtggtggtgcacagctgtagtctcagctacgtgggaggttgaggtgggagaatcacctgagcctggggaagtcaaggctgcagtgagccgagattgcaccactgcactccagcctgggtaacagagtgagaccctgtctcaacaaacaaaacacaaaaatatatatatgctgaatgctcagtgagctgtaacatgtgaggcagcccccaggggtgccgagatgaaccgctaagaaggcgtatgttcccacggggtgcagagatgaacccctgtctgagaaggcgcatgtacccatggggtgcagcgatgaacccctgtcttgagaagccgcatgtacccacgggggtgcagagatgaacctctgggaaggcgcatgtacccacagggtgcagagatgaacccctgtctgagaagacgcatgtacccacgggggtgcagagatgaacctctgggaaggcgcatgtacccacagggtgcagagatgaacccctgtctgagaagacgcatgtacccacgggggtgcagagatgaacctctgggaaggcgcatgtacccacagggtgcagagatgaacccctgtctgagaaggtgcatgtacccacggggtgcagagatgaacccgtctgagaaggcacatgtacccacggggtgcagagatgaacccctgagaaggcgcatgtacccacggggtgcagagatgaacccaactgagaaggagcatgtacccacggggtgcagagatgaacctgtctgagaaggcgcacacacccacagctgcccctcatcttagcaccacagtgccagccccaccctgtctttgataagccctggccttccagggcctccctcagagaaccagcccctgcggagtccctgaacgtagctgcggtctggggtgccgaccctcggcactgggagaaaccctcaccagtagcatcaccccccagtgagccaagatcgcaccacggcagcatcactggggagggagtcacgtggttgtcactgcagaactctggagaggcaggctcttgcgtgggtgggggccatggaggacgcagcgtgggatttaaaatgagcccagtgaagggaaatgctggttcttcaatgtccatgagctcaagccctgtgggaggtgtagcctcgattattttgcacagatctgaacagcattcacccccagttggatatggccctttcctcgaagcacagattggaactcaaggtcactgaagtgctttctggccgcatcatggagagaaaggcattttctcactcaggcatcaccccgggaacgtggcgtgccatgttttagcatctaagtgtgtcccccgaggaggcagggttatgccgtaatcacaagcaaaccccaaacctcaacggcataaacgacacagggtaatttatcatgggattgcgtgtccacctgggtccccgcggagctctgttgactggagtcgctcggagcccccggcgcgaatgctggatggctgggcggggaggagcgctcaggggcttcacgctgtcaacaccccactccgaagtgactcccgctgcttccagcagtcacctgctggacagagaccgtcacacgggccccttcacgcagtggggtgggaagggagatcctaccgcgtacctggaagacgggagaacaggggtgtttcgatcagtccttgtagcacggccgggacttaagctctgaaccaccagtgaggaggtcgttggtctgagcctgcttttccaagtcctatcttcccttcttgggttcagacagcagatccgactgtaagtggctttaaagagacagcagacatgtttgtggcagtttattcattgcccctggatgccacccttgcatgccccctatgtgacagctagcggcccacagcccattaaccctgcagatgggcacagcaggcctcagggaggtgatgtgggttcagtgtgccgaagatgaagagatgcaggggactcaaacccactggccgaggcaccacccgtttctccaggcaaagaggtgagtcccaaccagtgaagagaagggagaagtggtgccagggcgagaacgtgtgtgtgcctgtgtgtgtgcctgtgtgtgcttgtgtgtgtgtgcatgtgtgtgtgcacatgagcttctgtatgtctgcagctgcacatgtacatatatgtgcatgtgtgcatgtgtgcctgagtatgtgtgcatgtgcacctttgtgtgcctcagtatgtacacgtgtgtgcatgcatgcatgtgcattgtgcttgtgtgtgtgcatgagcctgtctctgcctgcacatgtgcgcctaagcatgtacccgtgtgtgcatgcatgtgtgtgcatgtctttg

SEQ ID NO: 611 - DNA, 1774 bp, Homo Sapiens
aaggaggaaatagctaacgctctttagtgggatccatgagaggttttgggtccagtaagacattggaagtccatgtttgcaaaggatcagggtattatgaggcatgtgaggctgaggggacagctgaccagggaacacaggcacgaacacccaggcatgtttaatggacctcagaatgtggtgtaacagagttggttaagagccaaaactcttcaatcaatcccatagacaggaattcaaatctgaccctgcaacatacttcctgtgtgatcttggccaagttactggacttctttgagcctcagtgtcctcatctgtacaatgggcatgataatagtacttgcttgtggagatgctctgagatgcctgagaggcatgtaatattatcccagtgcctgccctgtggtttggggacttacatgtcagttcgtggtgtagactgagaagctgaaaatgggacccaaaggcacattgtaaagcccatggaattgtattaaggagtttggactctatcctcttgctcagtgactttcaaatcttgacagtacataacggggttaaaggtctgaacagctcgtgtgccctgaccagttcagatctcttccggccactgctttccttcttcccaaacccctcccccaactactttatggattaagcataaaaatgcctatgggcatccacgtcctgaatctgactccttgtagtgctgagcacagatttttaggaagagagaccaggcaccccttatagaaagagctttttgatcaagagccatcaggcagcgcgtggagggcctcacctagttcttcctcctgggcttgggcatgctctcctccctgcttgcctctgctgaggactgtatttccttgaattctgcctacctactcccagcggggctacaggcgattgtctgcaccagtcctcacaggagggtgctccctgccttttggcagtcagtgctatttctctgagctaggtagcctgctctaaatcttactaggtttacaaagagaatcctccatcccacctgagaactggttatcagtagtgccatcctgctcaaatatcttcaaatacacaccaccatccatgtgtgggttgattaaggagctgacgttcattagatctgcagtctcctgacctgatgtgcatcagaatcactgggagaacaaacaaacaaaaatgaatccaaaacaagcaacgaacagacagattctcaagtcttgccaagtccaaagattgatttggtggagaaattgtactttgaaagctgcccagtttacttggcagacatctcagagtttctttctggtatctctctcaggatatagaccccaataaaacatatggcctcacacagcagcggcctcaccaggtcgcagacacatgtttagaattcctcagtctactgtgaggctggcaaagaaagccccaagcaagaaaagcagacactgggcacttttgaacttattctgggtattaaaggagcattacatgagaaagagtatgtgcaaacagcggccagcaatttcatctgacttgagagatccttgtcacaggagggagtgggtacatagctatgtgtgcagcccatgcatttcggaggtattttctaggcaaactgcatgaagtcttacatgtgtacctgctgtcctcatgtgcagaataaagccttctgtaaaagacagcagaccggagttgcatctgtgtctagggcatctgtgccttccaccaggtggagaagttcacagcagtttggattttttctgcc

SEQ ID NO: 612 - DNA, 1012 bp, Homo Sapiens
aatttttttatcatgtatctgtcacttacattagtaaatctgtaagagtactgttttaagtattataataactcactttattgcagagttaactgggatgagaaaatctacttttcgtttaacataatatatatttaacaaaaattacctgattgactttatactaaccggtgtttataagaaacatgaggaaacactacaccaaaaagggccacagaagcatcaatgactgagactccgagagggaggggaccaggtactgcttctccagcaggtatgcgtaaataaatagaggaaggatcatgctccagagccccacttccagaggcactgtttggctggagctgcaaaagagtgaaataaaaattattcaaaatctactttaggaaatctacttattaaacattgggaatgaggattacagcagaggagaaaggagaaaaggcaacaaaaaaagaatgattggatccgaacatttgaaaacagaccaaaatgtaatttggtcattaaaaaatcatcagtaacaccttatacaaattttaagaaaagctttattcattcgaaaacatatttacaccacccaccttattgcgtgaacaatatacacaagatcttaatcccacaattattttaaatggggctttaatcactctttaaaaagtacataagaaataatgtattcagtgggcaaaagttctaaatcttcaacctactaactcattcctctccaacctgtcacaaaacaaaacaaactaaaacaaaacaaaataccaataaccaaaaagccagttaaaactgatctttatcacagccaccacaaggtatctaaatacacagaatattaaataaagacaatttgccaaattctcactcttcctgtttaacttttttcactatctaccaccaggatgccatctttaagtgtctaagaacactaaatggggattaaacctttctatacactattttctttttaagtgacaatgtgtaataggaccattgtttcagatta

SEQ ID NO: 613 - DNA, 1743 bp, Homo Sapiens
tatttttatttgtctttctttttcaaacaccaacttgaaccagaaggaagagtttaagaaagtgaatggagaggccaggcgcagtggctcatgcctgtaatcccagcactttgggaggctgaggtgggcggatcgcttgaggtcacgagttcgagaccagcctggccaacatggtgaaatctgtctttactaaaaatacaaaaattagctgggcatgatggcgtgtgcctgtaatcccagctacttgggaggctgaggctggagaattggttgaacccaggaggttcaattgtgccactgcactccagcctgggcgatagagcaagactcagtctcaaaaaaaaaaaaaaaaaaaaaaaaaaaaaaaagagggtgaatggagagagagatatcattctggaatggtaaacaggggccagatcacgaatgactttgtaagccataaaggcctgagagaggaatgtgaaagaggaactaataataacatcaggcactgcagggcgctttgccaatcactctttttttttttttttgagtcagggtctccttctgtggcccagtctggaatgttagtggtgcaatctcgactcactgcaacctccgcctcccggattcaagtgattctcctgcctcagcctcccaagtagctgggattacacgtacgcaccaccatgcccggcaaatttttgtatttttagtagagatagggtttcaacatattggccaggctggtctcaaactcgtgacctcaagtgatctgcccgcctcagcctcccaaaatgctgggattataggcgtgaaccatcacaccgggccattccaatcactcttcatttcctgcatctcaaagcaacgctgtcaaacagttggagttgattttctaggcctttctgttttccccctcctgcttgccattgcagggcctcctctggtcactcgtaccagtgagagatcaggctcctttaggaagtactcacagcggaaaatcagcttgaaactgcctttggaaaagtatgactgagacagtgaaggagatcaaacttaactgactccctcttgctcctaacctccagactgtccttattcattcctgggtgtaggccgaactaactttgggagaaacttagtttatagtttaaacaaagacggtaacaaccctttcttaaagcagacctccttcttgcctggggactagattgcctttgtaggatgaacattaaccacaagattagaaattatggtttaggagtcatgcagctggagctacaagattccaaccctcccctaaactgctcctaagatcagtgcttctttcccaagcggctgccgaagatggcggaggtacaggtcctggtgcttgatggtcgaggccatctcctgggccacctggcggccatcgtggctaaacaggtactgctgggccggaaggtggtggttgtatgctgtgaaggcatcaacatttctggcaatttctacagaaacaagttgaagtacctggctttcctccgcaagcggatgaacagcaacccttcccgaggcccctaccccctccaggcccccagccgcatcttctggcagaccatgcgaggtatgccgccccacaagaccaagccaggccaggccgctctggactgcctcaaggtgtttgacggcatcccaccgccctacgacaagaaaaagcggatggtggttcctgctgccctcaaggttgtgcgtctgaagcctgcaagaaagtttgcctat

SEQ ID NO: 614 - DNA, 1349 bp, Homo Sapiens
tatcacactctggggactgtggtggggtaggaggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaagaaagaaaaagaaacttcacatggggccacatgtctaataaaggtgactgaatcccaaaattatattggtaacatggaaattcctgataggggaagaatattcccagaagtgtgaccagttagggccaaaataaaaggtacaatttacccaattattatacctaagtacccggccttattaaatatatgttcctcaatatcaaattgtactaaaaatcaggaaactaagctcctagtagagaactggtcaaagggaagatctttgtggagtcagcagtttcctctgtcctacaatttggcaaaataatctcataagcacaagaaggttaatatgcttgcattaaaaatgttaagttacttataatccaatttaaatgtaagttcaaataccttaacatgttcacattacttttttaattcacaaaaacgttcttatctatctttattttaagatgttttccacatacatgcttagtgaattttcttttaggagatgtaagagagtctacaaatctttattctactatttcccaaaatatacccaattactggcaaaaaatgttattattaaactgatgagaaaatataaaggtttattactggattaaataagtttttccatatgcttgaattttttatacacacagtatatactctattatatgtatacacagaatacaactctatcagtattgaacttagtttgtcattccataaaatggccatagatggccagatcaagtaatcctactcattttaccctgtattactgaaaataaaaatggggggggggcaaataaagactttaatatctttaatgatgttttttaagggttagacttttattttctgacatttttctacacctctaatgaaatacatttcacatatcgtaaaacttacccatttaaagaatccagttcagtgtcttttggtgatttattcagagttttgcaaccattaccacaatctaattttagaatagtctcatcaccccatacccatcagcagtcattccctcctcctccccacccaacgttcgtgacaaacactaatcttctttccctctctatgcatttgtctatgcttaactatttcacataaatagaatcattacaatatgtgatctcttgtgactggtttcttccgcttagaatgttttc

SEQ ID NO: 615 - DNA, 1585 bp, Homo Sapiens
acattttgctctctttaggaaaagacaacattgattttagaggtttttgttatggaggccagggggatttttccagtgcagcacagagaaatctgggtttggattgggaagccagacatttcttggcttacatttcctacttgaatgggattcgtttgccccctcctcacctctccccaacccccaggcagctagaagccccacctccttgcttggaccatatggggaagctggctcggtggctgttattctactgactccaagttcacgcagctgttcatcccctgcttaatgtactggttgcctgtgtctgtaccccgtttcatcttcacttctgggaaccaggctgatggagaagtcttctagcagaagtactatgggtcatgatggcagaaagaagagcaaacttggtggaccatgtgctggcccttgatgggtctactcagatgggtcacgtatctctgctcacaaggtagctacccttgcatttcatcagggctctgcttgcaagaatcgcaaggcagatcaagcctagcggcctaagattgaataactgaggcttgatagagttacatcacttgtccaaagagataatgccagtgaatggaatagccagatcgaattccagaatccgtaaagctccactgcttctctctgaatgtaataacccatccacaagccctaagatattagacacatcagtgatcactccatctgcttttggcccattgctgttgtcaggatttatgcatttatgtctgcaataattatttattgaggaccttctctcttgcaattgcatatggccttataactgaattctgactttatgtctctcttaggatagacagataaaaatttttcatatgtgatcttctttctgtcccctacctctcagctatgagcctgaaacagcagattcagtagaacagagtttctcaggaatggcagagccacaagttgggaggagcccagctctgtccaacaacctggaacatccatcaaccaggaaaactgttgcactttatgtgattaagaaacattttttaaggaaaaaagcagtaaatttttgggttatatttgttgcaatagctgtgttactttcctaatgcacaatcacaaatgtaaaatgccacacacagagtgtgaggaaatatattgctattggactacttgtagtctatttaatttttttatatagctatagccagatctggggtgaaatggtttagaataataatttccaatagtatacatcatacctttaaaaagacttttatggatggataaatatctaattatggaactgccctgcaacgtaagtggtgagagaaactctttatatatgctttgtttttttctgaatgcataggttcagaattattaaacaaatcctcatcttttgacagccagtaatcaatttctcatttgcagggaatctaattgcattagaggggacactggggaagttatggactacctcatctttctactataaaaaatgaaactacttgtctgtattgaatttgattttatatgttcaatgaaatatatcatatccttataataaagttatataagttgc

SEQ ID NO: 616 - DNA, 2548 bp, Homo Sapiens
acagcatctctctctagcctattatctcctgttagacacagcccagaaaatgaatagagacaagtcctggctgggtctgggttcagaaacataatagaaggattcatctaattagcaattgaacccttgacagtacccgaaatgaaagccctagtgggtcagcactcactgtttaccagctccaatccctgctgtgcacttgcctttctaacagctccccaaggactgggctccctagagtcctcagtcccatggtcctggaaacctggccctacctctatctatgatttttgattatcagctccagcatttatggatcccttctcctattatctaatctacgggctctaaagattaaactgtgcactttggactatttaaatagttcttaaccactgatctcctccctcagggaagggaattctttccacagttgctagttcctcacacctctgcctctatgggattctcctggtccccacatgctctgctgtgtcttctagctgtcggccactgtggaggaagtgaaccttctagatcctgctgactcatacaatgagttttgtgtggaccatcagacaaaagggctggctggtgaaggtggctgttgtctggaaattcctcccagctctcctctaattatgtcataaggactggaggccccttagcctgcttgtgtgagtatcaccagctatgtaaagttggggccttagctcatcctcagcacatggctcaggatcacttccttaagaaagtctcttctgacctccttacccctaccatgtttcttgtactgacttacgcaatggtcacaaccaacatagaagctgaaatcccaatgactcactgtcccagctgcgcttgtagataagggagaggcaaagcacttagaatggcaatcagacatggctatctgggaccaggaattaggaactgctgacacaaagaagcagggacagaagagaactcactcttgtggtgagcagaggcagctgtgcaaacaacctgctgttccggatgtgactgtggtggccgtggggtgcagagtccagggctcatggcgttggtcatgcaaattgtggttcctgggccttagcagaaacaaggaacctattcagtggcattgctttgggggctgctctggcttcgtaagctgtgtgcctgattcttaagcccctcccagcaattctgggactgaagtttggtgtgttgctcttcggtttagatctgccacagtcatttgctgttgcttgaagctaaaaactctgagtgatacgaacctctcacacaactcttaccacgttgtcactacctaccccagtatatttagattccatcagatcaagtactggattttatttatctctaaatatcctaaatctccacagtgcctggagtacatgtatatatatttgacctacattaaactggtcaataaaatgaggaagtcttgcttaaagttccttctaacttaaaatttgcctgaccacatggaagctgtcaggttgctcattaatgcagaggtaatttttttctcttaactagggttagaatttagactctaccccttctctgtatctcagagggagcagaactagtggtttcctacactggagagggaactcaagtccttcagtgacctatgtcgtatgttaaagtcactcatgtttggcccctgtagtacaaatataccagaaagagtgataggaaacagcatattccccccttgttcagatttttcttagtatgacattatcttggaaagagaaaggccacatttgcaagtttggaagaaagttccccctggagttttttctctgtcctatttcagtatgtattgactctcagaacccgggctgctatgacatccgttttctgggtcactttgtccctgagtcattatcatcctgtaactttctgaaaacatttgactatgccatttaccagttaatttcagtgaatagctgaaatcatagtaaaatgttagggccagagtaaatttaggtcagattgattttattgccccagattaagaaagtgagccaagttgttgttaacaatttcatagtttccttcatcacatcttttcggagccttactcaaccataagatgaatcatccataaaatgacccccacaaagctgtggtttacatgttcatcactcttttctgtcatttgttgctttcaggataacacgcaaggaaatatgggccaactcttcacatgaacacaagatatttccatgctagccttttgcaagtaacaacagagagagctctgtgcagttttcactggaatgcctgtggattgcttgtgtcataactgtaatctaaagagttgtccatttgttgattcctttgtatttgtattggtagaattgccactatcaaaccaagatctttagctgcctttgtatcaacttctttggagcttatgtgattttccagaaaatttccaaggcatagttttgtccctaagtcccatgaatatgtaatattttgtgtctctctattaaaatagcactttttgtgcattccattaacaaat

SEQ ID NO: 617 - DNA, 2438 bp, Homo Sapiens
cggtcgcttccgaactcgctgcactggaggacgcaaggttcggtcctgcctgatttcgttgcgtgcggagaccgccgtcgcggctcagaaccggagcgtgggctagtctgaacactaccctgactctcacctgggctttggccctgcgaaatcagacggggagagtgctgcttctatcgatggcagcagggccgacgggcccaccgcaaagaacacagggatgagcgtcaaggatgggagaaggggagatccagagaacctgacgcgggccctaattgatagtgttcttttctttagtagctgtagctaggattctgtgtcttcggtgccagaggggcccgcttcccttccctgaactcttccagcgtcgggaagtccctgataccaggcgccaggggtccaaatgttttatgccaatactgtaaaacctcaagtgtttggacacctgctttattcttttcttcaccgaaatcgtgtatttcacgaattcattcaaaaacctttatcaggccttggagatgttaaaagaatttacagcctagtggaagacacagattcctaattagtccaaatttactcctaacacctgcaatcatcctacaagatcttaatgtttatgtgcctcatttatctaaaaccctgaactttggctgcctgtgaatcctcaggtccatttcagcaacccacttttgcatgctgtacctttgatatcatctgaaactgcttacattgtctccggtatcagaatctaacagtatatgctgatctccacgttctagcaaattttgtttaccagcaataataggagcaacctgctctcgagagtccatattctgatccctaaatgtattagagccacagtggggcctggaacactgccttaacacctgggctaagtcctcttatatctcgtagtgaacaccttatgtatgtaaggtgtccccagcccccgggccacaaacgggtaccagcccatggcctgttaggaaccgggctacacagcaagaagtgaatctctggcaagccagggaagcttaatctgtatttacagctgctccccatggttcacattatcgtctgagctccacctcctgtcagatcagctgtggcatgagattctcataggagctggaactactgtgaactaggcatgagagggatctaggttatgctccttatgagaatctaatgcctgatgatctgtcactgtctcccatcacccccagatgggaccatctagttgcaggaaaataagctcagggctcccaccgattctacattatggtgagttgtgtaattgtttcattatatattacaatgcaataataatagaaataaagggcacaataaatataatgcacttgaatcgtccaaaaccatccttccccatccacctagcccccacccccaggaaaaaattgtcttccatgaaacaggtccctggcacccaaaagattggggaccactgccttatatagttactgagagttttttctgggcttttttgttttgttttgttttgtttttcaggagtacttaactctcagccgggtacagtggctcatatctgtaatcccagcactttaggaggccgaggcggacagatcatttgaggtcaggagttcgagaccagcctggccatcgtggtgaaacccggtctccactaaaaatacaaaaattagctgggtctggtggtacatgcctgtaatccaagctaatcgggagattgaggcaggagaattgcttgaacccaggaggcggaggctgcagtgagctgaggtcgtgccactaccctccaacctgggagacagagtgagactccatctcaaaataaaaataaaaagagtacttaactctcaactgacggaagttcaataggccttcaactgctttcagctccagatgcccaatatacatcttccccccaattttcacaattttgcatcaaagtttgtcaattttatatgtatacatatatatgcatatatctgtgtttgtacatatatgtgggccctatcaaagccaactattctaaataataaataaaaaggatccaagatatcacttagagaaagacatcagaagagtgctaattatgtgaaaagggatagctttgccaggacacaaaaaaggagacagggttgaaacccttcatcacatgtaacacaatgttgttaaaacattaaacctcctcacagccacattctgcttcaggtctctgcaaattaacattctttcagtcggaaagagcagtctttctgactgctcttaaacctagaaattactcaattcttcagctcctctgggtggcacaaatttggatgcaaatcaccttttgtagtctcaggctttggcccacttctcagaattctgcaccaatccagctgaagcacacggcctgcccccgttttctgttagtaatttgaactcatttccta

SEQ ID NO: 618 - DNA, 5963 bp, Homo Sapiens
gaaccggcagtgagtggggccctagaattcccaagagtatatggcctttgtgttcagttaccagggtgggtagggaaggaccatcaggtgggggcggggctaggcggggctaggcgtggccgacctcacactctccttgggcaggacctgctgcagctgctctcggggttggaggggaggttcctaggtcaatggagttgtgtacctaggaggattatggctgcctctgctgagtcatgcagattgtcaggaagtgtgagaaagccagcagtcaccggcctcacccagccaccctgccgccattaacagcactaggcaggcagtgcgcagagctgagaacttgccccaggttacccgcctcccagctgctaaacaaaagggaggcttttcagctggttcaaattgttacaaagttcagctagagatttgcttttacctgcggcgttttccccataccactggctgccctcccgaagaattcctgtgatgccaggcaggaatggcctggttggagaccagctagctcccagggcctttcccgctgcttcctctacccctgtatttcgctgggctctctaaatggattcagctccagccttcaacattttaaaacaagaaactaggaaaggagtgaaggaatctgcctcacagattgtaaggacttgaaaacccaccgatagaccaagaggaggaaaaccttgagaccctgagactttcagaaacttattcacagttaccaaagctggcacacggatggagctgaaggccattatccttagcaaaccaacacaggaacagagaaccaaataccgcatgttctcacttatacgtggcagctaaatgatgagaacacatgaacacatagaggaaaacaacacacactgggaccttttggaggatggaggatgtgagaagggagaggatcaggaaaaataactccgacgggtactaggcttactatctgggtaatgaaataatctgtataacaagtttacatatgtaaccaacctgcacttgtgccccagaaagaaaatgtttgtggcagggagtgggacatccggcttcagagcaggaactttcattgcaccagtgatgaaaaagagaatgaaatgtgggtgacgttgagaaaggcaagaagatttttgttcagaagtgtgcccagtgcctaaaagggaggcaagcacaagactgggcctaacctccatggtctctttgggctgaagactggtcaggccattggattctcttacaaagatgccagtaagaacaaagagatcacctggggagaggatacagtgatggagcatttgcagaatcccaagaactacatccctggaacaaaaatgatctttgctggcattcagaagaaggcagaaagggcagacttgatagcttatctcaaaaaaagctactcatgagtaataattggccactgccttatttattacaaaacagaaatgtctcatgacttttctatgtgtaccatactttaatagatctcatacaccagaattcagatcatgaatgactgacagaatattttactgggcaatcctgatttaaaactaagactggcttgtggttaaatgaatgtgttcagtttttgaattttaatagtaattccaattcagtaaatgctatcactgtttaccccttctaaagatatgattagacttcactggtaatgttcaacttttcacaaagatggtgactgccatcttaaaacttactggatattggtttatatttagatttctataactggttatgtgaatatatttaaatactcgggaaattccttcactgtctcagaaccaagcaagattcatctgtgttttgtgttcatttgcctcttaaaggcaagggttgaagataaataaggtagcaacgtctactttatatttttggccttaactatgccaatctaattagaattctctgcatttaaactggttctttttacttactgaagggcattttagtgtggtttatgtgtaatatcaaagattatttaacatttctcacattttatagatgatctataaggtcacatgcttttaatatagtagcaagttaaacttcactcttgaattctttacaatctaagtcaaactaagttataatttaagattgtctttaaacagccattcagatacataaaactgtggaactgctctgtatttgtgattgtggatagtgcttttgccaacttaaaagaattaaagtagaggagatatacataaattttaaaattatgtgtgatcataagacttaagataattaaaaagaaattcacagatcattacaaaaacatgttcatggcaaagaaaagacatattctaagtagattaataattacagatgtgtcaaatatacagttctaggatttatgatgtagtcattaagttcatcaaatactataatgaaatatgtaatttaatttaaataatatttagaaattatatccatatattcaacaagtaattattaagtgtatttatgtgccagataccattctaggtgcctgggatgcatcagtgaacagaatacatctagtgctgcatgagggagcttcttttttagtgaaggaggacattagacacagatgtataaatgagtcattgaacaagataattgcaggcagagatggattctatgaaagaaataaatcagggtgatgagagggaaagtgacagagagacagctttaggttggaggctaaagtgaggcctttgaagaaatgataattcatgtgtgacttgaatgacaagataaaatgtagagagttagaggctgaggattacaggccaaggaaatagccctgtgcatatgttgtgagacatagctccaagacatagacatgcatagtttaattcaacttgactcttccagaaatgaattgaaggtcgctaggcctggagtgtcaggaagcagaggagaagttgtgagagaagagtttgaagtgagatgcctgtgtcatttaatgaagcaaatcacatgaaaaatatcactggcattttttattatacgacttatttaaaaatagcaataaaatttacttcctactttatcctaaggttctgaagacctttcaatggtgttcttggaggagagtttacaattttggtgtgtatcatgattgtaaagataccctgatatctttataaaatagaagtaaatttagaaattaaaaaaaacaaaactttcctgttctctcggtcaatcactgacagtatgtaaaatcattgcctagttgataaattcattcaagtctttcattttagttcaaggagactttagtttcctccttttggattataaaatggcagttacctggatcccttttgtatatacaattcatgacttacacataccagttttgtacatatgttgtaaatagctactattgtaaaagaaaaaataattttcacaggaatattttctgtgtataacagaaatggcttactttgatgtctttgttgaaaatatgtccataactaatgtaagaatattctaaaactttatttaaaaattttaaaagaacatttttatggataagcaatctcaatattataaaaatgacttctctttcccatgtaaatgtaaaacttcccatcaaattctgatagaacttaatattaatggatcttgatacaacatataaaaatcatgtgaaatacaagggaccaaaaaattgcaaaaatatttttgaaaatgaataaataaattagtgttacttaagccacagtatattaagtcttacagcacctgaaagtcgtattgtgcagagacagataaatggaaagctaagcaaaataatgattccagaaatcaatcaataaacaaacacatatacacatatatttgatatatgactattgccattgtagactaacaggaaaaagagaagcaattcagaaaataattaaaaattagttatacatatgaagaaacatgaacttagattaataattccttccttatattacatacaaaaataaatgctatatttattagtctactatgtaaaccaacattagaaagtctttaaagaaaatataatagtatgtctttacaacacaagatatgaagagcattctaaataaaaactccaaaagtgaatcataagctggaatgcaatggcgtgattatagctcaatgcatcttcatctccctgggctcaagcaatcttccaagctcagcctcccaagtagctggaactacaggtatagagacggagtttggctgtgttgcccaggctggagtgtagtggtgtgagctctgcttactgtaaactctgcgcctaaccccaggttcaagcaattctcttgccttagcctctcaagtagctgggattacaggtatgtgccaccatgcccagctaatttttgtattttaagtgttataccatataatttaaaaattcatttaacataacttgttcatcatctctatttttgcctagttcaacatggctgccataaactggatattgatatctatgaggttctcctctgtcccaggacaggtccagaaatgtcatcaaggagcgaagacgccagtgtggctgagctgttaacccaagctcaagagaaagtttcctttactcttctctctcctttgcccaagtggaaggggtctcttcccataggcaccgcagctggctatgtgctggttcacacttgaagtcagcatggttttgagtgtcacccaaggcccacagtgaatactgcccagctaccattgctgcttgttgagggtccaagggcactttagttagctcatgatgaattctgcaaaaattgggtcctttccttgaaggcagtgagttccattctggcccaggatgtatttcaaaatgtcctccaggatttatttttagagcagttttaggtttacagcaaaagtgagcagaaggttcagggatttgcagtatagcccccgcctgtcccacacgtgcatgcacggcctctcccaccacctacatccagtgccacagtggtacatttattacattgacaatacatcatcatcaccaaataccatagtttacattaggcttcactcttgacgttgtacattctatgtgtttggaatgacatgtatccaccatcatagtatcatacagaatagttccactgtcctaaaaatctctgtaatccaccaagtcagccttccctttccattaacactaggcaaccattgatctgtatatggtctccatagttttgcctttttcagaatgaccctatagttgaaatcatatattatgtagctttttcaggttggcttttttcacttaataatatatatttaaggattgtttgtcttttcatggattgatagggcatttctatttaatgctgaaaaaatattctgtagtttaaaggtacgacaatttattttactattcacttactgaaggacgtcttggctgcttccaagttttgacaaccatgaataaagctgctataaacatcaatgtacaggtttttgtgtgaacataagttttgaactcatttaggtaaattccaagaggtacaattcatgggccatatgctaagagtatcttcagctttcgaagaaactgccgaactgtcttccgaagtggctacacaatttgcatttccaccaacattgtgtaatagttcttgttccacatccttgccagcatttggtgtttccagtgttttgcattttggtgatcctaacaggtacattgtagaggtacctcattgttttaatttgcatttccctaatgacacatgatgtgagattttcttatgcttatttgccaaatgtatatcttctttggtgagatatatgtttggggaaaggagaatggtttgaaaatggtaatgaggagaaagaatgacactgacaccagctccaggtcccgtggaatgaaatctatggtaagtagtgttaactagggtccttagaagaggttcagacttacattc

SEQ ID NO: 619 - DNA, 1826 bp, Homo Sapiens
ccaagaggtgggaacaatctaaatgtccaacagatgaatgaatttttaaaaagtggtatatatacatacattgagatattattcagccttaaaaaagaagaaaaatcatggccgggcgcggtggctcacgcctgtaatcccagcactttgggaggccgagacgagcgaatcacgaggtcaggagatggagaccatcctcattaacatggtgaaactctgtctctactaaaaatacaaaaaaattagccgggtttagtggtgggcgcctgtagtcccagctactcaggaggctgaggcaggagaatggcatgaacccgggaggcggagcttgcagtgagccgagatcgcgccactgcactccagcctgggcgacagagcgagactccgtctgaaaaaaaaaaaaagggaaaaatcctgccacatgatatggtatgggtcaaacttgaagacattaagctaaataaaatgtcagtcacaaaaagacaaatattatatgattccactcacatgaagtatcaagtaatcaaactcacagaaaaagaaagtaaaattgtggttgccaatggttcagggtgaaaaaaaagggagttagtgtttaatgggtaagaggttcagtttcgcaagacaaaagatttctggatatttgttgcacaacagtatgagtataattaatgctacagaactgttagaaaagagtctctttcagatttagatactagaaaatgtatgagtaaaatacgatgtctgaaatttgctttcaaataatctgaaggctggttggggaagttgttggagtcatacatgaaataaaactggtattagttgacaatccttaaaactgagtgggtttattataccattctctctctacttttgtgtatgtttgaaattttccatcataaaggagtttttaaaaacccaacattatcaaaatgaaaaataatcaatacaagtgctggataagaaagtcaaggaaatatcacagaatgtataatttaaaagatttgctgaggtgtgtgtatcacctgagctcaggagttcgagactagcctggccaaaatggcataaccccatctctacataaaatacaaaaatcagctgggaacactggtgcacacctgtagtctcagctactcaggaggctgagacacgagaatcacttgaacccaggaggcagaggttgcagtgagctgagatcacgccattgcactccagcctgggtgacagagaaagactctgcttggtcacttttttggcggaggagaatgcagttaaaaaggacatgtccccggggattcgaatacacttctcaaagtgtactgctggccctctgtatccatgggttctgcatctgtagattcgatcaactcaactcctggctcaatactgatggaagtaatctgcttaacaatctcagaaggactgtgcaagtcaatgagtcgcttgtgaattctcatctggaaacgatcccacgtcttagaaccttcaccacaaggagtttttcttgtagtgattctcaaagtcttggtaggcattcgaactggtcctttcactttgagattcttttcttttgcgcctcttatcaagtcagcacacaccttttccaaggattttacgttgcggcttgttagggtgattcgaattcggtgaattgccacctccggctccacgggtgtttttccggtatccttaaaagccatggctgttgcgcgcgggcttcctgaccgacttgttcctcggcgagagcgaacagcggtgagtcaggagcaggagcgtgcggaccaaaaatcctcagcccttacgaccgcgtcttcctcaaaaagaaa

SEQ ID NO: 620 - DNA, 4046 bp, Homo Sapiens
gccgcgcaggcgccgggcgggccagacgtaggcccgggggttcccggcctggccgggtagcagcgcgggggcggccctggggcggggagacagggggcggctccactccggcgctctgcggaggacagcagcgatcgccaaggctcagtgagtccccgcactagcgcggcacctggcacttggcggggccgaaccaacgaatgagcgaatttgccgagagtcgccccgtctgaatccattgactctttccttgcctcggtcctaccctcattcctcgactcacttcctcctgcccttcctcactatctccctccccgctcatatcctccctctcctttcctcattcccttcttcactctcttctctcctctcttactccccccctctcattccctccctccttcactctctcattccttcccttcctatcttacccaccattcccttcctccctcactcattcactccctccctgtctccccctctcatcccctccctctctcattccctttccctccctccttaactctcgttctctcctccctctctcattccttccctccctgtctcatttccccccttctttccctccctccctctcctcttctcccattgcctccctccctctttgattcccttctttcctcctctcctccacttgttcccttcgtcacgcgctcattccctccctcccgcggcctgctccttccccgctccctccgcggtcggtgccgctgaccgtagcgcgccccctgcgggatatcggggagaatcgcttaacaccgccagagtgaacaggtgctagtttgtgtgcccgttcctttactgagattttgcagtaaatctaattcccagtcttaaagcctggtcccagaggtccgtgcgcgggtcttggcattcattgttctccacctcaccttcgagcaggtcccatcctccgaggcgtatccgtaatggctgcgcccagagcttggagccacagagcctcctgatgggataaggttggagtgtcccacactgtggttttgagagggactgtgaagggtggagagagtggtagggggaggatgtggctggagatggctcatggttaaaaagaaaggtggggccgggcttggtggctggcgcctgtaatcccaacactttgggaggccgagacgggcggatcacgaggtcaggagatggaaaccatcctggccaacatggtgaaaccccatctctaccaaaacacacacaaaaaaactagccggtcgtggtggcgcgcacctgtagtcccagctactcgggagcctgaggcaggagaatcgcttgaacccgggaggcagaggttgcagtgagccgagatcacgcgccactgcactccagcctggtgacagagcgagactccgtctcaaaaaaaaaaaaaaaaaaaaaaaaaaaaattggtggaaggggaatgtaaaaggaggaaaatacacggaagagaattgctgtcctggctgagtccagagagataactgagggtcccagacaaggatcaagagaacgggattggcctccagaggcagaggttccaaatgggagtgggcttcctcctagaaagactttctggaggagacccccctactgtgtaacagaggaggactttgggattaagaaaagcattccaggaagccgacagtgtcagcaaacgtggaggtgagatccttcaaagtgagtggtgtggaggtttccagaattttctgagcctgaagggaaggttggagagcagaccctgccctttggaggcttgacttagccctgagggcaccctgtagccagggtgggcagatgccaatatggtagagacgaagactgagtagggagccagccacagtgctgtggtctcaggcagggagtgaagaccagagtggagcaggctagaaacctgggaaggaagcaggttccccagtataagcccagtgatgtgtgaagaatgagcccaggagatgggtggggaagtaggcccaccctgcctacaggggagccagagcaagagcaggtctgggggaagatgaggccccccttggctccaggtaggggaagactgacctccaaggcccaatgggaccaggtgtacgggtggacccagagaggagaggaaaaggaatcctggggcagcaacaagaaggccactgtggtctgaatgtcggtacccccaaaattcatatgttggaactgaatcctcagtgcgatactattataaagtagggcctttgggaggggtttaggtcatgagggtgaagtcctcaccatgggatcagtgtataaaagaggttcgaaggagctcatcccccacttttgccaggtgaggacactgtaataagcaccatcttcaaggcagagaatcggctgggcgcagtggctcacgcctgtaatcccagcactttgggaagccgaggtgggaggatcatgaggtcaggagatcaagaccatcctggctaacatggtgaaaccccatctctactaaaaatacaaaaaattagccaggcatggtggtgggcgcctgtagtcccagctacttgggaggctgaggcaggagaatggcgtgaacccgggaggcagagcttgcagtgagctgagatcgcgccactgcactccagcctgggtgacagagcaagactccgtctcaaaaaaaaaaagcagagaacggacccctcactagacactggggcttttttctgaaggctactgtgtcatataaaatttatattaaataaattgatatgcttttctcttgttaatctgtcctttgttagaggggtgtcaaccaggaaccttgtgatgcgtgaggaaaaaatattaccttttccccctactctttctggcacccaacaaacaagtggggtggcaaagacaccccacttgggacaactggcaaaagctctatgatcagaagatggcataagtggggctgggcacagtggctcagtgcccagctgggattacgcctgtaataccagcactttgggaggccaaggtgagtggatcacgaggtcaggagttgaagaccagcctggccaacatggagaaaccccgtctctactaaaaatacaaaaaattagccgggcgcggtggcaggtgcctgtaatcccagctactcgggaggctgaggcaggagaatagcttgaactcagagggcggaggttgcagtgagccaaggttgcgccactgcactccagcctgggcgacagagtgagactccgtctctaaaaaacaaaaaagaagatggcgtaatcagaagttgatattctgtctattggatcctgcttctcccctggggtcttcttggttccctgaagcccctcttccggagtccctgccctctatcggctctgcctcctgcttcttttctgtattgccatgatttttgctaaggataaaggacaacttcattggcttctttgggaaacttgcaatctccccaaacaggcccctctgagatttctcctttccatttgcttctgctcccccttcctccttttgccaccttcgatattttctccagtttccttgattcctttgatacgtccccattcaggccactctggccctccatccaacctgccagaactttttccacttcagcacttcagtcacttaaacattagggctccctgccctaaagggactcaaaatcctgcaaaaacaaccacctaaggataaaaagagaaaaaatgaaactgtttggaaactgggcaaatgaatactcttttaaaagtctttttctgggggccaggtgtggtggctcacgcctgtaatcccagcactttgggaggccgaggcgggcagatcacaaggtcaggagttcaagaccagcctggccaatatggtgaaaccccgtctctcctaatgatacaaaaaaaattagccaggtgtggtggcattcgcctgtagtcccagctacttgggaggctgaggaaggagaatcgcttgaacccgggaggcggaggttgcagtgagccaagattgcaccactgcaccagcctggcgacagagcaagaagactccatctcgaaaaatatata

SEQ ID NO: 621 - DNA, 3615 bp, Homo Sapiens
tttgctatatttgggtaatatatatttacatatatattcatttgacagagattctttatttatgaaagcttctcccaaaattctaagaacactttatgtgtgcatttacaacaaaattcctctttttctatcttttttttttttttaatagagacagggtctccctgtgttgcccgggctgatcttgaactcctagccccaagtgacctcctgccttggcctcccaaagtgctgggattataagtgtgagccacttctttttcataagaggtgtgaaaaccagttttcataaaccttttcaggaatgcttttttttttaattaaaaaccaagttttcacatcaaaatgattgtaaagacttttttttttaacattttaaatttgaaatagaagtgtatacctagatctcttcaccaactaggaaatccattgctgagatagcaaaattttctttttctttttttatttttaatttttgtgtgtacatgtatatattcatgaggtacatgagatgttttgatagaggcatacaatgtataataattacatcagggaaaatggggtgtccatcccctcaagcatcctttgtgttacaaacaatccaattatactcttctggttattttaaaatctacaattaaattattattgactgtagtcaccctgttgtgctatcgaatagtaggtcttagtcattcttcctgtttttttgtacccattaaccatccccacctcccccataccaccctgctaccctacccatcttctggtaaccatccttctactctttatttccatgattcaattgtgtgtatttttaggtcccacaaatgagtgagaacatgcgatgtttgtctttctgtgcctgacttatttcacttaatgaccatccatgttgttgcaaatgacacaatctctttttttttttttttttttttttttgagatggagttttattcttgttgcccaggctagagtacaatggtgcagtcccagctcaacctccatctcctgagttccaagcagttcccctgtctcagcctcccgagtagctgggattacagacatgcgccaccatgcccaactaatttttttgcatttttagtagagacagggtttcaccatgttttccaggatggtctcgatctcttgacctcgtgatccacccgcctctgcctcccaaagtgctgggattacaggtgtgagccaccatgcctggccataatctcattctttttttatagctgaatggcactctattgtaagtaccacattttctttgtccattcatctgttcatggacacttgggttgcttcctaatcttggatgttgtgaacagagctgcaacaaccatggaaatgcagatatctcttctatttgctcatttccaggaagcaggattttctatcagcctgaaggagccgactcttggttactcatgtcaaggaaaacacacacaatttaaatagtgatcatttatgatcttgtctacatagtattgaactacataggtttttccctcacattcagtcaatgttgagcacctactgtgtgccagacactgtctaggcaccagggatacatgcaggaatgaaaccgacacaatctgttacttcacggagtttatattctggcattaacttgtttttgaaaatttaggctgtaggccctttctacagcctagttagctgaagaagctttctctggatgagctgaagtaaccttctcagcatatctccattttcacaagagggaagaaaggcactgggtgatgaagggatgtgcccgctgtcagctggccagcttgtggtgcagctagctgccagcccaggcagggtatctgtcgagctcttcttctttctcctgttccaaccatttcagggctggctggctgctcaggtctcatgaatccttacctggaaaggttgcaaagtttgttagcctctccatctttaaaaaaaatgtatacttgtttttaaaattattatacagtaaaattgacttcttttggaggatggtacagttctatgaattttaactcgtataaatttgtgcagccctcaccacaatcaggatacaaagctgttccatccacccccaaaaatctccctgtatagccacacccccccccgactaacctctggcaaccactaatctgttctctctccctatagctttgccttttctagaatgtcacataggtggaatcctgtatacctttgactgacttctttcacccagcataactcatccccatctttattttttttccttttttggaaaatttccttccacccatacacctgatttgagcattaacacctttcagatgattatatgttcaccacaagcctcccgctcttaaggaaactgataaagtatcttattgtaaagggtttttctctggagtgaagttgcaggctctgggtagttctgttgtgctgggtttttgttctgtgcctcccgtatgtgcataggaaatgtgtctttgaatgatgggggagctgtggaacgcactgccaaaaggaggtttcataccctgttcacctgattgtgtcacagaaatcagaaaaggaaaatctgtgtcagtgaatttcactattcaagtacagtcaacccctccagattcgggcatctgtagagtcaaccaaccttggatcaaaaatatctggaaaaaaaaattgcatcggtactgaacacatacagacttttttccttgtcgctgttgcatgaaataatacagtgtaacagctatttacatattatttacattcattaggtattacaagtaatctagagatgattcagtgtaagggttgtgctgtgtgtcagttatatgatttgatgtatggagtgtgctgtgcgtcagttatatgcaagtactacaccattttatatcagagacttgagcatctgtggatttgggtatctgtaggaagatctaaccattgcccactgatactgaggggtgactgttggcatggctgtcacaaatcccagaattcactgtgtatttgttgtcttagtcttcatcttaatcagtattctaggatttttttctacatttttgcttgtggtcttcactaaaatattttaacttttctgccctgtatcttatcttattttgacatttttaatattatgtataatatctcattttgaaaacttaaaaaaaaaaaaaaactatgtgatttatatatgtagttctccgggtaaaaaagaacctttctcctttttgaatttttgagatgttacctaccagtaatgttggtactattataaggcaatcgtcttataaactttttcactaaatagtcattttgttttctttgttttcaacacagtttttacgtaacagaactgttttcctcatcactattagaaatcagttgttaatgtgcatgctagtgttttgaattttaatattgattataaattcacatgtagattagtaatttgtaaaaaaaaaaatgtaaatttatgtaactcatttttcagatactttggtactaatgttattttatcgttaccaattcttacaacaaatataccaaactatggatttaaatgttttggcattaaaaactatttgataataaaatcaggaaatttta

SEQ ID NO: 622 - DNA, 1491 bp, Homo Sapiens
tttttttttttgagacagaatctcgctctgtcacccgggctggaatgcagtggcgtgatctcactgcaatggctcagtgaatggaatggcacagtgaatggaatgcagtggtggagctcactgcaagctacgcctcccgggttcatgccattctcctgcctcagcctcccaagtagctgggactacaggcgcccaccaccatccctggctaatttttttgtatttttttagtagagacaaggtttcaccatgttagccaggatggtctcaatctcctgacctcgtgatccacccgcctcagcctcccaacgtgctgggattacaggcgtgagccaccgcgcccagcctaggaaaattcttctataaagggcctattgaggttaaagcagctccatcttggatgctactctgccagatggagtcttgctccatcgcccaggctggagtgcagggatgccatcactgcaacctcagcctctcaggttcaagtgattctcctgcctcagcctcccaagagtacctgggtctacaggcgcatgccaccacacctagctaatttttgtatttttagtagagtcggggtttcaccatgttggccaggctggtcttgaactcctgatctcaagtgatctgcccgcctcggcctcccaaagtgctgggattacaggtgtgagccactgtgcctggcctcttgcatcatttttatgtgcagtcaggaggtaccttggtagacgcatctatgagagcagaacctgataattagggaaaccaagttcaggctcagtgctgtaatcctccatcaggtctcatcacttgaagacaagcagcatattcaatgtcctctaaaggacaataaggtttcttgaggatagagtttctgtgatcttagcacctagaagagagccttgcacacagcaggccatcaataacatctgaataaaggattaatgatgttccagatctaggaatcagtcatttatgattctaagttacggatagttatattatagatacagatatacatatacatatacatatatatcaatatagagatataggcttatgcatgtatatatagagagatttatatatatatacatatatatatatcaatatctgcctatatcattagtaacagataaatcacagtctgcatttaggtaaattatgtacttatttgcctatttaacattctatttcttgccataaaattgcaagttccacaaggacagaaaattggcctggcttgttattgttctattgtcaatgcctagaacagtgtccggaacacagtaggtattcaatacatttttttaaattaatgagtgaacgaattgttgatgcacaataagtacatagtttctctctgagtttcatgcagacacagaattttttcttctgttctccagctgtgacttattggatgagaattgcataatcacactaattgacttcataacaaatttatgatttcccatctcagccagactc

SEQ ID NO: 623 - DNA, 1417 bp, Homo Sapiens
taggtgtgacacgttcacataactgtgcagcacatgccgggagtgatcagtcagacattttaatttgaaccacgtatctctgggtagctacaaaattcctcagggatttcattttgcagacatgtctctgagcttctatacctgctcaaggtcattgtcatctttgtgtttagctcatccaaaggtgttaccctggtttcaatgaacctaacctcattcttcgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccttatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacgctggaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttttggattgttttttacattcagtgttataatatttgattatgctgattggttttggtgggtactgatgcgaattaat

SEQ ID NO: 624 - DNA, 2324 bp, Homo Sapiens
ggagatgcggaccttgaggcttaggatcccctcctagccgagtggagtggagtgggaatgtccagagccctgaaccttcacggaagcccccgagacacctattattagtgacttcctctgaaatattcagtttaacatatagaaatatggtttatctaggagtgttgttgttgtttggcttaaagctgtctgaaatgggtttctgtttcttgcaactgaagagtcttagctgaagaggcttaactagggcaacgatgcttcagtgtggttatgaggattaaataacataaagtatttcaagcacttcagttagcacctccagaaatgtttctcccctcttccaactgttaacagtatcgcatgtaccgagaccatcagacttacctgtgttttgtacatgctcaaaataagagcccattttgcggtcagttttcttttctttttatttatttatgtatttatgtatttatttattttttgagtcggagacggagtttcgctcttgttgcccaggctggagtgcaatggtaagatctcggctcaccacaacctccgcgtccctggttcaagagattctcctgcctcagcctcccaagtagctgggattacaggcatgcgtcaccactcccggctaattttgtatttttagtagagacggggtttctccatgttggtcagggtggtctcgaactcccgacctcagattatccgccccccccccaaccccggcctcccaaagtgctgggattacaggcgtgagccacctcgcccagccagttttcttttttgcaagtttttcctcattccatctttcaggtggtgttatgatttatgtttttttttttgctatgttttaaagttttgtttgttcctgaaaggattgagttagtcatactcctcagttcatggcatactatcatcagaccatgacagtgaggccctcttgttttatttatttatttatttatttatacccttcaagtcccattttctcactacaataggcaattttctaatgtgcttaatgtggatatttccatttatgtgttttctaaacatagttattatttcgtgagcatgcattattaaatgtacttcaaacctactgagatatttgtctcattacttatatttgtttaacctaagcactgttttttggctccatccacgttgccagatgttaatatttaatctgttacttcacattgatgcctaatagtccgcggtatgcatctgtccactcttccattgatgagctcccatgctgcttccaactccatgctactacaaataaccctgcattgaatccccttgtgaacttgtaaataatttgttttatgttacttaggggaggaattgctgctgggctactgggtataaatctgtttaatgtgtccgagtaatgccatatcgctttccaaaagtggtggaaccaatcttgcagcagtgcaagattctgtatttccacgtctgacaacacttgcaatttttctttttcttttcttttcttttttttttttctttttgaggcagagtctcactctgctgtctaggctggggtgcagtggtgtaattatggctcactgcagcctcccaggctcaaccgatcctcctgcttcaacctcctgagtagctgggactataggcacatgccaccatgcccaactaattttttaatttttttgtagaaataggatcccactgtgttgcccaggctggtctcaaactcctggggtcaagtagttctcctgctttggcctcccaaagtgctgggattacaagcatgagccactgcacccagccaacatgtgctattttctagatttctaatcactggtttgataggaataaagtgatatctcattatttgtttaatttgcatttgattactaatgtaaatttccatatatttattagctttctcctctgcaattaattgcctgttcatattctttgcttcttttttttaaattgggttgctttttcctgttcatttgcaggcgttccttacatattttagggtgatattacactgttgtcagttttagacaaagcaaatatattctccattctgccatctgcccgttaacttcgttaatgatgccctttatggaacagaaatccttaattttttaataatgaagctccccagcttttgctttatgacttgcgcttttaaaacgttgaaatatgggtaccactttcttagttgtgcttattctctgccagatatctccaaatctgaattcactggtgaggtctctaggcattccattcactcctcttcactgaattccaaagtcactgttctgactgaatttaac

SEQ ID NO: 625 - DNA, 2249 bp, Homo Sapiens
agcagagcccataacatcctttcatgttggtgctttctgattcacagattgttcaagtaaactttgttaaatttcttttgtcagaagttcttcttttaacaattgtgtgttaagacataactctgggagcgttttgcaaaatgcttttgaacagggagaaaatgttggcatgaggatgagtttggatgcctttgaaataatccaggcaatagataactttaagagatgggagtgttccaggtggagtaaatagcttctgcagaagcccacaatctaaatgcccaacagggaacatctgcttggaactccctttgcttgctcttcgccagtgcctttgactttcatcacacctgttcaccagctctatcagcttggtagaagtgaaagccctactcctggcaatgggtcatttgagcttagaggagtgggctggagaagaggaaatgataccatgttcttttaagaaaaaagaggaaaaagcccacaagatgaacactatggtgtataaccctgtcatgtctttttagcaatgaactttggagccctggaaacaagtagccctaagttacaacactcaattttaaatgggaaagagcatctcctaaaagaaaactatccagagaagctgtgaagagaaattcaaaggaagggtaaactctgagtttacagtgtggcttcttgccattttgtatattgacagaacactataagccttatgtcaatatcctgtaaaggatgagtgtcacaggaggcatgaaaaataaagctgaaagaaatttgtataatatctataaaagcacttctaaccctgagagaaagcattaaaataaaagagaggggctgtatgttatctctgtttctgcataagaatgcagaagaattcatgaactctgcgaatgcagaagttaatgaacatcatgaaaagaataaaagaggaatgaaaatgcaaacatacaagtttgggatgttatcacacattaatcggaaatgcaaaaataaattgacaatactatgtgttggcaagaacacaatgggaactctcattcactactagtgggtgtgtaaattaatacaaactgtttgaaaacagttttaacttgtcctttcaaactatactacaaggctacagtaaccaaaacagcatggtactggtaccaaaacagacatatagaccaatggggcagagcagaaacctcagacataacaccacacatctacaaccatctgatcttcaacaaacctgataaaaacaagtaatggggaaaggatctcctaatcagtaaatggtgctgggaaaactggctagttatatgcggaaaactgaaactggaccccttccttacaccttatacaaaaattaactcacaatgcattacaaacttaaatataaaatccaaaagcataaaaactctagaagaaaacctaggcaataccatttaggacaggcatgggcaaagacttcatgacaaaaacttcaaaagcaattgcaacaaaagcccaaattgacaaatggggtctaattaaactaaagaccttctgcacagcaaaagaaactatcatcagagtgaacaggcaacctacagattgggagaaaatttttgcaatctacccatctgatgaaagtgtaatatccagaatttacaaggaacttaaacatatttacaagaaaaaaacaaccccatcgaaaagtgggcacaggatatgaacagacacttctcaaaagaagacatttatgcagccaacaaacatgaaaaaagctcaacatcactgatcatcagagaaatgcaaatcaaaaccacaatgagataccatctcacaccagtcagaatggtgattattaaaaagttaggagacaatagatgctggcaaggctgtagagaaataggaatgcttttgcactgttggtgggaatgtaaattagttcaaccattgtggaagacagcatagtgattcctcaaggatctagaaccagaaataccatttgtttcagcaatcctattactgggaatatacccaaaggaatataagtcattctacacatgcacacgtatgtttattgcagcaatatttacaatagcaaagacatggaaccaacccaaatgcccatcaatgatagactggataaagaaaatgtggtacatatacaccatggagccataaaaaggaaggagatcatgtcctttgcagggacatggatgaagctgaaagccatcatcctcagtaaacaagcacaggaacagaaaaccaaa

SEQ ID NO: 626 - DNA, 1106 bp, Homo Sapiens
ggaagaatgagacacctctcctggcttctgatgttcccatccctgaggaggaacacctattactctaatactcccgcctctgtttcacacctttactcactttccccaggaagactgtatattaaagggttcagcatggggatcaccgtggtgtagaacacagaggacaccttctcctggtccagggagttacttgaagggggcttgaaatacatgaaggtaatggacccaaagaagatcaccacagccatgagatgagagctgcatgttccaaaagctttggaccggccctctgaggagcggatgtgaaggatgctgtagaggatgaaggcataggagacagcaacagctagggtgggcaccaaggtgttaaaccccgcaatgataaaaagtagaagctcattgaggtgtgtgttggagcaggagagattgaggaggggaagaacatcacagaagtaatggttgataatgtgggatttgcaaaaggacagtttcatcatggcacttgtatgagtcaaggcagagagaaagcccaagaagaaggcagccagcactagcagtgagcagacccatgaggacatgatcgcattataaagcagtgggctacagatggcaacatagcgatcatatgccatggcagtcaggaggtaaccctcagccaccacaaagaccacaaagaaaaagagctggaccatgcactcagagtaaaggattgtattcttctttcctaggaagttcaccagcattttgggagtaatgacagaggaatagcagaaatcgacgaaggacaagctgctgaggaaatagtacatgggggtgtgaagtagagggctgactgcaatcaggagaatcatgcccaggttgcccactactgtgaccacatagattcccaggaacaggaggaagaggggcagctggagctctgcttgctgtgttaaaccatctaagacaaactgagctgccatagaataattttccatggtcattcttctttaggcatttctgtgaaaatagaaagtatgaattaccttaacatggaccctcactgctcttccaaacaaaaccaaattgcataagggaggttgacagcagctaacagactgagt

SEQ ID NO: 627 - DNA, 1318 bp, Homo Sapiens
gtagcttccacgcgggcaggtccggaaactgagcatgtctgcaagcgctcagcggcgccggcagcagcggggctagagctgggctgcgtcaggctgagcccattcacctcgcggccacaggagctcagcgccggcgccgcgccgcccagccccgccgagaggggcgcactcgccgccgcggggcccgccgccgctcaccgcagccccctcctggcgacccgcaagaggactcagccgccggctgcgaccaccgtggactccctctatggaagggaatcctgggagtcccggccgtcagaggggttcccaaatccaaagggtccatctccaaggcgtcactccaggggtccgcggttcactttgctgccccttgcaggtgatgctgtgattgttgcctgcggactgggaagcacgatggctccaaaaggccagcggggccgagaagcagggacagagaccagcatttaagggatctctggtgggggcctccctggagttctccacatgtaaatatagcgaaaaaagaaaacactacgttactagaataaacacgtcctaaaatttctgtgcaaaaacacctttttgaacagcaaagatttcacccaccaaaacaaggaagcaagaagcttccacagtgtgcaggatccgaaacaggaccggcccggcgttgggtgagagtgggggaggggttgtcggcttctccatccagcttgccatgttctgtcgtcggtttcacattttcagagagactttaccagatgcaggaaatgaggatgaaggcaactctggaaggatgcaaagaagggagagcaagcactgtacctactgtctgctgtctaagagggctggtctcataactaaaaggtccagtccctgagatcttgtgtgcaaccgtcagaaatagttcaggacatcaaattgcacagagaagattcagatgaagggaaacaagaactctgtggaaaactgttggggacagtggcacgagttgtcttgcaaggtgatgtctgtcccgtggagggacacaagagcgaggacagcatggttctaatggccagggcatgtcttcttattccatgtgacagtggctggctgagttgctagtacgtttttgaaatataccctttgaaatatgttgattattctggacatctgtaaggtgggagatttgaataaaaagacttctgctgtcattattggcttttatggctatgatttttttcagtcattattataaatcatgtgaaggtaaaataaatgatcattttagccattctgttctgcacagaatgctgttcaaataaaacatcatctgata

SEQ ID NO: 628 - DNA, 2549 bp, Homo Sapiens
ctttgagcaagaggacaaacctgggtagggatctctatgatgttttctgcgttgcccgtggacgttcatctttctgatttgttagctgaagatgaggatctggagcaggagctcggagtgccattgttccatgggcagatgtgcagcagagattagcattaggaagacaagcagggccttcagtaggcataaggtgatgaggttcatgccgttggatcccacgggtgccctggggaagagatggttgggaagtctgagaggaagcaggagagctttcggagcacatggatgccgtccagaatggagatggttgtggctcggaagaaaaagaaatcacccagctcggagtcaggatacatttggaggtccaggccgccgagtttgctggtggggaagataggcaccagaaaggaaagaggacatccagggcaatttcttctgccccccagccaatccgtacattgtccagagggtcttgctctgtcatccaggctggcgcgatctcggctcactttgacctctgcctcctgggttcaagcgattctcctgtcacagcctcctgagcagctgggattacaggcaggcaccaccatgctgagctaatttttgtatttttagtagagaccaggtttcgccatgttgcccaggctactctcgaactcctggcctcatgtgatccgcccacctcagcctcccaaagtgctgggattacaggcgtgagccactgcaaccagctggaacaatcttgatattagggtgaacaagtgatttcatagctttctctgaaggaggaaacactgggagcatccacccgagaatcaacactgtggatcattctggggagttaatagttttgagatgtgtcccaagataattgttagcttgaattaccacgtggatggaaccatgctgatcctaagagccaggtaatggccaaaggtgccattcaggtgaaatccccaggtggaaaattcttccacttccaatgatagaattctattactctgcctatagtttggtgaaacaagactttacaaatagaggacaagatccattttgccaagaacaaccatatggatttaactgctgctaacaaccgttaggaaggaacatcaataaaaagcaagcctgtgagacaactccttccccaaggggcgcttgttacagagcgcgggccccagcaggcctggtccatcctccacattctttcctctctgacttatttttactttctgtttgaattggcttggttttattttgccctaaactgtgtctgtagtcatcccccgacagagttttgagagtgaaagtccgatctgcccacgcttcacagaactcaatgcggagccttctcaggagtcacttgacgtcaaggctgacttttaaatttgccaaaaaggcattctttggggagcggtcggcaccatcactttccctctttagagagctgctactggctgctggaattcaaaacccacaaattgcatttctaaacttaattcgatacatagatgagcggaaagatcagacattgatgctattgttttcaaccaagatgttttactatatcatttatattttgtttttttcttcccccagtttttaaactttttgtttgtttgttttacaggccaagcctactgctgttagaaaacatatttagaaatcacttggttcttccttgcctgaacatcatctatttagttagcttgtgttgtttagatgtgcttcagatctcaaaaaaataaattatgttatttgaaagcttgctctctgcttgtttacactattaatttagagtccagaggaatctctaaatttgcctctagaaaccacataatcacctaataatacctttcctgactccactttctgacacaaagtgacttttgaaacgcttccatcttccctttctatttaatgtactgcactccactcttttttcctttcgttttttctacagtccgtcatggagtatttgtttaccaaatgttacttttcttggatccaatctatttttgaagagcgcaaaagcaaacaactgtttgaagctgtcaagcttcattttatttatgcatgaataacacaaataacttgaaaatgacctagtctgtttttctcagatttagatagaaaaactgcttccggccaatgtttatgccaatttgttcatgccaagtttccagtttcggtgccaaccggtttttacagccaagttgtaaaccttcggtaaacatggcttataatgaaaagtgcaacacagcctgaaccctggcaccaggggacggatgtaaatttattctaagaacaaaattctaacaggaacaggaggggagctaggctggctacaaagtgttcccaccgtaatatggaaaatgtacagatgatgatatatttgattactaagatcccattaggccaatttaggcactttatgtatttcctttgctctggacgctgagtggtttcatgctcaatttgaagcaactggctcattgtctcagggtggttctagaactttgccttcaggtggggctggggagggagcc

SEQ ID NO: 629 - DNA, 910 bp, Homo Sapiens
tatgacagatgccactgtgaccttctccaaggactttctggcaggtggcgtggctgcggccatatccaagaacacagcagtgcccatcaagtgggtcaagctgctgctgcaagtgcagcatgccagcaagcagatcaccgcagataagctatgcaaggactagacagactctgtggttcatacccccaaggagcagggagtcctgtccttctgccacggtaacctggccagtgtcatcagatacttacccacctaggctgtcaactttgcccaaggtaaacagaagcagatcttctgaggtggggtggacgagaggccccagttgtggtgctacattgcaggcaatctggcccccagtgatgccactgggccacatccttgtgtatggtgtaccctcttgattttcgcagctacttgactttgtacctgtctagcagctaatgtgggtaaagctagagctgaaagggaatctagaagcctcagtaactgcctggttaagatctacaaatccgatggaattaagagactgaaccaaggctttaacgtgtcagtgtggggtattatcatctaccaagctccctactttggtatccgtgacactgcaaaaggcatttttccagatcccaagaatgctaacatcttcatcagctgatgatcgcacaatctgtcactggcattgctgggataaaaagtcattcctatccatttgatactgtttgccaccacaagatgacagggtcagggttcaaaggaactgatattctgcacacaggcatccctgactgctggaggaaaattgctcatgatgaaggagacaaagcttttctcaaaggtgcatgatccagcattctcagaggcatgggtggtgtttctatgcttttcttatatgataaaataaagaagtacacat

SEQ ID NO: 630 - DNA, 2554 bp, Homo Sapiens
aagtgctatgggtcatccaggtgaagatgttcagtaatttaacaaatatgtatcaagtgtctcctatgtgctaggcactgatgagtatttgaggagagagatttgggagtgatttgggtatcatcaatgtatcataaaagttgaagtcttgggaggggacaatcccacattcagagacgtgatgtagattaagccaagagaggactaaggacaggactcatctctgggaatgccaatatttagggggcagacttgagttgccagaacagagaccaaagaggagctgccagaaaggaaagaaaacgcttctggaggagagtgtccaaaaagccaaggaaagaacaaacttcaggaaagagggagaggccaacaacatggaatttcgaggaggtcaattaagaccactgagttttgcaagaataaggtgctcattataaagcatctgaggagttcagaagagcaccaagaaatttaaaaactaaagtcctaatacctgtcttcgacattaggtgaacattccagacatatatacagacagaagaccacatggatgacttatcaagaaacgaaaaatgtttacaaaaatgagatcccactacagtattatttttatttatttatttttatttttatgtttttgagacagtcttgctgttgcccaggctggggtgcagtggcatgatctaggctcactgcaacgtccgcctcctgagttcaagcaattatcctgcctcagcctcccaaactgggattacaaacatgtgccaccacgcccagctaatttttctggggttttttttttcgtagagacggggtttcaccatgttggccaggctggttttgaactcctgacctcaagtgattctcccgtcttggcctccgaaagtgctaggattatgggcgtgagccactgcacccagcctattttatttatttttcagaaaaagtctcactctggcccaggctggagtgcagtggcacaatcatagctcacagcagcctccaactcctgggctcaagcagtccttccacctcagcctcccaagtagctgggactacaggcccatgccaccaggcctggctaattttttaaaaaatatatttttaaggctgggcacggtggctcacgcctgtaatcccagcactttgggaggcagatcacttgaggccaggaattcaagaccagcctggccaacatggtgaaaccccgtctctactaaaaatacaaaacttagccaggaatggtggcgcatgcctgtaatcccagctactcagaaaaaaaaattatttttagtagagatgaggtcttgctatgttgcacaggctggcctcaaactcctggcttctagctatcctcctaccttggtctcccaaagtgctgtgattacaggcatgagccacggtgcctggccctgtgttgttttactgtttaaaactgttttactgtttactgtttaaaaacagtaaataaggttaggcagatggctcacgcctgtaatcccagcactttgggaggccaagatgggaggattgtttgagcccaggagttcaagaccagccttgggcaacatagcaagacctgatctctacaaaaaacagctaggcctggtggtacacacctgtagtcccagctacttgggaggctgaagcaagaggatggcttgagcctggaaagcagaggctgcctagccgagatcgtaccactgcactccagcctgggtgccagagcaagaccctgcctcaaaaaaaaataaaaaagaattagctgtgcaattcagagtcagctatggcctgaacggattaagaagctggggtgccctagactggtgtttggggagagtcctgggttggaaggagatgactgtagtctaggctgaccacatgcagactcctaggtgacttatagggctcatctgggtgtgctcaggctggtgggcagaggccacggtggtgctccgcctggggctgaggcagagcgtaaccctgatccactcctggaaagccaagaagcatcctatggcacacgttctagtttagacatacctgctggggagcgtgctttgcaacatggaggagggagcacttcttcctggcaggacaccctgggtcctcagaggcactccaaggtgctccaaagtatgacagcttttactattttactgctgtttacactgcagaatatatgaaagccacactctcttttcggggatagagaccccttgttagccctccactgagaagcagtggagaaactctgataaacaatgattgactaaatgcatattctgtgccaagagcttttcatatactatactaagtcattcaatgtagtgactatatagtcagtattcttgcccctgctttatacgtgaagaaactatgcttcagagaaagcagtttgcccatggttgtcctcaagcagatggaatccaaacccaccgggcatggtggccacacctgtaatcacagcactttgggagaccaaggtgagaggatcacatgagcccaggagttcaagaccagcctaggcaacataggaagaccctgtctctac

SEQ ID NO: 631 - DNA, 2189 bp, Homo Sapiens
tgaggacattgttgtgagggtgtgacttttgtgaagccagaaaactgtgcctaagattcattacagtgagtatgtgcagaggcccctgacccagtaaatgctttttgcctttttattcccaatgtcttggacagttgagacaacttggcccaactctgaattgtagcagtgatgtcttatatgcttacgagtttatattaattcagctgaacaagaactacatcttaaaccacctttgtaggtatgattaatacgtgcaacagctgctttaaaaggtggtatttattattcatcactcatgaaacttgactcagtgaggacttcattatttttatttctctttccacgtctccaactttttaaaaatcactaatttaactctttgttaagtactcaagtacaaagtgatctcttctttcatgaactttgctataactgttgaaaggattggtgtcaggctctctcaaccctgggagtttccaaaatttagcaaatattacttgtgataagcttaaatgccacatcgctaagtacaattattaccaggaatccgtcaagggggagatagccccgctcacacccttagacccaaacaggtgctggttcatgctttctccacaaattggcagttgggtacttccccactgtcatcacagttgagctcattttaacatatattcaaagaagctttttagtttctactcctgaattgtagtgttcaagttatttgccttcctgggtaagaaaattttaacccaagtctgggattctctggcacctgtcttttcccatcttttaatgagttggcaagattaggtcaaatttcaatgctaaatttgattttttgaattttaaatagttgcactttatttcatgctgaccaccaacttaatttatacattttaaaataaaattatcctagaagtgttgtaaacgtgggaaaattttaattagtgttggaggtcattagattggacccaggtttaaatataatgatctcttcacagcttatttgatgtttaagagcaacttgtgtgatcttagctttgcaggttttctgtaatttatgtagcacaataaaggataaccagttgactgtgttactggactctgagttctcacagctagtttcatctaagcttggtttattatcatttctgctttggatttttttgtgcatcacatgaatacttagaaatccatttgttttcagtgtagtacctagggtgaagtagatgctgcacaagtaagtttaagggaataaaagtcccgacactttatatacatgttgaggggcacgatttaagagactgaaacagtttacattaaactgtttttattttctgccagtagactctatctgcttaaaaaaataaaaattgttcaacccagtgttctccagcatcaggacattacagttgtaatctatgttgtaatcttttcaaataagaaaagctactccttattctctacagtgtaggcttaattttagaaccgataatttactatatctgcattattgatatttttaagtagtagttttaaaaataattatttctatgtggagggtgttttaatttgggattttttttttcttgtaacaggtgctatttgtaaatatgaaggggaaaagtcacttagttaaaagtctagcttatgtcataattaagatacaattattcatttcatgtttgattctattaaactagtggcaaaacagaattggtcccttagttttttagattacctttccccctatatcacaaaaatatctctttccatatgatctcataattgaggcaaagaagctaagggtttatttaaaatgtgtataagcttgaatttggtcaacactgcataatttgaaatcactctgcatttgtcactgcagcttactgtatgcttgaaaggccttgtgtgtttgtcttaattttagtgaaaaaattagaatttctgccattcatgtacaaaaaaattacaactacagcaaacaagataaaaatgctggtttgcattaatactgttttagtcttaagagcaatttatattatgtgaaatgctgttacacatattttgttggccatatttcattttgagaaacagttgttcaggtacaaacatgacaaacaactctagctatgactcttaatgttcaattgcaaaataaagatgtgctttagtaatctaaa

SEQ ID NO: 632 - DNA, 4317 bp, Homo Sapiens
acgcccatgtgagcggccgcgagcgctgggaggacggacccagcggtcgatgacagggcctggcgcggttcgcttttcctgggtgactgtgttcgtggggctgaggccctcgaggtgcccacttccagctttccaccaattactgcactgtctttccgtttcctgccccgctgacgcgtacacctatttcagactcagcgcagctccgcggggagaaaagtgcggggctccctctcggctccacaccagactccggagtagttcgaactgcgctggggtcgccaagacgcgcgctgcccttctcccagcactgccctccccagcgtctttgaccactcttaatacccacaaacttgatcggacaatttctggtgtgtccagccatgtgtcacgtactgggaatacaaaatagaatgaggcaagctccctgacctcaaagatttcagagttcagttggagaaatcgacagaatctggggtttgcttctcacgcaagattttcaacagcctcaattggtctctctacttccgttgttgcatttctatgatatgttgcccgcacaacaatcaaaatgatctttttagttagtttggagctttggtttgtcaaggaattatgagtcaaccatcaatatttgaactaaaagaaacaaaactgggccaggcaccgtggttcacacctggaaacccaacactctgggaggctgaggtggggatattgcttatactcaggaattggagaccagcctgggcaacatggcgaaacctcatctctccaaaaatacaaaacttagccaggtgtggtgacatgcgcctgtagccccagctgaggtgggagaatcacttgagcccaggaaatagaagctgcagtcagccgtgattgcaccactgcactccagcctgtgtgacatagcaagaccctgcctcaaaaaaaataaaaataaaaaaaagcaacgaaactggatttactgtgtactctaataaggaaaagctatgctgggtcggcacagtctccccaagcagagctggctgctgatgctctatggagctttggggaatacagagttcaggaataggtgcatttcagaggcaaaagggtttgccatcacctgtagaagagtagatattctggtaagactgttattaattctccactgaatttattggagtgaacctgtcattggctgactttgagaaaggaggggtttttcaaaacaagttttactgaggcagttgattaattgaatgggtttaaaactggttctaggagtgtggaaacttgctttaattctcagggcttcaaaaaattattatagaaatgtgaaacctacagaaaaaaaaaaggtaaaaaggtaatgtacccaccaaactgagcatccagagaaggacacaggaaagagctttttagtcagtgccaactcccctgtgcatgcctgagaacttctccttgggggcttgcccttcccaggagttcaggctacctggttaccttgcaacccagctgtgtctgatggtttcagttaaggttgtgactttgtagttcatctgagtttttctcattattgagaaaggaaagatgttcattgcagcttttcatatcctaagcacaaaagaagtctttcgtctcaattttaacagtacattaatggggtattaccctttttctcccagtttcacagttgtcttttgtctttatgaagtttttggcttatttgttttgtcatgaaaagggttttttttagaatatagtcaaatttatcaattttttcttttattgcatctggattttgaaacataattagaaatcctttccttgtacccaggttaaagaagaattcacccatttttttttctagtacttgtatggtttcattatttagatttagattcctgacccatttggagtttattcttttgcctagtatgaggtatggatcaaactttttatctttttctaaatggctaaccaattgttaagtccatctttgtccaagtgatttgagatgccacctttattgcatactaaattcccatatgtatttgggtttacttctggactttcttttcggttgtactgctctttcttgtcatgcacaaggaccactgtttttattttagaggccttagaatatgttttagtgactggtagatgtagtcccctttcatagcttttatttttgttttcctggatattcttccatatttttccacctgaaattagtatcagcttgcctagctccataagaaaactggtatttttttaatgaactttgaaaattaacttaaggagactttagtttttaatgttaagtcatcacatacaaaaaaaaaaagtggtgttccagtttttcaaactatttcatgtcttttgagagtgttttaaagttttcttcatatatattttacaaatttcttgttaaatttattattctttgttgcttttgtaaatgtagttttctctacctttatgtcatgttactgattatgtatgtgaaggctgttgatttatgtatgttaagtttatgtcctgccaacttattgaattcttctctagtttgacttagttttgctgttaattttctgtgatattccaggtgtactgtcataccatctgcaaagacaaagagttttactcactcttttctagttctcctgccttcaattgatttctctttactaactgcagtagtgagtatctccagttcaatgttaaatggcagtgaagatagtgtacattcttcccttagacctgggataaatattaaacaaacagaagagaaaggaatgctcttccttgtaatagaaagccaatcaatacatgtagaaggaatgatggaaatataaaaccactgtttgctaggcatcatcataatatctgatccaggcaagaatcagtagttactaaaattagtggataaaagtttgaagtgtaaaggatatatgcataatctcaaagtagctcctcaccagagatttattaatgacaaaggaaaaaatagtgcagaagcctggcccacatacgtgaaccaagtgatcatagttaatactaccagtattggaacaaagtgacattatgtgcccccagatatgcactgaaactgaaaacacaaaactctgtgatttacctaacaaaagctcatcatacctaaatctcagcataaggaaacatcaaacaaacccaaattgaaggatattatacaaaataactggcctgatttctcagtgtcataaaagactaaggaactgccctgattaaagaagactccagagacataacagctgaatgcaacacatgatccaggatttctttggctatagggaacattattgggacagttgacaaaatctaagttctgtaagtaatttgtattctgtcagcatttattttctgattttgactactggactgtggttataaaagaaggtacctgtggccgggcgtggtggctcactcctgtaatcccagcactttgggaggccaaggagggcggatggatcacctgaggtcagttcaagaccagcctgaccaacatggagaaaccccatctctaccaaaaatacaaaattagccgggtgtggaggcgcatagctgtaatcccagctactcgggaggctgaggcaggagaatcgcttcaaaccaggaggcggaggttgccgtgagctgagatcaagccattgcaccccagcctgggcaacaagagcaaaattcagaaaagacgaagacgaagacgacgaagacgaagacgaagaagaagaagaggaggaggaggaggaggaacttgtttttagaaaacacatactgagatatttagaagtcaaaggacatgtacatatattagatatatatgtatatggagagagaataaaacaaacatggtaaaatgttgccatttcaggtgtctgggtagaggtatgtgggaactctttttactagccttacaacttttctgtaaatctgaaactatatacaccacactttgacctcctaagagtcttgtgcatctttgtatctcaaacatctagaacagggccagcttgaaaactgcttaataagtgaatcccttaaatcaggagcacgttacaccacctagtggtgtaacaaaggaagcttactgctgtggaaaaacctgttcctgtccacaatgaacttgctcattctaactgtgttgacctattattagccaaacaaattgcacttattttataattatcaagtgatgggaaagtgaaagcaatttggggtgtaagtataggctttatcatcttggacacaaggtcactagactgaccagcctggtttcacaggtgtgggggtggt

SEQ ID NO: 633 - DNA, 1896 bp, Homo Sapiens
tttttaagaaaaaacatctattttgggggaagaaatttattgtgacaatgtattgtacttgacaaattttagttatcagttaagtttaatttctgatagaaaccctatcagcaactgtattaaaattttatacattcttggccaggcacagtggctcacacctgtaatctcagcactttgggagaccaaggctggtggatcacttgaggtcaggagtttgagaccagcctggccaacatgatgaaacctcatttctactaaaaatacaaaaattagccaggcgtggtggcaggtgcctgtaatcccaactactcaggaggctgaggcaggagaatctcttgaacctgggaggtggaggttgtagtgagctttgatcacaccattgcactctaggctggacaacagagtaagactgtgtctcaaaaaaaaaaaaaaacctttaaattgtattcatggtggaaagagttgaaatgtgaatggtcagtaaaaacttgtttcattttctaatcatattacctgctttaaaaacaaaaatcatgttgtctaatttcttattatataatggaaagaaaggtcatctaggatattagcctcttttaaaaaaatcttgttggccaggtgcggtggctcacgcctgtaatcccagcactttgggaggccgaggctggtggatcacgaggtcaggagatcgaggccatcctggctaacacagtgaaacccatctctactaaaaatacaaaaaattaactgggcgtggtggcgggcacctgtagtcccagctactcgggaggctgaggcaggagaatggcgtgaacctgggaggcggagcttgcagtgagccgagattgcgctactgcactcagcttgggcaacatagcgagactcgtctcaaaaaaaaaaaatctcgttattctacaaagtatatcaatcactccattaaatcttatttcatttaaaaacaatttttgttggagttcctctttcaatttgggtcaaacagctctttacgtgatgactttatgtcaaacctacatagagtttctggagtgggctccatccactccattaccatacctgagagaatgtcagatttcctgcttcctcatttgcatgacttctcaaagtcagcatgttgataatgacttatagaaaacagtccttttaaaaggaatggcttgctattggtttgggcaggaggcattttgaatgactgagcagttaagtcatctctttatttgagaataaatgatgaaggggtgtttgaatgggttaccaagttataaattaatcttgagatactcaaatgattgtaaaccacctgagctttcctctcagcttttaaatcatatgatatcaatctttgctcattttcctctgggtaatttgttattatgctgatggtaaccaactccatgagacattaaccggcaatccacattaccagtgagtatacattacagcactaaaataaaaataaactcacagaagaaatagcttgagatctcaaccatgcttttctgtctacaaaacggcatgacagtttggggatttctagctgaaaataaatttaattatgttactactttgctgctgctaattagtgcctaagatatgtatcaggagggcagcccagtgtaggtttcgaaagagggtttactacaaaggcaggatagcaaaatgggttacctttttcactctcactatgtaaagtgacatttaaattagatcctggaaattaccttttctgtttatgttagcaagatagtcttctcttttgctttattcaaatagggaagcaactttataacattttgtatcgcctacatgaagtgttttgcatatctgtaacctttcaattaatgttatttatgtttcaataaaccaccatgctacttt

SEQ ID NO: 634 - DNA, 3097 bp, Homo Sapiens
aaaaccctgcctcgctagcgcagggagaagtcgcaccagtcggagcgcagagggacacgcagacatttcagcagaggcctcaaaggcagaacaaaatagtgcaaggagccgcacatccgcacagtgctgagaccctgcccaggacaagcttggtgagtggaaaacttcctttgtcagcccttcgcgcacttccagcctcagatcgaggcatcagggagggtttccttgaagagggtgggctgagggctgtgtgttcccaccacccctgttgcccttccatggggtggggcagcaagtgcttcccctcacctcaaggaagtgacaagggttgcacggagagctctccccacacctttcagtgtttggggaaacgtgaggactggtctgagaagtcagggctgccgtggccagtggtgccctgccccagagggcagtggggtgaaggtgtgtggctcccagggaccagatgggggcccttttgaataggactccacccaagtgggctgcctggaagggcaaagggacccaacagagatgtgggccactggaaaaccagagacccaagggctgctgagaccctgccccacaactacacacatcccaacctcataatgaaaagtgtagttgagatagggttgccagattttacaaataaatatacaagatactcgtttaaatttgaatgtcaggtaaacaacatgtatgtttttagtatatgttaaatgaaatatttgggacatacactagatctttttttatttttatctatctaaacttcaaatttaattggacattctgtatttttatctggcaaccctaagttgggagctttatagcagaaattcaagtggcttctccaagaaacccacaaaagcaccccaaagaaaagtcagccctagaaaccccaatggcagctcacaactgaagcagtcaagtaagatcatttctgctctgtcatcctggtcccccacctcaatgcctcatcaggatagggagtgggaggtggaagaagggaggggacaggaggaggagatgaccatctccatcacttcaggcttccgagccagagacgagacgctttaactttaaatgaaattgaacattttgattattacttggatcagacacagacatacaactactcttcttgtgacttaaagagacctatgatgtctgcctaagacggcatgtcttagatggggaaggaagcaggtcctggagctaggtggaaaagacagtgggtgaaaggagagttgcttcaagagtgtgctcagctgagtagcagtggttcccaaactgatggcttctttgcagagctgtctttctcactagcatcttagcatttgtttgtgtccccagttcatggcatatatagtagatgctcagtaaatatctgactgtgttgtttttttgagacagggtctcaggtgcccaggctggagtgcagtggtgtgatcatagcccactgcagcctcaaactcttgaggtcatgtgatccctcctgcctcagcctcccaagtagctgggactacaggtgcataccaccacacctggctaatttttatttttttctttgtacagacaaaaaagaagaaaattgggtcttgttatgttgcccaggctggtctccaactcctggcctcaagtgatcctcccagcttgtccttccaaagtgttgggattataggtgtgagccactgtgcctggccatgtctgaatgttgaatgttgacagcttcagtgaattgacccctctttcacctatgggacttatgaagagagaatctttctggcattgcataatccttcccaagagtactttagctgtggtaacccttcttgttataaaacatgccaggtatgatgatggagatcagctgagctggacttagaatcttctctaagaacatttacaggcactcagtgttaacagcagggcagatgtaggtttctgggaacctgaggcttataggaactggagttcattgtaagaaaaagaatatcaaattatgaagacaaaattaggcatcaatgtgaatattaatttaggagaaatcacaacaaatcgcacatcctgaaaagctaacaaatactgcatacatcgcagaatctagaagcataacaatatttgtattggttaacttggacatatcactatagtatgctttttttctacattttgggctatatttttttcctattctttttggttgatgtccttgtagtagtggctacatgttagtaggcactaaccctagtagtaactaatcctagtagtagggttcatgttattgttgtcgatgtctgtattttgtgatcaaatcaccaagactgcaaatccttctttcaacatattcatatgattcactccccttcattaaattgggttattcaaacaattatgctccaaatttatctcttcctcttaatcaagtactactttggcatgatctgatttttataattattctctcttctcatctttattatttatattttcttagctattatgattcttcttctcaatttcatgcttttgtctatcaggctttttagcttctgttgtgatagaacaaaagagtttttgacattttgtaacttcttccagtcttttatctttcagtttttgtctgagacttctactaggatgttttcttctcaacacgcttgatttttgtatagttaataattttgaaataaaggcattctcaagagcagttcaaatgcacttgaaaattgctgaaatgtattgagttgcatattgcataatcaaattacttttttgccacatagactgatctattggtgagtatgtgtaggggtttcattaccctggagtcctttttctttgctttttttcccctttctttccatttctgtggcaatttggtgaacagtttcatcaggaagtgtgagacttcataagggcaagaggatcagatagatactctaagggtgatccgttcagtttgcacaataaatctgtggaagacatcatatgtacagtggaatcttctttctttgcagagaaaagtggacaagcatccaatttccaaatcaattcttgggataaattggtataacttgttggaaagcag

SEQ ID NO: 635 - DNA, 1699 bp, Homo Sapiens
gtatacatatgtaactaacctgcacattgtgcacatgtaccctaaaacttaaagtataataataaaaaaaaaagattctaaagaggaaaaaaaaaaaaaaaaagaaacgcctggggttttacgctgtcactccccagctctgagtgtttaggtaaacttacccctttgtgcccctgtttcctcacctgcaaaatgggcatgataatagtagctgtttcacaggatttatgcaaggattaaatgaagggatacatataaattccttacaaaagtgcccgactctctgtaattggtgggtctacatataagagtgttgttgcttagcacaatgcctgtcatatgagaaatgttccataatgtgagcgattactttgcttaatttattctcccccaactttttttagagtacttttggtggaacgttaaaagtgatgccagatacattttattgacatgcttaagtaagctcaattaatatgtatataatttattgcctctgccatgcctataatctaattgttcttttaaaggatgctgaggcgggtggatcacgaggccaggagatcgagaccatcctggctaacacggtgaaaccccatctctactaaaaatacaaaaaattagccgggcgtggtggcgggcgcctgtagtcccagctactcgggaagctgaggcaggagaatggcgtgaacctgggaggcggagcttgcagtgggctgagatcgtgcctctgcactccagcctgggcgacagagcaagactccgtctcaaaaaaaaaacaaacaacaagaaacaaaaaaaaaacttataacttcatcttctaataactatataacatttcaggaactatctttaggattaaggtgttataaagggtgattatatttcatgattatgttgttaacaattattatatttttattaattagtgaggattagagaaaagaaccccagatctaagtaaactaaagggaagtccagggtctctgattcttactctgatgcttattaactgtatgaactaagaaataacaggataatttgataacgaattatggattttaaaaatataattctgttttaagtgtagaagatggactggcaaggaagagatgaaaatagattggttagaaaactattgcaatagtctaagcaaggataaaacccttaactaaggccatagtaatggagatgaagagatggtacatgtgtagatccttgggccacagttaatcttcacaacttgccccttacttctagtggaatttagacaggcatagatccaaatggtggttttaccatttactagtcatatgattttatgctgcccataattcaatatcatcaagctttgttttattcatgcaatatagataaaacagtatctatctcatttaaaccattgcaaaattaaatgggatattctagataaagctccttttatagtgcctgaaacataacatggacttaaataagaaagggtaattattcttgattatgataaaactatcaagattctggatgtattttagccaaggcagagtaaaaagagaactgagacaagaggcagaaaatttacatttgaatcaaagtctgccactaaatagtggtttgatcttaggaaagtagagcctccattttctaatttgtaaaatgaagggcttgtactgcataggtagctctgaagttgaagcgatgc

SEQ ID NO: 636 - DNA, 1723 bp, Homo Sapiens
aggctcagtagaattgcttcagacatgaaataaagctaaaatgaatttgtgtccaatatcattggcattagtgctcattactgttgtggtgtaatgcctcaaaccatctaaaatcaattttagaaactaaccaggctcaaaaccatggttccctttgtttatctgcagatctgtcctgtttaaggtaaaattcaccctgggccctcgcccctgacctccaccaggtgacttttcatggagacattctcactgccagcaatccttcaactctttccacagaagtctgccaggaagagaaatgtccaaagtccattttgagctctcagcctgggatttagctgcaatttttcatggacactgggcaattactggcatacgaagccaaggagaagcaagagagggaaggccctgcttctctagtgagatcatcatctttgcatcagtcactgttagagacatctctggtttctgttcccagcctaactgcacagaaaagagatattctagcttctccctagttacgcatatgtggagaaaactgaaaaagatgggtaatcatggttgttgtaagtacttgggggctccagaaggtgtccctaagaactccataaagaggggctgttgtttctctgagatttaaacctttagcacaaaatggatcacagtgcagctgctggaagtcatccgaaggagctgaaaattttccaagcccacaccctcaattgcaacttgtttgagcaattttattagcaaatctaaagaaataatgctttgatcagaaaggagagggtttactcagcatggaagcaggacaaaaaaagggactcaaaggcaaatgttagcagggactgcccaaaccttgtccaaaagagaaggagctgaagtcaatcgacgggtaatttctaggcctcttgaaagatgcatctccaatacggtgtcagaaatcatagatatcacaagtctgtaatcaacagatttcaaggattcaggtcccctttgggaagaacatcccatcctatcatggtgccacttaaacacttagttttcctgtctcaattcaatgttcaccaaaccttgtcttcaggttgccttgttgctgctgaacatttgccaacagaaagtagacaggatgctgacactgttgtagaccatctctgatagtgatttcttattaaaaatgtcaatgctgtgttttgatcttatacatacatgctgtgtgcctgctaaggaggcttcccacagaaaagctgctgctgcttcacctcagcgtataccttgacacagttgctatcctgaaagcggttttttcttaccattttaactagttttaagtgaccagttgagcggcattaagcacattcacattattgtgcaaccgtcaccaccagccatctccactttctaaccaccagccaagggctctcttcaccaccaagccaactctcagggcagcagcaatgtgtaccttatctttccaacaaggacattatttcattttatggaaactgggagagatgttttgtcttctgaagtatctggagatttcttcttcattcccagactctttcatcatcaaaactacacagcttctcacggtcacttactttgttaaatttgtagtttaaaatgaacataaggaaaactacttctccaacaaaggatgcagagttcctgttgtgctcaactctgccagatcgtgggcttattgacaataggtttggaa

SEQ ID NO: 637 - DNA, 2337 bp, Homo Sapiens
agcccaggatcccttgcgccctgcggtagcccggggctgcccagggctgcgggctccaggcacccagagcgctgcgaccacatgaaaggcccggcgctcagcacccgccagccacctccagctggtttctaactacaccgccggggcctccatgcttctcagagaccagccttcgaagtgccgccttacacccggggcctggccaccgggcgggcgcggatggagctctggtccacatttgggagctcacagttgttcctgccagatgtggaagctgagacttaaagaagctatgaaacttgatcaggtcatgcagcgccagaggacccaaggtgggatctcaacccagactgtttggctccaaagctgaactgctacattacgttgcttcagcaaacagtcattcatcctgagagatgaacatgattccgcacagtgacttcagggtggcttattaaggggataaactcctccacctcttcttgttaagcatgtctgttcgacagtccaagcccaagatgaaaggcaagtggcatggctgaatcagcactttggtcccaccatgcctgccacctgttttattaagcgtgccagtgtgtcaagtgctgaggaatgaaaagaagggtgttgttgtcaaccgtgactttatcccctcactccaggccttccctcagccacctcagctggagaggccttgaggctgaggaaaaagtgccttccaggaaagcaactgcacacatttacctcagaaaataggaagcccccaagagcagtgaatgaaacattactttgctgtctttggaggccaatttccaggtctctccattttaaaatgaatgcagatacaaaatctcctcagtcccctgtagccgcgtgtgtcgtgtttgtccccttgggacagaaaatggtgagcttatgtcctgtggtgagcaagagccccccttgacctgaagtagcttccatccgtccctcagcctcccccttttcctttccagtaaagaaacccagttgcctggtacagtgtcagactttgcaaggctgttaacgacctataaaagtccaaagacagactactccagaaggaggaatcactgactaaggaaatcctgaatgccctaagcctgctcattaacaagaggcgaataataacagccaaagtggagaagctcataaattacccaaggaagcccaacgaagttggggggtggggcctgaccaatggaatccagggttcacttctggggttaatggaatcctggctggtccctgggattgcccaaggccaggcgtggtgtttccttcctgccttgctgggagaggtgtggaagtttgagggaggtgattattgcagagtcaccagcaaatcagggcgatacttgctctgggccacagagggaagtgggtcacgcactggagagtattagaactccaagctttgtcttggcgatgtgctcccagataagtaaacaacatccctccctttccctccccctactgggcatcttccactcccagtcatttatcacaggctgaagaaaacacattattaaaaagaaaaaggaaaggcggggaggaagacctaggacttctcaaacccctttccttccaagagctccaggctccatgctatgatcactatgagcttcccggacgggcttccacacccccagcaaactgggggatgagtttaatttgctttccattaaagctcctgctacttactaaagatttcacaacgtaatggctcagtataagcaaaatggaagccccaggcatgactcagcccaccttttcatgactcaggatctggaagaaattggagaatgtatgatcaaatctcgcctgtggcacatccagtacgaagaggtttcccaatgccctgatgtttgtgtctgtgtagacggtgatttcatcactccaccaataaagcctaacagtaccaacaacagcaaaagaatatggtagctgacccttatggagccttatccatcccaggcattaatagacacacacgtttcctcctccggccctcatgctaaactcaagaggaaacctaggctcagagaggtgacgtgactgcccagatcgcacagggtgagagccatggccaaactcggggcccagttccctaactgtaggactacaaccacattttggtgccatatttgatacaaactcaggtagaggttaagatcacgggccaaagagccagaaagtccttggagactgtcttggccgcatactttagggtgagtcactttgccttcctgagtctcacctgtaagatgggggaaataataccgtttgtgaggattaaatgagattcttcacataaaa

SEQ ID NO: 638 - DNA, 5478 bp, Homo Sapiens
catgcacatctagatccatactttttgggctcaactcagggttaccaaaatagagtcaaactcaactcaggattacctaaatggagtcaaattttgtgtgtggttttgtaacatgattctttcagtcatcatttccaggccacatttttcatgtcactcatgactgcattataagtttgtaccataattcatttaaccaatactctgttgtgcatttagaatattttcagatgtttattgtccttataaaagtcagtatgaaggtatgcaattatcacttaggccacattcctggaagtaaaattgttggaatggaaactatgtacattttacagtgcagattgctggaagagttttatgcaaaaacttatacaaaaatttacactcttaccagcagaaagcctcagcgccactgagtgctgttgtattgttaatcttgattaatctggtatgtgaagaaggatgtttcaatgttttgtctgtgtctctctgattattttgcttgttgattggccagttgttaattctgtctttgtgagttgtctttttctcagtacttggcctatttgtctttgatttgaaaaagctctttatgttgtagtcattttaattcctgtcatatgttttgtaaacaatttttcgagttcataatttttcaatcttgtttgtattatattttgccacacaaaaattttaaatttgtatagtcaaatttatcagtctttttccttatgttggaccttctaatctcaaggtactaaatataatctagcatttttttaaacattaaaaatttttaatccatctataatttattttaggatagggagtgaggcaggggaaggtatctttttaaataaaaatcgttgctaaatggttggctagttgtcctattaatagtcattgagaccaggagcggtggttcacccctgtaatcccagcactgtgggaggctgaggtgggaggatcacttgaggtcaggagttcgagactagcctgggcaacatggcgacacacaatctttacaaaaaataagaattaacagaggccaggctcagtggctcacgcctgtaacctttgggaggccaaggtgggtggatcacttgaggccatgtgttcaagaccagcctggccaacatggtgaaaccctgtctttactaaaaatacaaaaattagccaggcgtggtggtgtgcacatgtagtcctagctacttgggaggctgaagtgggaggaccccttgaacaggggaggttgaggctgcagtgagccatggtcatgccctgtactccagctgggtgacagagcaagaccctgtttccaaaaaaaaaaaaaaaaattcattgactgtttttttctgttagtgatttgaaatcatatactgaatcatatgctgaagtctatttctgaacttcttcttttgttctactgatctatttctgtgccaataccacctactgtaactttaaaataggtttttgtttataccaagtaagaataagttaccattatttttccattaatttttttttttttttttgagacaaggtctcactctgtcactctgttgcccaggctggagtgcagtggcatgatctcagctcactgtaacctctgcctccctgcttcaagctattctcccacctcatcctcccgagtaactgggactacagatgcgtgccaccacacctgactaatctttatatttttagtagagaggggggtttcaccgtgttggccaggctagtctcgagctcgtgacctcacgtgatcctcccgtctccgcctcccaaagtgctggaattactggcatgagccaccgaggctggcctgagtattctagtttataacttacaaggtcattcatatgtatatgttgttgtgcttgtctagctattttatattttgttattctgaactcttggcctctatctcagctccagcccctgaaagtgcaggagtgcttttgctctgccagtcggccttttttgggaaatcatatcaagatggcttttccagcacaattacttcctagagtgtctgcttgatgcatggaaactcatagatttttggcatgccaaacagagggttttcctgccgtcactgctggctccagccacagacttcagttttcttacctgttagagcctttgtcctctgactggtggaaatggagcttgcttctttttgttttgcctgccactagtctggcagcctccacctcttgacccttgggtttcttatccttggaatcagatacgaggccctgtgtcttctgttgctgtagaggacacaagtcatattctctgagtggagatctctctgaagctcctctttccaggcttgtactgagggacctctggaccctctaccacgtggtgtcaaagctgccaagagctgtcatatgctgggtctgtaaattgactttctcacctctgaccagatgcattcacttgagcggcacagagatttgggggagtgaaagggcactgtttctttgggtccgtgggcttgtgtcccatcccctagccttggggttagcaggattcagaatttatgagtgtggtctgcaaaagtctacctctaccagatgggggagaacctagtgtgtggacctgaagggttagctctgtgctttagtccctgggagtggccatcttgagtcttggtgggcttggcaagtaaggagacattgaccagattcaaagcttccagaggtggtgagaactccagggccgagtaatggagagtacaaaggtccttcttggcccccatgacccttccaagccaagaacttggcagtagctgtgagaagcagagatagggagaggaggtgaggggcacctatagctcttagccatgagttatgactccctccatccaagggagacccaaggacatgaaaggggactcagttccaaggatcagagggaacttgggttgttttgggataatgactgtggcttgggatgtcacggagatgaacaccagaattggtgtgcaacagatgagctccagtacccctgatagtttgcatgggttttgctctgctgatgatggtcagggacagcagtgaggccctctacaatgccgccttctgcctaaacacaggcagtgcccacaaaaggggagctgtcattatggagcctaggaatggatagtcagagagcagcggctgggcagtgcaactcctgcattggacaaggtcctggctagagaatgtcaatgtccacactgcatgtagccctatcgaggagatgatgtagggggctgtcagccttggagactctagcctaagtaccccaccaccactctggctggcttccaagggcacaaatcagctttctgaatctgacttggcttcctgtgatctgcattcatgaacattcttactagagttctcatggaaaatgaatacacaactatttggtctgaatgtgtctgagtttggtgtctccaaaacaattctctggattagatggagaatgaagaaacttcacaaaggcaaaaggacaggtccccatctcgacccccagagaccacttctcagagtctctatctgttcgtctctggtgttagccacgttcctttactttccctcatttctgtggccactcctgtggcttcctctctttcaacctgcaggctgctgctgccctgcctcagacccttgtaggcttctgtagagatgctactcagatgggggtggagctagatgcagagctgaaacccacctaggagatctagcttggagagcttgtgaatcttaggagagctaggcatagaatgactaaagtttgtcaccgcatgagataaaataaatgaaaagccacttctggagggaatgaggcagtctgcctttattggagagatacatattgttgaacagctctgggcagttgattgtgtgcctgggagagctaaccatgtttactctacacttgacctgtgatggtctgtattgattgtatcacacgcttagctttctaaggctaaccaggtcatcgtcctcagtccctgcctgcaactaggttgccaactggcccttgatttcccacccaacttgttcagtttgccctcaatcctggggcctcactaatttcccaaaaagatatggttggtaccacctgtagtttgctgttgcatgttaacctgacttttgggaaactcaaataaacacttttcaaacgcattgaccatttttactctatgacttctgctttgcatgatcgctagcttggtcacccatcatgctgctttctggtgagctgaaaggaaaataaatggtctaaattgagcaacaagaaagtaaacttttaagcaggtactttccaagtgaaatgagaaccggagattgggtccaaaagagaggatgcccagccagactgaactttcaagtgttttccaactggaaagctccaatgtcctctgatctcagtgaatttccaatctaatttcaaggaagtccctcaggagccccattgcaagggtggttatagaaccatttacaactgctttaataaaactaatgcttataaagaaagaaaacttgttttttagtcatccataacacaaaaaagtgaggtttgatgcacagtaaaaggaatcattatttaagttagtctgagttatattgtattttggaaatgctccacattcaatatttatgccacatactctaaaaccaaagtatgtagattaaaaaaaaactatttccagaaataagcttgctgaatcaccacaggcttaatttatttattttaactaccagtttcctgaatgtttttgtctaattggcctatctgcagttgcccttggtccacccttgagcccactctttaagcctgtctgtcacttagagaagtacaagtacttcctgctgagaataaagccttgatcgcaatttcagtgaattatcagggaagtgtgagaataagtaggaataaatgtctaaacatttgggaaaaacttgtttgcaataaatgtggttaacagagagtgaataggcttactacataaaattgttactcatcaattaaaaaaactgtacaatcctcctccgggggaaaatgatcagatattttaagtctgctgatatttttctctggatgtcagacctgtatactttgtcctgcattattggagtataattggcaaataaaagttttatgtatttaaggcatacaatgtgatgatatgatacacctatacactgtgacatgattacctcaatcaagctaattaacacatccatcacctcaccttttttgtgtgtggtgagaacacttagatttactcctatagcccatttcaggtatacattattaactctagtcaccatgctatacattagatctccaaaacttattcatcttgtaactgaaagtttgtactctttgaccaacattcgccattcctccccaacccctaactttggtaaccacccttttgctctctgtttctatgagttcttctgtttc

SEQ ID NO: 639 - DNA, 2409 bp, Homo Sapiens
cgtccagtgcttttcctgtggagggtgtttagagaaatggcaggaaggtgatgacccattagacgatcacaccagatgttttcccaattgtccatttctccaaaatatgaagtcctctgcggaagtgactccagaccttcagagccgtggtgaactttgtgaattactggaaaccacaagtgaaagcaatcttgaagattcaatagcagttggtcctatagtgccagaaatggcacagggtgaagcccagtggtttcaagaggcaaagaatctgaatgagcagctgagagcagcttataccagcgccagtttccgccacatgtctttgcttgatatctcttccgatctggccacggaccacttgctgggctgtgatctgtctattgcttcaaaacacatcagcaaacctgtgcaagaacctctggtgctgcctgaggtctttggcaacttgaactctgtcatgtgtgtggagggtgaagctggaagtggaaagacggtcctcctgaagaaaatagcttttctgtgggcatctggatgctgtcccctgttaaacaggttccagctggttttctacctctcccttagttccaccagaccagacgaggggctggccagtatcatctgtgaccagctcctagagaaagaaggatctgttactgaaatgtgcatgaggaacattatccagcagttaaagaatcaggtcttattccttttagatgactacaaagaaatatgttcaatccctcaagtcataggaaaactgattcaaaaaaaccacttatcccggacctgcctattgattgctgtccgtacaaacagggccagggacatccgccgatacctagagaccattctagagatcaaagcatttcccttttataatactgtctgtatattacggaagctcttttcacataatatgactcgtctgcgaaagtttatggtttactttggaaagaaccaaagtttgcagaagatacagaaaactcctctctttgtggcggcgatctgtgctcattggtttcagtatccttttgacccatcctttgatgatgtggctgttttcaagtcctatatggaacgcctttccttaaggaacaaagcgacagctgaaattctcaaagcaactgtgtcctcctgtggtgagctggccttgaaagggtttttttcatgttgctttgagtttaatgatgatgatctcgcagaagcaggggttgatgaagatgaagatctaaccatgtgcttgatgagcaaatttacagcccagagactaagaccattctaccggtttttaagtcctgccttccaagaatttcttgcggggatgaggctgattgaactcctggattcagataggcaggaacatcaagatttgggactgtatcatttgaaacaaatcaactcacccatgatgactgtaagcgcctacaacaattttttgaactatgtctccagcctcccttcaacaaaagcagggcccaaaattgtgtctcatttgctccatttagtggataacaaagagtcattggagaatatatctgaaaatgatgactacttaaagcaccagccagaaatttcactgcagatgcagttacttaggggattgtggcaaatttgtccacaagcttacttttcaatggtttcagaacatttactggttcttgccctgaaaactgcttatcaaagcaacactgttgctgcgtgttctccatttgttttgcaattccttcaagggagaacactgactttgggtgcgcttaacttacagtactttttcgaccacccagaaagcttgtcattgttgaggagcatccacttcccaatacgaggaaataagacatcacccagagcacatttttcagttctggaaacatgttttgacaaatcacaggtgccaactatagatcaggactatgcttctgcctttgaacctatgaatgaatgggagcgaaatttagctgaaaaagaggataatgtaaagagctatatggatatgcagcgcagggcatcaccagaccttagtactggctattggaaactttctccaaagcagtacaagattccctgtctagaagtcgatgtgaatgatattgatgttgtaggccaggatatgcttgagattctaatgacagttttctcagcttcacagcgcatcgaactccatttaaaccacagcagaggctttatagaaagcatccgcccagctcttgagctgtctaaggcctctgtcaccaagtgctccataagcaagttggaactcagcgcagccgaacaggaactgcttctcaccctgccttccctggaatctcttgaagtctcagggacaatccagtcacaaggtatacctgtatatattttggatgactattctgatgtataatttctttttcttactttaagtggttgaaa

SEQ ID NO: 640 - DNA, 39996 bp, Homo Sapiens
aggccgccctgctagggccggagggaggtgggcacgccgggctcgggaccttcccggggtcctgcgcccgcccggcctcccgccctgggcatggttggcccactcctcccgcagccaccaacctgacagcccccgagggcgactccgccgacagaccgccatgcaccgggccccgccaccagcgccggccccacaacccgcctgcgccatagcccgcccgcccgcgcgcagcttgcctcgcgcgatatccaggttccagggccgccgcactttcctttcctcttggcgcgcctctaccgggccccggaacccgtatagaaaataccgggcacggtccaccccgccccccgcttcgccgcggcagccatccaacttatcctggttccggggctcctggagcccaggcggccgggatctgaaccgagctcttcggagccccgcccccaccaaggccggggtgacgcatggccagcgaggctgagcgcccagggaaggcgtgctgacgtcacgacgcccgggtcagggcctgggcgcggctcggagccgggtcgtcgctatagcaatcgggaaccgctacctgtccattccaaggattcggtccagcagaagcgtgaggaggtggcggaggccccgagggctttgcgtcatcacttctgcggcctgcgggcgagaaggtgcgcttcgggagtagcgcgggaggacaggaggcgcaggttgtgagggacgcaggccctggggcttcggtctctgtcctccgagctcagagcctccaggcttcttcccggccgcgcgctcagcactcactgtcttacggtcccgaagcgctttaaggtgcgcagtccgcaggccttgcctactgatcttccagccaccccttgaaggaagcagttgcaggtattaagagctccttattgaaaaggacgatgtagaggggcggtgagggactcgcctccgcagggagggcgccctggcggtcttctcaggttctctctcattcccgcgtcagctccaccgtcaggctcgaaaccgactactcccttttgtaggcttgctttgggttgaacataaaaaccaagcccctttactatttccctgctgggaggggctgcgattgggaaattttcagaaacctgagggaaaattaaaagggagcgagctttcggtaaaaaatcaaattaaaaaggaggggcgttagagaaggaactggtaaagattgccttttaggagaggaactgggtggctggaagaatgaggtgagaaactttcccctctctatcctttcagactttaactggtttcttttgtatcttccccgccccgaaaacaatttaacttaataagaataatttttaaaggacgtaaactagacacagttacaaagtacggggtttggggcttgtggtagctaaaggtgtctttggggatgcgggcatccttttcctctcctgcctgaagagcttaactagaaagcccccctttcggtcttagacatcccctcttcctgacttgttctggctgggaccagagttcagtttaggtaggccagtgagtgacatttgatggttagaattcctacggttagaattaatcccttctgtatctcctagtatggaaataaactgcctggccactatgctgccctctttccattcctttttggtggaagtttgacaagttatttcccatagaaaataacttataggccgggcgccgtggcttaaacgcctgtaatcccagcactttgggaggctgaggcgggcggatcacgaggtcaggagttcgagaccagcctggtcaacatagtgaaaccccccctctctactaaaaatacaaaaaaattagctgggcgtggtggcgggcgcctgtaatcccagctactccggaggttgaggcaggagaattgcttgaacccgggaggcggaggttgcagtgagccaagatcgcaccattgcagtccagcgcgggcaacagtgtgactccgtctcaaaaaaagaaaaaaaaaaagaaaaagaaaaagtaccttatagatacagagagaagattaagtagctcctcttataatatgaattgagggttagaaataccgcagggaatagaactcaggctgtacctgagtttgtccctctccaaccaccctttttccatagctctctctgtatatatatatctgtcttttctcacattccttacggatcgtaatctgatggccagtcacctctgcaattatacatttaacaagagctctgggaaacagtgtctgaatctgaagtaatgatcctaatggaaggtaatttcaggttctcaggagaattggtgaggatattttggagggcagtattgaagaccattgctagcagtttctctcctatcccttccactcaacatataggctggtgatcttcagacattttttagaatgaacccataaaagaattttgaagagctatgtacctcttgttcatttttaagttgatacctaaattttccttcattaatttaaatacttatagaggatacaatttcaaattttgacatcttaaactaagacttacatcattctttttttctgagacggagtctcgctctgtcaaccaggctgagatcgtgccactgcactctagcctgggctacagagtgagactgtctcacattaaaaaaaagtatccggtggattccaagtaccctaaaaatctaatgcctaccatcatccacttaaaaatatatgaacaagctcttcaacagaaattttatatggttctctttctccttatactttgaattccattcacttcctgtaatcattagtatataacttactaaactttttttttttactaaatattactaaatactaaattttcctaaatatttttaacatttttatgacttgtgaaacctaaaaagtacaatttttattgaaaatgcatctgttaatgagaaatatggtgtttctccccaattagttcaggtattcatggattaatattacctaatggtagaaggagataaggtgcaacatcaatcctttacctgttttttatttttatagacatgagtattgagaaaccttgtttccacaattgggaaaggaagagatttgttacaatgatattctttgagtctttgaacttctaaattatatgccaacaatcacagagtgatctattaatactatcaaatagagtcttcttttaattttgttaaaagcaaaggattagaaaccactgaacttccaaaaggatttagttattagagtctcagttttggttttattaaacatgattattaattatctgtgacctttacactcagagacactttgttaatcagatattgatttccatacttctttgcctacacaatattttttggtaaaattctttaattattacatgtcttcaagaactttttgttaaactgaaatgcagattcagctcattcactgtatagaaaacaactgccatttgtggaattggcaaagccagttttcatttcaaaccaatcagccaaatcagacctactttctgttagaaacatgtctgactttattcttccattcaaataaatatgttaacattcattttgaggaatattataaaaattattaggaaataaatgattaactatagcttataaaatggaccactgataaaccagtcaagattaaaattatttagacctactattaacataataaatggtaaaaataagatagtactgtttttcattatataattaggaataatgctgtataatgtatagttaaatccatcagttttgagaagtcatatagaaggcatatattcccttggtaaatgtgtgtgcctgctttcatcaaactcttgttgttcagcttttgggaacaattaaatgagaatcatgtctaaaaatcagaaataactaataatcttgttacacaaatttttttcttctgtattttttagaaaggaaagctgtatttgctaagaaataatgaattgagcagctagcaatttcactttttactaggaggtagaaaataataaacattttatataagataaaataggaagactgattgcaatgggaatattttgatatgaagtggaaaataattgctccctccaagctcctcaggtttttacaccctggaccatgcatcaagattcagtgtaggggagagacattcctttcttttgtaaagtaggacaaggactatggtgaaagtgggggcagtggtagagtggagaatgtgcatgaatatgtcagctggctcccaaatggattggtttttagaatttttttttttttttttttttgagacggagcctcgctctgtcacccaggctggagtgcaatggcatgatctcagctcactgtaacctctgcctcccgggttcaagcgattctcctgcctcagcctcctgagtagctgggattataggcgcgtgccaccacgcccggctaatttttgtatttttagtagagatggggtttcaccttgttggtcatgctggtctcaaactcctgaccttgtgatctgcctgtcttggcctcccaaagtgcggggattacaagcatgagccactgtgcctggccgttttttttgtttttgtttttgttttttgagatgaagttttgctcctgttgcccaggctggagtgcagtggcacgacctcggctcactgccacctccgcctcctgggttcaagcgattctcatgcctcagcctgccaagtagctgggattacaggtgcctgccaccacgcccggctgtttgtttttttttttttctgagatggagtcttgctctgttacccaggctggagtgcagtggcccaattcagctccctgcaacctccccttcctgggttcaagagattctcctgcctcagcctcccaggtagctataattacaggtgtgcactgccacacccggttaatttttgtatttttagtagaaatggggtttcactatgttggccaggctggtctcaaactcttacctcaggcgatccgcccgctacagcctcccaaagtgctgggattacaggtgtgagccagtgcacccggcctggttttagaaaatattttatagggaagttgaggatctggaaatttattcctttaaaactctcctcagactgatttgaggctatttcctgggtattccttgcagtcttacgtaccctaggaaaaatcttcatttaccccacttggaagacttcttaatataggcatatccaaactccaatgtccctgactatccattattttgagacaccaaagcaaatgtcctacgaagtaaggaggaagacgtgttgttcttagaatagaagtgagttatgagagaagtcaaagaggatggctccaagttggtatagtgtgaaggtcatggatatggtccttggctttgcagttctagaagtgtgattttgggtcagtccacacaaaggtgttcatgttttgtcacattaaatcaaactcataggaagttaatgtacataatagaatgccagtgcattcttttatacttacagccaccaagtgaactggattatcgctcctgttgggtaaatcttatctgggaagatcaattataatcagaaagttacatgaggagtgtggatcttgagcatggctattgtcaataagctgatgagcaggtgctcactacctggcatataataggatctcagtaattatggaatgaatgtacttcatctgtatcttcattatagatgctaaagggtaagtttaagattctgataggccaccccacatgttttttgatcaggtagatttttccttgttgctcaagttatactcttaaatggctatatcatgtagatattaaatccaataaaatttcatgaaagggaattatataattgcaacagcaaagttttatctatatctctgagcctagaaattgggactgttcatttataatagagattggagattgctttctcctgccctgtaggagtagtgatggtggtagtgactaaatgatctgtatttcacaatactatttggtggctaagagtgtactgcatacaaagaatgacactgggtgaccctcagtgctggcgctttcctagaggtgggacatcctgagtagggaggtgctgaaccacctgtgggctggccagctgttgtggactgtactgtggagaggaggaacaataaatttcccccactccttagatccccctcaggagataatacttgatgctgcttttaaggacagagaaaagacaagccttttcaaattttaaaatcattagggatgagttgccaaaaaatttgggttaagttttatctggaagccagaagacattgtctcctcaaggctttttctggctctgggataagctattgagatagaggaaaagatgccgggctgaggagtttcatttagtattttaataataataaaaaagacatacaaaatccaaacatttctttttacaattcagatacatatttttccccaagtgcaaaatactctatgaactgcatcatttgctgtttattgtcgattgtataggagatgcttactaaattggcagcagtggaaggcagatataaatacaatattttgaaatttcttctgcatttaacaaaaagcctcccacatggcgatgattattctgaaacttgagttcagctcacacagaagtataaagttttcagtttgttcaaactgctacaacctgtggtgtctaaaaaagctgatgacaactgggggttctattccttctaatcatatatttccttgtacaaataatggcacaaggatagggtgtgctacttttgagacgggtcaaatgtaaaaatatccttgtgttgttcgctcccacttttattgtgcttaagaaagaaacctggagggttaacattttctgcttatgctcagttatactttgtcttggtaccccttgtttgtggctgtaatattgaggttaagcagcaaatacaaaagttcgagtgctctataacgttttctgacattttgagatatgacctcataatccattccagagtcacctcaaacatgtatatagagaacacttctcatataaaaagtttctctagggccaaagaccaggactgtgttactgaactttcagcaacaaatctgagtctccaccacctcaaactgaccaaatcttgggggctgttaaagcagtcacagctcagtgccagcctttggggatttctaggcctggagcaggcagctcagatccaggatctggtcagttttcttctgactccaagagttgtctcaggttgtaggaataggcatggcctgataatatagaaagagggaggcagagaagtaaagaggaactgccatgttgctgaggatataagtgcctttctggtgtgcattacttggtgcgtgaagccctcccatttccaggctcagagcaggtgaggttttgtactaagatgaatggaagccccacaatactgtcgccccacaccctacacgctgcagagaggcctctgggttgcttcatgaagggatcctatttataccatctttccatttccctccaatggtaaaaacctctcttctgtctgacctgtaaagacctagaatgtccctgagcgttgactcctcattcaatccagttaacccctagtttgatgtcccagggccagcctcctccatagattcagcagcagctttgcctgggttcttaaccctccaacttggaggacctaaattaaacttggtggacaatagcaggtttttacctgctcaccaagatctgccttgacatcaattaagaagcctagtggtctatgccttccgtactgtggaactcatttgcaggtctcataagccatggaataaatggttgaaggatgtgtatttgtatgtatgtatgcatggtgtgacaggaaaggaagggagaaaggagaagccagaccctgaaggcataaattaagaagcatggtcaccgtttggctttccaagagacgcaaaacggctggcagagaggaatcagaaagttatcctaggctgggcgcggtggctcatgcctgtaatcccagcactttgggagactgaggcgggtggatcacctgaggtcaagagttcaagaccagcccgggcaacatggtgaaaccccatctctactaaaaatacaaaaattagctgggcgcggtggcgcatgcctgtaatcccagctacttgggaggccgaggcagaattgcttgagcctgggaggcggaggttgcagtaggccgagatagcaccattacactccagcctgggtgacagagcgagactccatctcaaaaaaaaaaaaaaaaaaaaagaaagaaagaaagaaagttatcctagcttctggtggagaattaggatagtcagagttgattaaagcagttttcatggtgcttcctgggaagtacagagacactcatactaaatgaccatttcccttgtttggaagcagccattttgcatctttacagtggccctccttgacccagaaagacaaaggtagccagacactctacccacaaggaccatgatgttggctaatggttgtcagggaatctagctgtgtcattggctacctactgctatggccgttttggctgatgaatgctactgatgggagggcagggagtcagactcctttatttagtgttgagtctcctgggggagcagtagcctaggacagtcacctagaaatgaacctgagctgttctgtgagttaccaggagagttaaaaagaaaaaaaaaaaaaaaagaaatgaacctgaggactcagttggtagcctttgattgattgggactacagctttgggggaactagagtgagaaaacagaaaataattttataggcaacacttggattaagggcagaatgtgtgcaggctttgggcttgggcatggacttgattcttcttccatttgattctttcttccttctgaaaaacagtagttgaggaagctaagcttgaagtcaacttcaaagggaagtgaccagagccaggcaaatatctgatgccttctgtcttattcttggctcccacagctttgtctctggcctcgggaccctgagtcagcccatccccaggtggtatgtcctggtcctcttccatgtgtacaccaggggataacaggatgaagacagggaaaagatggaggttttccctacttggggtagagaatcactgaccagttccattggcctctataatcatgaggtccacactgactccatggagaggcatagggatagcaagattggtttagcaaacataggtctctctcctttctgctccatcaaatccccagaattactttcctacacatcagatgcctctgcgcaattaccctggattaccacagccaagggctctaggtggccagtggtggcatagagacagatcagatgctccagcactcaaggttcatgagattcaaaaccgattttcttccactccaaacatacactcttttctcttgggcagctataaatagggttttgctaatagaggaagaagaaacaaaaacaaaaaacaaacccagaaaacaaaaacccctccgtctagacaacatagaaagactcaaaatgattgcacttattaggtgtggacagggtgggcaggaggctcgccaagtgcacacacattccttttgctgcccacagcctgaggccagaggtaggtggctccaggctggcttcagagtggggtcctctttggtgaagcccacaagccagctggggctacaagggaaaaacaactgtagggcaaggcctaggctggcttcaggtcaataaccatgtttaaggacaacatgtagcaaggggagtagggctcccccagggagcatcacatggggctgaggaggtggctgggccagggaagacaagaaaagggattagtgtttgaagttgacttccaattgttctgtgtctagtcctttagatgatacattttttctttctgttttcttttttttggcaatgctttaaaaccttgtttctgtcctgcagagttacagtctttctctcagggagctacagcggggcattcaccatgacaatgcctgctgctcttcctcatttagccggtgtccactaactcagtgttgtgggccatttgtaaacccttatggagtagaccccaggcagacgtagggaaagaaagagaggatctgtatagacaagaaagctggccatgtgggaagtccagagctcaaaccatgtgccccagaggactggtgctggcattaagcctgtaaatcaaaggcttctttggcaggaccctgggctgttagaatcaccctagggagcagagccaggggacattttggcccctgactagcaaggcacaaccctataatggcagaagcccttctttcccctccccgtttcccaccagacccacttccttgatgggcctctagcacccttccaagctgatggggtcgggaatgtgagctggtaaaatgggcagtggaaggggctgtactgtttctttacatctcacggggactagagccagtactgaatggcttttctaggtagtgtgttagaaaagggggaacagtagagaggcaggcagagagagacaaggaaaggaaactagaaagacagaaagggagagtgcctggtttgtgtagtgatattttttttttccctccaaaaagagaggagagagttccttgtctgagggtagggggctgccggctctgagggctaaggagtctgggggcttaaaaaattgggtctctgagcctagggttactatttgtagggcctcaggaagctggaaactttggagcggagcagcttgatgaaggattttggcagcatctccttgtgtttctctgtgtacttgaagtagttctgggggtgggctagcacctcaaagaaggccttgatgagcttcttgtcctgcaaaggatggcagggagcaatgtcagcctcaccgtcgggggtgggaaagagaaacaccatgactcagcagcccttcttgatgtctactaggcatcctatactgaatatatccagagggcaactctggattcccattcccaccatctgcccttattctggaattccacaactgaatcagtggcagctccatccttctgttgcttaggccccaatccttggagccatccttgaatcctctttcttgcttacaagtatagcaaatcctattgactctaccttcaaaatatgtctgggtctgaccacttatcatcttcccaagccaccactgtctctgacttggagtactgtagtagcctcctaactggtctccatgctacctttgtccctccgtagactcttctccccacagcagccagagtgactttttgtgtttttaattagttcatctttttcctgtttgaaactcttctctggtttcttttatcactcattggcagaatgtgatctgtatcttgctttccacctccactcttgctccctctgctgagccacactggccttctggaggttcctgaacacactaaattgctcccatgctccttagcttggaatgctcctccctcatcttctaatggggagcccttttacctcatttgggtctcttctccttagaggcctttcctgaccaccctgtctacaacagtagcatggtatgtggagagcctactaggtgccaggcactgtgcattaaaactcaggtcttctggctcctaggctggtgctccttccatggcgtcagtggatttttcaaataagaagtaggggtttcagcctcttaccccactttaatcagaacagctgcactgctttatgtgttggaattccacagtacatttgatttgaaataagggttcagatgctttaaaaatgtttgaaaagtattattaaaagtatattctttgaagtctgcaagttctaggtgatttttgttgtcaaggcttttattttgatgataatataaaaatattttgctaacacttaacttttttgcagtgataatttatgaaggataattctatgactacgactatagtttccttttttttttttttttgagactgagtctaactcttgttgcccaggctggagtgcaatggcatgatatcagctcactgcaacctctgcctccccggtccaagcaattctcctgcctcagggtcccgagtagctgggattgcaggcgcccgccaccacacccagctaattttttgtatttttttagtaaagacggggtttcactatgttggccaggctggtctggaactcctgacctcaggcgatccacccgcctcagccccccaaagtgctgggattacaggcatgatccaccatgcgcagccagactatagtttcttaaggaagattttcttaaattgggattcaccgacccagggcatctagtccattcttccatgttggaagtatttattttccttgaaaagaagtctgtacataaattgattctgagaaagctgtgctagatctgccgctgctttttttgtttttgtttttttgagacagggttcactcttgtcacccaggctggagtgcgatggcgccatctcggctcactgcaacctgcgcctcctgagttcaagcaattctcctgcctcagcctcctgagtagctgggattacaggcgcctgccaccgcacccggataattttgtatttttacaaaattaagacgaggtttcaccatgttggccaggctggtctcaaactcctgacctcatgtgatccacccgcctcggcctcccaaagtgctgggatgacaggcgtgaaccaccacacgcagcctatctgctgctgcttaatgaggcctggggagagaataggggaaggaagggacttatgcaaaagtatctttctatacttcactttccctatgtctcttggaagaggtagggacatttcttctcctcactttccctttctcttccaagttttccccaaggtgtaatatagtgtgggtgacgctgcagtcggataggcttgggctcaaatcccagcttcccatggggcaggttctttaactctctataccccagttttcccatctgtaaagaagcaatggagaaagcacctacctcatagagctattgtgtctatcaagtgagaatattcatgtaagcacttagcctattgcctatatattgttacatgcttattaaatgttagctatcattattgttaatattcattcacctttaaaatctcctggtggttttcagaggcatagagccggccatctcgcacaatgtcttctaccagctgctcatagtcctctgcaaagtcaaccaaggtgaggggctcaggggcgggagctcttcctgctctcctggttccctctcaaaactgacatacctccccttctcacccacctccttggcttaccatcataggtaacatagggaatctggaagccacgggcgctgttggcctcgcttgtcttgaagttgatccagagcttcctggaacgggcagtgaaggcaatgggacgctcgtaggtctggcaggtcagtagagcagcagggcaggctacccaagccctcctagaacgtgggctgtacagctggtggtgggggtatagggcaagagaatcattctgacaaaggctcccccttcgcatacacacaccctaccccacaccctctcccattgcccactgggctcattccacaattcctccttgatacctgggcactcacatagtgtaataaatatgacatttaaatgaatggaatggcaaaaatgctaggataggaaagtgatacatgtaacgccattggagttctagccccactgctagctttcttaactctgttttctaccaaacatgtgtcattgctgttttcctttgttagcttctctcttcctaaaggcctctcactatttcaccctcatagatccctaacttcactgccccatttcttcctgtatcagtctctctctttgttctccgccttaaccagatttggactgcccttccctggcccagctctgcaagccacccacagttctttctcatgacgaggacgtccccacactcatcctcagatggcaggaagatctctggtaccacgataaggatcttgcgcttgggtggggggttgatgttccagatgcactccacaccagctgggtagttgcccgggtagttgggggactcaatatagccagtgaactcacccagctccccaccacactgacgatctgcagccaaaccccagtggataaaacaagacagagaagggaagtcagtggggaagtgtgctgggggaattgaagagttctgaagtagaggtcagacatttatgggaagtctgcgttctagttcatcattattttccaagctctgagtccatcttccttcctgcccttttagtaccttctcttctcacttcacctgtctctgcttcctcattaactgtctccagggagagggtgttacagggtccagcctagcaactggccttgagattgagtgagttggggagaggtggaaggtggagttttcctgctcctccaccccccagccctgctccctgttggtttcacacccctcctttagatgtccactgctcccaggcctctctcctcccttttgcacagcctggcttgccacgtactcttgcattgggccacactggtagagccatcaaagtctgtgcttgtgtttcctggacagcggctgcagaagttctgacggaagtcgggctgataggagcccatggcacagcgaatacagcggtggatgctggtgttgtagtagtgccctggggagcactggactgtaggcaagggagaagggcaggaatcaagatggtaggcaggtgggagttacggggcatgggatggacaggatacattcatcctggagaatcaggagatcagatacatcaaagttcttttctagggtctcaatctttcccagtcatgccagaatttaagcccacggaaaaacagagtttacagagtggttggctacagtgccaatccttttctttcagacgctgagcacagtgccaaacctatatagaaactcatttgggatatggaggagaatatgccaccagttctccaaagtggagaggtgaagccatgcctccctttccctcacctgtgtaaactgggtatgaagacagaggacaccaggaaagaagccagagaaagaggaacagtgatgaaggtaaggatggagattggtcacattggtcggataggtaactgggggttgcagctggttgcaatgagcagccagggaatgtaggaacctgggaagtggctctgggtgcaggcagagctatggccatggtgctgaggttggaggggcagggtggggaaaggcagctgagcctcacctccttgtggagcagggaccatttctgtggacaggccacagccctgtccttcctcccctcccccctgtgcctgggcttgctgccatattccctagcctttctcctattttggcttaacaaaacaaagtctgacaacttggcggggagggatctggggagagctgccaggccacaccctagatggtgggggtggggggcagggagaacagtaggctctcacccccaaatcaccacccctaggttctagagccaagctcaccctggagcccccaattcaacaccttgattccatctctatgctagctactgccctcccaagtccatggcccttctcagtttgccttggcccaggaggcatcacgtagattggttgtcaaatggagcagctagaatctgggctcctgagggcttcatctgcccctctcttcccatcctctctgctgagatcctgcaaccttctcttccccttctggccagggcagagaggcccagatccagctggctcttgcccaagagatgcacctgttggaagagctaaggtgtactttcctgtgctttgctcctgtctctaccctgtcttttgctgttctcttgacttctccccatccctgtcttcctgctcttgccacattctacatgccatccttctgtctgctcccttactatctaaccttgtggctttgctactctagccaagctctttcctccaattctcagtggggaagctaaggcccagagcatggacaactttctcaaaattcccctaagagccaaaggtagtattgagactttgaaccctaaccctaggtaatctttgtcccttgaccctctctatacctaatcattctcttgtccctctggttggttctccccaaaacacttatagggaaatgagatgtggtgacaatcaggggcctagaaaagtcaaaggcagccaaagaactcagaagcttatgtgcatgtcctgtaggcaactcactgtcctggtctaagtgccacagcttcccttcccaaaggagtttcataagaggccctcaagggtgactgggcagatatgaggcccttccctggaagctaaaatggtaggagaggtgaccagggctgggattaagggcccagcagatatcagggtttggaggccagggttgggtgtagaaacctatagcctgggtccaatgatgggttatgactaggtttggaggcagctctgcagtaaggaggctcttctcagccaataggacttaagagaattcatctatttggtcaattggtgggtgaggaccagcccagcctgcttttctgggcatcattccttttgtttctcttcctttcctggtcctttatgcttctagtgcctgttttctgttgtggctacagggtgaagtaatttgggagaaggccctgggttcaaatttcaaatccttttctgctatgagcttcagattttctgcttggggaagagtctgacttggtcccagtaattttccaaaatgacagagaccaaagttgagttcagttccttagagattctcttatctctgatccagctcctgggacaaaggagatcagtgaggagagggtgagactggagattgcaggaagaactgggagaaaacaagcctgtaagggtcagaggcttcctggggcatagggatgcactgtcgtcatcatcaaaaacattcttcccattactgagctcctaccatgtgctaaggattgtacagggctcttttcatatgttgtcttgtggtgatccgcacagcagccttcaagtgggttattaccaccccattctattttattgttattttttgagataagattgctcgatctggagcgcagtgacacaatcacagctaactgcagcctcgacttcctaggctcaagccaaggaagagctcccaagtagctggggactacaggtatgcaccatcatgactgactaatttttattattattattttttgtagaaacagggtctcactatgttgcccaggcctgtcttgaactcctgggctctagcagtccctctgcctcggcctcccaaagtgctgggattacaggtgtgagctaccacacctggtcccacccccattttagagaggagaaagatgagatttccagagattggctgatttgcccaagacccaaggctagtaagcagcagaaccaagatatctgtgtggagccaaatcagcttcctaccatgcctcaccactggctaaacccactattcccatctcctggcccttgccctaggagcatttcgtagcagcttttcctctaatgtttttcatccagcaggatttttcatcctaagtggccagtctcaaaggggaggctgaccttattctcttgtgaatgtagctcttcttgatcactctctcctccttccctgggaaataggaaatgctgaaaagatctctttctccacaagacatccctccaccaaatcccctctcctttgcttacccagacagttgtgtccgtcatgtgccaggtggaatccatcatagcaggtacaccggtaattgccagggatgttgacacagtcatgcacacaacctgcattatcctctcgctcgcactcatccacgtctgtgggcaaagggaagctgagacagctgaacccacctgcgaacccactgtccacccccagactcagccttatggttgtgtttacatagttatgttcatggcctataagccatttagcatttttctgttttcatttaaacctaagtcatgaacattttcaggtctccatccagtctttctaattaccattgtacatggttgcagaatattatttttctatttttttctctattgttagagatttagatttctttaatttattttaccatcatagataatgcatcaaagaacatcttctcccatgtattattttgttactttgaataagtccccaagagtaaaattcctggatcaaaggaaataccttttaagattcctggtaggtattacaaaattacttttcaatttataatgcaactaggaattaacaagtgtaccctgtccactaaagtctcaccaacactgaagctcataaatttaatatctcaaggctactttaatttgcattgatttaattatgaggggaagatgtgtttacattatgaacttcctctgaagcacactttctgttcccatccattgtggatgtggtgtaagggtctaaagataaaggttccaatgtcagggaacctcaggtcttagtcttatgattttcatgctcccaccccagccaggttgtgggctgtgaactgtccccaccagggcctctgctagcctgcatggtgcctttgtgcaaattagaaaatggcaccctctctgggaagatgcagttgcccccctcaccacccccccaccacttgaccagtggaatttctagccttgatgtgatggagagtggccaactgagggcagtggcactggtttgccttcttccacaggtccctctcctccaggtgcccttccagcctcacctttgcagtgtttgccgtcccctgtgtagccagacttgcagatgcacttgtatgacctcggggtgttctggcagatagcatcgatgtggcagttgtcagtcccctccacacactcatccacatctggcaggggcagagggggcacatgagaacctctgttggcacctcttaaggggtgtcttgaaggtgggcttccaagggcagaatcccctcttctctaaaacagaggcagtgaccccctccagaaacaggtgctgtctcacatctctctgatttcagagtaggcagacactgattttgggaattcagaaggaacccccactgccctcaaaaatactaaattcacagtgacagctaaaactccatcattcgaaacactcctttttttatttgaaaacaaacaaaaaacccttagagtgggtagtacacttaacttgattaggaataatcaacttaaagtgaatgagtttacggagaaggcttagagggaaagttaagggaaaaggcatgggaacagtggtctctgggaaggtggcagggtccagcaatcactagtaaaggaggaagaaagggggatggggcatctgagggatcttcatctgtgtcatgattctgcttgagaccaggcctgcttccacttgcccaccatggagccaagaagctttagaggaaaaatgttccatcctggatgattttcctcggcccctgtgctgccaacaatggagacatccagagctggcagaggttggcaccagctacctgaagcctaataagtgcagcccttcaggccctaatccccagtgtttagccctctgtctcctggccctagctctaacaataggtgctacacacacagctatacttgaaggaagaggccactcaccatctagcaaaaaagaggatggttaggaaaggacatagatgatgccaggcgcggtggctcatgcctgtaatcccagcactttgggaggccaaggcaggtggatcatgaggtcaggagttcgagaccagcctgaccttgatgaaaccccatctctactaaaaatacaaaaattagccaggtgtggtgatgtgtgcctgtaatcccagctactcaggaggctgtggcaggagaatcgcttgaaccagggaggcggaggttgcagtgagctgagatcgcgctaatgcactccagcctgggcgacagtgagactctatctcaaaaaaaaaaaaaaaaaaaaaaggacatagaaaagagtccaacttctgaggcaatattatggtgcccttaaatctgaactgaaatagagaaacatgttattcagttgaaaacgccttattgagtgtgtttgtgaaagacactataatgatagctgtggaggctcaaaggtgactcagcccagccaaaaggagaaacaaaaaacatggagcagaatgtggtacatgccctgaagacatgagagataaggtgagggggtcctccaccctgcacatcagagtcaactctcctaggagatgtccaagccacaaccccagagattctggtcagatagcctggactggtgccgggccatcagtatttttctaaagctcttccagttattctaatgtgtagtcaaggttgagaacctgtgttacggggcagatcagaggagaaagagattacttccagctggaaactgggaaacccaaaatagtgtcttaagtagcagcctgcaagtgagtgatcactgaatgggaggcattactctcctgtgatcccacaactgagcacagaaaggagatgagatttgacaccaagacaatttgatatccaagtgtgatctatgggccatagaattgcctaggttttattaaaatgcagattctcaggactcattatagcctttttgaatccaaatccttaagtgattatttttactgagtgaatggatgcatggaccagtattctctccaatttatagatacccagagtcctagcttgagacagttatctgtcctccgcttttatactctgaaacttcctggggctaagaagagaactgaaatccccaaacaccctgcctcaaatctcacaggtttccgttcagctcttcattctacccttcaactcctatgcagccaaccatcataccagttgattctaagtgctgggagcctctgtctacacttactctccacctcgctcaggctccataggcatggtgtctacctgctggcccatcctgggaagtcatcccaacgtgacagaatggaaaagagagggcatggaagactagttcataggtaagggcaagagggacctcgcagatggtaaggtgctctgtggagaatcagtttgtccaactgataaacagaaaacagtacaaagaaatgtgctatcacagaacgatcttaagcactggaaccagtcagtcccagattcaaatccagctctacccttctctagggatggttttcttattctccatctcctcccccttaaaatggggatgataatacctcctcatgagaggctgtgagtagctgatgggataatttgtgtaaattggctaataaagtatctggtaaacagtagggtcccaatacaggaagcttgagatggtattaaatcactggtcaggcaatagatgctcgagacagtatgacagccactagccacatgtggttatttaatttaaaattcacttcctcagttgcactagccacaggccaaatgcgcaatagccacatgtggctagtggctaccatggcggaaagcatagatatggaacatttccaacaccacagaaatagcactgctattagcacaccacaggatagcactgctctggggttctgaataagagatactccctgggtccagcagcacggatactggtctggaactgctcccctgaccatatcagaggtatgtgcctgtgactgaatcagctggtgcttcactagagactgtgtcagactatatgggctcccaattctttcctttgcctcccattcagtgctcaccagtactagagtggatcttgatgctgatcaccacaaacccaggcctcccagcagattcttttttttttttttttttttttttttgagatgaagtctcggtctgtcacccaggctggagtacagtagtggtgtgatctcggctcactgcaacctctgcctcccaggttcaagctattcttctgcctcagcctcctgagtatctgggattacaggcatgtgccaccacacttggctaatttttgtattattaatagagacatggttttgccacattggccaggctggtctcgaactcctgacctcaagtgatctgcccgccttagcctcccaaagtgctgggattacaggcgcgagccactacacctggccacagattttttagacccctcctacagccagacttctcccaccatctaactaacccctctcccttacctccctgctcacaatgcttatccctctccagcaaagagtctctgctctggaagacattatctcttcctgttccctctacaatacctaaccatcctattcctttctatgcatttgcgtattttcgttattcacattgcagatgcattcctcatttttctcttccagccacactatgctcagctttccattccagctcaaatttttcttcccaaaagctcttccttgtaagccccgttcctggtgagttcctggtccaaggggactgttctcctcagttcatttacagccgtcactgaattgctctgctaatactttaaagcgtgttcagctttcctcacctggctgggtacctgctgaggaagatgtcccttcaatgtttggttggagtcttttgaagcagaacagacctaagacaaagctgtgaaagagggccccaaattatacccagtatctcctccttttaccactcattcttccagagttctctcctaccatatgtgcccacccagaatttgtccttgcaaggacccttcaacgctcacagcacagtctcatcttagcctgttctctcaggatgcaggtgcttactagctggaaaaccagttgatgctactgggtgtggactggtttaaaccagcggttctcaaccctggggctacacactggaattccctgggggttttgaaaaaaatgtgaatgtacagatgtcccctagaccagctgaatcaggatctccagggtgaggctgtggctactatctgtcttcctttcccaaggtaatgccaataaactatttgcccaagctgggaagagaccagggcagccacatgacagagtagttaagagagaggttctggagcaacattgtcagttcaattgctagctctacctgtgtctgtgtggtcctgggccagcctctgaacttacctgttccctcctctgtatgtgggaataatattcatcatagtacctccccatggggcttccaggaacatcagttgaattaatacccatcaagtacttaacaccacagtgtgggcatatagaaagtgctcaacaaaggtttgctatttttttctttctttttgaaacagagacagggtcttgctctgcttatccaggcaggaatgcaatggcatgaacatagctcactgcaacctcgaaatcctgggctcaagtgatcctcccacctcagcctactgagtaactgggactatatgcgcgtggcatcatgctcagccaattttttaaaatttttagaggcagggtcttgctatgttgcccaagctggtctcgaactcctggatttgaacgaccctctcatgtcagcctcccaaagtgctggtattacaggtgtgagtcgccatgcctagccaaggtttgctactattattccttctctccaaccttctccctgtattctttctgaactccctttccctatcaaagccccatttcaggcctggtgtggggaaatgcagcaccaggtgagcatgtgttggtggggaggatttggggagacacatccccactgcttactctacctgtgctgggaactgcacaaagaatgggggtgaagtgggtgagaggccagttgggaacccaaaagctgtcctctacaattctttttgaaggctagggagatcccactcctacttcaggccatgcattggaaccaaagttgaggtgggggagagtggtggctgcacagataccatagacaagccaagacctccctgcctcgccctgtcctggcatgaaggcacaggtctgtaactacagcagcttttcccagtaccatctgacatttcttctgaatttgctttagcgcctagcagagcactccataaactctcctaaagtaggtaggaagggtaggatggggtatgggatatgagggtcagagggtcagaccagaaagggtggattattataaaacaagtagtcctaagattctgaggatgggcaggtgtaccctaaaagggaagcagtgggattcccaagtaaatacttcatctacttcacaagtttgcccaagcccagctcaggaacagtaacaaatggaaatgagcagggatgccggctgtggacaagcagaccccctaggtagagtccaccccaccttcccattaccacaggaattattaccttaccacccataggggagggggtaattgtgggcaaatttgatgggcccagtgggacagtcagaaacagcctgcctagagccctaatgtacccacccacatagctgtgacatcctcagcccagccaggctagcccaggatatatggtgtgtgtagcgcactctgctattttcctctccttgaatgtccttgaggacccagttcaggtgcctctgctgggacactccctgtgacactaccagccttctctgatctactctttctcttgactcctaagacttactgtcaggctctctggtcacctgatcaatcccaggcttgtgatacctcatatgctaccttgtaccattatttaacttttagttcatgtgtataattttcctactgaagcagtaggagcttgaggccatggctcctaaagctttgaaacccatgcagcaactgaaatagagctcagcattcattcattcactcactcactcaatagttattgagcacctccaacatgcgaagcaccgtgctaggtgctggggatttggcagtgaaccagagatgaattctacattgaagccacttagtaaatatttgttaaacagatagacgagtggatggagacatggatgcattagtagtgagtggataatgtctctatctgtggcatcccttctgctctatgttacctcagagaaaaatctcacttctttactctccgtgatcccacaactgttctggatgggggaagtcccaggaagtttagtctcaagtggagagtagggagagaggaaactaaattcagaggggtagtacccacttaaaggcatccatatgatgagtgctggggccagaagagactggaaccaatgagtcatagggtctcagggtcttcagacatcatatggggctgctacagggatcttttcagagcatccccttcaacagatgttcctcagcctccatgctaactctcaatgatggggcacctgacacaggcattccactgcttgcccctggtgatttccctcattctcacctctaagtaacatccaaaataaaaccagcccagccttgggccatgatatcctaacccacagcatgtgcacatgtacccacatctgcatatctgctctacctccagatcaaaatagcaaccagggagattggcagagcctggagtaccaggctgtcttcccagtttgggactggctgaggcactgtgacttcagtgagagtctgggcccatcctcagtctagaaaaagcttatgcaaggatgagggtagcctagagaaagtccagaaaaccacacaaatgaccacctgttgattccaaggcggagacagagcactttctccttttaaaaacagtatcctctcctctcactcaagcttagcctgctcaactgaacagccaggaaaagctgctggtgtttggtgatttgaagggaagggggtctgaacctcagaagcttgtcacttactggggaccctgatgagtttctctctgttgtcctgccttatccctaatctagctccctgatcatttgaatgtaaccctaattggacaagaattttctccctttcagtatggacaaaatcaacaaccatgaatcagagacttttagaggatgggtagtgaagtgggggaagaacagaacattgtagagtgaggggcagagaggcaggcagtgggcatgggtaggttctggttttgtgattagtaatattatctctttaattgaaaaaaataaactcatttcagattcgtataatttcactaagtgtacagttttttcatgcaggttggttcacgtggtcttcaaactgtcctctctcatctggggcccagtgaggatacctcaggaaagagcaagtagctagtgtaaagccaggatccaggtcttcaaactcccagtccagtgctctctaactacccactgtgttctctaagcacttgagggaggaatccatgccttagtcattattgtacctcccccaactccacctcagcacttagttcagcatgaagcatgcatccagtatataaccgtggagcggaaggagctgaaatgtacatgatccagggaggaaatcagcagtgggaatgcagatgctctgaggctttgggcatgggagcagcagaagagagcaaggctgagtagtgggcagggagggtacagacacagttgcaataaggaaagggtgggcaatgcaacagtgggcaggtgttgcctgcccttggattcactatgctggggccaagcagctggttagaaacaaaaacaaacaccagggatacaggttcctgctgttaacagcttcaaaccgccagaggaaaactccaaataaatataattagaaacttgtaaaaacgtcctctctgtaaacctgctccccagggtctacccttcaagcactccccttccccagccctccccccaatgcccacatatcctgatactccccactttcagagggattccttagatgtgtttccttatcctggatcttccctccagccctgcagcccctgcccaggtctttcctcagcttgttaccaccagtgaccagacctgaagagcccctggtgtaggctcagaaatccaaaccccacagctctctagggctatggttataaccacagggaaaaccagaggtaagagcaaggaccactgtgccctatataggggtcatcatcccatttgttcagccaaagcacagcatctaacagcaactacaaagcagtgcttgatctgcagggggacatgtctaggctagggcagaatacagacagctagtctcagagctagaaacacggaatcctggggcccagatccaagaatattcagttcccataacacggatatttcagctccacttcccaactttgttggatacacacatatagaaacacacatgtgttcttcaggggctatttccagggataaatacccacttcatggacacagtaagaactatcagctacttggggttccaggaaactggggtgggggaagaaaggaagagtatccagatgacctagcctcaggcaggcagaagtggaccagcatccaaggaggagagcgcctgagatttgggtgagtaacctgtggaggcccggcgccttctgccttcagcaggaaggatttcagtgagatgtgcagaatctcagggctgcagggaaccctactgatattttacaagtgagaagagggatttcagtgatttcctccgaggctcaaatccttaggctctgcatttgtctaaacccactggcaccatatacctctatatccccggtgccacttgaggctggcattgggtgggcataggaacaggagagtagccagtccaatgttaagtggccagtgggggaggggagtctctgtcccctcttagcccaggtgactagctcctgtaccccctagacatccctgggttggccgttgtttcgcttctatacccaaggcccagcagtccttctgtttccagactccagtcttctgagcctgaagaagctgtccccaggtctgggcctcttgcaggcactgccagcctcagagcagctctgcagtttccagccctgacagggactctttcttataagtggtcatgtgctagggatacgggatgtcaaaggaggcccacaccctgacatttggggaccagagctgggggaaaggactgagtgagttcaggcagcaagctcttccagctccatcttctcaaaaggtctgaagcccttcgttcccttcccctgtcctcagttcaaggcactggaccaagccattccacttctttacttctccaactaaaacaaaatgcatattgccccacttcctttttcctctcaccagagcacttcacacacacacacaccctgagtcatgcacacacattcacacgtgtgtgaatgcacacttcacattcccaaactcacacccagggccggctcctcttacaacaggtcccagctgctcacatctcaaaccggttctcatgctctcagattcctgaaggtttcaaaaaacaatctcatttgagggctgctgatgactgtcttctttctctgcctgcagtaattctggccttagtgtcttctagtcccctttctcttattccaccctgcagagactcaaagagatgagaaggaaggggttgaaaacagggaaaagtctctgtactctcccaccccgaggctttccccacctctgagacatgtcatgagagaagagaggtcaaagggattcctgaggaatttctaagcagtccaccctcttctccaccttctggaaaaatgggggtgggcttagagggaactgactaaagatcaggctctgagtggggactctccctctctccagtgtggcctggacagggcacaggcaatagccggctgcccacggggccacccttacccgctgacatggttatggttttcatttcatattttggagggaggggctagtaggaacagtcccctcactgtaagagctggccacaggagcccagggaagcggggaggaaaggaaacagccacattaaagaggaagagaagggtgggagaaagaaagagacacatacacccagacagagacccggagagacacaccgagacagagagacactgtttgccaccacatgaacgctctcagtcccagggatggggttacttggaaattctaaatgcatgactttatcaaaactctatccctaacaaggagagaaaactaccaggtaaactaaacggccaggctggctctcctggagccagccctggggacaagtttccctggaggccgagagaccttttcattcagctgtaacctgagccctatgcgaggattaggtctttttaaccactgctgcacacacccccccccccgccgcgcctcccccccgccccccccccccccgccaaacacccacccccttaccaaaagcaaagcaaattaatgcttttaagttaacaattatcttggttatccagtctgtctactttaaaatatacagacaagcacttgaaaaacactcaaaaccatgtcccctcatgctccctcccttcccagtcacacaggcttacccacctactcttccatacagttctcacagacactaaaacagcagtttacccttagcaactacgtcacaagaaacacagacatccagctatgttgcctgtgggtaactgtggtgaacctctcatgtgtgcacagtcgcacactcacctttacacttagggctcccttccttgtctccccctttccccccttccacatgactttggttttcccattgtgggaatcactgatgaaaagggacagaaacccagatacccccagaggtatagtaactccgtgcaagatacttgccaagggtatttgattttaaagacctgctagtgctttatataaagcatgtggcattaaaggcacactttctggcactgctgataaccaggagatatgtttgaaggtaaggcctccctgatgctcacagactgtgtctatgggtaaggctgtaaggttgccccgcctggtcagtactagttcttcctgcagcatctgcctgcaagtttgtgtccagagacatccctgtaacccagcaaacctgctattaggcaacctctggcagatggggtttgtagatttcctgaagagaagggtcaatgaaaggcttccattctaggccaagcttagggatcagaagaaaagaaggaggataccaagctaactgcggtccagtcacaggaagggtggcctgtgaatgagataagctggggacaaaaactactctaagttccttgagggcaggggccttcactctggcagcatgttcctcagtacccagcagggagtccaatgaaagtggaagccctggagtaccatgcagggattctgactcccgttcctgaatcatgagctgatctcccatacttgagtgccttggcttgatggcacctgtcccttggaggggtctccatctgcccctgggcccccctcgaatacactgcttctcctttggtccacagcctcactaggccactacagacactggctccaacttgaaagaggcccttatcttgtctctaggttacttcatgatatctgttccttccttcagactaaactccccacctaattccatgttatgagtaagtcagcacacactacaaaagccagctttgtttatgaaaacacaaatccacagtgaggagaggggctgctcccaggttgggggtggcagtggcgatgcgctgtctggaaccaggactggaaaagaggcagtgtggggctggaaggtgtgggggcagggtccagtatttgacagctgaggatctctagtgtttcagttctgtgaaaggacaggttggagggggaagaggttagctgaagaggcagtgtttggggagaggagggcggcattgatacagcaccttcctcttcacagagcaggagcccatccaatacaacagagcagcttaagagccaaacgctcaggctctgggacacagcgacctgtgtcggacactcaggcttccccaactcccaagttcaactttccttctggcccagccatctcctcacccagctggcttcaggagcccctgggacaataggcagaatcatactctcctgggcaaaaccttgccaggaggaattttctttttgtccatataaatctcttgtcggtgaggacacgatgggggaggggtacagcaagaggtcaagggggaggagaaactgtcccgagagaactgtagtacatcagcctagtctctgcctgcacagccttgggacctgccaggcgatgagctgggggtcagggacgggggcgggaggcctccctgtctctctttaattcctagagggatctgtcagagctccccggcctggaattctactttgttattttaatgcaattctgacctggatttaaatggaattggaaacccgaggccttaataaataaatattatgataagaaatgaaagccatgcaagacgaaagagatttcaccccaaagaggcagaaacgcaacattcctgtcgggagccagtcacagaaattttcttctcttcttcagccccctaccatccggtgagagatgagttgatttttccataaaagatcctatttttcttcaacatttttccactgataaggcatcaacttagaaatgtctaactttgcatgcgggttgggggtaagggaaagaaatatacggcacggctgaaaagttttcattattccctcagtctctccaggccacagcgtaagtttctggcaatgtttgagagaagagaaaattctctctcagattttggaagacaagaagtctttcgaagatgctgggagtggatgaagtcgagcggaattctgaggcgcgtggtctcttctgcccaccgcccccaagagtttctcactcctctctgccgcccccagcttgtccggcttttcgctcggggcgcagcgcccagcggtcgggcccctggccggggagtccgggtgcacagagccgggttctgacagcagcacgctccccagcacctgccctgcccctcgggaatcgctcctaggccctgaggcccagcagccaggacagcccccaggccgcgcgcccctccttccttaccttgcgcggctttgctgtactgggcggcgcgggcgtggaccagcaggacaagcaggcagagcccgggtacgcgccccgagcccatggctggagctactggcggcccagccgccggggccggtctcgcggccaggggagggcggaagccggccggatcccagctcgcaggagggggaggggagggggcgccccgccggggccaggccgggggctgcagtcgcggggcgcggaccgcggcgccctcggcgcgaggctcccgatgctaccggctcctcctggccggacgtcggggagagcgaggcggagagtgcgacgaggcgaggggcgccaggggcgactgacggaggggaacccccgccctctccaagccggcctctgccagcggcggcggcggggctgctccgtgtaatcccacccaattcccagcttcgccgggagagagctgcagccggagagcgcgcagagcccgagcgaaggacctgagaaaggggaggggaaacgcagcgccagaaacacgccctttctgcctctctttcttcctctctcgctctttctccgtctctcaggctctttttcttcgcctttctcctcctcctcctctttctcctcctctcctcgctccttttcgttttcttcctcctccccctcctcctcctcctcctcctcctccttctccaccacctcctttttcgtgcccttttttctttcaaatggggcctcggcgcggtggccgctccccctgcgcgcccgggcgcggtggccccctccccaggctgccgggccgctgcctgcaggaatttacaatccggcgatgggggagcgggcctggtctccatggagacggcttccccgggagcagggaggtcaggcgcagaccgcgcgcaatcaatggatcaatgcaagctccgctcggctccagaccaaacagcaccgggctccgactcgtcctcgctcccctaggaaagagtcggggagcgagggtgcgtccccgcgctcgctcgcgaggacggccgtgcggcgccaggtttgaacgcacacctccacccgagacaaagagggtgcgaggtgttggggaggctggggcagacgtggacacacggacacacgggcactcgggcgtgtccaccgacacagcctgacaggggacataggacctcggaacacaccgcctccgacaccaggccgagtaacaacctctcaacttttacacctaccacacccccaacctcaagactcagtccccattcctagatgcgagtccactttgaggaccaaaaagaaagtagcctccgcctgctaaaactgccagctccagggcagactcccttgcagttaaggccttggaggtaagcctaatgaaccaccctacccgcagagacatggactcacatacagacactctcatgtggtcagcacaggggcgaaagctaccccacagaatcatgtctatgtgtataaacacagagacatagagacaggtacaagaggctcctccaaacctgcaccccgcttcaagaggtggtcctgactggtccattctgaacccttcatccttccaactgaggggaagcagaggaaagagaaaggatatttttaaaacaggggcaaaccgcagaaggagcagggtcttccaaccatggatgctgcctcttgactgttcacccactctgtatcttctttccttccattgtaagggaaagaggaaagacctcttgaaaggctatgaagactttcttggagtgtgaggctgtgttcagaatgagaccaggccaggtccagttttctacagggaagatgctgctaggacccagactagcctcacagagccctcagcgtacccaggaggaagaggcaatgaccaagatctcctcaaaggtgccgccatctaacataccatccttcagcccttggtgaagtcctgaagccagacctctgggagtctactcagggaacccactgcctcaaacaaatttgcaaataaaattattgtatttgaaataggcccacattggtgaagttaagatgtggaactaattgtatgtgtatttctatataaccacagactcaatgtttgatgtttgacatttattgtgcacttactatgtaccagggacttaaaggatgtggggattcaaagatgacatggtttctccttttaagtttatgatttggcaagagaaattcacatctaaataattggaatataaggcagaatgtggtaaatgtccaaacatggaggtgccaacataaaattctaatgagggcataaagagcacagattaattccagctggaagcaggaggacaactcagtggaggaggaaagggtttaaagctgacctcaaagaatatatagaattctcatacatggagttgggtgaagagagtgagggctttccaggtggcaggaacaacatgagcaaagacttggagaggagaatgtcttcagggaattaataattggttcaatcagagacaagtatttcagagagtgtggaggaagatctgaaaggtgggatggggctagacaatgaagagcctgtttccatcagatgctaagcgactgacagtgttgcataggctccgggaacccggcaactttacagcaaagtagcagcatggcgggctcacttcatgaattagctttatgtgtgctccaggatttcttcaatgtgttgatttttagtgaatttatttcatcatgaatgcaggaagagaacagaaagaaaaacggggaaaagaggacataaaaagaagtgggctgggcatggtggctcacacctgtaatcccagcactctgggagcctgaggcaggcggatgacgaggtcaggagatcaagaccatcctgactaacacagtgaaaccccatctctactaaaaatacaaaaaattagctgggtgtggtggcggatgcctggagtcccagctactcgggaggctgaggcaggagaatggtgtgaaccccaggaggcggagcttgcagtgagccgagatttggccactgtactccagcctgggtgacagagcaagactccgtttcaaacaaacaaacaaacaaaaaagaagtgacagggagggaaataatggacagaaggaaaagagagatggagaaggaagagagagaaagagaaggaggcagccctggaggagacaaggcaaaccctgaactgttcaggggccaagcttaaggagctacttgggcttttccaggcaaacgacctctggcttcttgccctggccaaccacagaggacaatgtgaggcgagtttgtttggtgatgtgttttctgctggccctgtttgtttgtttttcatttttctggtattggacagatctggggtgaaggaagagggagacagggttgtggctggcattgatagtggtccttgggctgggctctgggctgcccagagcccccctttagtgggggcttatgggcattggagctgaacttttgatgtccctggaagggggcctttttgtaggtgcccagagccaggtggccttcccaagcctggagatggtttgccctaagctctttgtctctgtctttccccaccctggcaagaaagaattagtccttgaggcctgggctccttgcctgtgtagccaggatgtcgtgctgggctggggagcccatgggggtagcaagagcagctgcttccagattggtgctggggaacgcaggggcagtccacgagagccagccttctccccagccccgatgatgagtctggctttctctcccgtcccacagcccttggaagccaacctaacaagttctattaaagttaatgaaacacaatgattcctctgtttgcttggttacaactcattacgagttgctcttgcttgctcggcttttgcagaggagattcatttgagtagccagtgcttggcctttgtccccctaatttttactggcccattaacaagatcagacactttggctgaccaggaatatctagtacccaagtcccaacaaaacccattgggtggagtttcagatgaccttttgagtctaaattagcctaaaaacatgctgccgcccttcctccctctgttgcttccctatatccaaactcagttttatatgtaggtacaataggagtatgcagagatttcagaagttaggagatgcttttccagcctctttagaatgtatctcaacccactgatttagagaagttccctagtaagagctccagctcgatttaagggctttcctcccccatttaaatggaaataaactgaacattgttagtcacttatactttggtgtgaattagttcatattgtcactttaaggggatttgggagtctcctaaattgtatacaaacttttgtccacattatccattcttccagagagaggttttctatagctttcttcaaaatttccataaccgtccccccaccccctaccccaacacgtacacacacacacacacaaactctctctctctcaaaaggttaacaacctctgtgttagtagaagagtgggccgtaactggggcacagaagacaaactctccttccttcaccatctgcttggccagtcctgcctctaaggagggaccttcccctcctccttgagttccttatccacagacctcccattgtcaccacagctcaatcatgtgcttcccaaatcttaaaaccaacctcaagttggtggggaggagtcaaaaggagagcccttgaactctatgttgatttacatgccgaggctgtaaatgataggtttacatgctggtgtaaatactcataaactcgcagtaagtgcagggcatcacatgctttcagtgtccagatcctctgcagcccgtacaggcctggcattctcagggtcagggaggagagcgccgagttggcagcagctagcatgacaggggctgactatgactatggaggaaaagggcgtgcttggagttggtctctaaaccctcatcctctcccatacagcaggtggcttctgcacagtgataccttggcatgactccccctgctgctcagccagcctgactgttcttttgggttaaagcattgtctccagaaggtccctgttaaaatgcaaaggggcttcttgcagggtgacttgggctggttggctgactggctgtcactcaacagaaaacagagaccccagatcagggaggttaaggtttgggagaaaggttcaggtgggtcaatactatagctatatgaagttgatttaaatggctttccaggtgttctccctaattccactcttgggggctgagaatctatccttcatatggcagccagagtcgttttaaagctgggccatacaacctcaacgtgattgacgtttgttggggggccatcctatgcattgtagcacatttagcagcatccctggcctctacccactaggtgccagcagcagcactccctccccacgttgcgacagccaaaaatgtctacagacattgacacatgtcccctgggggaggggagtgaaatcataccccctatcttcacttccccctgccccactgagaatctccatcataaagtgtaagtcagcccatgttactccctggtcaaaaatcctaccatgtcttctcattgttctgagcatgaaatccgccgtttggcccagccttcaaggccttgtgtagtccagccttgcctccctctcctgccccaccttgtacccctctgctgtcatctaccatcaccctttagccacatataaccctttttgacatacctcgataaaccaagctctttcttggacagggtggaagatggagagatatgggcagatttagagtaagtttcagaggccctaatttctttggattttactgggaggccttttcttttcgcttttttgagatggagtttaactcttgtcgcccaggctggagtacaatggcgtgatctcggctcactgcaacctctgcctcctggtttcaagcaattctcctgattcagcctcctgagtagctgggattacaagcgcttgccaccatgcccggctaatttttgtattttttagtagagacagggtttcaccatgttggccgggctggtcttgaactcctgatctcagaacgtaagctccatcagagcagggaccatgtctggcttgttcactatcgtgtcctcatcatctcctgtactgcctgccacatgaacaatggccattaacaggcatggaactggagcagaaatggaatgaaccctaggggcctgggagcctggaggggtgtaggagtggggaggggattggggagacaggcggcagaggaaagcgcctgccctcgcctcctcccatcaccccctatacccctgtccctaatgaggtgcttctggcggcacctgacttttccattgcaaacaccacttgactctcggcccttcacactctcatgaggttctaaggggctgcacaggcgccgcccaccccagccatgccctgggactcaccacacaccaggaaggccgggagctgcagcaaggggacagcttaaaacagccccaccaacaccccaaagtgggtctcccagttccccgagaaggcctggatgccctgctgaagggtgagcagggccatgtgggtgacttggaggacccaattccccggccatgggaacccccagcctgggctttctttgggggtagctgagacaacgagcccccacccagagcaggagatgacgcattttttctgtggccacaagccactttgacgggtccgccccactggggagcaaccgaaacctcatcccacccaaagcggcctttgtctgcactacatatttgtcttatttggaagatttttgtgggttttcctgtctttctccagcgctcactgccctaagggggacgaaggccatggcggagctgagggaagggggtgagaggcattcttggggcgctgtgcctggtggtctgcagcacatttgggggtgggagagaaatccaccccacacaccctcggcgccccagtgatgccttggccccaggccacactctgggccttgcctgtcctctgtggactcgtgcccctcctggtcctcccagagctgtttcctctccatcttctctcagcctcctcagctcactctccaatacttctgtttattccctcatgttccatccttccagccagcttggcacctcatcatttcctacctcccccgtcatgggaccctctgctttctttctacctgtctgaattctgaagactctcccagggcttgttcccccatcttgcctcctcctgggagcctccctggactactgtagcgcttggcaggatctcctccttctgaaatgtaaaagtatgtgttttctatcctttctgtgattctaaacacaccctgcccctataccacctgcccagctaaatagaggccagaggccatggcttttgtgccttggcgtccaagccccatcctgccttgtacaaagcaattgctcaactaatatttgttggtttggggcttcttaagggctacccatgagattaccaacaaattagagaatttcagtgatggaagggacctaagagcttgaattcttgctaaggggtgtctgggttcagcttacatacctttaatgacagggatcttaccacttcctggggcaacccattcccttgcctgtaactctgaccataagaaagttcttccccacgttgagctaaaacctgctgccttctggctttccccaccctactcccaactaggtcacatcaaactattccagtcctctttcctcacgaccacccttcagatatttgagggcagcaatctcctacctctgcagtcttttcttttccagggggaaacacctgtagtcctaaccttcagtgccccaatgcccctgatgaccatggactttgggtattcccccccacccctgtgctgggcctctcccacatccctgctgaactcattcttctcacaaaatcccc

SEQ ID NO: 641 - DNA, 1646 bp, Homo Sapiens
gatatattctcggtgaaggagttagcaactgcaatttgcgctcaaacctggctgttccattaacttttataatgaacctgaaaactgagtgctggagtattattaaagctgctattttacaggtggtgggagagaggatcttgaagttgtcttcctctttctggcttatttcacttaacataacatcctccaagttcatccatattgctccaaattacagaatttccatatttttaaagaaagaatagtatttcattgtgtatatttaccacaattttctttattctttcttctattgatggatacaggttgattccatacctcggctattgtgaataatgcagcaatgactatgagagggcagatatctcttctacatattgatggcacttcttttggatttatacccagtagtgggattgagggatcatatggtagttctatttttaattttttgaagaacatccacactgttttctgtactattgccaccaacagtatgcaaagattcagattttctccccattctctctgatacttatcctgcatcttattgttagtagccattctaacgggtgtgtgcttagattccactctggttgtaatttgcatttgtctgtcgattcaggattgtatgtggtttcattttagattttagattttttttctatttttgggaagaatgtcattgatattttcatagaaattgcactgaatcgctacatcactgtgggtaatactgatattttaacaataacaatcttttttattgttcttttagtctcaaattcatctatttatttcctaatctttattttgttccttctagtaatttggagtttggtttattcttgcttttctagttatttgaagtgcatcattgggttatttatttaaaatatttctatttttttgatggaggagctcattactacacattcctctctttctacagctttgctgtataccatagattttagtatgttgtgtttctactttcatttgttttaagaaaattttaaatttttttcttaattttttcatttactcattgatgtttcaagagcatgttgtttaatttccatgtgtttttatattttctgaagttccaccggttacttatttctagttttattccattgttgtcagaaaagatacttgatataattgcaaattttttaatttgttgaaatttgttttatagcctaacttattgtctatcctgtagagtgttctatatgctgatgagaagaatgtatattctgcagcaattggatgaaatgttctataaatgtcagttaggctcatgtggtccagggcatggtttaatttcaatatttcttcattgatgtgtacattattgagagtggagtgctgatgtcctctactattattattttgaagtttatctgtccattagatctattaatgtttgctttatatattttgtgctctggtgttatgtgcacatctatttaaaattgttatatcctcctgctaaattagtccctttatttcaatattgtgactttctttgtctctttttgcagtctttgaattgaagtctatttcatctaatataagtacctataatcctgattttttttgttttacattagcatggaatatctattttccatcatatc

SEQ ID NO: 642 - DNA, 10528 bp, Homo Sapiens
acacgtagcggccaagatggcgctagcggttggagcaggggctctgctgcgacctttacggtagtgaggttagggacgatgggagagcagctttgttcctgaagtgccgtcgaggattaggatcgagtttcttcgatcgtgagggcaattattagtggcctctagccccccagatggcatcttgaggagagagaatccacgctacgagaactaacatagtggacatcgcagttgtccgtagccgatttgcgggttacggagttgttgcaagtaaagaaggggaaatccgagcgttctcgcgttggatttcctccacgtgtgaagtgggaatggtagtgatatctcgtgctatctctgtcaagggcaagaaggagaaggaatttatttgaggccctacgacgtggccctccctccgctgtctccctgaccttcctatgcatccagttgcttaagaactcttggaaagatagtaagtgaaatcttcatagaggatttttgtactttaacatatattatttgatttgagcctcgcaacatttcagtgtgacaggtacgattaaggtctttcatactatgaatgagaaaaacatagatgtaccaaggactcaccaaatttcacggagctaggaattggaagagagctaggctttgtaatcccaggtcttctgacctccaaatgtcctttcctctacagtgaatgtcaaaatgacaatgaatgtctactcctctacaatggagtacaaatcgaaagacaaggggcttataaaactgactctgaccttaagaagtagcatatgagtgatgaattattatagtcaatccttgtgcttactaagtgccacatactggtctaagcattttacatagtaattcagtccttagaacaactttatgaggtggaaacttttattatctctaattacaaaggaggcaactaaagtctaggaaagaagcaaaatagcttgcctaaagtcacacataagtaaatggtggctcacgcctgtaaacccagcactttgggaggctgaggcaagtggatcatttgaggtcaggagttcaagaccagcctggccaacatggtgaaagcccacctctactaaaaatacaaaaattagctgggcatggtggcatgtgcctgtaatcccagctactcgggaggctgagacaggagaattgcttgaaccagggaggtggaggttgcagtgagccaagatcgctctactgcattccagcgtgggcaacagagcaagactccatcttaaaaaaaaaaaaaaaaaaaaaagctaaagctgggatttaaacctgattatgttggctccagagcctatgctctagaccagtggttctaaactttaatggtcaataggaaccgcttgaggatcttgttaaaacgcaaatattggtagtatagatatcaggtaaggcctggatcctatagtcttaacaggcccccaggtgatgttgatggtgctggtcattacatactacagttcacatcttcccttttctcctaaccgtatttattttgcagtcagaaactacctttcccatgctgcctgtgactgctttatagtctcaaatgttcccaacatgctcttccttaaggattagactcaaactttttcctcaaaaagcttatcctgcccctgtctttccctctaggataagacagacatccctgcctctgctcccctaccactcagtgtacaccttgttacagagctcagaacactgaattatggccatttatttgaaaatcttcctggccgggcatggtggctcatgcctgtattcccagtactttgggaggccgaggtgggctgatcacttgaggtcaggagttcaagaccagcttggccaacatggtgaaatcccgtctatactaaagatagaaaaattagccggtcatggtgttgtgcatctgtagtcctaggtactctactcgagaggctgaggcaggagaatctcttgaacccaggaggtggaggttgcagtgagctgagattgcgcaactgcacttcagcctgggcgacagagcaagactctgtctcaaaaaaaaagaaaagaaaatcttcctgactggacaacgagctctttgaggagaggaaccaatcaggtctgtgtactgtagagcctagcatataataagaataatagctaatacttacataggactttctgtattccagatcacgttatacacattaacttgtttaatctctactataaccttacagatacacttttatccccattttatgaatgaagaaactaaggcatagagaggttaaatagctggcccaaggtaacaagcttgtaagtaacagagccatgattttaaataaaagcactttggctccaggaaatgtgtggtgaattaaatgagagccactctacactcaaccaaagaaggaaaactgagacttactatcctattagacatgattataactacctctagtctgggaaaatacacagaaatctgttcccctggccaggtgcggtggctcacgcctgtaatcccaacactttgggaggccgaggcaggcggatcatctgagatcgagagttcgagaccagcttgaccaacatggagaaaccccgtctctactaaaagtacaaaattagccaggcatggtggcacatgcccgtaatcccagctactcgggaggctgaggcaggagagtagcttgagcccaggaggcggaggttgtggtgagccgagatcgcgccattgcacagcctgggcaacgagcgaaactccatctcaaaaaaataaataaaaatttttttaaaaaagaaatctgttcccctttgctggatttactttttttcctttctgtcctggaccccatggttatttatttcaaattcagtctcaatcagtactttcaagtttattcaaccatctctgtccttccatcgaccccgaaatagtcctcaacctgtgatcagtttcccatctttcctcatgtttgatatagctgttagttaactcttagtgcataagaaaaattatcccaaactttagtgacttaaaacaagaataattttttaaatttttatacagtttttgcattttctattggaatcaagagtggcttagctgggtggttctggcttggggtctcccaagcagttgcagctatctgaaggctgactggggctggaggatcagcttccaaggtacctcactcacattggttggaaagtcagcaaggaaagaggcctcaatttctcactatgtagacctccctataaggctgcttgagcatctttgggatatagtaactggattgccccagagcaagtgatccaagagtgttacagaagctataatgttgcaatatgtatacagagagatttagatataaaatcagattttatatatgtttgtataaatgtatataaaactcacgtactctgaaggtgaatttgtacaaagcagtaaagctagaacaactggtgggaataagttgaaataatactgcgtagcgtttattacagacccattatgaaaagaacaccttgcttatcttatttaaaccttacaacattcctatgacttggtaattattgttccattttacagttgaggaaaccaagccctagagaaaactcatttgtccaaattcaaatatcaccagaagactcttcccccaaacacacaggtgttaaggaggtctggttatctgtgattccataaccattgctgtggcctaaattatctgttttactcatgaatctccaatttgggtgggacttagtggggacagttaatctctactcctcttgacatcagcaagggaaatttgaagactgaggtctggaatcttatgagggctcgttcattcataagaccagcagttgacattggctgttgtctggaatcagtcacagacccacccaggttcaaggaaaggggaaatagattttatctcttgatagaagcatagtagcatcctggaacaccagaatattactgtgctcatttttagaaatatcaactgccatagtctatcttctgtccacaacagttcatattcctcccacatgcaaatggactcattcctaccacccaaagtcttcccattttggcaacatgcttaggtttgaggtccaagatcttgtcacctaaatcaagtccagatatgggttagttttcttaggtgcagttgctttcagtgtaaagactcgggaactaaagagacaagttaccttttccccacacatccaacatacaatggtgggacaggcatggaaaaaccactgtagaccttaatcagaaaggggaataaaggaggcacgccagggccactgattcataacagctctgatgctagttccttgatcaggaatgatctctaggaatgattctctacagctcttgactctaccctcaagcctccaggttacgctctcagaagcattaatgatctctaggaatgattctctacagctcttgactaccctcaagcctttaggttccgctctcagaggcattaatgatctctaggaatgattctctacagctctcgaccctaccctcaagcctctaggttctgctttcagaggctttctttattttccataaaatatagccagtgtttgagaccaattatttatttatttatttatctatttatttatttattgagatggagtctcactctgtcgcccaggctggagtgcagtagcacgatctcggctcactgcaaccgccgccttccaggttcaagcgattctcctgcctcagcctcccaagtagttgggactacaggcgtgcgccaccatgccccactaattgttgtatttttagtagagatggggtttcaccattttggccaagctggtctcaaactcctgaccttgtgatccacccgcctcagcctcccaaagtgctgggagtccaggcgtgagccaccacaccaggccatgtcattgtatcttttttagatggatgaatattaaatttatttatttattattttttttgagatggagtctcgctcttgtcacccagactggagtgcaatggcatgatcttggctcactgcaacctccgcctcccaggttcgagcaattaaccctgcctcagcctcccaagtagctgggattacaggcacgtgccccctcatccggttaatttttgtatttttactagagatggggtttcaccatgttggccaggctggtcctgaactcctggcctcaggtgatccacccgccttggcctcccaaagtactgggattacaggcaggagccactgtgcccagccatgtcatgataccttttttagatggatgaatattaaatttaaaaaacaaaatgatccgtgtgcgtagaaggaactaaaggggaaaaagatcaatctgaaaacaaactatatagaacagcataccagcttcatactaacatgataaaagcagaggctttgggtaaccaaaaagtatgctttttaagcatgagaataattctaaaggctagctatatcttttctttcttctaaaaataatttcagttaaagaatttacatataaagttcatttatcatcacccactgtgggtgaagctctgtcaggctccggagaaacaaattactaaacatgatcaactgcccttcacatactcataatctagtgggggagacagacacatacacagataattgccatacaatatggtgttcatggtattagcaagtgtgttttttttttgttgttttttttttaattttttttagtttcactcttgtcacccaggctggagtgcaactggcgtgatcccggctcactacaacctctgcctcctgggttcaagcgattctccttcctcagcctcccgagtagctaggattacaggtgtgtgccaccacgcctagcaaatttttgtatttttagtagagatggggtttcacaatgttggccaggctggtcttccaactcctgacctcaggtgatccagccgcctctgccccgcaaagtgctgagcttacaggcgtgagccaccgcacctagctggtattagcaagttgtaagaaaagagttcctgtaatcccagcactttgggaggccgaggcgggcggatcacgaggtcaggagatggagacaatcctggctaacacggtgacaccccgtctctactaaaaatacaaaaaattagccgggtgtggtggcgggtgcctgtagtcccagctactcgggaggctgaggcaggagaatggcctgaacctgggaggcagaggttgcagtgaatggagatcttgccactgcactccagcctgggcgacagagtgagactccgtctcaaaaaaaaaaaaaagaaaagaaaagaaaagagttaaggagccattaatacttcctaggagctagtaaggaaaagtcaccaagaagacagcatgcaagtagggccttaaaagatagaagttcaacagaaaaaggaggaaaggctattaaaatccgagaaagaaatagcaatggccaactcacaggcataaacataagaattttgggaaatgcatacatttcagtttagctaggtgggggtttgggggtggcctcattaccactggttggaggtaaaagtcccaactctccacttggccttgtctgacaccatcccacctgagaagggaagggcacctctttgccaccaggtacaggtgaaattccatgttttacatgtggtgggctgacaagtgtgaggggcaagtattaggagagggccttgttactgtccattgaggatgaaagtctaagcttccccctgtgtattctctgacatgaacccagaaatggagaaaggaagttgagtggtctcattagaacctggcctttgctggtgggggtgggggttgggttgtagtttttttcccgtggtacttatctggagtagagacattatcatctaaaaatgttctgtcttgcaaagctgctgctttcctagtcctttgactagacagagcaggcttttcctagggctttaaaaaaaaaatgctgtgcccattggcatttctgggttgccagcttctccagtacccaatctgggatatataaaagaaaacccagggaactcatttctgtgtattccttgggttccagatccttaggtggtctgccttcttgtcacctttcagattcttcttacatttgttttatgtataatgttttacatatagtgtccagggtttttagctgcacctaactgaaggaatagggaaaagtaaatatactctttctataagtggtagtctgaggtcaattgatttgttacaaagctgccaaggcaatgctctgtgaaagccaccattaaaagaatgcaacagtgggcaacaaactgggagaaaaatacttgtagaacacttatcagacataagacttgtatctaagtaagaaaacaaccccattttaaaataggcaaaagacgcttcaccgaagaggatatacagatgggaataagcacaagaaaacatactgaacatgattagccataagagaaatgcaaagtaaaatgacagtgtcacagctgggtgcagagactgtctccagatgctgagacaggagacatctccagatgctgggctcacttgagcccagggtttcgaggctgtagtgtgccgtgcttgcgtctgtgaatagccactgcactccaccctgggcaatatggtgagaccccgtctcttaaatcaaataaaatcatgatacaataccactacccacctaatagaatggctgaaataaaatacattgacaacaccagctcctggtgaggatgcagagcaactggaactctcatacatgactgataggaatgcaaaatagtatggccactctagaaagcagtttggcattttcttgtaaactttcaaacagttactatatgactcagcaataacattcgtacacattttgcctagagaaatgaaaaatttcacatgaaaacatgcatgagtgtttagaacagttttgttcttattcaccaaaaactggaaataaccaaatgtctttcagtgagtgaataagtaaactgtggtacatttatacaatggaatactactgagcaataaaaaagaggtaagatacacacaagaagttgggtgaatctcaaaggcattattctgagtaaaagaagccaatatccaaaggttacatactatatgattccatttgtatgacattctccaaaaggtacaaatatcacaacagcatacagatcaatggctgccaagggtttggagttgggggagggtgatggaactgctttgtattttgattgtagtggtagttacaaaaactttgttaaaatttatagaactgccgggcacagtggctcactcctgtaatcacaacactttgagatgccgagtcgggaggatcatgaggtgaggagtttgagaccagcctggccaacgtagcgaaaccccgcctctactaaaaatacaaaaaaacagccaggcgtggtggcgggcacctgtgatcccagcaactcaggaggctgaggcaggagaatagcatgaacccgcgaggcggagcttgcagtgagccgagatcacgccactgcactccagcctgggcgacagagtgagactccgtctcaaaaaaaaaaaaaaaaaaatctataccatgaaaagtatgtgatgctgtatgtaatattttagaatttatttactgtttttatttatattgctaagagtcatccatattgtcgcatgttgctatggttcatttattttaactgttgtttctccattgtgtgaatttatccattttttcacccattctcccattgatgaacattttattgtttttgttcatgtgaacagtttgctctgaatattcttgttcatgccgcctattgaaattatgaatttctctaagtcatttgaacccaagacttagagaaattgttgggtcaacttttgtcctaaagttaaatattcatgtgttcaactttaggagaaaatgccaggccattttcaaatgttagacataatatttgatactgtgagaatgagaataagagtgtaaaagtggaagcatggagatcaatctttgggatgctcccactgcactctgctctttgtccaagagacttggccaaattccctcttttttagaagcctcacctcctcccacaccaggcacaatcagttttcctcctgtaggttcccaaggcacctgtttcatgccatactttaggtaattatcagactgtattgagataataattccttctagcaggtaggaagcttctagaaggcataggccaagattctttgtattctccatgcccaggacctagatgagcacaataaatatttcagtaaatgaacgttcttcctcaaatctatacccccactttcccagtatcagataatgaatgaaatttattctttctttaataatatagaatataattgcttgtttccatggtagttgccaatgccaaagctccttgaaggaaggaactacaccccttttttattatatccagcctttaatatagtgcttggcaaattgtagattcttgaaaagcgtattgaatatgtttaataaattgaaacttgcagcattttaagagtgtttattcacagcctgggcaacatagtgagactccatctctataaaaacattttttaaaaattagccaggtgtggtggcatgtatccatagtcctagctacttgggactgaggcaggaggattgcttcagctaaggaatttgaggttacagtgagccatgatcatgccactgcactccagcctaggtgaaaaagtgaaaacctgtctcaaagaaaaaaaaaagtgtttattctgaatgtcagttaccatggtccaatgctggagataaaatgtagaagatttagctacttataaatatgccatgatgaccgtagaacatatccatgcatgtggcttaaaaaacaaaaataaaacaattcttggatatcaaagggtgagatttcatttatattatataaagttcaaaagcagttgaaaataatctatagtgatagaggtctgaatagtaaatacctttagggagcgacctatagaacacgtgggagcctactaggatgctatcaatcttctatattttgatctgagtaggggctatatgtatagatattgcatatgtgaaagtttattaggctgtacgtaaatgatttatgtgctttatatagattgtatctcaataaaagtaaaaagcactataatggtggattcgtggcattatacatttgtcataacccatagaatggacaacaccaagagtgaaccctggtgtaaatgatgggctttcagtgactgatgctatgtcagtgtaagtttattgattgtagcaagcacaccgctttggtgcaggatgttgatagtgagggaggttgtgcatgtatggggatgggatatacacaatatccccaattttgctatgaacttaaaatttctctaaaaaatcaagttgattaattttttaaaaagtgaaaattaaaacagggcaggcatggtggctcatgtctgtaatccca

SEQ ID NO: 643 - DNA, 2882 bp, Homo Sapiens
agtggcagctcgctgggggacccaaacgctgtgctcgccgggcacatggagcgacagcctagaccgagctgccgcttcgatcactgccccctgcacccgccgtggccatcccggagccccggtggaagcaacgccgcggaaacatcatatttgaaaacaaggtggggccttcatcatatgcaaccttcatattttagggcctgcctctttctattccttgacataaaccggactcttcatgctaatcaggctggaagtgtatcataaggatgctgaagctaaaaacaatgtccaaggccaaataactgacaagaagaaggccaaggcatctagaaaccatgtcttctgattcacagttgatcatatttttctatcacctttgataaggcataaaatattattttgatgagtaaataaaaagactttggacacctgctgtttgtctaatttatggtttccttctcttttctctagttgatatgactatattaagccaagaaaaaagttagatttgacaaacggattttaacaattttatgcacagaatattttttaaagttatttttacgagtctacagttttacaagtttaatgacatgttcagagggactagaaaatttacaaataacatgatttataaaatccatgatttcccaggaatatttttgccaccacatgggggtgtagtgttcttaatatgtactttgcaggaattctgagcatctcagctgagcaagcctggggagcagcagggagaactggattttatgtgcaagtttgtcttatctgcaccaagcatgaggccaggaataggagtcgatcttaattcatcctccaagtgtctcaaatataaaattggctttgtgatattaatttgtttaaattgttcaatctcaggaaaaacttcacagtatgtatgagttacccacatacagcagcaatttcaacaaaagcagccatattagtatgtgccatgctatattctccagtccaagaaggttattagaaaattgtttaattgaggccaggcgccatgactcacgcctgtattcctagcactttgaggccgaggcgggcggatcacgaggtcaggagatcaagaccatcctggctaacactgtgaaaccccgtctctactaaaaaaatacgaaaaactagccgggtgtggtggcgggcgcctgtagtcccagctacgcaggaggctgaggcaggagaatggcgtgaagggcgcttgcagtgagcggagatgcaccactgcactccaccctgggagacagagtgagactccgtctaaaaaataattgcttaattgagaaaaagttgcttttgtcgctggaattactgtgagataattgaccgtgatgggagctgtgtcccccagatgaaagcaaatcatgggagccagggtcaatcatattaatgtctgcagtgaaaagaggtgttgtgatcatcataagacataaccataaaatacttaaagtcttaaatggccaaagcctttaaactacattataatgattacagatccaataaagtttaattaaaacaaaactactacattgaacatccataatgattagaaaggtttctaattggggacaaatttggtattgagaacacatcaaaagaatttcccacgttctttgttacatctgtttgtgctggttttctgcttctgcatctgtacagggcacatttctaaaaaactgaccagtttaaaaattactttttaagtttataatgctcattttaggtaagtcattaactctttccataatttaggtgatcatttaatgttttagggattgggaagcacagcttacttttagttaaaaaaaaaaagcaaaaaaaaaaaagcatgagctttggaatcaggcagcctggggattctaggctagaattctaggtttctcatgtactaattgtgcaatttaactgcataatctctctgtgtccatagggtcctcaaagaaaataataggaaattatggataggaaataggaataataggaaagatggaattccaaagataatgtaataaagggaggtatgataggttaggggaattaacaaggaataatgaagcactccggaacccagcagcagcagcagcagcagcagcagcagcaagaaacctttactatccctaaggattagggcaagagagaagaaatagggagttacagtctgatgagaagaggagccttggaagaagtgttgactgacaggagctacggttatggagtgaccaaccccagtcactactatggcagaaaataaataccctggtatttttcttctcttctcttctgatctcttgcaggaatcaccctttggccaaacccaattagacaaccagaaacaagtcagcaaaaaaaaaaaaaaaaactctgggtggtgcagtcaatagtggtaagccctctaggcactgaaaaaaggccagagatgagcagaggaattgttctgtgttaggggggatgaaagtagaaaaaagcaatttacgctctttgtttctttttcctcatcttttcttttctttctttcttttatgaggcagagcctagctgtgtcaccaggctggagtacagaggcgcgatctcggctcactgcaacctccacctcccgggttcaagcgattctcctccctcagccacctaagtagctgggacaacaggcacgtaccaccacacctggctaattttttgtatttttggtagagacgggtttcacagtgttagccaggattgcctcaatctcctgaccctcgtgatctgcccgcctcggcctcccaaagttctgtgtttactggcataagccacagcgcccggccctttttccttgtttctaagtggagatatgaatcaactcttgtccaacaaaa

SEQ ID NO: 644 - DNA, 3196 bp, Homo Sapiens
acgtgctggccctgtccacacagacgtcgactccagcaaaaatgtcctgactgacttcaggagagaggaattattgctacgtgcctctttcccagtgaagaaaatctctgttggctgcgagcagagaagcggcggaaggattcccgactccgggaagccaggtgtcggaaggaggaagtacgcttgaagggggtccggctggccgactctgcactcgtccgttcgtggcccaccgtggtggtcaccaaattgagggcttcctggaaggacctcctcacggtgcccatccactgggtcatgtgggtctgggccactgtgagtttatctcccaggtaatccatggggccagccaggaggagagggaagaaggaagttagggagggagagagcaattaaaacgccagtgtcctcttgcctctttggactcttttgctcatggaagttttgggcttgcttggaggaaaaaaaattaaaaacagcagctttcttcaggcaaaccaagggtaagtaaacatccctgagccaggagccggctgcatccacgggtgccgctcagaattaagaggcagctaagtgccaggctgggagtccaccccagcggagttataaagtcaacacactgggcagtccaggttccagttccagggctcacccagctgatcggccgagacaaggagctttgaggaacaagccggctgcactcactccagggcgtgacggtcccgaaaggcgggggatggggatgggggtgggggtggagggggcggcctttgggcaccctcgtcctcacttcccttcaggtaggcagcccccctgaggtgcaccctgggaggttccggtgggcaagctgccgcaccctgctgccccctgcccggctgccctcggccagaccccgctcacctgacccatgcaggttttctgtcctctggctggagattccaaacctgtcggccggcaggcggctagctcacttccggaggcagccaccagggcccccgggtcccctggctgagcagcccgggatgacatcagcccccgtcttagcgaggggcttcgctgcccaggaatgcaggaggggcctcggggaggcggaggcggtggcggcggccgcccagggagctgacgtccgcccccatttttttctcccccaagtcccaactcgctcacggtccctcggggctgatggcaacttcacgtgcctgccagcctacccacccctgtgccctcacagcaagcgcaccaggaaatgcggctgcacgtgtgtgcatgtgtgtgcactctgtgtgtgtgtgcgtgtatgtcggcgatctggcagccccgggaaggttagcactgctgggaaacggcttctgcctctaaggttacaggcagcgtcttgggacctctggtcggctgtcagtctgtctccctctcgtggtctgtttctctgttgatttctcagcctcgctctcctccctctccctgtgtctcaacttccacttgcttgtctctaagcgtctctcctctctctctccttttcagctgtctctccctccctctctggaaggcaacactgatccaggtgagacagcctctgaggtcccccaggaaggactggggagggctgtatttcagtacaggcggagttgccatggcaacccggggcacagcatctgccctgtcctgggcagcaggctcagcactgggagcaatgggaatgattcatggtttacactaggtcacgtgagctccctgggttttaacccttacagggctggagtactaggggttgggggtacgactagaccctaacacccactgtcctcggccaggccccgctcatctgacccatgcaggttttctgtcctctgcctggagatcccaaacatgtcaggggttgttagaagggggtgggcagcagctggatcctggaggtcaggcacacctgttaaaggaggtttctccttctagcagggatccatgtccccccaaccccactacttttacagacaaggaaatgcagattcagagacatagattcacttgcccaaggtcacacagcaaggatgtcaccaggcatgcaccagagctgctcccaccccaggttttcccaggtctgacatggtacctggcccagagtcagggctctgtaaatatttattgttcggacaccaagtacacaattgaaacccaggtcgctcagaatgcatcctatgtcctttccaccaccacctcacttcagttttgaacaaatatttgttttctagacactggtcaaagggcctcacttgagaaagtttatcacaaaggactctctggcaatatggccaacagatctctttcttttctatgtattcccagtccttacagctattcattctctttctctccctgtctctcttcttctttttttggatacaggatctcactctgttgcccaggctggactgcagtggcatgatcacagctcactgcagccttggcctcccaggctcaagcgatcctcccacctcagcctcctcggtagctaggactacaggtggagcaacaccgtcagtcagaaggcagcggatggcacagggcttccgcgtaaggcctgcatcgcctgagtcatggttttctcatcttgtatgaggcccacccccttcaaaaggttgtgacaaaaaaaacaactgagataatttgtgccgctggcacatagttaacactcaataaggccgggcgcagtggcttacacctctaatcccagcactttgggaggctgaggcaggtggatcacttgaggccaggagttcgataccagcctgaccaacatggtgaaaccccatctcaactaaaaatacaaaaattagccaggcatggtggtgtgcacctgtagtcccagctacttgggagcctgaggcaggagcatctcttgaacccgggaggtggaggttgcagtgagcggagatggcaccactgcactccagcctgggcgacagaacaagactctgtctcaaaacaacaacaacaacaaaataataaatggtgaccacaagggatgatcgtttttctattataattcctatcatctcactgttcaaatgaatcacaggaccctagacagtcagaatcaagacaccagcagggaccaacctaggccaaccttcccactaaactgaagaaacaggcccagaccgagggctgccctaaggcctcacagtccatctgcagcagg

SEQ ID NO: 645 - DNA, 2469 bp, Homo Sapiens
acttctctgagatgagggcggcaacaggagcaaatgcgagcagacagctggcagaagttctgcaagatgacctgggaataaagttggccaagaagcctccgaggggagatcggcgtggtggagagccccgcgtctacatgaggtgtgagatcccaacaggttgacaatggaagcagagctgagaatccggtcatcttatattaagccagatgctaaaaaggtttgaaaaaatcaatggactcaggctggtctccaactcctgaccttaggtgatccgcgtcggcctcccaaagttcttggattacaggcgtgagccaccgcacccagccaggcagactgatttcaattcttttggttatacacccagtagagagatggcgggatcacatggtagtcctctttttaatttttttgagaaaacttcatactgttttctataatggctgtactaatttacatttccattagcagtgtgccagggttcccttttccccacatcctcaccaacacttgttttcttttgtcttaataaaagccattctgacaggtgggcggtgatacctcattgtggttttgatttgcagttccttgatgattagtgatattgaacatcttttcatttacctgctggccatttgtatgtcttcctttgagaaatgtctattcctgaatagcttttgcccattttttaacagagtcttttaaaatattgagttgttttaggtcctcatgtattttagatattccttatcagatgtatggtttgcaaatacaatatttcctctcattctgtaggttgtctctttactctgttaatttttccctttgctggacaaaagcttagtttgatgcaacccattcgtctatttttactttggtcacttgtggtttttgagtcatattttaaaaatcattgcccaggccaatgttatgaagctttctcctatttccttctactagttttacagcttcagaccttatgtttaagtctttaatccattctgagttgatttttatctatgatgtgagataaaggtccaatttcatccttctgcatgtggacatccagctttctcaatatcatctatcgaagaaattgtcttttccacatgtatgttcttagtacctctgctgaaaatcaattgatgttaataaattcagtcaagttgcaggatgcaaaatcaacatacaaaaatcaataggatttctatatactaacaatgaactatcagaaaaagaaataaaacaattctacttacaatggcttcaaaaaaagtaaaatactttggaataaatttaaccaaggagatgaaagatctgtgcactgcaaactttaaaaccttgatgaaagaaattgaagacacagataaatggaaggatattctgtgttcatggattggaacaattaatattgttaaaatgtccatattaccgaaagtcatctacagattcaatgcaatatctatcaaaattctaatgtcattcttcacagaaatagaaaaaatagtcctaaaattcatatggatccaccaaaagcgctgaatacctaaggcaattgagtaaaaggaacaaagctggaggtatcacacactatctgatttcaaaatgtactgtaaagctaaagtaattaaaacagcaaggtcctggcataaaaatacacagactaatggaacagaatagagagctcagaaataaataccctgataaatttatcttcagaaagttattattttctaaagttgagtactcataatatgagagaacatgacttgactagactgagttttatctctgaaccaggaaacagtggacacatttcaagatgggtaactgtaaattatggcctctcttaaggatttctggagctggttttaatgtttcaaagaatctcaaaatgcgctaagagcagaggggcaagtgtgtaatcccagccttttgggaggctgaggtgggagaatcacctgagcccaggagttcgagaccagcctgggcaacatggcaagagcccatctctacaaaaatttaaaaaattagctgaatgtggtggtgcacacctgtagacccagctacttaaagggctgaggtgggaggatcatgtgaggctgggaggttgaggctgcagtgagtcatgattacaccactgtacttcagctttggtgacatagtgagaccctgtctcaaaaataaaacaaaaggtgtgattgttaaataaaaagactaattttctcacaatctgcgttagtttactagggataccataacaaagtactacaaactgggtagtgtaggcaacagaaatttctttcttcccagttctggaagctggaagtccaaggtgtcagcagggttgatttcttctgagggcctttttccttccttccttcctttttccctccctcccttccttccttccttccgagacagagtctcactttgtcacccaggctggagtacagtggtgcaatctcg

SEQ ID NO: 646 - DNA, 2489 bp, Homo Sapiens
acttctctgagatgagggcggcaacaggagcaaatgcgagcagacagctgggtgtgtccctttccagcagagggaagttctgcaagatgacctgggaataaagttggccaagaagcctccgaggggagatcggcgtggtggagagccccgcgtctacatgaggtgtgagatcccaacaggttgacaatggaagcagagctgagaatccggtcatcttatattaagccagatgctaaaaaggtttgaaaaaatcaatggactcaggctggtctccaactcctgaccttaggtgatccgcgtcggcctcccaaagttcttggattacaggcgtgagccaccgcacccagccaggcagactgatttcaattcttttggttatacacccagtagagagatggcgggatcacatggtagtcctctttttaatttttttgagaaaacttcatactgttttctataatggctgtactaatttacatttccattagcagtgtgccagggttcccttttccccacatcctcaccaacacttgttttcttttgtcttaataaaagccattctgacaggtgggcggtgatacctcattgtggttttgatttgcagttccttgatgattagtgatattgaacatcttttcatttacctgctggccatttgtatgtcttcctttgagaaatgtctattcctgaatagcttttgcccattttttaacagagtcttttaaaatattgagttgttttaggtcctcatgtattttagatattccttatcagatgtatggtttgcaaatacaatatttcctctcattctgtaggttgtctctttactctgttaatttttccctttgctggacaaaagcttagtttgatgcaacccattcgtctatttttactttggtcacttgtggtttttgagtcatattttaaaaatcattgcccaggccaatgttatgaagctttctcctatttccttctactagttttacagcttcagaccttatgtttaagtctttaatccattctgagttgatttttatctatgatgtgagataaaggtccaatttcatccttctgcatgtggacatccagctttctcaatatcatctatcgaagaaattgtcttttccacatgtatgttcttagtacctctgctgaaaatcaattgatgttaataaattcagtcaagttgcaggatgcaaaatcaacatacaaaaatcaataggatttctatatactaacaatgaactatcagaaaaagaaataaaacaattctacttacaatggcttcaaaaaaagtaaaatactttggaataaatttaaccaaggagatgaaagatctgtgcactgcaaactttaaaaccttgatgaaagaaattgaagacacagataaatggaaggatattctgtgttcatggattggaacaattaatattgttaaaatgtccatattaccgaaagtcatctacagattcaatgcaatatctatcaaaattctaatgtcattcttcacagaaatagaaaaaatagtcctaaaattcatatggatccaccaaaagcgctgaatacctaaggcaattgagtaaaaggaacaaagctggaggtatcacacactatctgatttcaaaatgtactgtaaagctaaagtaattaaaacagcaaggtcctggcataaaaatacacagactaatggaacagaatagagagctcagaaataaataccctgataaatttatcttcagaaagttattattttctaaagttgagtactcataatatgagagaacatgacttgactagactgagttttatctctgaaccaggaaacagtggacacatttcaagatgggtaactgtaaattatggcctctcttaaggatttctggagctggttttaatgtttcaaagaatctcaaaatgcgctaagagcagaggggcaagtgtgtaatcccagccttttgggaggctgaggtgggagaatcacctgagcccaggagttcgagaccagcctgggcaacatggcaagagcccatctctacaaaaatttaaaaaattagctgaatgtggtggtgcacacctgtagacccagctacttaaagggctgaggtgggaggatcatgtgaggctgggaggttgaggctgcagtgagtcatgattacaccactgtacttcagctttggtgacatagtgagaccctgtctcaaaaataaaacaaaaggtgtgattgttaaataaaaagactaattttctcacaatctgcgttagtttactagggataccataacaaagtactacaaactgggtagtgtaggcaacagaaatttctttcttcccagttctggaagctggaagtccaaggtgtcagcagggttgatttcttctgagggcctttttccttccttccttcctttttccctccctcccttccttccttccttccgagacagagtctcactttgtcacccaggctggagtacagtggtgcaatctcg

SEQ ID NO: 647 - DNA, 1377 bp, Homo Sapiens
ccatatattcattaatcaacttgtctcatagagtgtaatagccactctaattatttttttcaaagtgttctcagctgttcttatttgtgttttcatctataggagttctgcaataaaatgcctgctttctccaccagatggtatgtctattgggacaaaattaaatttttgaactacttgtaacaaattgatgattgagtaatattgagtttttctatcttagaacatgatgtggttttccacttttttatgctgattttctcatatttcaaaaactttttatgatctttctcatactttttacaaatttttgttagatttatgtatggctagtttattttactttgtactgttaaaaagtaaactgtagcacaatacaaattttaaaagttttattggctgggaatgatggcttatatctgtgattccagcactttgagaggccaaggtgagagattacttgagcccaggagtttgaggccagcctgggaaacatagtaagaccctatctctatgaaaaaataagaagaaattagctgggtgtagaggtccattcctgtacttgtagctactcatggggtaaggtgggaggatggcttgagctcaggatgtaaggcttcagagagctccgattctgtctatgcattccagcatgggcgacagagcaggaatctgtttcaaaaaacattttcttgagtaggaagcaactaatgaattgtggaacatgagaccaaaaaaggtttagcatttaaatgacaaagtgtcagaggtaagattgtattgaaaatatgcagaaggaaaatattaaagttatttgattagttgcagttaaaaaactgtcttttttggtttaccttatagacatatattactataccttcttgggtacttctgataaacttaagttctgttattgttgatttttaatacaggtattcacaaaaatagctcacattatgttttgcttgtttgcaagtcaacaagatgaggtcaccgaaaaggtctaactgattctgtctgctcaggaatgtttcaggcttggtctcccttttaatttacctcgtaaatcattttgtaatttttatctcctacccattctgtaacttgttaattacttttatacacatgtaatatcttttatgtgtgatttctaagtatattactagtgaacattgactgttacaaggcataccttgtcttattgcaatttattgtgcttcccaagtgttggatttcttacaaattgaggggttttggcaaccttaccttcagtgactctgtcaacaatattttttccaacaccatgtgatctgtgtgtgtgtgtgtatctttgtcagcatttttatcaataaagtacattttttattaaggtatata

SEQ ID NO: 648 - DNA, 3701 bp, Homo Sapiens
ggattctggaggaggcctcggcgcgcagctgggcgagtactaactgtttgcactctcatcagacctgcctcggtcatgggagaagttgaagactttctgcaatgcagcatcttcaagcaatacacacatggatgaaaatcctaaagtttgcatgaaggaccaataacgtgcctagaaacaggcaaagtgagggagctcctttgctagatgatcttcagagcctctcccagctgtgaccagaaatggaaagccagagaaggtaagtgacttgccaaacttatggaatcagggcactccagttggtgggctgggctgataaacagaaatgttacataaaatacttctctcctgatttaacaacaattaactttagggaattataaaacaagatggaggctgggcgtggtggctcaggcctgtaatcccagaactttggaaggccaaggcaggtggattacctgaggtgaggagttcgagaccgacctgaccaatatggagaaaccctgtctctactaaaaatacaaaaattagtcagacatggtggtgtgcgcctgtagtcccagctacttgggaggctgagacaggagaattgcttgaacccaggaggcagaggttgcagtaagccgagatcatgccactgcactccagcctgggcaacagagcaagactcaaaaaaaaaaaaaaaaggtggaaataaaatattagacaaataaaaaattttaagttattaggtagaggtagcgacatggagtgaacggcctttctcaatttcataagtaagaaagatagataattgatggaacttaggctttggtaagtatttattttaaaaatttaagggtatctctttgctagtatatataattcccaaactagtagacagggggaagggaataaagaaaacacaatcaactcaatagaaggcaagaaaagaagagaataaagaagcaaagaacaagcatggaaaataaaactcacaacgtaaagtgcaaaaattaaaggcacacgactcaacagcaaaaaagcaaaagaagaaatttataaatgggcaaaggacctgaacagatacttctcaaaagaagacataaaaatgaccagcaaaaatgctcagcatcacatatcatcagggaaatacaaattaaaagcataatgagatgtcaccttacactgttagaagggctataatcaaaaagaccaaagacaatgggtgtgggtgaaaatgtggaggaaagggaacccttgtacactgttgatgggaatgtaaattagtgcagcctttatggaaaatagaatggaagtttcccaaaactctaaaaacagaattaccatatgatccagcagtcctacttctgagtatatactgtgaaccctgaatatctgagacagttctcagttaatttagaaagtttattttgccaaggttgaagacacacactcatgacacggcctcaggaggtcctgatgacatgagcccaaggtggtcagggcacagcttggttttatacattttagggaaacatgagacataaatcaatatgtaagtgtaaggtatacactggttctgtccagaaaggcgggaaaactcaaagcagggagggggcttccaggtcactggtaggtgaaagacaaatagttacattattttgagtttctgatttgcctttccaaaggaggcaatcagatatgcacctatctcagtgagcaaagggatcactttgaatagaatgggaggcaggttgtccctgagcattttccagcatgacttttccctttagcttagtgatttgggggccccaaaatttattttcctttcacaatactcaaaggaattgaaatcactatgtcaaagagatatctgtgtttccagaaagaggtcccagtccagaccccgagagagttcttggatcttgtgaaagaaggaattcagggtgagtccatatagtaaagtaaaagcaagtgtattagtaaaataaaggaataaagaatggctactccataggcagagcggcccgagggctactggttacttgctgttatggttatttcttgattgtatgctaagcaagtggtggcttatttatgcctccccgttttagaccatttagggtaacttcctaacaggtcatggcatttggaaactgtcagggcagtggtgggagtatagcagtgagaactctcgttgccatcttggttttggtggggtttagctggcttctttacagcaaactgttttatcagtgaggtgtttatgacctgtatttggtgccgacctcctatctcatcttgtgacttagaatgcctaaccatctgggaatgcagcccagtaggtttgtttcagccttattttacccagctcctattcaagatggagttgctctgcttcaaatgcctctaacatctgtaccccataaaaatagacaattattatttgttaattaaaaataaaattaaaaagtgtatcatgaactgtgttccctgtcattaaatgtgtgccttccccactaaaaacatacgttagtgaacacagtaaatgttaacagatttaacatttaattaatttaattaattaattaattatttaatttaacatttaactgttagtctatcctaacagttaaatgttaacagatttaactgttagggtagactctcagattagaatccaattggaagtgttttgttttgttgttttaatctagctatgttgcttttcaaaggtacacctaaaacaaacttatagacaggttgaaaataaagagggaggatagaataatatatggcaggcaaccaaaagaaagttgttaatgcatataaaagttagtaaagaaacattaaaaagatgcttttaatggtaaagagaagactcattaaagatagaatactattcacctataagcaactgacaacatagtcccatattatctagcacaaaaattgacaaaatatgaggaaaaattcaaaatccataattattacagaggatttggagtacctctatcagaaaacaataaatcaagtaggccaaaaagcatatgaagaatatggaagacttaagtaatatattaagaattgtgatctctgaaaaacagtgacccctgaagaatagattgtttccaagcacatttcaaatacttacaaaaacttgaccattccctagaccacaaagaaagtttcagcaaactcagatcctatcacatagaccagattttctgacctcgtaattccagtagaaatctatgaatttattcattttctacacatacatacacgttcgaaaatcaaaacacactctaaataattcatgagtttacatacatctgagaatgggcaagacccaattatgtctgttgtcttcgtgtgattattaatagcactcttccactcactgtcaaacatgtcccagtttggttgatacgttatgtggacatcctatttaaaaggaaaattataaaacatttggaattaaatgacaagaattccctgtcaaacttctgctttactcctgaggtaataatttgagggaaaacagcctggaaaaaataaactggagtttcaactcaaagagtaggataaaaagaatcaaaagggaaatcacaggcaccaaaaaatacataaaaaggggtgacaaaagtaaagacagacactgatgaaaatgagaactattgcattagttttctgtctagctgcattcgaagctggaa

SEQ ID NO: 649 - DNA, 853 bp, Homo Sapiens
atggcttctgcagggtggactggcctccttccccctatatgtgtgtctacggctgacctgtggctttgccgaggctgggaagctgctggtagtgcccatggatgggagccactggttcaccatgtggtcggtggtggagaaactcattctcagggggcatgaggtggttgtagtcaggccagaggtgagttggcaactgggaagatcactgaattgcacagtgaagacttattcaaccttatacaccctggaggatctggaccaggagttcatggcttttgccaatgctcaatgggaagcagaagtacgaagcttattttctctattaatgagttcatccaaatgtttagaatttaatttttcacattgcaggagtttgtttaatgactgaaaattagtagaatacttaaaggagagttcttttgatgcggtgtttctggatcctttagctatgtgtggcttaattgttgccaaatatttctccctcccctctgtggtcttcaccagaggaatactttgtcattatcttgaagaaggtgcacagagccctgcttctctttcctacagccctagatatgtctcaggattttcacatgccatgacttttaaggagagagtatggaaccacatcttcttcttaaaggagcatttattttgcccatattttttcaaaaatgccttaaaagtagcctctgaagttctccaagcacctgtcatggcatatgatctctacagccacacatcaatttggttgttgtgaatggactttgttttggagtatcccaaacctgtgatgcccaatatgatcttcattggtggtatcaactgcaatcagggaaagccagtgcctatg

SEQ ID NO: 650 - DNA, 1469 bp, Homo Sapiens
gaatgaactctaatgtaagctatggatttggggtcataaatgtgtataaatgtaggtttgttgattgtaacaaatgtaccactctcttgtatgaggctgatagtcggggaggctatgtgtgtgtgtcagggggtgcagagtatagatgggaacaccctctactttgtactcaattttgctgtgaacctaaaacttctctgaaagataaattttattttgaaaaacactatgatacactaaaacttcttttgtccttatttggtaatacttagaaatataattttattaagattatatttaaaagtagagtcaaaagatatgcatgttttagtgaaatatcttctattgttattactatcatcatagttattattatttgacttagaaatcctcagtagacattatgaaattagagatcagtaatgttctagttgaaaaagacatatacttgataaaattgcttcttattcttttggcgttactgtggttaagagtcttgtgctgtaatgatctcagttaaaaatagtaaaaagaatctcttgaatattgtggtggactctgcacagttcatgcaacaagaggcatggttacctgcccatatagctttgtttgtatcagccagttgaaatgtcaacatggttccttatccactgaataatttcacaaccctcctcttaatttggttgctttggacacattctatcctggaaacaaaatctaggcttcataatacattcggaaataatagattcatgttctttttttccagctggtactggtagagtttacacatttactcctgcaccataggaacagctgcttaaaaagctgaagtgtgtatttgattccattacattggcacaatagaaagtcatgtaaaagagggagactctctcagcttctccatatttggaaaattaattcttttaagtgctttaaaaaaaatctctacaggtggtcagactctatgaacttaggaccagaaatgacctcatcaccttcagctggtctaaagttgtctttggctgctgcacacttcacaaaatcttgttaattatgattgtttttcctagttataagtccttctggatacatttttatagcatttatttttatcgcttacataactacataaaatattttcattggtgtcaaaatgtcatgttattgccaaatagattccatttcaatttctagaaattattggaaagttaatacccacattttaatggcacccttgctgtggtattaaatcatgttttattgaaattcacaagaatcaaaattacgctgcgtttatccagaataaagcactagaacagttactttttggccgtcttgcccattaatttctatgcttgcactttctctttagacaaacaatgaatgaaatttagtgtctttctagaattgaattctcatgaaagtgattgtcatatacacactcatcatctacttctcttttcagc

SEQ ID NO: 651 - DNA, 2531 bp, Homo Sapiens
aggcactgctggcatcctggccggctgcgtttgcactgcttctccaaaaccacattataggtactaaacaacattgtttagtacctataatgtgctagactcctggctgctagcgaggtaaagttaaacatagtttctattactgagctctcgtaattattgtcataacaccacttagattgtggaaatatctgtcctcacaccccttatattaaaggtgtgtgcatttagaaagcaaaacgtcttgttagcattaaaaatctgaatcgtggctgatttcttttcttttctttttttttttttcgagacagtgtctctctctgccgcccaggctggagtgcagtggcacgatctctgctcactgcaaccaccgcctcccaggttctaagcgattctcctgctccagcctccggagtagctgggattacaggcgccacaaccacgcccggctaatttttatatttttagtagagacggggttttgccatgttggcccggctggtctcgaactcttgacctcaggggatccacccacctcggcctcccaaagtgctgggtttaatggcgtgagctacagcgcccggcctgatttcatgttttatgtgaaattaacttgtttgcctgggttaacagtaattaactgataattacataatatttatcaattttttcagttaattgctgacagtgtaagaagaggagccaaatccatttcagacacagtatgcaattgtgttttaagccccaagagtagttactttaaaaaagctcacattattttaaatttcaaaatacatgccaagacagcttgtcattttctttggtaagacatctaattaagtagttaactaagaatcaaatctgtgaagtaggactaaatagtagtgggcttcctgtactagataatatacatatatggtctttatgctgaaatgtattatgtgcctactttatttttgtcttagtctgttctgcataggtaaatgtttggattatttcaccaagctgactggccagtatcaatgttaccagactactgggtaaaattattaataatgaaagctaatgttttgtggtttgcacagtcgcattgtttttgtctctgcttagacaaaattataaactggtcttttttttttttttcttttttttgccttgcttcaccacagtcacagagtgaccctctctgattagttggtgttcgataggaaaatcatagcctagttgtgaatgtcaagctatctcccaacactgtggtgtagctgtgtcaggtcagtccctggatgtcagggatgattttctcatgactattagatctggctaaaaaatgcatattaaatagtagtgtcagtgaactgaccctttagatgaatattttcccttctatttttttcagtgaccaattatagatgtttttctccataaaagttattctagcttaagaccaaaataatttagaggagttaatataattaaaatacagtagttcttatatgcaataggcagtttcagttaccaagggttaaacatgatcttgaggcaggagaatagggtctcctattgaggcagggaacctaaggccgattcatgctgacttcctagagctaaatcaaaaggaaaaccccaacttcccatacctaagtaacaaaaggacccaaagctacgccctttgcaaacccctctttttttctgcgtggcagatagaaaattgaaagtatctctgcttggtagctttctgcaaccaatcagacgtttgcgtaggagtgtaactttgtaactttgcttcagcctctaattggttgtttttcacaaccaatcagactgattgtgggctagtacttcatttacatttacataaggtgtacaccaagtaaccaatgggaaacctctagagggtatttaaaccctagaaaattctgtaaggaggcccttgagcccctatgctcagatggttcccaccctgtggcgcgtacttttgttttcagtaaatctctgcttttgttgcttcattctttccttgctttgcttgtgtgtttttccagttctttgttcaaaacaccaagaacctggacaccttccaccggtaacaatccgaaaatattaaaaagaaaattccagaaatattcataagttttaaattgcatgccaaagtagcatgatgaaatctcatgccatccagctccatcccacctgggacgtgaatcctccgtttatctagcatatccatccatgcaatagacattactctcttgttagtcacttaggagccattgcagttatcagatggactgttgcagtatcacagtgcccttattttagttctattacaatatattgttataattgttctattttattattaggtattcctcctaatctcttacggtgcctaatttatacattaagctttatcataggtatataggaattggaaaaaaatagtatatatagggtttggtattttccagggtttcaaacatccactgagggtgttggaatgtatctccaaggataaagggagtgggaggggc

SEQ ID NO: 652 - DNA, 2283 bp, Homo Sapiens
ttctcctgcctcagcctcccgagtagctgggattacaggtgtgagccatccatattatataggtatattaaaatatcacattgtaccccataaatgtatacaactctgatttgccatttaaaaatactattaatacttttcttagaaaaaagagagaaataaactttaagaattgggccagagaaaaaagtgtttttttcatcttaaaattcaagacaaaaaatatttaaaaattttaatggaatgatatagtgacaaaacctatcaaaacctctgagatacagcaaaggccgtgctaagaggaaagtccatagctttaaatgtctacatcaaaaagtctgaaagagcacaatatactaaggtcacacctcaaggaactagagaaacaagaacaaaccaaacccaaacccagcagaagaaaggaaacaacctagctcagtgcagaactaaataagattaaaaagaaaaaaagacaaatgaaacataaacctggttttttaaaggataaataacattgatggaccattagcaagattaagaaaaaaagagagaatattcaattaagcttaattagaaacaaaacaggaaatattacaactgacatcacagaaatacaaaagatcattcaaggctactatgaacacctttacacacataaacacaaaaatctagaggagataaattaattcctgcaaatgtacaaccctcctagcttaaatcgggaaaaatcagaaaccctgaacagaccaataacaagcagtgagattaaaatcgtaatttaaaaaattaacaacaaaagaagtccaagaccagacagactcacagcagaattctacccaacattaaaaggaaaattggtaccaatcctattgacactattccacacgacacggtaagagggaacctccataattcattgtatgaagccagcatcaccctaataccaaaaccagaaaaggacatagccaaaaaagaagactacagactgacctaatgaacatactggcatactcaattataatataaactaaaaaaccaaaacaattaactcatgtgaggtggcatatcctaaaatatataaaacaaaaatataaaattccaaaagaaaattaaaacatgaaatgtaaaacttattggacaccatcaagtacatcaatatattcattaaaaaactcttagaagaagaatgtagggaaaaagtaatgtagaggttacttgtagatgaaaaaggctaagaacttcccaaattttgatgcagtaataaaattcctaaccaagaatacttgattcaagattagtgtactttaaaaacagataaaaataaagacttttcaaaataaaaggtgacagtgttatgattcattatgactagcacagttctacatgaagggctacatagtagcctggcaaagtggattatttctgtaatcccacatctttagggaggccaaggcagtaagataacttgagaccaggagttcaagatcagcctgagcaacacagtaagactctgcatataaacaaacagaaatgctaaaatgagtccattatttaaaaaaaaaaaatgatgctggacagcatcataaaactatatataaatataaagctattaaatgtaaatatacacacacacatacaattctttactctcataatgatggagcataaaacctttaaagttattctatatgagaaactaaaaataagtctgcataaatctgtcgatacccaataaaaaataatagtttttaacatcaacaaaaaactggaaaacatattagtttttgcattaaattgaagttgttatgaaattaaaatatattgttttaactttaagatgttttatgtaatctccacttttcaagataattacattgtatttccagaaagtatgtgaaacaaattttaaaataatcaaagtatgtcacaacaaacttaaccaaaaattggcagggcaaggtggctcacacctgtaatccctgcattttgggaggccgaggtgggccgatcacctgaggtcgggagttcgaggccatcctggccaacatggcgaaaccccttctctactaaaagtacaaaaattaactgggtgtggtggcaggtgccggtaattccagctactcaggaggatggggcaggagaatcacttgaacccaggaggcggaggctgcagtgagccgagatcacgccattgcactccagcctgggcaataagagcaagattctgtctcaaataaataaataaataaataaacaaacaaaaataagcactaaaatgaacaa

SEQ ID NO: 653 - DNA, 4159 bp, Homo Sapiens
gttttgtcaaaggggactcttccaattccctgcctagggaatataaatctagttgccagtgccctaactgcaagtgagggaaaaagggtgggagtctcactaattagtatatggcatgtagacttgaccttgatcatcctttttcagccttactcctatcctctacaaaacatggtatcattgggtctgaaaatccctggctctatttccctagaaattaaaccagttgcctgctgggctggttggtgtacagaagaggagaaggattctgaggggtcatctccaatcccattttttttcagccccagcctgcatccctttctacagaagtaacaacaatttccagtttctgagcctttccagggttgtacagtaggtattcatttgctttttgatattttccacagcaaagcaaactttcttgctgctctgttaacttcgttaccactcacccgtctgccttctgtcttccaacattttgttgctagctcttgtctgctgttgcctcttctgttctctttatccttccaggttttataagattgtttttattccttttcagtcatttcagagaggcttcaggatggagttgtgataaacgcatgtgttcagtctacaatgtttaacagggagtgcctcttgattttttcatgtgaattactgaggagtaggtagtagactatcttgatgcccttcctcatgtccctttgactctgagttgacctgcagctgcagtgaacacttcctaaggatgctgatgtcttcccctatcaagcacttgcctcattctgcttctccgaggatttcctccagtacaccaagagcttgcccgacactcacaaggtatcctggaactgctggggactgaaaacccctcaacccatgaagaatgaggatcagtggattaatagcaactgtcccataccttggtgggactattataaggcattctggttggttcctcagaggtcccaaatgggattgaaccaaagttgcccacagtaaaaactcattcaccaactcaattttcatttcacccctctcaatttgcacactcactcacttgttctacctgggatactctccaagataaactcctgtatccaaagctttgtctcaaggtctcatttgggaggaactcaaactaagataataggtactggaagtgactacagaaagtatattatcaatggtatggaggcaacaaaaaccccattaatggtggtgagtaaggtggtgacaaaccctggcactttgaagaatttcattacccacaattgacccatggtgtacttggatgaggtaaaaatgaaaggagacgctaaccttatgcaatagtgctaactcctgaaagatatagggctgtgataatcacaggaattgaagagttgtcttgttcttgttaactcccctagaagaattgggaaaaaagaaagataggtttacaacatccaactacccattcagagcatagcaatgaaagccagaaggtctccttgggagaatctgaagagacccccatttcctgcaaccagagggcaggctgttctaaaaaaatgacattcaggggttcactgcaagaggaattgaactacagagcagactgaagacacagtccaggcaggcctctcatgcaaaagtcaaagccctagaggaaggaaatggtccttaaaaactactgggatgcaggcaggcatctggatagatgtgctagataaccttgaacccctagattccctgaacaacccaggctagcaggagtatcctgcaccctgttacttgaacagaacagcttccctttgcctagagactctacacagtcctcctctgaagcagacacctccaagattacttcaaggtctgctacttcctgccctcattgcctctattccaaaaactggaaacaagtctcagcatgccctgagcagggtagcacatttcttgctgtgagagatatgacagattgtattttctaaagaaggctgcaaccatgtctctcatcccaaatgctcttctacaatgcaatcttgtcactcctctaccaagagatgaaacctaatttcaatgcccttgaatctaagctggactttacttgctttgacctgtaatgtacagaagtgacactgtgtgattcttacagctgagtcataaaaggtgatgcagcttctgccttgttcctggggacatatgcctctgtgagattgagctactaaataacaagaccacctaccttgaggctgccatgctggaagaaagcaaagccacatgaagagcaagtaagctggttgctttagcaagatccttcatattgatagtgaatgtgcacttctgtctttctcttgtgaatgcaaaccactttttcaatagtctcacgttaagtgccaaagattgttgtttttgttgaatgcattctctttatcattcactacctggccctaggaatttgttcaatgatcctcatttctgttacaatatagtcttcagtgaccttgatcatcttcacattctatagaacatcatcctggcccattatattaatgacagaataataattgaacttggtttttaggaaggagcaagtatactggttttaaatacttcatgctgaaggaatgagagataagccctacaaagttttggaagtctgccacatcagggaatattttaggggcccaaagatccaggggtatgttgagacaccctactcaaaagaatactttacatttcctaccactaagacagaggcacagcacttggtgagctgctttgaattcctgaggcaaaaaaataacaataataaatactacccatgagaataatgctctgatctattgtatcagaagactattgactttgcgggggtctgagagagtatctgaatagccttttaaagacttaaaaaggcattggcttaggaattgcaccttgcatggctaggtcattgtcctcgaggatacagcatatttgttgaaccagtgatcactatatgcaatcactgtgctgttttcccagcatttggaatacacaggaatgataattaaaggatacaagtaggactgacttaaacacactccctttcacccattagtggaaattatgtttttaattcttacaactttaggctcttcctgattaaaagccttggtctcaaggtgtgtgtacagacggagacagtaagtgttccactgcatcaatgcagtgccatctgaggatttgggcatctccatactgacaggtcagcaggcaaaaatgggagtactatactggcagggacacctgactgattatcttgaagagtcggagttgctgctacataatgggcccagggaggaagatgtctagaacttgggggaatcactcaggccccccttagtgcttctttgtctggcgataatagcagagaagcaattgaagtagccatgtcctcacaagggcaaggtaatcaaggcccagccactcagagatgaaggtctggtcatacactgagcaagcaatgatgactagtggaagtgctagccaaggattcgggaaatctagaagaagtggaattggagagagatgatgagtatagattatagccttgggaccagctgcagcagtgaagattgtgacttgttccacatattcttctattttcagtcatttttggagattgcagccagctacaactctgaaatgtcagtaacagagcaaactaagggtgggcatgagaggatctgctgagagcaaggaatgaacatggtagtcactaatgatacactgcccatgttccccggctcacctgttagctccccggcagcttgcaaacatgtctatacacactgccatcttcctaccacgagtgccataactctctgcttctctgctgaggcccttctcagctcacagtgcgagtagcctgcaagtgctaagggcataatgcctccaaggtcaactttaatcaacgaggttcaagagtcagaagagtgaattccttctgagatacattctttctggtttctcagaggctccccagaggaagtaggccccagttgcttaggaaaaatggaacctacttattaaggcaccccctttttacttttctcctttctttctctccctttccccactccattccgtgaagttcctgggatcaccaaataaactatctgtaatcaaa

SEQ ID NO: 654 - DNA, 1273 bp, Homo Sapiens
ctttcacagaaagaaagtaacagacataattcctgttgatgaggctgggattgtttttaagaggagagataataacttcatatttttaaagtgccagtagcctaatatgtgaaacagatcagaatctgttgtgtagtaagtctgctttgttgaagaatttattatgggagtaaagataagaaggaaagagatcaccatcagaaacaagtcagccttttcatgcttttttgagcatttttggagatgattccacttctcaagttattatcatttgtgcatctcttcaatgctattgttaaatgctttagaattagaatattttgatcctttaattaaagtaagccaaacgtctaggcaaaaacagccaatcattaaactttaatagtaattcaaatatagatttctcatacagttttccatgtctgtagaaatcaaagttgtaatgttaagcagagggaaatgcgtgtgatttactaatacacttcaacgttctacttttgaaaggatactcatgtgggtggggcagagaacatagaaaaagatatgatggaaaacctgtccattttctacctgttaaccttcatcattttgtgccaggccctggaagcaaagagaggaagggaccgactgcatttatctttgaacacttgagcatcagtagtactactgagtggccaggggtcttgtctgtcaaagcaaatgataagttcactcaggccattattgactgctgaactctcttccttcccaactcttccttgaaagagaaaaaaatactttgccttcttgctctccttatcaaatgtttttgtacaaatagtgtaagcctgtttaagcaaaccaattaaaataggcactgattattttgatctgtttgtaacaaatgaatgtaagtactatttacatggtgtgcctaggaggagctgaaatcattggcactttaatccatattgtaaagatcagtatcaaaagcatagtgttcttcacctctcctcctcagcatccatctctatatacttgattaaatggaaaagtctcttttatcacctctatgtaaagttttatgggtagttatcgtcagtgtatttaaatatatcttctagtatgttttaaaggctggtcttcaatactgtggagacaaaaaataaaagagcgtatgaaaagtacgttagacttttgctggcattcaagtcatggctagtctgtgtatttaataaatgtgtgttatttatgtcgtgtttgtcaatggaaaataaagttgaatattctgaaa

SEQ ID NO: 655 - DNA, 1168 bp, Homo Sapiens
tttcccaggttttatcctaggatttttatagctttaggtaataatttgagattttaatccattttagtttatttctttatagggtgagagatatgggtccagtttcattcttctgcatatgccaatccaattccagcaacatttgtcttacatgcttccacagagttttctgtgagatatttagctatgtgaaaaagacaaagttcacactgagactaattttctcacatttatactatttaattctgtttgtgtcaccatctgaatgctatttgagacctaagtcacctgacacctgctaactgataccattttctttccccacttatgttttcattaagtgaaataacatagatactttaaaaatagaatgagcacaacttattgtagactaaaatcagataaatgtcacaaatcagtatatttaatcttaaactcctgtccccaaagtacaagatgtttacaacagattttatttctttacgattgctttgactgtgtatgggtataatattaatgtcttatttctagttatgttgttgttgatgatgattcttatggggtatgtcgacagggcaccacttaatctagaaaaaaatgaggggtggaggatataacactggaaatcatcaggctaagttaggagaaacacatgaataaaagccatcaaattcatgaaatgtagagagttcatgaagacctaatgaaaaatgtacatacatgaagaaggagaaattacataatttatatgtttgcaaacactgctttaagatgagagaaactcaggaggagcttaaacaaagtgtaggttctttttaaggagggaatgctctagaaatggggctttcaggtgcaactgtgaaacacacttgcaaataaagtaaacacattgtgaccctagagacagtattagggaggagactgagggtctaaacaaattattgtagcttgggtataaaaatagttcttgaagtctgcaagcaccagagtgcttccgagtactaatgaattcttcagtcactgactacagtcaattcagcaaagttgcatattcaagtaatcttgaatgttctgggactgctatttctgatcatggtctcagaaaagcatagctctctcctctggtactcagtgtaacttggtcttggagctgagcaatccaacagcc

SEQ ID NO: 656 - DNA, 2556 bp, Homo Sapiens
ggggccgggctgaaccatggcgggcggcggcatgggggcggtggggctccgcgggcagcctggttgcgctgcacccggacggggccgaggggacctgaaagctgcggcagagcctgaccgcgccgttctccagaagagccccggccgcggctgagtcgcgctccgggtgtggacggagccggagcctccccggggctcggtgaggacacagggcccaagccccggaccttcaagtcttgaccgagcgcatccccggcccttctgcgcccacacctgagtttttgtctgtaggagtttccgcagtttgctaagaatcgacatctagaggagtactcaccacttaattgatgatcaatacacgttccttgaaagaaccgatagcatgcgatcgatacagagcatctgcactgggattgtccgccccgcctgtcagggaggcctcgggggctaatggagctgagggtatagtcggccttggaccctcgcttttttcctttcctgtactatgaagataactgccttatctccccctcaggactgttttggggattaaataggacgtttaaattaccaacgctctttgaaataaacatttcaaaattattataaccctttagtacatgtgggaaaacgttgacattcatgttcaagtttatttttctgctggctcatttaggtttgttgaagccttgagtccctaggattgtctaagaacatgggtaaatgtgtgtggaggcctccctggaggccagagaactgccagcagccttcatgatgttaggggaacaggaacctaggagagccagggtgacatcgttttaaaatcaacaacccatcttggcgggcgcggtggctcaagcctgtaatcccagcagtttgggagaaaaaaattagccgggtgtggtggtgggcacctgtaatctcagctactcaggaggctgaagcagaattgcttgaacccaggaggcagaggttgcagtgagctgagatcacgccatggcactctagcctgggcaacaagaatgaaactctgtctcaaaaaaataaaaataaaataaaataaactccatcttaaaaccagtgaaaccaccattgcaaaattataactgagacagtgagagatctgacctaaccaactccatcctacttttaacctccaaactgtccttgttcattcctgggtgtaggccaaactaactttggaagaaacttagtttatggtttcccgaaacaaatccttttcttgtctggagactagactgcctttgtaggactaactgaatattctagatacttgtgaaaggatattgtggaggaggagctgggggtagtaagtatgatggaaggcagacgagttttggaatcttgtctccaaaacactctcatctgttagaatgactcctaggctataggattgactatggcttagagtggattcatagttgttaatttcatcatgtgacttgtgacttatccttttcttttcataatagaatgaaaattgccatctgtctggcttcttccccatctttttgccttctttcattacaccacacacgtgtcctaattattccaaaggtgatacatttgcctcactcctcagtatacacacctcttttagggatttctgggcttcttgactagctcaagctcttcagaggcatgcactttatcttggtgttcagtcttgactagtttaaacttttgatgtccagaaggttttcttcatgtgttgttgtgtggaattgtaaatattttctagcttttgtaaggttgtggctcatatttatatttctcctggtttgaaagaagagagagaaagaagtatgtcaaattgagactcttagattggaaatctgaatttatttacacgattgagattgatctagagttttattttttctgctgtaactgaaatttggattcaagattatatgtgttttgtgaatatgtttggtaacattgtgacttttctataatttagggaagtttgatgtaggagaaagagaaaaaatttttgagagaatcctaaattcatatatggcctaaccttttaatatctatgtaattttagataataaataatttgtttgagattatgtggctctaacaacacctgcttcacagtgtaattatgaggatttcatagaatttgtatagtgagcgttagttttgatgttactttaaacctctttgccttatacattctgttttttccatggaatattatatgatttcatgtccacatattaatctcatactttcaattacattttatgtttaaattgaatattatggtaatcgttatgtaaatgattaaaaatttaaagggacaacatttaatgttgctctggaattcacctttagtcataaaataaagatttaaagtatcatctgtagacaatggcaaaaggccttttttgtcataagaaaatcaaatatgctttatttcacccaattaacagtttctgggcttggccatcccgggaaaaccaaaatgaccataggcggtaattccccaggccgtgtgatctcagtctggcattctcagatctc

SEQ ID NO: 657 - DNA, 1843 bp, Homo Sapiens
tcatgctgttctcacgatagtgaataagtctcacaagatctgaaggttatataaagagaagttccctacaccacttctgtctttgcctgctgccatccacgtgatatgtgacttgctgctccttgccttctgccataattgtgaggcctcctcagccacacggaaatgtgagtccattaaaacctctttatcttctcagtcttgggtatgtctttattagcagtgataaaacggactaatacaataaattggtattggtagagtggggcactgttgtagatacccgaaaatgtggaagcaactttggaactgggtagcaggcaggggttggaacagtttggaggcctcagaagaagacaggaaaatgtgggaaattttggaacttcctagagacttgtttggctttgactaaaatgctggtaatgatatggacaatgaaatccaggctgaggtggtctcagatggagataaggaacttgttgggaactagagtaaaggtgatgcttgctatgttttagagactggtagcattttgcccctgccctagagatttgtggaactttgaacttgagggagataatttagggtatttggcagcagaaattcctgagcagcaaagcattcaagaggtgacttgggtgctgtttagagcatttagttttaaaagggaaacagtataaaagtttggaaaacttgcagcctgacgagcttataggcataagagacttgccttgtctcagatgaaactttggactgtggacttttgagttaatgctgatattaggtaagagtgtggggagtgttgggaaggcatgcttggttttgtccaagtctccttgaacagtgcttgcctgatatttttgggaatataaatccctgggtctcttataaaaaggtaggtttaaatttaactggtcagggatggggctgagaggctgcatttccaccccaggtgatgctgatgctgttggctcccagacaccactttgggtaacaagctcctacatcagaggtcaacgaactacggcaatagaatatggtagaagggaatgtgtgtcagccccaaatctggcctcaagaggcttaggcttacctgcttctgctttttccctcaggactctgcttaccctttgtgaataagcccagtgaatctgctgagtgatgagagagagagtgggccagtcacttcattgctccaggtaacatgcagttatcttcccccaggtaggtcccagaagacctgccaactgactggacatgcgtaagtgagcccagctgggttacctgagtctggcccaggtcagcagtgctagccaatggacaaacaacatcatgagcaaaaattaatgtattatatgccactgaggttttttggctgtttgttgtggtacattattatagcattagataatgatgcaaagtgcagaacagctttatttggcaggaagagtaggggatgtgtgctcactttccatttctaatcaatcaccaggtcttactcatcctatatcctggatgaatatctctaattcattcccttctcatcactgtccctgccactcacctaacctggttatcttcaccacttgaaacttctcatgctgtcgtatacaactgtgtacttccctcccaagcatcattataatttgctccagttttgaaagattctgaagccagttttgttgagagaggagggcaacagatgaacaatattgggcatctactttattctatgcacttaattaagcttattgataaggctaatcacagacttaaccataatcataataaattggcaaacaatgtttattgagcacttcttacgtgccaggtccttagttca

SEQ ID NO: 658 - DNA, 2876 bp, Homo Sapiens
agagggtgagggtcccacatctcctgcaggacaggccctagctactgagtcacagaaacccagggccgaagcaaagtcccaatcccagagaggctggggcacacctacaactgaaaggaggcttagaaatccttcagagaccaccctatcggttctcctccacctggacaggatgagccagcaacacagaaggaagaggccttcctccgaaaggtatatttgtaagccgagttgaatgctttgtggagagagatcccattcaggagggctaagcttgaatccaggacttactgaggagcaatcacacagaaaaggacagacacttcgagggaagtacctcagaatgagagccttgcattcatttactttggctcagtagctcctactcctatagcatttgggaaggaagaatgattgcctccatcccatgtaacacagctcatattatacagaaggagaatgcaaacttccttctctcaagcctctaaaggtggaagcaaacctaccttacaaacagcaggcttgctcctaatcagtgccgtgaagggaccaatgctgcctggtacatggagtcagtaggaggatgggcagatggccactagcatcagtgacaatgcagcctggagtggattcaacagacaacacagacttcccttcactctcatctctgcccccaccagaggcactgagtcactggcttaactgagtcactgaacctggaagggaccacgtcctccttcattcactcattatctcagtcagcatatacctctatgtgtcaggcactgtcatggccgctgctccagcaatagataggacagggcccctgccctcaaggagcttccagtccagtcagggctaccccttcaatgccacccccctgctggagagcctggatcttgggtaaggttccacatctgttactgctgtaacctggtgatgtcacttactcctctgtgtcttggtttctttatctgatatgaaagtctcatgacttgctgaataaatgtcataacatttcatttaactcagtttataatgttgcactagtcatcagattcactgagttcttcaaaaatatagctctttggcaaaattcattgttaaaaaataaataagccattgtaagcaatttttataaatttagtttgtttttattcattctaaaccatgggatgccctttggacataatacaataatgattctagggttcttagaaacatgctatttgtttccttccttatccctctggatgtgaagtaaaataataacttaaataacttgaagtaaattatactttaaaaagaatctcagccaggcacagtggctcacaactgtaatcccagcactttgggaaatcaaggtgggcagattacctgagattaggagtttgagaccagcctggccaacatggtgaaaccctgtctctacaaaaatacaaaaattagccaggcatgctggtgtgtgcatataatcccagctgctctggaaactgaggcacaagaatcacttgaacctgggaggtggaggttgcagtgagcagagattgagctacttcactccactctagactagtcaacagagtgagactccatctaaaagaagaagaagaagaagaatctcagatttataagatgagagattcagaaatatttggtttccaagatctaggcatatttggtttcagcacccaaaactttggacagcagcctcctcattctctcctggtagaactgacttgagagaaagcctggttagggctaactgattcttaacatctctctttaaccaaggtcatctcaattctaggaaggagagtgtgcccctggctcagataaaccagtgagagttgaagggtaccaaggacaaggtactcagatgacaaggctaaggggaaagctgcactgtgggcagcaggaagtaactggacccacatcagagctaacagcaaatattcacaccataactccgaattctcagatcccaggtagactctgacttcctcagaatcccactgtgatgtctgagcctcagagcaaggcttggatgccacagtgggctctcctgcttagttgtagtttgagtcactcctttgctcttttgcaccatttcagctaaatcctgtgcatggggtgtgggggtttctttagaccttgagccgaagctagaaaccagatttcaaaaaattctgtgagcagcattgagaagctataccagggagaagcaaggaccaggcttttcagtcaagcataactgagctattaagacacaagagactcaggcgtctgcctgtccgcatcaatctaaggaaaactcagcacacattgctgcagcaagcagaggtttggacatgggatgggctgttatactgtgcataatttaaccaacacatgtcggtggctgaatgctacaaaatccacttcttgctcaagtcttacatgaccagtagggggtcagcagggggctcttctccacatgtctttcaaggaccctgatggaggctgatggaggttctaccacagcatggctgcaccgtctggaatccatggccttctgggtcacctggcagggaaaggaggagatgaggagcctttggactggcaattaaatgctgcagcctagaagggacacactcatttcctttcacaatctattaatcagaaatagtcaaaagtgatggtccccaaaaaaaaggaagagctggctgtggctgagcactagaagattctgccacagtccctgctatggatgagtcctcctccccttctgagaccactcgtttcttcctgcatatttactgtacaaaaatattataacaatacaaggaataaaaatggaaaggaagccctccgcaattccatcactctaacaaatc

SEQ ID NO: 659 - DNA, 2878 bp, Homo Sapiens
agagggtgagggtcccacatctcctgcaggacaggccctagctactgagtcacagaaacccagggccgaagcaaagtcccaatcccagagaggctggggcacacctacaactgaaaggaggcttagaaatccttcagagaccaccctatcggttctcctccacctggacaggatgagccagcaacacagaaggaagaggccttcctccgaaaggtatatttgtaagccgagttgaatgctttgtggagagagatcccattcaggagggctaagcttgaatccaggacttactgaggagcaatcacacagaaaaggacagacacttcgagggaagtacctcagaatgagagccttgcattcatttactttggctcagtagctcctactcctatagcatttgggaaggaagaatgattgcctccatcccatgtaacacagctcatattatacagaaggagaatgcaaacttccttctctcaagcctctaaaggtggaagcaaacctaccttacaaacagcaggcttgctcctaatcagtgccgtgaagggaccaatgctgcctggtacatggagtcagtaggaggatgggcagatggccactagcatcagtgacaatgcagcctggagtggattcaacagacaacacagacttcccttcactctcatctctgcccccaccagaggcactgagtcactggcttaactgagtcactgaacctggaagggaccacgtcctccttcattcactcattatctcagtcagcatatacctctatgtgtcaggcactgtcatggccgctgctccagcaatagataggacagggcccctgccctcaaggagcttccagtccagtcagggctaccccttcaatgccacccccctgctggagagcctggatcttgggtaaggttccacatctgttactgctgtaacctggtgatgtcacttactcctctgtgtcttggtttctttatctgatatgaaagtctcatgacttgctgaataaatgtcataacatttcatttaactcagtttataatgttgcactagtcatcagattcactgagttcttcaaaaatatagctctttggcaaaattcattgttaaaaaataaataagccattgtaagcaatttttataaatttagtttgtttttattcattctaaaccatgggatgccctttggacataatacaataatgattctagggttcttagaaacatgctatttgtttccttccttatccctctggatgtgaagtaaaataataacttaaataacttgaagtaaattatactttaaaaagaatctcagccaggcacagtggctcacaactgtaatcccagcactttgggaaatcaaggtgggcagattacctgagattaggagtttgagaccagcctggccaacatggtgaaaccctgtctctacaaaaatacaaaaattagccaggcatgctggtgtgtgcatataatcccagctgctctggaaactgaggcacaagaatcacttgaacctgggaggtggaggttgcagtgagcagagattgagctacttcactccactctagactagtcaacagagtgagactccatctaaaagaagaagaagaagaagaatctcagatttataagatgagagattcagaaatatttggtttccaagatctaggcatatttggtttcagcacccaaaactttggacagcagcctcctcattctctcctggtagaactgacttgagagaaagcctggttagggctaactgattcttaacatctctctttaaccaaggtcatctcaattctaggaaggagagtgtgcccctggctcagataaaccagtgagagttgaagggtaccaaggacaaggtactcagatgacaaggctaaggggaaagctgcactgtgggcagcaggaagtaactggacccacatcagagctaacagcaaatattcacaccataactccgaattctcagatcccaggtagactctgacttcctcagaatcccactgtgatgtctgagcctcagagcaaggcttggatgccacagtgggctctcctgcttagttgtagtttgagtcactcctttgctcttttgcaccatttcagctaaatcctgtgcatggggtgtgggggtttctttagaccttgagccgaagctagaaaccagatttcaaaaaattctgtgagcagcattgagaagctataccagggagaagcaaggaccaggcttttcagtcaagcataactgagctattaagacacaagagactcaggcgtctgcctgtccgcatcaatctaaggaaaactcagcacacattgctgcagcaagcagaggtttggacatgggatgggctgttatactgtgcataatttaaccaacacatgtcggtggctgaatgctacaaaatccacttcttgctcaagtcttacatgaccagtagggggtcagcagggggctcttctccacatgtctttcaaggaccctgatggaggctgatggaggttctaccacagcatggctgcaccgtctggaatccatggccttctgggtcacctggcagggaaaggaggagatgaggagcctttggactggcaattaaatgctgcagcctagaagggacacactcatttcctttcacaatctattaatcagaaatagtcaaaagtgatggtccccaaaaaaaaggaagagctggctgtggctgagcactagaagattctgccacagtccctgctatggatgagtcctcctccccttctgagaccactcgtttcttcctgcatatttactgtacaaaaatattataacaatacaaggaataaaaatggaaaggaagccctccgcaattccatcactctaacaaatcaa

SEQ ID NO: 660 - DNA, 2520 bp, Homo Sapiens
gtgctcgagcgtgcgctggcggcggcccgggctcccgggcgtctctcacgctgtgttttggcggcgcctggggtcttcgtttgcatatgagaagagccgaaagcacagagctacaggcgaatacaagtggattttttttctttttctgtttttttattagaagtaatagttgctgcattttgaaaaatcaagaggaaaagagttaacaggaagaaaagttcgaggctggaatgcagtggtgcaaacatggctcactacagcctcaacctcctggcctcaagcgatcctcctgcctccacttcctgagtaactttggtcacagagacacggtttccctatgttgcccaggctggtcttgaactcctggtctcaagtgatcctcctgccttggcaaaatgctgggattacagagctgccggcttccccttgaaggaataggagtagacctgctgaactatcacatgagagaagaggcccaaaagcttgcacactacagtcaagctggcccttaaagagatggacctagaagatgctgagccagatgtactcaattacttctccaaaattcatcaattagggtcacacagctgctaattgttctgtgtggggaacatgtgaggggagaagaaaagacacacatacaatacctgtaagggtaaacaacctttatcccatgtaaatggcaatgcggatataataagcaaatgatataataagcaaattgatataataagcagattgatataataagcaaattgcaatgggaaggggagaaggaaaagatacatacatacatatatatacatgtatatatatgtatacacatatacactcaccagactatggaggattcaccaccagactgggaagcaacagcctgggctccagagtcggacaccacactcaccagattatggaggattcaccaccagactgagaagcaacagtctgggctccagagtcagaagtaacaacaggctgacctccagagtcggacactaactcaccatagtatggaggggattcaccaccagactgggaagcaacagcctgggctccagagttggctacccatccatgcacagatgaggagaggtctcatgaagctttggtattgtccgggaccctagctttttttgtaaaagttgtttggcatgaggcccagtcacagtggcccttcgctgtgtcataaacacttttcatgtaattatttgtggttttatgatcatatttataattacagcaaattttccactttataacacaacaacttgtacatttcactaataggcatacatattgtgtctgtttttttcactagtataactaatgctacagcaaacatctgtgtgcataaatctttgtttaaatatgattattttcttattattagaaataaaatggtgatgagaagataaaagtatttctaaggctcttgaagcaagtggtcacactgtttcctcccacaaattttgccattttattctgaacagaatacctttttcattttttactctgtattatactttttaaatctttgctaactttacagttgaatgatacctcaataatacttgcattttataaagaaattaacatttttttcttcttatagtttctaatccataggtagtttaaactattcattgatattctttttttttgcatttctatgcttcattatttatagaaaatttttaccgttttatatttctttggttttgtgttactcttgattttccatattatgtttttccatatgaatatcttttattgttatgtagttaaccaagttgtgtcttcctttatttttcttttactgttttaagcttggaattatttcccatggagagataaatattagtctacctattttttatacaagtattttgattttttgaattagcagtttaattcattgaaaatttaattttgtctaatatatgaggtgaatatctaaagtttttccacctagcttatatttggttgcaaaatcattgtttacgtttccccattggtttgtattgttgcatttcccacgtgaacacttctgaaccattgttttgtttcatttacttatttgtcttttcctctctcagaaccacactaacttgttattatgactttataccattttgtaatactcggtaacattattaattcctcatcaatctgacttttcaatagttttaaaatttaatcttaaacatcacaatcttaaaaaaaaacccataaattccattggcattttgaccaagagtatattaattgcacagattgctttgggtgaaattaaccactttgtaggctcagtcctcctatttggaaaatgttaattatctccatctatttatgttatcttctgtacttccctttcttcctatattttacacatgtcctgataatgttactccaaagtattttatgatttttttccctactgtaccacactgcatgtttactcatacaaacattataataaaatttcttacttttaaaataacttctattttaaaaata

SEQ ID NO: 661 - DNA, 2864 bp, Homo Sapiens
gtaagaccacctcatgagtagagctgtgttcttccatcagtcaggttgcttctctgtttgtgatgtttgcagccattgatgatcactgcctagatccattaattcattaaggtctgcaaaaggaccctctcttctccactctgtctcccaggtaggaacctctgaagctgaggacgtattcttgctggcttcattattgtcatcattcctcttcgtgacctattacacatttctgaagagaaactcctctcaccagctcctttgtttcctaagatggctgggatcctgatacctacatgcatgagaagccacaccagaatgccagccgacatttgcatgcagagacgttgcctgtggagctgtctccagaagaggatgcagctgcaggtacttgaggaccacactccccctcccaagcctaatgttccctacatggcagcgcactgagcattggcaatgcaaaaaccacttctcaattactcataattgagttgcaaaaagagattattctttgctgaaacttgacttctcatcctggaagcaggtttttctcatttgggatgggaggggggcaaattatattaaaatttgctggaaatttttgcttggaacaaggcacaaaaatattccttggaggttgcagatgcctcagttgtcattctttaacaaaatcagggctctctttgtaaaaacaaacacgacccaggcatgttcactctttctttggaatgtatccatggtgctaaattagattttttgaataccctcacaactggccccaaggttgtgcatggctattgctgactctacaacaggggaattaaaggctaaatgtattctgctgactccctggttctctgcttatccaaagggcactgggattcattttggaaaatcctagagattacacacaggctttcttccagggataagttaaagaatttaggaaacacccaggcttctgtcttaacacacttgaaaaaaaaaacaaaacatatcttataaggtgtcccagtgacccaaaataggtaaaacacctcccaaggaagcacttttctgtaaaatctggttctttaacccctgtgcctcttctcattctcaaaactgcacaagaagcagcatgcccaaggttctagcccaaattgacattgcattaacactgtcaaaacattaatggaaagtgtcccaggaaggactagagagatttcttctaccccattgttgctgactctgacttcctggttccatcaagattccaaaggggaggagaaacttgatgcttacctcggggaaatctctgagtataaaaccttaactgaacctaccgagatcaggaagagctcatgttcaaaagctgtcacccctctcccggacagacaggcttgcagggagccccagctctgtccacaggagccttggcctgtgacctgactctaggcttgggaccccctctccaagaggtagggagggcagacctcccaaagcacagggtttcatccagggctctttataatttctaaggctgccctctaaaacctactcctttgcttccctttatcttcccctccatcaattcccttccctcctatttccaaaaaccataaccataaccaaatttggcctgattctttaaccgataaacctaaaaattcagaaatcaggcagctctaacattcttgaattgtgcctcatgatactttagttgttgctgttgtcattttgtttgtcagaagaatactttgctatgtaggtgaatttaaaaagtgaccctggaccattatatttcattataaaatacagcggcataaggccctctccaaaagacatgctacagctcctgccttgttgatgtaaccatataaacctgtgaggagcatgagcacacatccaaatagacatatctcacatgaacacgctaaacagagacatggcgcagaagctatgtggggccttgggctgaaccagcagttagagcatgcaaaataccactacagacaaactacagacaagttctagaaagtccagttgatactacatgagcaagccagtgaaaagaaataattgcctgtagcaacacaggatacaaaatatatttttagaacagggtcttaaaagtgttaggacattaaggattctaaggaaatctggtctgtatcagtgaaaataattttgaaaaccgaggaaaatgctaaagtccaatgtaaaggaaagggtggaaggggcaagtaattgacaggtttcctggtggccgcgcacctgcggagcacttactcacctcactcacctcactcagtgcttttccaggcatgttttatttcctttgcagtcctcggcaccctccgaatgacccctgataacagcaatggccagcgtttctctgatgctctgctaattccacacgtgacctcatctgagcctcacaatgaccctgtgaggtaaggattattgtctcccattttacagagaaggaaactgagacccaagtggtactcaagtgtcccctggatacctaccagtaagtgataccttactggtaggtatcctaagctcactaccagtaagggacacagcagaagctccaccccacttggtgactctcagtgacaagccctccctacctggccataccacctcatgtggtgtaaagctctgttgccagtatggaaaacactcacacgagtaaaaccaaatatccacttgcattgtccaaaatgacatccagagtcgagaggccaggaaatattcctagacacacataggttgtccattcttcattcagcagtttagagacaaaggcataattaggcccatctgtaaataaagtgagtccctgacacaggacacaaataaagggcttcactgtc

SEQ ID NO: 662 - DNA, 2240 bp, Homo Sapiens
attcagaccttgacagttgtaaccgatagactgggctggggcaacgctgatgaaaggcaaattcctgagagaaaaatcacccagattagcattttggtgtggatacagaagacgagattaacacagatcaagtaacatggaaataaaaaaggagacaatgctggatgatacaggggcagccaacaagaggagaaaacccaagcattggcaaatgcctcattatccaaagaacactgggcctcagagtatgtcagctggggtcagacgggaacaggagtctggctcaacacacatttattgcactcctgtttcatgccaagaaatgtaccaaaatctgggactgtgtaacacagcaaaggaaaagactcatctccaggaagcccccttgtctaggaagagaaattgaatatcagcataaggtggtgaaaagctgtgaaggagatgagtgccaggagtccatggaggaaggattctagcctggacaggtgaggaatggctttctggaagaagcagatgccccagctgaactttaaaatgcccatgtgaaatgaactgtctgtatcttcaatcagcaaatggagtaggtggccactgtttaattctggaatggggaagtgtaaaggtgtggtgtgtgtgtttacccctacttagggattcaaaacagacagtaaagaacaaaagtctagccctttgagcattctccatgggacatttgaggtctagctggccccagagaaagagagacagaagcaaggtcatatccatttgagaaaatcaaagtgtctgctccaattgagtctggtgtccttattcctggaatagccatccctactgctctggtgctgatttacctccggcagttcagtgcttcctggaaggtaggctgggctttttaacaaagtgactccttacttgacatgttttacccaaacacagaggccactgcactatgtgcaagaaacaacaaaaaattaaatgagactcaatgccttccttagggatctaaaaccccagtaacacagataaacaggtaaacaaataatgtgatggtgtgattctatagcaacaggaatagagcactgcagggccaccgaaggaaaaggtgatgacctggcttggattcagtgataaaaaggggcttacctcctttctctgtttctgctaaaagccagtgattaccccctgcttttcccatgttgggcatagctgtaagtactttagacatagcggcacatttaatcatcatgcaacaataagaggaagctgaggcagacagaagtgcccaaagtcacatacttgaagccaggacttgaacctgggctatctggctcctgaatccatggctttcactaataatgacttaccctccaatgaggaacaagctccattctggcctttctttagcgaaggcaactgcctgagctcatggtctgatctggcttctgggaaagagaaagcaggggaaacgtctagagatggcatactgggagaagaaatttcttgctgtggaatcctgcccccatctccctccccaccatacacaatcccacgtgcatttacacctacacgccgtgtacacacgaacattttttctgctactcccatgggccccaactctgccttttcatcaaaatcacccagagttttaaataaaatgcagatgttgaggcttgttcctaaattataatcttgggcatctaaattttttgattaaaaaaaattgacatgcatgcttaaagtaaaaatttagacaatacagcaaagaatgtgtttgtacccctcccacctagcccttagttcttccgaaaggcaaatacttaaccgttccttgttatccttccagaaaacaatatatgcatatattcatcttttttttcttcttcctctgtaggtgattgtggtgaatagtcatgagaatctgggaactggctcctgctctgtctatcttggagatgcatcttttgtgagaagccagggcaagaatagggaggcttaggcaatgggaagtttctgagtagataaagcagatggcagagcaaagggacagagcctggcgagaggctactccctgtagcaacctgcctaagagtgagaggaaagcaaggcatggctatgagcacgtgtagtctcagctacttgggaagctgaggctgggggatcacttgagcccaggagttcaagaccagcctaggcaacatagtgagaccatgtctctttaaaaaaaaaaaaaaaaagaaaaa

SEQ ID NO: 663 - DNA, 14676 bp, Homo Sapiens
acacaagctatcgctgactgccggtgcatgttggaaatgggccacagggctgggcatgatatgagctgcctggacattggagggggcttccccggaatggagggctccgggcccaagtttgaggaggtgagctggtacgggcgctgggggtgttcagggaggtccgcatgtgtgcccaggcatgggtgtgtgtggggagtctgtgttcatgcatgtacctctgtgtgtttaggtctctctggtgtatctctgtgctctgtgtgcacaggtgggtatgtgtgtatgtgcatgtcttggctttgatatcccccaaaagcagactctgagacaaacacttggatacaagtagtttttttggagatgatccgtggaagcgccaatgaggaagtcaggaaagagagatagaagggagaaaagtcaaaagaaaattcatctatgagctggttaccactgtgggccgctgcaccagtccccctggggacaatgtagaacctcagaatcatcccactagaggacatggggctggtcctttattcaccaactcctgtccttctttggttgaaggctgtggtctgggggtgttaatttcctcacattccagctagtttccgagggtgctggagaaagcccacagaatgagaagcaaagggaggcaggcgctggaggctggaaatcattttgcacgggcagatgagctcaggtaggctgaggggaggtggcacagggtgtccactgcagctgcagcaaggtgtctgggggctgtgcctctctgtgtgtctgtgtgtctgtatgtgtatatgttttcctgtagaatgtagaattcttgttagcatcaccaatacagttacagttacagttgggagtttacattccctgggtccacaagacactcgccttcttacggtgcatcagattaaattgctgcacctttggacttctcagggagcctggtggccagcaaccccacacaagtgacctcctgtctctcaacttctgtttcctctttggtaaacagggataattctaatgcctacctgcagggtgcctcggggatgaaaggactgatgcaggtaaggcgttggcacaggcgctggcacatcaacacgtgctggatgagttaacctcttcctgctgtccctccaccccattccagttggcgagagtgatcagtgctgccctggcccaggacctccctgaggagcgtggtgtcaaggtcatcgcagagcctggctgcttctatgtggagtctgtctgcatggccgctgtcaacatcattgccaagagggctgtgctggagcccggtgggtgggccaggatggcactgggtggggatgccactgtccaggtgtccccaggccctggaggagaggaagggcagagggttgggctctgtcccaggagctgggggtcagagtagtgactgagcactccccaggaggcagccggaagctggtgtattatctcaaagatggccactatggctccttccgcctctgctaccgagagcctgtcccaagggttcccatcgtggtgaaggtaagggggccactccagccccgagtctagtcccttaccttgaggtgccttgtgcctcccctactgggaacagtggctgtgctggaccccagaggcaggtcctggcctgctgcttagaacacatgtggacacgtacatgatgtgtgctcacagatcagagcgtgtgcagcagctggatatgtaggcctcctcaggcaaaggggcgatcaccagaacacaaaggcgtgggttgttttccaaaatattgaagttcttctccctggtggcttaagagccattccttcttcctggtggttaaagagctattcccccgagtccaccaggggcctccctgccgacactcttgctgctcagtccctcccacgatctggcaacaaagcttcaatacctgaccctgtagggccaacaggatcttcctccagctctgcagcagttgtctcctaatgtgatgggttggtgtccgggccacactgctttgtaaatatcttgactgtttctcccggccagtgaacgtcttggtgtgtgcacacatttggtcatgtatgtgacgtgtgtttgcatgcatgtgcgagtgtgtacgtgtgtgaagtgtttctgggtgtgtgtcttcgtgtgtgtatttgcctctcttctcatcggaaggagtgagttctggatgtggaggaaccagtaggagaccctgtgtttgtttggttcccacaatagttttcaattttagttgcccatattaaaaaatctagacatatttcataaaagcctggattttctcagctcctctcaaacatttgagagatctgatgatacgtggcctgcagaacaacaaggcaacaaataattcaacaaattagtctagcatgtcaggcactgtgatctgctggaacgggacttcctcagtggctttcccctttggacagacattgactttccagtttgttgtaagacttacctggcccatttcactcatttgtgttacctgcttgacctctaggtaattgagttttcaactgctgccttatagcaattattgaagacaacagccccacttacagaggaggaatctgagcccttacttgtaggcacatcagacctggccaggctgggcaggggccatggagggatgggtcccagccagtatacacccgtgtgcccctgggagtgtccttccgggtctttcagtgccttccagataagggggtgggataggccagcctgctgtcttttctgaccccctttcctatgtcacacaggagttctgctcagagccgcccctcttcccctgcaccctctatgtcccatgtgcgatgcctttgacaggctcttcttggaggatgtgcggctgcccgagctggatgtaggcgattggctggtcttcccctccatgggtgcctacatgtcctccatgagctccagcttcaatggcttcctgcctgccaccatctgctacaccatgggcccccagctcaggtgcctaggggttggggttgaagaggaagcaggaaacctcacactcatttgagcttggggtgggaactggccccagggaatctcccttcccctgttgactcactgaagtcaaagtgtccatctgacctttggactctcatctgcctctggcccccctcccagggaggtggagaattgcaaagagatccccaggccctctagccactggctggccctactcctgcttcagacgcccactgtcccagctctgcctccaggccccagctctgctgctgtgtgtgcagcctcagggctgtaggcaaaggccttgacacccaccctgtaccccatgtcctttccccatgagccttctggaggcagagccttaacccagagccagctaggctggagggctttaagacactctggtaggtaggcccctgggaactgttgggagttgggatggcagggaggaggcagaggtttgggtaactatgaaatcctatgcagaccttccaaaaatatcttgctgtcattttgggtcagttctttccttttctcttttcatttcttttcttttcttttttcttttctttctttcattttcctttcctttccattcctttccttttttctttctcttctttctttcctccctcccttcctccattccctttctctttctttcctctctttttgagacagagtcttactctgtcgcccaggctggagtgctgtggcatgatctcgggtcactacagcctcgacccctcagggctcaggtgatcctcccacctcagcctcctgaatagctgggactataggtgtgtaccaccacacccggctaatttttatatttttggtagagatggagttttgccatgttgcccaggctggtctcgaacttctgggctcaagcaatccgcctgcctcaacctcccaaagtgccggcattacaggtgtgagccaccgcatgcctgtgtcttcggtcaggtcttacactgacttttctcagcagtggcctgccctgcccaccctccttgtcatttgcctctgcatccctcctttcccactctcttgagcagtggttgaaggggacgcattagaagctacttcttctcagagcgactacaaaaaatgggctattgatcttttacgttaaataatgcagcccacacacctgctcagttcatacctagctggtgtcagtttacatccttaaattcatcctgccgctcctccccgctttttatttattcatgcccttgccttgtcccagaaagcgtttctataaaattcatcaacatatcatagtggttaagagcatgtcactggaataaggaagaactgggctcaaatttaggcaccactgctactagctttgaatttgggcaggttaactaacatagttgaactctagttttccttgtaaaatagtggtaataataataactttaacttccccgtagggttgttgggattaagagagggatgaatatatcgtttagggccagcttttccttcggccaccctgttcttgctggctctcctcctggagtctagatgtcacagagaccccaccgtgcatcctgggtcttttcagagagtgttggtagggtgtcccactcaggccaagccaggatgtgtgcccgatgctagggggacaggggaggcaggcacagacccagtctttgagttgtcctcaggcctgtggaaagctaaaggcaggcgcagctggctgcagcacagggaggaacatgggacatactttgaggacagttcaggtggaagccatccatttggaggagtgggtggcttcttggagggagaatggtgggacctggaggcagagcagaatcagtaggtaaaagtgggtaggaagcgtggctcaggtgtgggaacaacttggctcaggcatgggaatgagcctctgctcagagaacagtgagtggccaggattggagatgagaaacagagattgcagagcctggggacacaaggtgaccagtttgcctggatttgtctggaacattcctggtgctagcactgtaaatcctgagtcctaggaagctcctgagtctcaggcaaaccagatggttggggagggagaggagggaggggaggagctcgtcacaccccaaggccacattcctgcagctatagcaggtacagccattgatttctcagcttccagctcagccaaggaaggtgtctcccctcccttcagcagggcctctcccaccctctctgctaccactcaactcagccaggtcctcggggatcccagagtccctggagctgaagaggaacttcccctgacatgtgggaagcaaagagcagattggggtaacagaggccactcagagaagctagaggagctcaacagcccatccagtcaggtgcatctcatgagggcatcccagaacatcaaatttcccgcctgcaaaatggtcttgcttatgcccaaacactcagaatataagaagcacggattatgggtacgatacttaggggtgtgagcaggctttgggaaatgtgaactctttccagatggaagacattccagtgagttttctttgcccctggggggtgggagagggtgagtgggtctgagtatgtaagtcacaggtctccaggtctaaccaaccagtggcggggtgagtagtttggtgggaaggacagttaggaacaggtaactaaaggtgagttaggtcagagcaggtgaccaggggtgattcaggtcaaagcaggtgactgggatgagtcaggatgcagagcaggtaaccaggggaacagatgtgaactgctgattaaaactggggggaaatgttgtttactgaaactacggggaagttaaactttaaaatggaggacaaagaactgaacatattgacatattgattctttgaagagaaattttgaactcattgtatccaacaggaggatcacgtgagcccagcagtttaaggccagcctaggcaacatagaaagactctgtcttatttttaaaaataaaataaaataaaaatgacagaaatgtattctctcatagttttggaggttagaagtctgaagccaagggttggcaaggtcactctccctctgaaggctccagggaagaatatttctttgcctcttgcatcttccagtagccccaggccttttctggcttccggcagcataactctagtctctgcctcacaacgtttttctctttgtctctgcgacctcttgtcttcttataaggacaccagtcatccagtggacacaaattttgtgggggcatgatttaacttcaacctccaaccccctgccgcaggtcaccctttggcccttatggcctccaagtcttgcggctggagctcacttctcagcctggggtcatctgtgtctactttccatagcaccaggattcacctctgctggtggttcccaggttctctctccagctgtgacctctctcccacactccagacctgaaaatctcacagcctcttgatcaccgacccaaggatgtaccacagttcactcagattcaacacaagccaaagggagcccgctatgggcccccatctagcggaagggctgcttcccttagccagagtgtacctcactcctcagctagaaatctgggctttgtcctccattttgaacttctccatcacctccctcatcaatgggccaccaagtcattcacactggaggtggtagagaaagccaactgtgtgccaacagcttttttttttttttttgaaatccttcctgttctacccccagaatgtctcatgcacacagcccctcccttcttccctctctcccaggtcactgtcaggttccagcccctcactagttctctccagagccagcataacagcctggtggcctccctgctgtggtctcattttctctaatccattgaccacatgaccccacaagctccttcttttttcttttttttggagacagtctcgctctatcccctaggctggagtgcaatggcatgatcttggctcactgcaacctctgcctcctgggttcaagtgattctcatgcctcagcctcctgagtagcaaggactataggcatgcgctaccatgcctggctaatttttgtatttttagtagagacggggtttcaccatgttagccaggctagtctcgaactcctgacctcaggtgatccacctgccttggcctcccaaagtgctgggattacaggcatttgccaccacacttggccaccacagagtcccttccaatgtgctctcctgagcctgatgcccactgtgtaatcccatttgcggcagcccatatatgcaggataaagtccaagctccctagtgttatgggatctttggggtgtcaattttttggctggaaacatctgtggccacagcacctttgcccaagttcttgtcctgtgtccaggaagaatgaggtatgcagacaagcaaagagcgaacaagatgaagaagagttttatttagtgttacaacagctcagagactggcagtgtgtagctcctctctgcaggcaggtcatctgtccagtgttcagttctcagcagagaggaggcctcggagagggtggctcctccctgccagcaggttgtctctgtagctctcagtggagaaggtagctcctctctgctgctagtcatcccatcatctccagctatcagcagagagtactcctctctgcagctggttgtgccattgtctctctgctctcctcatcctctggccatcctctgatctgctctggctgagcctagggcttttatggaccttttatcagggaggaagtccatgccaattggtccacgggcagccatgggtgggctggaagaggcaccatgagtccccactccagtccatgggactggcagcctggcccgcagccttcaggccttccctgacctgaaagtggggtcttactggggacctgcccccttctgcccaggactctgtctgcctcccgctgccattcaaggccccagggcttggccccaaccccgctctgagatgggagcaggtgccaggagcagatagaggccaggcagcgggagcagacacccctgagcctgcaggccaccactgggcccttcgtcccaccagcagagggagagctgaccttcttctcttacattctcagcacctgtgaggtggaaggggatgcttttatgatcacttcctgaaagagaggctcacagaactgaactgatgtgcttgtcatcacacagtggaggactgtctaacaccaagtctctcattcccttggtggccagcccctctcagacctcagcaagtccctctgggccttcatgggagagcagtgtccaaggaatgcggtgtcacgcttgcggctctgccaagggcttcttcttcgggctctgcctctagctgcttctgacagaggcggattcatcatgaagcaaacgcggctgaaccccccagtggtcttcattcttctccaacccctttcaagacccagggatgggctcagcaattctgttttaataattttgcattctgtcccttaaatcataaagagagcccccaatctgtaaagcttctgatcccacacaacctctcagggctccagggtcctgaggaggatggccaggtcactgtgggcctgtggtggagccagcgggcacccagggcttcctggtgggccaggtccctggtcatagactgagccagccagcatcagcctccgatctccaggcccctgcggtgagggccccaatgcccctgataaggctctgctcctaaagggctgttggccttgaacaagctgctctcctgcctcagtttccacttcaggatggagacatgaatgagagaagtgtccctgaaactcctgatggctttccatttcctggtttcctgtctttcctgaggctgaattcttcgcctgctttctctgagatccctcactttcctgccaagaaatttcctctttagtctgttcagagtgaagtgcaaatcaaaataaaaaagtgcaagttcaaagtgcaatcaaaacaaacaaacaaactttggctaaggcaaaaccaaaccaaaacaaaacaacccaactatctcttttagtagagttttgacgctgcagcatgtgttgaatagagcccatgtgagttaggctgcccagggcctgagtgacattgcgtactgtggggagtgtgtgcttttgttcaagcggtggctctcaggaagccaggaggagatttggacaaaagttggaaaggttggaagaatatgtaagcttggactgacatggctgattgggtttgggccagtttgagctggttttatctggttggatccaatacagtacggactcgggaggccaaggaaggtcttggcaagtttggaccagtttttgccatttgagctgacttgggctggcttgagctggttgctcatcacagtggcaaaaaagaagaacccttgggcaggggtgttcagggtcaggagtggaggaagggaagctatgctcattgttcgtggcacttggtagagctgtgcatctttacaaaagcaatttacagtacaggcacccctcattttcttgcacttgctttgttgcacctgcagatatttgttgtgtttttgttttgttttgttttgttttacaaattgaatattttggcaaaagtttgtggcaaccccttgttgagcaagtgtactgacacctttttccctaaagcatgtgctcactttgtgtctctgtgtcatgttttggtaatttttacaatatttcaaactcactcttttctttctttttttctgtctctctttctttcttttccttccttccttcctcctttctcctttcctttcctttcctttcctttcctttcctttcctttccctttcgggtctagctttgttacccaggctgcagtatggtgatgcaatcttggctcaccccaacctctgcccaggttcaactgattctcgtgtctttgcctcccaagtagctgggacaacaggtgcaaggcaccacgcccaggtaattttttttttttttttgtatttttattagagatggggtttcgccatgttggccaggctggtctcgaactcctgacctcaagcgatctgcccatttcagtctcccaaagtgctgggattacaggtgtgcgccaccacacccagcccaaactttttcatttctactgtatctgttatggtgatctgtgatcactcatgtttgatgtttctattgtaattgttttggggtgccacaaattgcacccatataagacagagaacttaagaaatattgcatgtgttctaactactacatcaatcagtggttcctctactcctctctccttctcctcaggcctctcaattccctgagacccaacaatattaaaattaggccaatgaataaccctaaaatggtctctacatgtttaagtgaaaatgtcacacatcccttgctctaaatcaaaagctagaaatattaaacttagtgaggtaagtgtattgaaagccaaaataggccgaaaggtaggcctcttatacctaacagcgtagttgtgactgcaaaggaaaagttatcctcagcctttcatgtgtattggcttattcagtcctcataacaaccctaccaagtagcatgtgttagcctcaccatttggcagaggaaaatggaagcacagaaaggtcaagtacttgcccagatcagcagcagaacaggctcaaaggttggcagtctggttgcagagtccatgaacttcactaccacactccacagcagttgtgagaccatgggcaagccatctaaacttttgaactttaatatcttcatccataaaatggggacgataataccctgccccattgcccagtgagtgtgtacacccttaactcggtgcataggcttgggttggcttgatccggtctcattcatttctccccacctgaccctacacttgagtcagagtatctcatgttggctgagcttgaagtatgcaggagcacaccccagaaaggccagggcacaagccctgcttggggtggagcagggagggcctgctctgccccactggggtgttcttaggtggaagtgggtgtgggatggtccctctgggagaactctctccctccagcctccctgcagagtcacccagggaactgaatcacagcacaagtgaaatgggaaaagttcccttatccccctcgcagggcctgcaatgggggtgtggctcgcttctttggtaccctgctgctcaaacctctagggggagcatgcagatgggcaggttgtggggcttcaaccccacggcagtgtctaggggtgaatgcttacagttcctgaagccccaatgggtgtgtgttacagagcgctcttttagttttgctatctgtaggcagcttgtgttaatcagctcgattagatcctctgccttatcacaaggacagagggctttctgtatcccagggtttttgccttggtgtactggaggaatcagatcacacgtgggcttagggaccgagtgcaagtttttattgagtggaagtagctctcagcagatgggggagccagaagggagatggagtgggaaggtgaactatcaagataaaatcagtctactactccataacagaggtaaggaagagtatgcatggaatacaggacatcctttagagcatctcttagtattaccatgccctttgattaaggtcaatgggaaactacaatagcgcaatccaggcaggactacaaatagcccagacccctcaggaatgaaggtttgggtcactccaccaggaaaaaaaccacaacctgctgaggtgcttgctgaaggcaaagggaatacagaatgggtagtagaagaaggtaatcatcaataccacctatgaccatgtgaccagctgcagaaatgcggactgtaactatcatgagtatttcctccttctttggctaaaaacatgtttgtgcatgtatacacttgtacgaagaaaatatatccattttatttccttttcctttatcatgtgacataagatttactgacttcatatcaacatttaagtattattaactttatgtaataatatttgggttggggattggtgggtttccagttgtaccaaggatagttgtattattttaggcataattatgaccttattattgtctttatttgaagattatgtatgatctcaggagatgtgtatgggttcagcttgacaaggggtggacttaccatggttaatactgagtgtcaacttgattggattaaagatgcaaagtattgatcctgggtgtgtctgtgagggtgttgccaaagaagattaacatttgggtcagcgggctggagaaggcagacccacccttaatctggtgggcaccatctaatcagctgccagcgaatatacagcaggaagaaaaaggtgaaaaggcaagactggcctagcctcccagcctacatctttctcccatgctggatgcttcctgcccttgaacatcagactccaagttcttcagttttgagacttggactggctctccttgctcctcaagcttgcagacagcctattgtgggaccttgtgatcatgttttagcacctcttacgaatgagtgtctgagcagccaaaaaataaataatgaatcatccaggcaaaggggaagaaaaatggacttggccagagatggggaagaacgtacgcaaaaagatgaggtcgttcagattggaagttggattggagggcggaccaaaggagaagctgctgaagtagatgttaaagatggagagaagtggacggcagagacatagaggaggaaaagtcagcaagacccgagatgtgtatggagagttagagtgtgggaagtgtgacatgtaactgaatcggatgatggcaactttcactgggcagtgaaagttgagaacaacaagcaataacaaccatacgaagaatctagcaaactcagactttacttctccttttcgtggtcctggaaacagctcagaataaagtggatctggacctctacagaagagagggagctccagattccagtccattacacacatgaagtatgcttgcggcccacaccactgcgcaattcttcaagactatgttgtatattcttcacttacatagaagacatctcagtttccaggaccagttcaggatgtaaaagtgtgagtcacttaccagtggcacaggtcagagtatctccttcaaatcctggtaacccaagaagaaaaggggtcctcatccaggcaagctgattttcctagcatggtcccaattgatagtgatactgtgaagagacacattttgtgctgttttgctggcagtgatactatacctacaaaaagaagctcggtagttgttgtggttgtccgctggtatagcagcttttgtgcagggggaatgatgggatgagctgtcaagaacatctggtgtataaggatccggtgttttccatgggtgatgcaaatggccttgggaactggtgatttagctgttggactatctgaaaaggtaggcttcacctgtgaagactttacaggtgcttgttgggattagttttaggaggccggtgtcctggtggtcaagctgctagatgttaggactcctgctgggatctcagaagttgttatcctatgaccaattttatataaaccttggaggatcgctccttctttcttacctcacactcagctgcctcacccagctagccctcagctcagcagccctaccccgaccattgcaaggccactctgccccactcccctgcctgatttcacggtattttacaaaagtattagctgagacagatggaaattatttcatttttttaagaagtcattatagaaaaggaaagtgaagcactgacgggttaaatcacttgcccaagttcaggaagacagtaatgctgtcgttcacctaacctctgatttaacaaatgtttatgaagagacttgtatgccagacaccaagctccatgcaggaactactgtgtaaaaagaaaaaattatatggatgtataatcaatggatttttttttcttttttttgagacagggtctccttctgtcacccaggctggagtgcagtggcacaatcacagctcactgcagccttgacctcctgggctcaagagatcctcccacctcagcctctctagtagctgggactacaggcatgtgacaccactcctagctaatcttttttatttttcatggagatggcgtttcaccttgttgcccaggctggtctcgaactcctgggctcaagcaatctgcccacctcagccttccagagtgctggaattacaggaatgagccaccatgcccagcctacagtcaatgaaatattattcattataaaaaagaaggaagccctgtcatttgcgacaacatagaaccttgaggccattatgctaagtgaaatatgtcagacagagaaagacaagtactatataatctcacttctatgtgagaaacatacagtgattctcacattatctgtggaatctacattctataccttaaatttatataattctatttgtcatgtatacctcaataaagttgggaaaattatgtacaattaaatgacttttagtatcttcacagagttgtgcaatcatcaccacactctaatgtttgatgtttttgtcaccctaggaaagaaatcttatacccattttctctcctcatttcttt

SEQ ID NO: 664 - DNA, 7022 bp, Homo Sapiens
tctcaagggcaattgagatgtcagtgaggctgtgattaaatgtattggatattagaggattttaaatacaaacaagtattataggtgttaccactgaccccgaaggtaagatttactgtgaaaatttataatgcaaggaagaatgatcaagttggctgtcagaacaacaaaatattacaaaccaggatgtctaagagcagaagtccgtggttgccacctctcaagcctcttagcttaatccaatctaggatgcatttccactctgcaacaaacagtatttatttttgccttatttgcagataacagttttaatgcaggtactgcccatggattagctttgagcagtgtctttttgctttggtttttttatttgtttggtttgttttgagactgagtctcagtcctccagcctgggcaacatagcaagactcccaccccttaagaaaaaagaagagagaaaaaaatagaagttgtggagagggaggaggatgcttgaatactttgaccgtacttggcataatagacattttgagggtttttttgttttcttaaaattcctctggatcagttttcattgtttctagtaattatatttatcgttaatgaattcatattctgctctagcccctaaagatagtttgatatgctaacttttgttttgcctttctagctgctaagatagataatggttattgcaaaatgcacgtttttaaatggtctccagtgtggattgcttctgagctgctgatggattgaatacattgagaaggaatgtgtcatttggaatccaggaccagtcagcaaggataactgcctgattttatggtcagaatgctctaactcttatggcatactgatgactttttcttccattttccaaaaaagcaagttttgtcagtctcagtgtttctctgatctagctactcacaattccattcccaaagtagtgacctagttctgtcacttgggtttcaaagggagttgaagtgtcactgagtgagtacagcaaacctgtttaatgatttataggaagcaaataaaaagaattttgtttgctaacctagaagtatatcagattttggtttcaatttataattttgcaaaatataaagacatttcctggctaactccatccagatgaattattcagtattttttctcctatcttaatgaagttaatttgaatgctaatttcctataaccaagaaaacagttgaattaaataacccttatcttttaaacttaaagcttatactactaataatcatttaacattcacttccttttttctgacttaattggtaggtaaataaaatacttcaaatttgattggcaaattggaaaatcacttagaacaatctgctagtattttttattccctttgttttttcctttacacatttgtactgcaaaataaatcaaggacaaagactcacactgaattgatcaacttgtgtttggtcttcatgggaattacatcttttttcccctcaacatttattaaaggaacatacagaatttcagactatagcaaactaatacctttagcttgactaagagttgattttcgttaaggaacagaacttgtaatttatttcgacatactttaatgtatgactcatccctgttaaagttgtgagactcaaaactacgcccaaatcacttaattttatgtccttccctgtttactgtgtctgaccttcaagatttcgtgactgatgctgaaatggaagccaaccactgcagaaatttgggggaaaatgagatctgaagaatacaaggggaagtaggaattcatttctagcatttccaaacctgcttaatcgtgtctgctccaccacagtcagaggaaaagactgagttcatggaaattaccagctaagccttacatctgtctttaatgtttttaggaagtatactgaaaaggtaagtgagatgtctgttttgaagaaagactcttactgggtaccttaaaacccgttgtttcctattagtaaagatgggcagcttctttattcctagcttcaaaaagccttgcccctgtttggtgtgtttctcagtattgtggagaaggtagtttctgagcaaggtggtgcttttcctctgcttctcagcagctaagacagaaattgcaccgaagtgtacaaagggccaatttttgttgtcctgttgtgctcaaatccttttttttaaaaaagttatttcaatcaagtcttagttttattcctcactatataggaaaaaaatctttaatgcctcaaaagttccattcagcattacatttgcattactcttatttgcagcaaatatgagtaaaattataggtttttaaaggtctctaataacatccacttatattggttttgtagataatccataaattaccagaaataaattattccacatttattacacacccatgtaatagatgtcgtgccaggccctggaatatactaatggcatcacctcatgtggtaaaaagacacattccgccatcctggagtatacaaaggtagactagcatatagttcatgtgctcaaggagttcatttttattgacatgatacagatagaattgtagtttagggaatcaaaatctaataaaatgaggctaattccattttcccattaacactaataactagtgtgtaaatctgaatatgacacattctatatgaaagaagctctgtgtgcatctacactaaatactcgtgtgtgccaggtactgttttaaactacgtatatttttttaattctcataactgttctctgaggtatgtactaatactaaagcttattgttaaaggaaggcagaaaaattaagtaacttggcctaagtttgcataactgtgatctgggatcaatatttgaacccatacaggctgattgcagagcctgcactcttaatttgagtgtgatatttatgtgcagtacctggctataagtacccacaaaacgtttcaaattctttataaaatttgcttagttaaaaaagtaccaattgcataatatggttataagtctggtagaagttaggctttttacaagacatgctgcttactgcaccaaggaggcaagaaggctttttagagagcccagaatttcctttcctcaactcctgcttccaagacagtcattttgcatgataaccgtttccccaaaaaacacagacacaaaatttaaagaactggaacagaggaagcagagcttatcatagtatatatgtttagtaccctgtcacttaggtccacccctctttctttgtggattgtggacattttgtttaactgctaaatcatgagaatatatgactgctgagacttttccaaggattttttaaaaaacacattaggctttgtgcagaagtaaagaaaaagtgctgtgagaaccccaggtaggtaatttactttctattgtactcatagtttgtttgaaacctcttcacctctatcccttattgttttatactctgtaaatctgattttacctttaataaacttttctgaagtgaggaaagagtatgttattctctgagactgaaaaaaaggaaggaagccaggtcttggatggcctactataccatgataacataccagtttaagggcacagaagcaagtgaagtgtcttcagcaaaagaattacatacttagattaaaaattttttttcttttactgaagcgtaaatagtaggattttaagtgggaaggtcgcataggtgactatattctcttccaaaaatgacataggtaggcttagacaggaatagtggtgttacagatgaaaataaaggaacatatgtaaggctctttggaaggtagaataagacttgatgatttattgatttgggggtactatggagaaagaaatctattatttttcccagattttgggttgtgcaactaggtaactagttggtacaatcttggagaatcacaggacaaaatagcataggtacggtttctcttaattgagctgttataatttacaaagcagtagaaacaaatacatgaaaaaagtatgtgtaacttcaatagagtttttattttgaatgcagaaatcttcaatgaaattgaatatgcctcaccatttctagctttattcttatcccaaaatatcaaccacagatgcataagctccagggaatcttttgcctgactagaaaaccttatttaagaaaccagtacctctaaacacatatccttgggcgattagtctcctgtgaaacaactgttatttctacacatctatttagaataaacttggatggttgacttttggaatgttctcatttttagaataatagagatgtaggaaaaagtgaaaatgctctgtctgtatctatttaaagtcttgacagcattaaagaaatttattctcttcctgcaatcactcaaatctgagcacaaaactgaaatagcatcgtaaactgacaaagctcaaggtaaagtcaaatctcagttcagggctttgcacacgtattacatagttgtttttgtttcttattctaatttaaacagaaattaaaatggaaattttaaaaatatactttattaatttataatttacctaagttcacattttatttattccatctatatgcttactatgagataaatttattatgttttgaagctgaaagtaattacaattagcatgtctcagaaaatgtcattcaggaaatagtatttgaatatcaagtttactcctgcaaatcagcttggttttgtattcttatctctcttctcaatggaagtatatgaaattaatctcttctctgtggtggcaagttaaagatacctctgacttaatcaatttctacatggcacctttgctaaactatctcccaaaatagtagttcttatcacaataatgctggtagccatgtgactttcagtgttcttggtgagactgaatcatcttgcactctggatatgcaccatttattatgacatcctgctagaacctgcaatccattttcccagtctttccatggagacgttcatgtctttgtttcttaatgtgtagatcctagacaggggtgatagcaaaaggaacaatgaacaaatattaatcatgtgttgttttaggcaaaggctacacatacagaaatatacatggcataaaaaacaaaatccctactgtgatgtgatctaacatgacacaaatgctttagataagtctcctgaagaaggattctagacggttaccgaaatgaaaatataggatattattaataagaaacaggtagctatggatataagcccactgttagcagtgactacaacctctagtttgtaagtgtctacacaagcaagtttcatgacataaggaaaatcacagtgaaaactacctactctattagggccacaaaaaggcaagtttatggcaaaaacaaactgagatacagcatggattatcctgactatccaggatgcctccaacaaaggaaacacacattttggggttcattgtggtcaggtaatggggaggcttacagattggcagtgtacctgctctatgccatggttatgagcagcaccatctcaatttttacgcatgacacaaatgaaaaatatctgtatgatgcatcttggaaaagaaatgatgctgcagttagtgaaaaagtcagaactgtaggagaagacccagatcaagaagataaatgttggccagtaggcagtacctggggaatttaaatgagagtcaataattactgtgaacacaatgaagagattttccaggataattcccatgtagaacacagagaagaaccaaaaaagaaaaagatgcatctcccaagagcttgaaagtccaatcaatacaaatttagataccgcagaattatttactctatccattggccattgactcagtcagtagagaagaagctttagtattctgaaggaagaaagtgaggaagaattgagaaatacaaatgctacacgttgaagtgttgtttgaccataaatgattttgtgggaaatatgtggcaagtgctgaaatatgaagacagaaaacacacaaagagagaaaatgaaagaaagataaatgaattggggaaatgcggtgataataagttatttattaatttattaataaatcatgtgatgataagttattattaataacaattagatcataagttatttattaattattaataacaattagacaagaacagcaaagaaaaaaatcatgtgggaatatggcaggtggagtgaaggattagaggggcaaagaatataatttccctaacggagtgcttctttaccatgcgcatcgtgcagtaattacggctgcttcagtcttactcacccatgttcaacacaacgtcgtccacgtaagaaacagtcaccgtatttgaaatgttaatcgccttaactgtatttatctgcatgtacccttaggggaggtactctctgatcaatcttctttttttttttttgaggcggagtctcgctgggtcgcccaggctggagtgcggtggcgccatctcggctcactgcaggctccgcctcccggttcccgccatgctcccgcctcggcctccccagcagctgggaccgcaggcgcccgccaccgcgcccggctaactttttgtatttttagtggagacggggtttccccgtgttagccaggatggtctcgatctcctgacctcgtgatccgcccgcctcggcctcccaaagtgctgggatgacaggcgcgagcccccgcgcccggcctctgatccatctcttacttcacacagtctcaggcattaatcacacactaagagtgactggccaatgagggaaagagcaattaatcccagaggtacagtagcataaaatacaaagacttactcttccgctggttttccaatacgtgtgattccagccaatcacttgttgacttgttggaggattaagactcactttaaataaagtgaaactcaacccccacaaaaaagagtatctgaaactcagagagagggcttttccatgctttgttaggaatcagagttggtgcttttgagagtt

SEQ ID NO: 665 - DNA, 4985 bp, Homo Sapiens
accagaagcagaggctggcaccatgtttgttatgcagcctgcagaaccgctggggacagctctctgaaaataggaataaatagtggctcctcgataaacaccttcttgcctacagcatgtgtgactgcaaacacattcccacttcaactaatccaagacgagaaggatgacaaaataagagaaatcatgggaaaaactgcccatttctgttttgtccactttgctttgggaagtgagagctatagtcattatcaccacatcccctggcatccaattccgacaatgatctctgaccttgccactaagagtaaaaaaatgtgctgaacacctttactgggatactagtcactgattaataattcaattccagctttcctggaagccagaagtcaaaatatacttgggatttctataaatattttttaattatgaccatcgaactccaagtacttcagatttggaactcggactgctttccttgctcctcagcctgcagatggcctattgtgggaccttgtgattatgtagtgagacgagcatgagtggagcaggagacggctgtcccccacccacaaggaatatcagatgatggttcagcgatcatcacattgcctctctgaaagtgataaattggcagctggcaccagggagaggctatttcctgatggcccacacctgttgcactaagatgttaatcgaatgcagattccagggagaaacaacttcctgggcatgtgcgtaagagacaaaatggcagtaaaaattagagaatgagatcagaatatggatacattgcaagaggtggagccctggaacaaaagtaagagattatgcagtgtcactccccagacatctataaagatttctactgaacaagtcagccatcgaagcagattattcaccatctgtggtcatcaattccaaaggaatttttgtttctggtaatggccaaataagcatctatatgaatattttctacagataataaatataaactgtgaacaaatgtaaaaagaaaaaaaaaagaccagccaaaggcactggaaatgaccctaaaagagcatattctgaagagtagtctacaatagaaaagggaaaatgacactgactgagtctctcatttactttagctgttagactaaaggcagttctaaaccatgccatggatagtagccaaaactgcgatagaaagggcattgtctttctgattttaaaggtgtactagaagagagagtttgggacaaccatagctgctagtaagtgagaatacacactgcacaggaaaagagccagaaaaagagaaggtcgccaacttgaaattataaactgtgtccatgtttttagaataatgactttgtggatctgactccaagcaagtcacctaaggataaaataactgaagcaagacttcagctgccacacaaagatagattttgcagaggtgtgatttcaaccaagtaaattacattacagactaaatagaaataaaagattcagaagaagattacaaaactcatgatctccaaaagataatattcataatttccaacatgcatcctaaattactccaaaacatgaataaagaagaatgttttttattctcaagataaatgaaaatcaacagagactgacagcaaaatgactcagatgttggaattggcacaacaaagattttaaaggaattatgctgagtgatgtaaaggaaaatatgtttgaaatgaatgaaaaattaagaaatcacagcaaagagatagaaattataaaaaatgactacataaagacagtaataaggtgtcttttcaatttatatggaagtacaaagttctagcatattcaaagcaattctgaaaaaaagcatagtttaaagcaattctaaaaaagaatagcatagtttaactataataaatgttttcaagaatattataaagctataggaatcaaaataatatggcaatgatgtaaagattgattagcaaagccatagaataaaatttgaagcccagaaatagatttgcacatattgggggggttatttaactttttacgaatatattaaagcaattcaatgaatgtgcagggaaggagtaattcacatgcctgggttgctcaaaccctgtatatttcccataagcatctttcttcagggtgggcccttggctggctcctcaaaaatgagctccgaggctctggaatattctgcctgagaagagtgcttctgtatgtctgacacctccgtccatgtggtaaaaataatgttcaaactgtttacactaattatgtgttttattgtgaacaactgtttttgtaagcctgagactttagattacaaagtacaagtttaaatgggtagtttttgttaacaatgagatttatggtaagtgtatgaggaactaaaatctcaacagctgaggacagttatacaggtgctgcatgcctacgtgactgacccctaataaaacctctgaagaccaaggcaagattgagcttcctgactggaaatacatcacatgtattgccacacatcattgctgggataataaagcacatccataggactccactgtgggaggacacctagaagcccatgcttcatgtcttctagactttatcccatgtacctttacaatttgctaattttaatgtgtatcttttcattgtaaaagacactaaacatggagatagtaggtttttctgagtctagagaatcttcattctctagaatgaagtggtagtggtcatgaggagtctctacccataaataaaacatatttttaatgaatgatactgaaataactatatttatatggaaaaaatgaatctccacccataactcacaatatacctaaaaataattcaaaatgaattattgaccgaaacatagaagcttatacaaaagattttcagaataaaatatggaagaatgactatttgacatagagctaggcaaagttttcttataggtagataagatacaggacaaatgatgacatatggaaaaaatgatatgtttgactttaccaaaaacaaatcatcagtgaatcaaaatactcacaaaatacaactcctacagcaaaacattataaagacaaacaaccttttaaaatgggaaaaatgtttgaacacacattttatacattaagatgtataagtggataataaacacataaaaactgttcagcatcactaagtaagtagggaatggtacattaaagcaacattgtgatatcattacacaccctctaggaatggctaaaattaaaaagactgaaaacatcaaattttggcaaggttagggccaattaaaattttcatacattgctggtaaaaatgaaaatgtcacaaccactttggaaaaaatttttaaaattttttacaaaacttcatatagatccattatatgacccaaccattctactgctagacatacactcaaaatgaagaaacacgtacaaaaagatttctacaagaatgattttagcagcttcacaacaaaccaggtgttggtcaataggaagatgaaaaatcaaaatatagtatagctataaaatacaataatatttaggataaaaataataaatgcatgttataactaataatatcatgactgaatctcaaaaatattttgctgagttaaacaagctttgcacaaagtagtatattatgtatgatcccatgtatagaaatatctagaataaggaaaaacaaattatgatagaaaagatgttgcttctggtgattgggtggagctctgatggactgggaaggagcatgagggagctttgtgggttgatggtaatttatgtaccctgacaggggtttggtttacatagctgtattcatttgtcaaaacttatattaaatggtgcaattaatattgatgcatttcattgtatgtaaattttaccctaaaataattttagacaaattgtaaaacctagttaaagacatatatgctgatattttcagggttacctctcttgatgtctgcaacttactttgaaatgcttcaaaaggaaaataggataatggatggaaatagggagagagaaatggatcgatgtgtaaataaaacaaatctatctaaatgttaaagcttaattgtagatgatgaatgtaggagtgttgaatgttaaattctttcaacttttatgttgaaaaatcgtcataataaaatatttgaaaaatgtatacattgaaatattacagcaagtatactatttttactgtgattttggaactgaagttactattactgatagtatactgaagtatactatttttactgtgattttgaaactcaagataatttcctgaagaaagttttttgacaattttacttttgaaaattcccattgatctgttagttatcttcaaaacgtctggagaaaagtcaggatatatatataacagcaaatgggcaatttctactgttttcattactttggttttagaattgccactactgcttgcttaatatttaaaatttgctggtcttaaagcaacagtctattttccaatcttggggaagattatggtcgtataatataccagatggacgcattagtactgttaaaaaaaaagactagttgcctatatgaattgcaaacttaataaagaaaatgaactaggaagaatgaaataaaaagttctattaggtttattatagtctacaatgttctcactgtccagaaatagtctactggaatttggagatatttcatcattatgcccttatattgtccctattccttctgtttaaatttttataatagctctttaaaatacgttagttgttaccaccttttaatctatctctatttcatgcaagcaataagataaatgactaaatgagctcaatttaacaacattgtaggcatattctcacactttatcttatagatcatcttaacacactcattgcacttcactgaaataccatgcctagttcttaatatcatttctaaacttaataaggaacaagtcaa

SEQ ID NO: 666 - DNA, 2204 bp, Homo Sapiens
gaaatcaattcaacaacaactgccccggtgcttccccgtagatagcaccgctggtcagttcgggaggggatgggacattgaggagcaggacagtcttcaggaagcttacagtctgctttgggttgtttcaggaacacagtcatccctcagaaatggattgggtgacaagtggtctgcatgctgcacacgggcactgggtctctgaatgtaaccaaattgttctcctcttatcattcccattcactggtgtacttgtttgtggagcctgcagaactgcctttttcaagaatggcagcttggcctctaaatctgcttcccactgatgggaagagctgacagaagctttagagaggcacagggtgagttcctaaaaccagagtcaacacacactcttcatctgttttgtgcttcactccctgctcatcttcctaaaacactgagtttggtcatatcatgtcctacaagttgtcaatgatttcccatgatcttgtcttcaggataaagttccttagtcaaaagcaatgaagacctgacctaatctgtaaggcaaaatcaacactttttagcctggccttccatgcccttccatgcccttcgagcccccagagcacccatggcagtccatctctctctacttgtccagagggacactctcttagagccagtggctcctactcacggttccccgaacacgtcgtgggaatgtttgccttcataccttcccagatcattttcctgatctcagacaccctccgtcctcattcattcactcttcaattgtccaacaaatatttgttgctcatgcaacctggatcacccacatagtttcaagactgcatcttctaaactatttaaatcctatccattcttcaagaaatgtttcatgacgcttccttaactgctaaggacccgcagattctcttcctcttgggactcacacactgactcatctcccgatcttttggtgctcagcaaagtggaggcttctgttttggacttagagtcaagaccattaaataagactatgctctaaaaagtacacctccgtggcccggaacgagtgaattaacatctatgagtttccatttccttgtctataaaattgtgaaattgcaacttaagattagttctgaagattaaatgaggtaacataggtgaaaatgctacatttatgtaagaaattactctttcataaggatgtcaatgtttaaatacgcattttctcaattttgttaatgaaatactttgaaattcttttttctaatgaaacctgctgaatgtaaaagagacccgtactaaagaaagataccacatgaagcaccaagggtctctttctggatctatcatgactcttgtgactgtttcagcagcacagaaattaaaggcgattgttattctggaggaagacaatgagtctcatctatatcttgtttgggttgattttgtaaacagaacattccaaagatcattcttgccttttgtttccactgagaactagaataaagtaaaacaaactatcaatttaaggaaagcctcgaaattgttagcaatttcttcagtaactttcatccatcaactgattttatgaacacaaatttgcagaaatgggcaagaaaaactacttaactcattggtgggaagcagtgggctctctaaggagggagagatagcagtgatttcaccaccggaccgtggaacacaaagagcctggaagagtctatcactttcaactgaaaccgcaagaagaactaagtaggttaagccctaagaatgttcctaggtaacctacttgagttgaaatttgactaagaatccttacaccctacctaagagaggtaacgctattaggatcggaagtgattggaagctttgtttcagatctcgtccaaaagggagaacggtcaatgacaaagctgctgtgaatagtattctgggggcgtggtggaaccccgattcactgctatctcccgaatcagcaacttgacagagcgcgcctcccgggccttggaagccttccattccgagctggctgggtgggactcaggttttacggtatgctggactttttccccgtgagttaaaacacatttatagtaactaagtggttaatgatgagaaaaaaccccaaactactgtactaataatcaacctctgctatttggtttgtaaaaaacaaaaatacatctataaaaagggttggccgg

SEQ ID NO: 667 - DNA, 5819 bp, Homo Sapiens
aagtggaaccggagcccgggcgcgggcgcccacgttccattcccgggaaggcctgggaagggagggaatcgctcacccgccagcccgcctgcagggaaagggctcctggagctgtcgatgcctgcccgacgctgagataactcttgggtcccagttatccaccagccacttctgcctcgattcaccaaagggcagggaaagaaccttttggtgagatggtgtgaattagcgacatccagcctgagctgaagtctccagcgggtcaaagaaatctttccatttgcaaactaccaaggctgacttgctgtgcatttggcgggcctcctgcccctgattctgctggtttggagatgctttctcgctctttggttggcttctgtctccacacattgtggggatcccagggattcgtcataggactctcggatcgctggtgcctccactgtgatctccggtctccctgcggccagcactgacttctagcaacagaatcctgcatgagggcctaggcacagaactttatttccactcttctgaacacatctaatgtgatgctctgcaattgtctgaaatttatcctaccctaagtcattatcttgtccccttctctggaacctgcttcacttcccgtatcccaagttctggaagctggacggtccaagatcatgctgccagcagatttgtggtctggtgagggtctactttctggttcatagactgcacctcctagctgtgtcttatggtagaaggggcaaaagagctcccttgagctgcttctctaagggcactaatcccatttgtgagggctccagccccatgatgtaatcacctctcagaggccccagctccttataccatcactttgaaggttaggatttcaatgtatgaattatggggggggaacacaaacacccagaccatagcatgtggaacaccgtctgacatgtacgtgctaatagtgttagaagtagtctttgctcttatatcttaattatgataactgttttcatctatgataattgcttttgtggatgtctttgttagtgttagaagtggtcttagctcttatatcttaattatgataactattttcatctattataattgcttttgtggatgtctttgttccagctaggctgtgagtttctggagggctccatgccaatcctagaggcttctataacaaatacttactaaacacctactatatgccaggcacaatactaggagagacggcaattcattaaataggggaaaagcctagctctcatagaggtgagcttatattttacagggtttgaggggatttagaagagagattgcccaggctggcatgggtagggaaggtaggtagggccagatcataggaagcctcagatgtgtgttaaggagtacagactctctatagttaatgataacataaataggccttttttttttctttctagagtgtcagttcctatttaaaacaaaatctgaaatcttcctgaaactatatcctcacccttaaaagaattcaaattgattggaaatgtgtctgcacatacataattcagagttatatgtgtgcttacccaaaattttctttacaaattattgcaagaaatgtaatcattaaaaattcgcagcaatttttgtgtaataccacttaaatagcatttggtccattgcaccctaaatcttacattttggagtttcaatattaatttcaatcttaattttcataaacccaacaccagccatctaatatatttcctgttcaaatacttattcattccttctggcttactaaggttcccttttgtgcttttatgttaatttgtttctcccctttagagtgcccagcttttgctcaagcaggccctgaggctgtaaatttctctccctacccacggaattccttcctttaatacccatctgaagaccttacttctaataagaaattttccattattaaataagtgacgtgcacaaagtttttttcatctcatttccacaatcctgttgtcacattacaaatttccatcatctgtagcatctggaaataccgagtgggatagataacatggcctggctgctgtttgttttttttttcatcagtgtgctagatcttcctggacacgctgcacaaatctcacctcagtcttagtgccaccgtggacgctggaaggagccattttaaaaggcaaccttaaacagttcagtctaatttaatattagtggcctccacacctctgactcttgtattattagaattgcctgtttggcttttattttccagtgtgaactgatgaaacagacacaaagtgaagtacccgttggtttcgcggtctccacctcgagaggaaatccaaaaggagtttctggcatgtgtggtgttgcttagcaatttacccaaacaaacatgtttcctcctcatttttttccccagtacttatttactcaagaacattgtaaaatcaatttttaccacttgacatctgaaatcattagaagaaaatctggtgttttgggctttatgagaagaactgctaaccacacatgaatgcagtatgctgctaccacaaattacgcagttgagtttcccacatttggagaaatcacagggatcagcaagtcttcagtggaatagagaagccttgccctagggaaaactacccttgtggtcatggtatctaccctgcctggtgaagaaggtccttgcttccccttctccttccgccatgattgtaagtttcctgaggcctccccagccatgtagaactgtgagtcaattaaacctttttcctttataaattacccagtcttggatagtagctttatagcagtgtgaaaatggactaatacagtagcctttgacctttcttcttaaagataaggatattagcaaatgtaaactttttaccaacaaacaccttttaaaataaatatcttttacatttgccaaagtctataaactttcattttgtggtacaacagtaaatataacttattttatatattttaatttttcattgttcactaccagtacttttttaaaagtatattatctttatagatagtcattaacatattgttaaatttatattttatagaagatagttcctagtattgtttaatttgtagagataaaagagaaaatatgcagatccaacttctaagagcattcaatattatacaccaagcttattcctgaaaacaatgacccagaaaaccacatgaaagagttttattatggatatcctaaaacaagtaactataagtttcagatatatatagaatattccacagttcctataataaaaattcatgagttttctgatcaccttcaatgtttgtactgagttaacacaccgctgttacattaaagcaaaccattaaaaataaagctagttttctctctttttttcaacttttattttagactcagaggtatatgtgcaggtttgttacctgggtatattgtgtgatgctgagatttggggtatgaaagatcatgtcatccaggtactgagcatagtacccaatagttagttactaccagtactttactaacatgaatttttcttccttgaatttttttctctttatttaaaccttctggagtagattttttattaggtgttttttttttggtttgttttcaaagaacaacccattaatgcttcattattccccaaaactgtttaaaattaagaaggcctttctgttaccatagacataaaacgaatggattgggcattatatttttcagtttaatcttttctcctcctctttaggattttctaaatattcctccactttcctctgccattaaatgttgttatgggaaaagtaggaggtcagattaaacccattgtttttctctcaggctgagtagatgagtattttattatgattattatttggcccaaaagttatgtctgtttagtgaaattattattattactattgttattgttatcctgctctcagatacatctttctgttgattattcagcataattatttacctaggagatattgtgcatgtttaatcagcaaattcaaatttttacttattttaacaaggttttcttcttttataatttcaaataatctgctgtttcattaattctgtaaatttagcaatacctattacgcatatgttgagctactgtgtcatgtttctgtattatctcctttctaatttctctttctgtcattttctatttttatttttaataggatttttataaatcttgaccttcatattattgtaccattcatgattttgtggttttaaaggtggcttttcttttcctaattatttattgaaaatctttaattcctcctgtgaattctgccagctcacttttcatttttccatggtcatgtattttattttatatttttcattcttttttaaagttaaaattatttttaaaggatttctgttcctggctctgatggagcaacacggacagatttaccctcttacttaaacaaaatacagacaaaatttataaaggatggttctgaaacatgggacaacaggcagtataaacagtaatttttcaaagaagataaaaaaaggaagtaaaccctatggtttctctactgattccctagaaagagatttcaagctatcagtctcactcaattgagaagacagagttcattgagaatttggggaaagtcaaagtggacagaattcacaaagaactaaaaaaaagagtattgtgcagagaaagagctccagctacctccacagagtttcccttgagttttcagatcatgcgtttggtgaacccacctgaggcaagggaaagaactaccagaaagaagcaggtggaaaaattcctgatgttcacatagaccgggaaatttctcaagtttttgtcatctgaattgaagaaatcttatactgtatgaggtgttgaagagaatactcagaaggacaatgcctccgtagtaggaccaaactagcctagagtaaaggctggtctgtcttgtatgactccttgtgaaactattctgctgagtatgtcaccaattttcttagcgaatctaagtgattccaagtaataagttgaaattttcactatttgtatgtttttattgattattcattgtggttctaatagtttttggtttataatattttgttggtctgttatttgctgcatagtggtttatgatagttatatctttattggatctttaacaatgtagaataagttctttgtttcatttcatgttatttgtttctaaattttacttcttatttaacagtaatgttgcaaatctttaaaaatgttttactttatttgtaaggaaaacacctaaagcaaagtgaaacaataagtgatgtaggatctattattattattttccatcatgtgaatctttgtcttaacagagaggcttcgtctatttatatttgttgttacaattgatttctttcatcattctgttatttcagtgtttctcttgaaaaataggttcttgttattcaatgatttagttttcactttatgtatcgttttctttattttgtccttcatattttgcaagctatatagcctctgttaaattccattaatggatatctttaagcactctttgacatgtaattttctaatgtctcagtaaataaagaatttgtcaacataaaatgtgtgtgtaggccaggtgcggtggctcatgcctgtaatcccagaactttgggaggccaaggtgggtggatcacctgaggtcaggattttgaaaccagcctgaccaacatggcgaaaccccgtctctactaaaagaatacaacacttagccggacgtggggg

SEQ ID NO: 668 - DNA, 9609 bp, Homo Sapiens
gcgccgacgctcggacaccgcccccgagtgcgaggcccggcgcggaaccggcagccgagagcctggcgggggcggggcgcaccgcgccgctcccgggagtctccgggctgcggtcgcggaatacgactttgatccgcgggtgagggctctgtgaatgggcaagcaaagccctctgactccgggcctcgtggctgggtgctgtgtgttaagcgcctgcgctgtactaggaccgggcgtgccgccgtcggcaaaaagtgacgctttcttgaagcacaaagtccaggggggacgaccaagcggacagcggatgcgtcctgcgccggtagccaggcgaccggtggaagagcagagtccagcgcgggcgatgcggcggggccaggcttgctgcgccgcggggtgattgggagaagagccttcctgcggggtggaggacgaagagctgccctgaggaggtcccggagtctggtgggaacggcctcttcgggactgctccgagagacggtgtgcagagcctggcgtgctcgccgaggtctgacaggcagcccggggctaggtcctgttggatttttttttctaaggaaaatgggaagtggtggtagggtttgagcagtggagtcccgggcagttttaaaaggatccctgcagctgccggctgggagggcgtgggtgcgcgtaaggccggaatcacagagaccaggtagaagatgattacgagaacccaggaacgtggccctcaggaggccggcagtaccaaggggacagcagctgggaggagagaggcaggagatggtcaggggccagaccagggaaggccgcggagaccgcagaattcgctctgaatgagtggggaggcccttggaagagtaaggggtccaacttaacttttttttttttttttttttttgacacagagtctcgctctgtcgccaggctggagtgcagtgcgatctcggctcactgcaacctccaacaccccgattcaagcaattctcctgcctcagcctcctgagtagctgggattataggcacgcgccacccagctaattttttgtatttttagtagagacgggttttcaccatgttggccaggatggtctcgatctcctgacctcgtgatccgcccgcctcggcctaccagagtgctgcgattacaggcgtaagccaccgcgcctggccaccaacttaacttctgccaggatcatgggaagtggtagggtttggggtctgatttcaagagggagctgctgtggagtatcagcacagcttactgagatatcagaaaggccttggtaaagagccctttactgagacagggagcacattttggcagaggtttgaattggagcgtgttaagtgtagtgtcttcttcaccactgtgacgtgaggtcctggcgcaaataattgagcacagaaatacatgtcaggcattgctaggcacaagggtacagccagtgagcagggctgccatggtccctgccctcttagagctgaccttcaggtctgagggagactgaaaaataagtaagaatacctccagccgggcgctttggctcacgcctgtaatcccagcactttgggaggccaaggtgggtggatcacctgaggtcaagagttcgagaccagcccaaccaatatagtcaaaccccatctctactgaaattattaaaattagctgggcgtggtggtgggcacctgtaatgccagctactcgggaggctgaggcaggagaatcgctggaacccaggaggcagaggttacagtgatccgggatcgcgccactgcactccagcagcctgggcgacagagggagactccatctcaaaaaaaaaaaaaaaaaaaaaatacacctccaatgctgaaagctacgaaggaaacaaaaccatgtgcgagtgatagggcagcccctctgggaagtgacatttgtgcccagatctgaagaaagaaaaggagccactcatacagaaagactgagacaagatgagctttcgggacaagtcaggctctagggagaacacctgacgaggaaaatgcctgggcagtttgaggaactgaaaagccagtgtgtctggagcttagtgagggaggcagagagcacgggaggtgtggttaccaaggtaggtgggaccggctctggccctgggtaaaaagtttgactttcattccaagagtaatggaaaataatgaagaattttgaactcgaggtggtgcatgcctgtaatcccagcactttgggaggctgaagcaggcagatcgcttgagcccaggagtttgagattagcccgggcagcataacagggcagcatctctacaaaaattttatttttggccgggcgcggtggctcacacctgtaatcccagcactttgggaggccgagggggggcagatctcctgaggtcaggagttcgagaccagcctgaccaacatggcgaaaccccgtctctactaaaaatacaaaaaattagccgggcatggtggcacgcgcctgtaatcccagctacttaggaggctgaggcaggagaatcgcttgaacccgggaggcggaggttgcagtgagccaagatcacgccacttgcactccagcctgggcaacaagagagaaactccatctcaaaaacaaacaaatccagaccagcctggctaacatggcaaaaccccctctctactaaaaatagaaaaattggctgggcatggtggtaagcacctgtaatctcagctgcattggcggctgaggcaggagaatcacttgaactcagaaggtggaggttgcagtgagcacagatcacaccactgcactccagcctgggcaacagagcaagactctcaaaaaaaaaaagttttgaagggagcagatccactttaaaagctcacactggttcttgagtgatgaccaaatggcactgtgccttatgcagagccgactcctggcagtttgcacaggctggaggtggagctgcagactccctctccctctcggccttgcctctgtaaatgggaaagccgttgacattcacaaaagaggggcagggaactgctacacaagagcagctacacaagagggtcctttggtccacacaggaaacaagccatagtgatgacatattttgaagctgttagatgttttgtttccctagctggctattatttttgtatggcttgtctttctcttttgagtatgtgtgagaacaggatgggttaacattagggaagagcacagaagaggaaggaaggaaagaaggaagggagggagggaaaggagagagaatagggatgagaagctcagcttgtagaattggcaggtgatgtttgcagtcattaatcatttgagaagtagagagagaagccaagcaggaaatcttcatactggaaaagaagtgctcaccattaaaaaaaaaaaaaaaaaaaatccagtgtggttcacagctgtaatcccatcacttggaggctgaggcaggagaaatacgtgaagccaggagtttgagaccagcctgggcaatataacaagacccacatctctacaaagagaaaaaaaatgtaaaaaaaagaagctttaaacctaagacggcagaattcaagactgttgtccttgagaacttcctggctctggaaaaagctcagtgagttagtctcatcctgtcgttagctctgttttttaggggctcactttgtcttcacgacagtaccttgcaccattctcatgggtatcccagggtggtgcaaggcagttttctgcacttcccagaatgccctgtcagctggcttctgggtaggttctgcaaattggaggcccctgtgaaagatcgctgtggggtgggaggaagaagctttatctgcctgctggctgcagggtagaggactgcagtggggttatagggatcaccacctgcacatgtggagctttgagcggcttcactctaagtttctgctcaacagtggcagccctggagtccttcgggggcgagtgtgggctcctgggctccaggccaggggcagtcccagcttcctgatctcgaggtagcgtctcctcccttttgctccatagcacctcgcccttctcagtgacgtgcctccttctcagtcatgcgcctccagctctaacaatgtccttgaaaacaattcttgaccatgcgccgtggctcacgcctgtaatcccaacactttgggagtctgaggcaggcggatcacttgaggtcaggagtttgagaccagcctggccaacatgtaatcccagctactccctccacttgatttgtgttccttgaagaaatttgcataatccctgtatctggttggcagatagcagagatgtagcctcagtctttcctttaaaaattttgctttaggcagggcgcggtggctcacacctataatcccagcacgttgggaggccaaggtgggcagatcatgagagcaggaatttgagatcggcctagccaatatggtgaaaccccgtctctactaaaaatataaaaattagctgggcgtggtggcacaagcctgtaatcccagctatttgggaggctgaggcaggagaatcgcttgaatccaggaggcagaggttgagatgagccgagatcacgctattgcactccagcctgggcaacagagggatactccatctcaaaaaaaattttttgctttagggccaatcgtggtgacacacgcttgtaattctggcactttgagaggccgaggcaggtggataatttgaggtcaggggttcgagagcagactggccatgatggtgaaatcccatctctactaaaaatacaaaaaaagccaggtatggtggcatacgcctgtaatcccagctactcgggaggctgaagcaggagaatcacttgaacccgggaggtttaggtggcattgagccgagattgcaccactgcactccagcctgggtgacagagcgagactccatctcaaaaaaaaaaaaaagggccggacgcggtggctcacgcctttaatcccagcactttggaaggccgaggcgggtggatcacctgaggtcaggagttcaagaccagcctggtcaacatggtgaaaccccgtctctactaaaaacattaaaaaattagccgggcatggtagtgggcgcctgtaataccagctactgaggaggctgaggcaggagaattgcttgaacccaggagacagaggttgcagtgacctgagattgtgccactacactccagcctgggcaacaaagcaagactctgtcttaaacaaacaaaaagcccagtgtggtggtgtatatttgtggtcctagctactttgaaggctgaggtgggaggattgcttgagtacaacatgtagaggctgcagtgagctgtgattgtgccactgcaccccagtgtgggtgacagagcaagaccctgtctcaaaataataaaattaacattcattaacaataatgttaatatatatgttaatgtatatgttaatcgtaatgtttatattttaccatgataaaaacattttaaaatcatatatcaactcttgccgttctcctgttgaaaactctccaatgacttcccactccatcatcctgtgggatgggtccaccatgctggaccacaaggctctgcacaatgcggctcccaccagcctctccccttggcccagattgcttcctcctacccctttctctagctgccaggccccccaacccccgcatggagcccttcagcagctctgtgagctccctgcctgttggcagccatcacagcaacgggctctggtgtgccccttgttatccctgtattcaggccattatctgtaatgacagcctggcataattttattttcacaatttgtataattatattctattgagctaaatgatcattataatcattattaaatatttattaagcacttctagctgtgcaaacataataagatgtggcctcagctcttaaaatctttcttcctaattccaacccaaattcatttcaacttaaccaatcttccttcttggagaaggagggaacttcggcgttttgtctgggtttccatgcccgagcttataggagcttcttagcaatgctgtggagcagatgctattgacttcagtttacagataaggaaacaatcagactgaggaagctagtattaataagtagcagagattaagatttgcctgtggttcttttttacacaaagcctctcccactcctttcatgcactgttagccaagtttactagaataggcaacttcctttttaaaaaatcctgtttacattttaggtgccaaacactgtgctaatccagtgggggaaacatatgctcaaaaagatcactctgagaccaggcatggtggctcatgcctgtaatcccaagcctttgggaggatgaggtctgaggactgcttgaggccaggagtttgagatgagcctgggcaacatagtaaggccccttctgtacaaaaaatttaaaaactagccaggcctggtggcatgtgactacaggctgcagtaagctatgatcgtgccactgcactccagcctgggtgacagaatgagaccctgtctctaaaaacaaaacaaaactcaagcagtatcctaagtcagggtccaagcagtaatggaaatgggtgaagctgacaggcgagtgatagagaatggaggggtctgtagcaaacgtgacgactctggcttacctaagagggcagccaattttgccatgaggcaatgtgggatcagtgagtgctgttccagtcttcaatttcgatttataagtaaaatctccaatattttatatgttggcaactttggcattcctttccttaaacctcactgccaccccgcaccccaattcatttcagtagggatcagatagccaacatccttataaaatcaaaagtatacaggccgggtgcagtggctcacacctataatcccagcactttgggaggccgaggcaggcggatcacgaggtcaggagatcgagaccatcctggctaacatggtgaaaccccgtctctactaaaaatacaaaaaaaaaattagccgggcgtggtggcaggcgcctgtagtcttagctacttgggaggctgaggcaggagaatgttgtgaacccgggaggcggagcttgcagtgagctgagatcacgccactgcactccagcctgggtgacagagcgagactccatatcccaaaagaaaaaaaaaaaaaagatacaaatcttaattggcataaaccagtcctagtaatatcatgccctttggccagtcgttggtcacagggtgagctaatgacccaactctgacaaattacatgtaagaggaatactgctaaaaagatattttcggccaggcgtgggggctcacacctgtaatcccagtactttgggaggccgaggcgggcagatcacttgaggtcaggagtttgagaccagccttggcaacatggtgaaaccccatttctactaaaaatacaaaaattagccgggcatgctggtgggtacctgtaatctcagctactcgggaggctgaggcacaagagtcacttgaacccaagaggcacaggttgcagtgaaccaagatcatgccacggcactccagcctgggcgatacagtgagactcagtctcaaaaaaaaaaaaaaaaaaaagagtatcttttcttcagtaaaaagacaaagctgtttgggtgcagtggctcacacctgtaaggagaattgcttgaacccaggaggtagaggttgtagtgagctgaaatcataccactgcactccagcctgggcgacagagcaagacactgtctcaaaaaaaaaaaaaaaaaaaaaagacaaagccttgagggctgaggaagaaatgtggaaactgccctttccctttgttcttgtctaatgcagtcacaaagtctggagcagtagcagccatttttcaaccatgaggcagtaagcatgaagcctaaaaccagcatgccaagaaggacaaagcagaaagactgaaatctctaaggcccttgcagacacccttactgcatcagttccagacttggctcccatagctccagatgtggccatggccactgtatatgtaagcttgatggaataagcactaatgcggcaccttagagctgctggaaaagagaccaatggacatgtacgaatgggggatcctgccatttgccgagtaaaggcctcctgtgtagaaggtgtcctttgataagcattcacatggaatacaaatctccactcatctctccccaatccaaaaggttcatccacaccccctctccagaccttcttgtctttctgtctccaaacatgttctttccaagtttctgaaccttcaaagtgttagtgactgtccgtgaactggagtagacccaacccttctggctttcttgcttgctttttttttttttttttttttgagatggagttttgttcttgttgctcaggctggagtgcaatggcgcgatctcggctcaccacaacctccgcctcccgagttcaagcaattctcctgcctcagcctcctgaatagctgggatcacaggcgtgcgccaccacgcccggctaattttgtatttttagtagagacggggtttctccatgttggtcaggctggtctcaaactcctgacctcaggtgatccacctgcctcggcctcccaaagtgctgggattacaggtgtgagccaccgcacccagcccacttccctgttgattctgtctctctggaagaaccctcactaataaactttacttgaccttcaaaataataatgctcaaaagacaccctcatttggggtgccagagtctggcatttgttctctaccagtgcctggtagcaaatctgaagctgtgtaatgcttaaatggagaatagtcattttcagaggagggtatatctttgctctaaaccccttggagtctgtgctgtgacttttattttttatttttttttttgagacagagtcttgctcttgttgcccaggctggagtgcaatggcgtgatctcggctcactgcaacctccgcctcttgggttcaagtggttctcctgccccagcctcctgagtagctgggattataggcacccaccaccacacgcagctaattttttgtattttttagtaaagactttaaagacatttcaatttcaccatgctggccaggctggtcttcaactcctgaccttaggtgatccaccgcaccttggcctcccaaagtgctgggattacaggagtgagccactgcacccagcctgtgctgtgactcttatactggtccctgccagaacttacaggagcatgacctgtcacggacaacctgagcaccactggatctgcagggttatctgtcaaatgggtcggagcagcatactcaaatgtggtcgctattatctctaaaagtcaaggaaagccagcagtgcaggacactcaaatccagacgtcattccactagctaagctaagcaaacagttggagctatcccagctgtcgaagctaacacgctgcatttagactctcttgcaagtcagctgtgttggtaactagaggctctggattgacacattagaatccactcccatacattccccaggttttggctggtaaaaattgattgatatcccataattccttcagcatgtgaacttctc

SEQ ID NO: 669 - DNA, 1851 bp, Homo Sapiens
gtagaaatgagcaattgcaactagaagagcctgtgtgcccacaatcaagggtaaggaggagtgtcatggagcagctctctactgccctgagaatgacatccccactgttcaccatggccttaaatcccctgcgaattccacctcatcctctgccacttcccgtcactgctctgaagatgccctgatcttgtttcagtcccttggatgtacccagctcttctccatctttgcatgtgtcatagcctcttcctggaaaacccttcctgctgctcatcccagaactgactctccatgtatttactcttattttgagagaagggggcatttccaccaccagaagggaacttgctgtcttggtagccattgtcccctgacacctggcacatctactctatacagtcaccattcaagtggatgttgaatgagtacacttgtttcacagtttggttgggtaagccccaaagcttggttcccggtaggatcaggctttatgagtgggctgagtttctataaaagtctccctaccagtttccaatcttggtgaaactatgtctgtgggcacaaatgagaaaacttgccattcgtatcaccggttacccagctgtggaccatgtgggccaggtccacagaagagccttatcctactttcactttttatttcctgcagtcatggggacagtggggcaccaccttttcagaaactctaagaaagagtgttcatgaaagtggccagagagttttacaattttgccattaggaatgattaaatatccatgactaatgcctctgtgattaaattgtattgggagttccaaagtttgctttttgtgctttaagagtaaaatgagaagaaagcaactgaacttctcatttagaaaatatttcttctctccttggccaggtgcagcagctcacacctgtaatcccagctctttgggaggccaggcagtgggaccacttgatgccaggagttcaagagcagcctggccaacatggtgaaaacccatctctactaaaaataaaaaaattagccagacatggtggcatgcacctgtagtcccagctactcgggaggctgaggaaggagaattgcttgaacctgggaggtggaggttgcagtgagccaagatcatgccactgcactccagcctggacaatagagcgagactctatctcaaaaaaaaaaaaaaagtaaaaaaaaaagaacatttcttctctcctggacccagaagcaccttccagacatgaatccaggaagtaggaatgagagctgccactgcagggtagaaaatgcaagtaaaccttatacgagatgtaacacccaggcagggtgagcctcaggaaatgggaacgctccaatggcacggctcatctggactgggccactctgagtgccagaatttgtataacgttttagatttgcttagatataggaatatacaagaaggagaatatataagaggatttagcagtggttatttctgagaaacagggagtacatgtagttttgggtttttttcttagctggatttttttaagtttctaaaatgaacatgatttacttttggaattttttaaaaagcattgaatatttaaaatttttaaaataataggcactcattaagcaaaaaaattataaaacagtgaagttacaaaggaagaagaaaactgttcaaatctactatttatgtttggggtttttaaaaattgtattttttaaaaaaataaactggtttgtcttatttagcatagctataatgatactgtatataaaatatttttgcttgcattcttcaacttatttcattataagtactttccatgttattacttagtctttacagcactatt

SEQ ID NO: 670 - DNA, 3134 bp, Homo Sapiens
ctctgcactaatataccagatcctaaaatgcatataaggtggactagcatcttaattctgctagttgattgtgtctttactgaaaagaacccagctaccaatttgcctttttttacaccacaaatcctaattagaaacttgaggttttatagaaatcatttaatgatagagattacatatgtgaattaatgtgaatatagtatctgtgcttcctgtgtctatgactattttaagatataattgtgctgcgctatcagattaacatttggaagtttctagaacagttaatgctatttacagaaaggagtagaaactcatcaactggcactctctttgatttttatattttaaattaactctcttcgatctcaaagtatattttacgagtaattttattaggaatctcttatagtgccccaatgggataagctatttgcctattttcacagttctgaacttggaaagaagcaaagtatatgtaactaaaccacatatttgtctttttattgctttttcccttcttttatatgctaaatcaaatatagatttgtggatagggaagcaatatgtgaatcacaatgtagcagaggcagaccaagcattacattattatttagagctggactgcaccaattacttgtcctcgtgccaaaggcaaatatgtttgcacctttttttttttttctgattctcaggttgattaatactgctaatgcaaatgctcaagtagatgtttaaaaactttacaaaatagattcaagtgatactttcttttaaaagtgaagagttgatgattacacatagtaaattcatgaactacagtaggtttgtatcaaacaattttttttaatgaaaatctgttgaggtgtacacaatatgcttcttgattgtattagtccttggtctctgctagacctcatgagtttcatcatttagaaaaggggtagaggatgaactaatgtctccttcagatgtaaacatgaaatacctagagttttacttgcttttcaatacactgaataattttaaatgattctgacactgatgtagaccctttgacttataaattctgaggaaacaactgacagcataaaatatttacattcttataacacagcacagtgactttcttctttcaagattgtagctcagagaaaagatacaggattcaattgggggttcaataggatagaaatggagagattcctttgtgttgtagtagaggcattttcctaaggagtatagatttatactttgcattttcattcatcatcccccagaatcatggtcaaggtgtaggtcactccacacagctgatgctcaggttattcccttgtgagaattatgagaataaagctcccaagatatgtgaaagtgcttaacacagtacctggcacacagcactcaataaaagtttggctctattatgggatggttcaattctggtttaaggaaggaagaaaggttattatatatgtaccactaagcaaatatatatatatatatatatttggggttttttttccctaatattatttgggtgtcccctgtgcttctttaggatgtagttataactaaacctgttatacttgaacatcactaagagaagtaaattattatgaagctagcaaaaatcttgaggccaaagttgtttcttaacagctttaataatgcttgttgattttgaataatcctttaaaaagtggaccatttgcttattttaatatcacgtcagtaaaatgttagtattaaaaagatcagctttttatggcattgaagaatgtatctgctaagacacaaaaattgcatggtaagtataataggtggaggaggaaaggttgtaggccggatgaaaatttaactgactagaacatttattcaggagtgtaattattttcccttaccccaatccctgtgtacgtgttgggtatagttacgacattatccggatttgcaaatagacacaactttcagtcttaccctgtttattgtttaagagtgatagactgttgtcctcttgctggtggaaaatctaaggtggagcccactcttctatgctgaagttcaccaggcagagcagttttcttacaagtcagctactctgcttggtttattttaggttttggtacttcacgtaagcactgttagaaggtacaagtgtattaatatcactagttttgaggcgcttgggtacatttgtttttaatatatttagaatgtgcagtaaacttttttctcatttttttttctttttagcaaacttgttattttaggtccaattattgagttgacagtctactgtgagaatgagatgacatatctactgtgagaataccataaatgatgaatagtttatttgagaacttttatactcagtggtgttttatatattaagataaaaatatgtacacacatgcatgtcacatctctctactgtggagttaatgtgaatttttaaaaaatggaattgcaaccacaatcatatctaagagaacattcactcctagtgagggtttacaaaagctactaagagaataaggtagatgataatgcaaagggtcatgatttggggttatttttgttttattttaaaatttatactgctacttttgaaagaattgtttttatgactatgctctttttgtgattgaaaagtcatctaatagaagctgtatagaagctactttttaattgctggcaaacagctttaagtgcactttctttgattacacttccattttttgttaaacttgaattttctgaagccttttatgtaccactaagcaaataactttaacctttaaataaagcaaatttacatctttattgtatttctacttgttacaaaacatacttgctaaagtaacttcagtcctcaaatatagctgggaaacaattatgagatagactcagtctccccctcccaccccttttcccctgccatatctaattaagcactaactgattttattactttattgcctttacactgcttattctttttgactgaattctgtccctgattcactgttttgtttgaaatttaaagttattttcttactgtatttatcatacctgttttaatctgttttctttaaatgcaataaatcccaaatggattgcatattctttat

SEQ ID NO: 671 - DNA, 24702 bp, Homo Sapiens
agctctgcccacttagagatattcccctcactactgtctttcaggacactcctaagtgattgcctgtggcacttgcacatcaggactgtcacctttgggtccccccaaaaactagggcagcaatggaaaaagggcaggctaggccaagagtgaggaataaacagtctttattggctttggactaggagtccttgggtcttgagtatctctgtgtatttgtcgatattcttcagattcttctcagcctgtttctgcagcctcataaactgctccttctccctttgcccctccccattctttctcctaatggatcttgaccttctccttcctcttctcctccagaatggctgtcactggttggtacttccaggcaaatttatgaaccaggtgccccaggtaggcaaacttcagtgtgggcttcaggtgcacaaccttgagtagagtagaaatcaccatccacttttgcaaagggcagggcacagggggtgtggatcccatcaaataccttgaggtggtccaggtggccaggcctcacttggttttatggggcaatataccactcatggttcagccaaaagatgcagttaggtgcccgaaagtagaagagacccagaagtggtagggtctaaagacagagttggtgctcctggtcttgtggaaggttagatactgaaacttgttcctgtagaagttgacaaaaatgctgatgtccttgcagtgcaggacctccagcttcctgcccagcagtacttgcttggccattatgaccaccaggcaactcaggagaggcctaggccatcgatcaccagaacctgccccttcaacatcttcaacagccacttggaaaaggccaggaactattttaccaaagggatttaagtctgcactgcagatggcatgaccttgcttcataaccatagagatctgtgttgtgattcttcgaatgggatttgatgtaaacttttttatttttacaaaggcaaggaaattcaaacattgaaatgcttaagaaaataaaaatctttccaaatcctataactggagacaatttgtcgattcatcaatatcctagtgagcattattttaaaccttttactatatatttatacaaatagaactacgtctgtaatttattttttatttattatttactctgtttatagagacagggtcttgctctgtcacccaggcaggagtgccatggcagaatcaaactcactgcagcctccaactcgtgggatcaaatgaccctcccacctcagcctccccagtagctgggactataggcacaccaccacatctggttgttttttgtttgtttgtttgttttttgtagagatggtatcgctgtgtttcccaagctgaccttaaactcctggtgtcaatcctccctcctcagcctcccaaggtgctttggttataggcatgagctactgaacccatccaaattgctgctttttgattaaacactatttttatataacataaattaaccagtttgctatagataattcttaattgagtggtactgccctctagagtatgttttgtgtctcgactatttacatgatgaaatacatattttgttataaattactgcttttttcacattacagttagtatattttgttgtatgtacctatgactttcatttcaggactgtaagggagtgttacaaagtatttattataaaaagggcatgaagtcagctgggattgagaagcactgcttgtagatggacacagagtatcttcaattttcaatactaaaaatattctgatgaacatctttgtatattcatgttttgcagtgggtttgttaggccaaatggtacacatgtgcagaaatttggcacattgtaccaattcacctatataccaacagggcatgagagtgccagtttcctcatatattcaccaacaataatgttgccatggtttggatgtgattattttgccaaaactcatattgaaatttgatccctgatgtggcagcagtattcagaggtgggacctacttggggatgtttgggttacggggacaccactgtcatgaatgccttccggctgcaatgagttcttcctttctcaggaatggattattttacatcagagagagcagcttgctaaatagtgcctgggttccttggattctctctcttgcttcctctctcaccatgtggcctctttgcatacacctcccccaccttccactctctaccatgagtgtaaggaagcagtacaagaccctctctagatatagctgcccaatcttgcactttccagccaccaggatcatgaaccaaacaaatctattttctgtataaattatccagcgtcaggtattccattacagcaacactaagtggactgtgacaaatgtagtcctcttgcatatgccagtcactcttcccttaaaaactagttaagattttcttaaaatttctattctgtgtcttggggtagagtccttcaagtgattctgaaagttccaggattttactttatttctagtaattcctgggtttaatttctgactttaattgatttctcttttccattttttaaaaataacagctatactgggatatacttcatacactacacaattcacatatttaaagtgtacacttcagtggtttttagagacatgcacagagacatgcaactgttactacgatcaattttagaacatgtttttcttttcttttcttttcttttctttttgttttttgagacagggtctcactcatttgcccaggctggagtgcagtggccagtctcggctcactgcaacctccacctcccaggctcaagtgatcctcccacctcaactgcccaagtagctgggactacaggttcacagcaccatgcccagctaatttttgtgtttttggtagagatgaagtttcaccatattgcccaagttggtctccaactcctggcctcaagcaaaccactgacctcaacctcccaaagtgttgggataacaggcgtgggccactgtgccctgccgcaatatttttttcatcaccctctaaaaccccatatacctcagcagtcactccctattttctcataaccccccagtcctaggcaaccactaatctactttttgggtggatttaccctttctggatattatataaaaatagaatagtcaagtatgggggcttttgccactggcttcttttacttagcataatgttttcaggatttattcatcttacagtatgtagtagtacttcttttctattgttgaataatagtctgttgtatatacatatcacattttatttatccactcatcagttaatgaacatttgggttgtatctacattttggctattatgaataatgctgttatgaacattcttgtacaagtttttgtgtagacatatgttttcatttctcttgggtatatatctaggagtgaaatgtcatatggtaactctatgtctaaccttttgaggaactgccaaactgcttttccaaagcagctgcaccatttgacattcccaccagcagtgcatgagagttccagtttcctcatgccctcaacattgcttgcaatagtctgtgttgttggttattgctattctgttgagtgtggattggtatctcattgtggttttaatttgcctttccctgatagctaatgatgctgaacatcttttcatgtgcttgttggtcatttgtgtatcttctttgaatgtcacttagatcatttgcccacttttaattgagctatttggttttttattattgagttgtaataattcttaacatattgtagatacaagtctcttattagatatgtgtttgcaagtattttctcccattctatggattgtcttcattttcttgatggtatcctttgcaacacaaatgtttttaattttcatgatgcccaatttatcctttttttcttcccttgagtgtgctttggtgtcatatctaagaaactattgtctcatctaatgtcacaaagagttatgcctatgttttcttccaagaatttagcagttttagttcatacagttaggcctttgatccattgatttttgcctatgtatatgcataaattttctgtacatgcaattttattattttgcttctggatatgcagttgtaccagcatcatttgctggaaagattatcctttccccattgaattgtcatgacacccttttcaaaaaccaattgaccatgaatttgagagtttatttctagacacttaattctcttccattgatctatatgtctatctttaatgccagtaccttaccattttggctactgtagttttgtagtaaattttggaattgggaagtgtgagtctttcaactttgctcttttttttcaaggttgtttttcctattctaaagcaaattcaaacttattctaaaggaaattcaagagaatttccatataaattttagggtcagcttgtcaatttctgtaaaaaatttaactgggatttttacaacgataggttgaatctgtagatcagttgagaagtattgccattttaacagtattaagtctttcaatccagcacatggaatgccttttcatttatttaattcttctttaatttattttaataatgttttatagtttttaggatataggttttacagttttttggtttaatttattcccaactattttatacgttttgatgctattgcatcagttttcttacttttattttcagattgttcattgcagcatatagaaatataactaattttcatatatcaatcttgtagcctgaaaccttgctgaacttatttattagtttgtaatgatgttttagtggattccttaggattttctatatacaagtttgtgtcatctacaactatagttttacttctttctttccaatctgaatgccttttacttctttttcttgcccaattgccctttctacaacctccaatgcaatgttgaataaaagtggtgagaacagacattcttttcatttattgatcttaggaggaaagctttcagtctttcatcattaattatgttagttgtggcttttcgtagatatctttttttttttcttttttgagacagggtctcactctgtcacttaggccggagtgtagtgagtggtccaatcttggctcacggcagcctcaacctcccgggctcaagcaatcctcctactttagcctctggagtatctgggaccacaggtgtgtgccagcatgcctggtgtttttttttttttttttttttttttttttttgatagagaagaggtctcactatgttgcctaggcttgtcttgaactcctgggctcaagcaatcctcccaccttggcctcttaaagtgtggagattacaggagtgagccaccatgcccacgcctgtaatcttaacactttaggtggttgaggagggagaagtcggaaggagatgcctgatgaaagacatatcttttatcaggttgaagaagttcctttgtattcttagtttgttgaatgttttcatcctgaagggattttgtcaaatgctctttctgcgtgtattgatataattatgtcatttttgttccttatcctaatgatatggtatattaaattaattaattttctaatattagccagcttgcattttagggataaatcctacttagtcatggtgtataattctttttatgtgtttctggattccatttgctagttctcttctgtactttgcaattgattctttgtcaatgtccagatattaggccaaatggggggtatgtccacttcctgatatttccccagataagactgttttggtcatttttcactcattctggtgcctggaaatggaactctttatgagtcttgctagggggaaaagtcaatttcttactgtaagaattaaaacaaatttttattactatatgagtttaatattatttcttactataagaattaaaagctaggcatggtggctcatgcctatagctgggaggccaagatgggcagatcgcttgagcccaggagttcaagaccagcctgggtaacatggtgaaatcctgtctcaaaaaaaaaaaaagaaaagtcaggtgtggtggtttgtgcctgtagtcccagctacagaggaggctgaggaggcaggattacttgagcccaggagttggagcttgtagtgagctgtgatcacaccactgcacggcactccagcctgggcaacacagcaagaacctatctcaaaaaaaaaaaaatagaatttaaaaaaatttacttttgcaatcttccttggtgctagggaagaggcatatgatcattcagacacacgttaattaatatttaatttgggagtgaatgacacctaaagtaaggtctttctctctttctacagcgatactgttagaatagcagaatcaggcttgaggcatgatttagggtgtttttctcagctatttagtctcaaccctagttctctagttctcttagtaattcatggcactgcccagttttttttacttttatttttctttttgatcaccatgaacaaacaatttccttttagtaagtcccgtattgcttaattcagccagggtccacttttattaagagcaactagtagccttgtcagataaaacactcacacatggcattgttgttagttgccttatactaataattcaggagatgatgtcagagattacatcaatgaagaaccatacagaaaataatttaatatcaaatatttgactttcatttttaaaagaatagcattgtccatttctcccaacatggccccagccttccacaaggtgctttactccattctctttacattttcttctcccggctccatccctaaatccttgatcatttcttaagtagaggagtttatcttactcttttttcttgccaatcccaagtaagttttaaagaacttttcacaaataaaagcacctcttttcctaaaacaaaatggttccccttttgtttcattccacctgatatggtttggctctgtggtcccacccaaatctcatctcaaattgtaatcctcacatgtcaagggagggaattgtaatctccacgtgttgaccgagggaggtgattggatcatggggcagtttcccctatgctgttcttgtaatagtgagttctcatgagatctgatcgttttgttttttttttttctttttgagatggagtctcgctctgtgcccaggctggagtgtagtggcacgatctctgctcactgcaagctccgcttcccgggttcacaccattctcctgcctcagcctccggagtagctgggactacaggcgcctgccaccacgactggctaatttttttgtatttttagtagagacggggtttcaccgtgttagccaggatggtctcgatctcctgacctcgtgatcctcctgcctcggcctcccaaagtgctgggattacaggcgtgagccaccgcgcccagccaatgtgatggttttataaggcggttttccctgctgttgctggctttctctcacccgctgctatgtaagatgtgtctcttccccttctgccataattgtaagtttcctgaggcctccccagtcatgcagaactgtgagtcaattaaacctctttcctttataatttacccagtttcgggtatttctttatagcagtgtgtgaacagaccaccacattagaattgcatgttgctttgtcattgccaatctgacaggtaacaaaagatatcacacttatacaaactcacatttgttgcatttattgttgttgttttgggacagagcctcactctgtcacccaagctggagtgcagtggcctgatctcagctcactgcaacctctgctttctgggctcaagcaattctcctgcctcagcctcccgagtagctgggattacaggtgtccaccaccatgcttggctaatttttttttatttttagtatagacggggtttcaccatgttgaccaggctggtttcaaactcctgacctcaggtgatctgcccgcctcagcctcccaaaatgctgggattacaggcatgtgccactgtgcccagcctattgcatatttttaaattagagactaagatttcttcttttctgaattgtctgttattttaactatttttccatgttggaatattagtctttttcttattcttttgtagattcttttaagctcttcatatacagggaatattagtacatagcataaatattgcaaatagttttccaggttgttatttggcatttgacattgtttatgatgaagttttgcttattttcctaaaaaccaaaacagaatttttggttttgtttctaagaaataaaagctttcaagcttttcctttttgacatctagatttcatgtcatctttagaaaagctgcccccactgcctttggcacaaaaatcatataactgtttatgtgtcttttttctccacctgtaattcattaaaaattagaaaactgatgtccagattgataatacgacttgcccaaggtcttacaactaattaaaggaaataggctacagaaaagatggtgctcctactgaaagcagtaatgcataattagtggtacacttcttaattaaaaattttaatgttaagtgagttttttaccctttaaaaattatggctattttctggaagcttttttaggaaataaaaggaaatactctcttaaacagtgataattcaaaagacacattgggacttattacacaaatgaatattcagagtcataattttctttattaaaacatatgggagaccaagcacagtggctcacacctataatcccagcactttgggaggcttaggcaggaggattgcttgaggccaggagttcaagaccaccctgggcaacatagtgggaccctgtctccacaaaaaataaaaatgaaaaaattttattttaatttacttttttttggtttctgtttttgttttgagatggagtctcactttctcacccaggctagggtgcaatggtgcaatcttggctcactgcaacctctacctcccaggttcaagtgatcctcctgctttagcctcccaagtagctgggactataggcatgcaccattacacccaactaatttttgtatttttagtacagacggggtttcaccatgttggtcaggctggtctcgaacccctgaccgcaagtgatctgcctgcctcggcctcccaaagttctgggattacagacgtgagccactgtgcccggcctgatttctagttttatttcattgtggacggaaaagacttgtcatatgatgtctgcttttttcaaattgtgtagacttgtttcattacttgagatatggtctattctgcagaatgttccatgtactgatgaaaagaatgtatattctgcagcagctgggtaaaatgttctgtacatgtcacttaggcactttgatctcatgtgcagtttaatttcaattttttttgttgattttctgtttgtatgatttgaccattactgacaatggggtgttaaaaccccctacaataatattgcagtctatctctccctttatatctattagtgtttgctttatactcttgggggctccattgttgtttgcatacatatttatttatttattttttgagatggagttttgctcttgttgtccaggctggagtacaatggcccgctcctggctcactgcaacctctgcctcctgtgttcaagcaagtctcctgcctcagcctcccaagtagctgggattacagacatgtaccactacacctggctaattttgtacttttagtagaaatggggtttcaccatgttggtcaagctggtctcaaactcctgacctcaggtgatcctactgcctcggcctcccagaatgctaggattacagccgtgagccactgcatccagctgggtgcatacatatttataactgctagttcctcttgctgtattgaccccattattattatatagtgatcttctttgtctctttttacagtctttcacgtgtagtctattttatctgacataaatatagctactcctgctttttcttggtttcctgttgcatagaatatctttttctatcctttcaccttcagtttatgtgtgtccttataggtgaagtgggtttcttgcaggtaggatagagttgggtcttgtttcttcatccattcagcaactgtatgccttttaattggagatttaagtccattttacattgtgttattatggataagtaaggacttactattgccatttgttgcttgttttctgattgttttgtaacgcctctttttccttcttcctttcttgctcccttcttttgtgggtaagtgattttctctggtagtatgttttaactctttgcttttaatttttagtgaatctattaaaggtttttgtattgtggttaccatgaggcttacaaaaaacatcttacagatataacaagttgtttaaaaaagacagcttatcttagatcaaaaatacaataatagaaacaatcaaatataaaaaatgaaagcaatacactttagctccttgtatcccgcattttgactttttgttgtctcaatttacataatttatatataataattatattacattatatattatgtaacatataatatatatcattatgcatattatatataattatttttacaaatttttacctcaagtacattttttatattacctatctcttaacaggttgttatgccttttttaaaaaattagatttgcatttcagtatctttgtactagagttgtgagtggattgattgcacacataattacagtattagagtattatgggtttgtctatatgcttaatttttaccttggattttataccttcaaataatttttttttgcatgttagtgtttttcttttcctttcagactgaataattccctataatagttcttgtaagatgggtctggtggtgttaaattttctcaccttttgtgagaaggactttatgcctccttcatatttgaaggatagcttttctggatacagtatactttgatagcagtttttagaattttggcactttcaacttaccattctgctttctcctggcctatatgttctccatagagaagaccgttgccaaacaaattggagctcctttatatgttgattcttttattttgccacctttggctcctctctttgtccttgacctttgagagtttgattattagatgccttggggtagtcttatttggctcaaatctgtttggtgttctctgaccttctggtaccttgatatttatctctttctcaaggtgtggagagttttctgttattatttctttcaataagttttctaaccctgctgttgctcaactccatcttgaacaccagtgattcttacatttggtctttggagataattttccatatcttgaaggcaatctttgttcctttgtattctttttcattatttctacttagacaatgtattttcaaatatcctgtcttcaagttcactgattcttttaaaattgtgtttattttttatttcaatagcttttaaggtacaagtcatttttggttacatggatgaattctatagtagtgacttctgagattttagtacactcatcacctgagcagtgtatgctgtacccaataggtagtcttttatcgctcccccctccccactgagtccccaaagtccattatatcactttgtatgtctttgcgtcctcatagcttagctcccatgtataagtgagaacatacggtatttggttttccatttttgattacttcacttagcataatggcctccagcttcatcccacttgctgcaaaagttactgcagaagacattatttcattctttttttttttttttttttcaagacagagtttcgctctgtcacccaggctggagtgcagtggcacaatctctgctgactgcaagctccgcctcctgggttcacaccattctcctgcctcagcctcccgagtagctgggactacaggtgcccaccagcgcgtgcggctaattttttgtatttttagtagagacggggtttcaccatgttagccaggatggtctcgatctcctgacctcctgatccacctgcctcggcctcccaaagtgctgggattacaggcgtgagccacagtgcctggccttatttcattcttttttatggctgagtagtattccatgatatatatatatatatgtgtatatatatatatatatatatatatatgtgtgtgtatatatatatatatatatgtgtatatatatatatatatatatgtatatatataccacattctctctgtctactcattggtgtcaatgggcacttaggttggttccatatcttttcaattgtgaattgtgctgctattaacatacttgtgcatgtgtctttttcatataatcttctttacttttgggtaggtacccagtagtgggattgctagatcgaatgatagatctacttttagctcttcaagggatctctatgctgtttcccacagaggttgtactaatttatattcctaccagcagtgtaaaagtgttcccttttcaacacatctacaccaacatctattgttttttgactgttttatcatggccactcttgcaggagtaaggtggtatctcattgtggttttaatttgcattttcatgatggttactgatgtagataattttttcatacatttttgggctatttgtatatctttttttgagaaatgtctattcgtgtcttttgcccactttttgatggattttttttctaattcatttgagttccttatagattctgcatactagccctttctcagatgcatagtttgcaaatattttctccttttctgtggattgtctgtttactctgatgactatctcttttgctgggtagaaacttttttgtttaattaggtcctattcacttatttttgttattgttgcatttgcttttggggtcttggtcatgaattcttttcctaggccaatgcccagaagtgtttgtccagtattatcttttagaatttttattgtttcaggtttaagacttaagtctttgatcagttttgagttgatttttgtataaggtgagagatgggaatccagtttcattcttctacatgtggcttgccagatttcctagcaccatttattaaatgggatgtcctttccccaatttatgcttttgtatgctttgtcaaagatcatttggttgtaaatatttggctttatttctgggttctctattctgttccattggtctacatgcctatttttatatcagtaccatgctgttttgataactatagccttctagtatagtttgaggttgggtaatatgaacaaatccagatttgttcttcttccttatggtttctttggctatgtgggctctttttcagttccatatgaattttagaattgtttattctagttctgtataatttgaagtccagtaatgtgatgcctccagctttgttctttttgcttactggggctatttgggctcttttttgattccacatgaagttttggattgctttttattgttctgtgaaaaatgatgatggtattttgatggaaattgcattaaatctatagattactttgggcagttatagttattttcatactattgattcttttatcatcatgggatgtgtttccattcatttgtgtcatttatgatttctttcagtagtgttttgtggttttctttgtagatatctttcaactccttggttaaggatatttctaggtattttaattttattattatttttgcagccattgtaaaagggattgagttcttaattttattctcagcttggccattgttggtgtatagcaggacaactgatttgtgtacattgattccgtaaccttagactttgctgaatttatttattaggcctagtaatcttttggatgagggatgagtctttagggttttctaggtatacaatcatattgagaggtgacagcgtgctggcagtcctcacagccttcgctcactctcagcgcctcctctgcctgggctcccactttggcggcacttgaggagcccttcagcccactgctgcaccgtgggagtccctttctgggctggccaaggccggagccggctccctcagcttgcagggaggtgtggagggagaggcgccagcgggaacaggggctgcgcgggtgtttgcgggccagctggagttccgggtgggcgtgggcttggccggtccgcactcggagcagcgggctggccctgccgccctgggcaatgaggggcttagcacctggtccagcggctgcggagggtgtactgggtccccgagcagtgccagctcacccggtgctgcgctcgatttctcaccaggccttagctgccttcctgcggggcagggctcgggacctgcagcccgccatgcctgagcctcccacccctccctgggctcttgtgcggccggagcctccccaatgagcgccacccactgcgccacggcgcccagtcccatcgaccacccaggggctgaggagtgcaggcgcacggcgcgggactggcaggcagctccacctgcagcccccgtgcgggatccactaggtgaagccagctgggctcctgagtctggtggggaagtggagaacctttatgtctagctcagggattgtaaatacaccagtcggcactctgtatctagctcaaggtttgtaaacacaccagtcagcaccctgtgtctagctcagggtttgtgaatgcaccagtggacattctgtatccagctactctggtggggccttggagaacctttatgtctagctcagggattgtaaatacaccaatcggcactctgtatctagctcaaggtttgtaaacacaccaatcagcaccctgtgtctagctcagggtttgtgaatgcaccaattgacactctgtatctagctactctggtggggccttggagaacctttacgtccacactctgtatctagctaatctggtggggacctgcagaacctttgtgtctagctcagggattgtaaacacaccaatcagcgccctgtcaaaacagaccacttggctctaccagtcagcaggatgtgggtggggccagataagagaataaaagcaggctgcaagccagcagcggcaacccgttggggtcccttccacactgtggaagctttgttctctcactctttgcaatatatctagctactgctcactctttgggtccacactgcttttatgagctgtaacactcaccggggaggtctgcagcttcactcctgagccagtgagaccacgaacccaccaaaaggaagaaactccgaacacatccgaacatcagaaggaacaaactccagacgcgccaccttaagagctgtaacactcactgcgagggtccacggcttcattcttgaagtcagtgagaccaagaacccaccaattccagacacaatatcatcggcaaacaatgctagtttgatttcctcttttccaatttggatgtactttatttctctctcttgcctggttgctctggctaggacttcccgtgctatgctgaatagaagtggtaaaaatgggcatccttgtcttgttccagttctcggaggaaatgttttccacttttcctgattcagtataatgttggctgtgggtttgtcatatatggcttttattattttgaggtaaatcccttctgtgcctagtttattgagagtttttaatcataagcaatgctggattttatcaaatgtgttttctgcatctattgagatgatcatatgttttttgtttttaattctgtttatgtgatctatcatatttactgacttgcatatattcaatcatctctgcctcgatgggatgaaacccacttgatcatgataaattttctttttgatatgctgttggatttggttagctggagtttgttgaggattttttcatctatgttcatcagggatattggtctgtagttttcttattttaatacctttcctggttttggaattggtgatatggacttcatagaatcatttatggaggattccctctttctcttttatttgtttatttggcatgtgtctcaagatattaccccttttctcaatctttttgaatagtttaagtaaaattggtaccatttctttctttgaatgtctggtagaattcagctgtgaatctggtcctcggctttttttgttgttgttggcaattttttttttttattattgattccatctttctgcttgttatttgtctgtttaggatttctatttctttctgatttaatctaggagggttgtatgtttccaggagtttatccgtttcctctagattttctaacttgtgcacataaacgtgttcagagttgtcttgaattatcttctgtatttctgtagtatcagttgtaatgtctctggtttcatttccagttgagcttatttagatcttctctctattttcttgattaatcttgctaagttctatcaattttatcttttcaaagcaccagctttttgttgcatttatcttttgtatttttggtctcaatttcatttatttcttctctgatttttgttatttcttttcttctgctggctttaggtttagtttattcctgtttctttggttttttgagatgtgaacttaggttgtcactttgtgctctttcaggctttttgatgtcggtatttaatgctatgaactttcttcttagcattgcttttgcttttgctgtatctcagggattttgataacttgtttcactaccatcattcatttcaaataattttaaaatttccatcttgattttattgttaacccaaaaatcattcagaaccagattaattaatttttatgtatttgtatagtgttgaggattcttttgtcattgagttgtagttttgttatactttggtctgaaagatatttgagatgatttttattttcttaaatttattgagacttgttttgtgacctattacatggtctatcttggaaaattttccatgtgctgatgagaagaatgtgtattctgcagttcttgggtagaatgttctgtaaatatctgttaagtctatttgttctagaatgtagtttcagtccattgtttctgtgtttactttctgtctcagtgatctttctagtcctgtcagtggagtatttaagtcccccactaatattgtgttgctgtcaacctcattttttagatctagtagtaattgttttataattttggaagctccaatgctaggtgcatataaattcaggattgtaatcttgttggattggtcttttaaccattatataatgaccttttttctttttgctgttgttgctttaaagtctgtttggtctgatataagaatagctcctcctgctcgccttttgtttccatttgcatggaatatcttttccacccctttaccttgagtttgtaagagtccttatatgttaggtgagtctcttgaagacagcagatatatggttttttattttttttatctactctatcatccagtatcttttaatcggaatacttaggccacttacattcaacattaatactgagatatgagatacggttccattcatcatgttagaattacctagatacttttttgttgtgttatggttttataggccctgttttatgctttcaagaggttctatttggatgcatattaagcttttgtttcaagatttagaactccttttaacatttcttgtagtgctggtttggtagtggcaaattccctcagcatttacttgtctgaaaataatttcatttcttcttcatttatgaaatttagttttgctggatacaaaatttgtggctgacagttattctttttaaggaggctaaatgtaagactccaatctcttctagtttgtaaggtttttgctaagaagtcttctgttaatttgaaagttacttgctgcttttgtctcacagctcttggcattctttcctttttgttgactttaggtggcctgatggtcatgttccttggtgtaatctttttacagtgaatttctcagttgtttgtttgtttgtttgtttttgaggttcttgtatttggaaatttaaatctttagcaaggccagggatgtttttctcaattattttctcaaataagtttttcaaacttttagccttctcttttcctgcagaaacaccaattattcttagctttggccattttacataatcctgtatttcttagagactgtgttcatttctttttattctttttcctttatctttttctgactgagttaattcaaaagccttgtctttgagctctgaaattctttcttctacttgttctaatctattgtttaaactttccactgcattttatatttctctaagtgtgtctttcatttccagaagttctgactggtttttctttatgatatgtatctctctaagacacttttcattcatatcctctttttttttttttgagacacggtctcactctgtcactcaggctggagtgcagtggtatgatcacagctcactgcagcctcgactacccaggctcaattgatccttcgatctctcagcctcttgagtagctgggactacaggcatgtgccaccacacccaactaatttttatattttttgcagagatggagtttcacaatgttgtccaggctagtgttgaactcctgagctcaagcaatccacccgccttggcctcccaaaatgctatgattacaggtgtgaaccactgtgcctggcctatatcctgaattgtttttaaaatttctttatggtggttttcacctttctgtggtatctcttcaagtagcttaataaccttctgaatctttatttggtatttcaaagatttcatcttggtttggatccattgctggggagctagtgtgatctgttatagaactctggttttttttgtgtgtgtgtcaccaaaattaacttttctggttccttctcattagggtagactatttctgttaagtattcttgaatttaagatttcttttctttctttctttctacccttaaggatgtgactttaatgtgtgtagtttattatagcctaatttggttggtcgtgcttttagggtgatgactctgtatgagttccttggttatggagagtgtttgtatgatagcttcctcagatactggttgtagaagctacgtacttggtgtgtggataagttcactatctcctatggggttggaatgacagaggtcttttgaagcttatcccatttccgtgtggtgtgcacttatttatttatttatttatttatttatttatttatttattccccagtattctatttactgagttgatgattcaggtctcaggtgagtagggaagattttcctcggtagaaactggttgtagctaaagcaggtgggtaagtgcaatggccagtggcgggcagagatcccagccttgatgatggtagctgggggagctctcaattagatgcactgaggtcttaacaggggaaagggtaggagccaccccagctccccctgccaggccagcaggaaagctgtccacctcccagactcactcctgtcccaatgtttcagctattcagattagacaggcaccccttttcttctgcatgaatgttgatgttccacatagagaagaactgtgactctgcctctcatggaagcctgaacctggaaggtgctcctcctgtggagatgcagtcaccctgcaatgttccaggaaggatgtctgtagatgcacccatgctgagctaccatgggagaagcctcagctgtgtctgtagtggtggacaaggagagaaagaagaccccttcttcaagacccttcatgagcaccaaggctgcctgactgttgggatagtactgcagactttccctgctgagcccagcactgcaattgcatctctacagaaagaaacttcccaccagagtgaagatctggaactcaaagcttgctgtccagattcttttgtcctatgaggtgttcctttcatgtagtgttctccctcttcccctaggagtaggagtttctgagagccagactgcagtgattgctattgctcttctgggtctagccacctgtgaggctgccatactccaggttggtgccaggaaatgtctgcaagcgatctggtgatgtgacctgtcctcaagtctcctagcagtgggtaccagcaccagctctgatgagggtggcaggggagtaacgtaaactctgtgagattccttggttatagatagccttagcgtgctgtctttctcaaatgctggttacaatagtagtaaactggtcatgtggacagactcaggacctcttgttgacaatggtgatagctgaggtcacacactggttttcttcttcctgggtggtatgttagtgtgcctgcagatgctgtaatggactgtcagttaccctccagccagcaggtggtgcctgcaaaagagcagcagcttcagtagtaactgtgggatttgagcttgccttatgttgcccaggggaggtattttggtttctcaggtgatgggtgaggacataaagttccccaaaatttctgtcctttgtgttaagctaccagggtgtgtggagggccataaccgggtggggtctgagtcaggtgggtctgcattctgactccctgtgtgtggggcaagctgtgacccctgttggggtaggaaggtcattcttaagcctctgaggtaatgttccataggtgagtgtaactgctctgctgttcagaagaacttgtacaagaggtggggagtaacatgtggcagtaagcctcacttagatcccacacagttggccaggctgatctcactcccacagtgccctgctagtagcactgggctaagtttcaggtagcctgcactcagaactcaaaccttcctcaggccataaactttccccatgaggataacaaccacagctttcaggccacatccttccccatccacctgcaaggatgggtgcctggctcctgtgctcacaaatatagcatactttccacttgccgtccccacccctccagggttctgaccaagagaatttgtccctacttgatgttatattgtgaaattcagttgggagttgtgactactgtctgagctggttggttgactttgctgaggttcctgtgagatataataaggaatggcttcccttggtctgcactggagattgggaatgcctgcaaggcacttcccactgctgcttctacttttatatttcactgctccctaaatcagttcctgttctgtgttggattaaggccttcacctgtggcctggatttttaagttccttaatggggatatgtatcctggaggcagtctctcccactctaacactctggggacttagtttttggcctgtttcatggtgtaggctgaagcctgccacttctttcaaagagtctgtggattctttcacttttcctgttaagttcctgtattgcttcttggaaaaaagttcacaatgtgaatctctacacctattttgtccttccaagtggagaggcatgctgacattgcctccaattccccatcttgtgggggagaggggaagctcactgattctttcctctgcatgatccattctgctattgaggaccccctaatgaattttttagttcagccaatgtatttctcagttccaagatttctgtttgatttcattatttcaatctctttgttagattttttgataagattctgaattgcttttctgtgttatcttggaggtcattgaattatcttaaaactgtgccttggtgtgtgtgtgtgtgtgtgtgtgtgtgtgtgtgtgtgtgtttggagacagggtctcactctgtcacccagactggagtgcagtggcctgaacctgacctactgcagccttgacctcctgggcttaagcgatcctcctgcctcattatcctgagtacctgcaactatcaccatgcacgtatcaccatgcctggctaatttttaaattttttttgtagagatgaggtcttgctatgttgcccaggctggtcttaaactcctgggctcaactgaccctcctactttggcctcccaaagtgctaggattgcaggtgtgagtcaacacacccagcaatttgctattttgaattcttggtcagagagcttacatattgccatctctttagggtccgtcactggtttcttgcttcattagtttgtggaggtcttgattccctgtttgctgttgtttattgatgatgtgaatctatgtctttgcactgattatttatttttccagtcttctttgactagcttgttttttttttaattggatatttttcttagactttttttttttttggtaattttcctgttgaatttctattttttttttttttttttaagatggagtctcgctctgtcacccaggctggagtgcagtggcgtgatctcagctcactgcaagctccgcctgctgggttgatgccattctcctgcctcagcctcccaagtagctgggactataggtgcccgccaccatgcccggctatttttttttgtatttttagtagaaatggggtttcaccatgttagccaggatggtctcgatctcctgacctcatgatctgcccgccttggcctcccaaagtgctgggattacaagcatgagccactgcacctggccttcctgttgaatttctttcttttttttcccactagattgctgtgtccatttagcactagatagtattttaagcccaggtttgtttcaggtctagaaaaggatcagagtgctgcctgtcccaaatggagaatgccccaaaagtacatcccagcagtatgggaaggctggttaggggttcatgtccaggagacctatggaacacttttcctacagcatggtgctgctgaacattcactctggtttagtatcatctttggctgagttacagagcagtttccagggtaggggatggcagtcccaccatctccctttgtctctggctgtccacagggctatttctcccattaggcattcacaatgcttcctgtgggttggggcagggacatgtcttctgtcatggaactcaacatagtggggaagctgattattcatcttgatctcactttttccagtgtaaaaattgtgagttgaggagaaattttctgcatgtttggtttggggcaaattgagggaaggggtgttatggacatggaagtctgattttcttatcatctactcagaggtttttcacttccctgtgaccccaggaactgctttatcttcatttttgagttctgggatattgctggtgataatctcagcactgtatgccacttttggaactggaagcccctttctgtctcagattgtctttatctctttttcattcttgaaggatagtgttgccatgtatattattatttgattgtttgtttgttttttcccacagcactttgaatatatatcatcccatgccattcagacctgcaagatttctgctaaaaactagtgatagtctcatgaggattccctcatatgtgacatgttgtttttctcttggtgttttttcaaaaatctttctttgtctttgacaatttaattataatatttctcagtgtggatttttagggttcatcttaagttgggttctgtaagtttcctgcatctaaatgtccatttcctttctcacatttgatactttttcagccattatttcttagaataagctttctgcttattttttctctcgctgtctctcttcctcttctgagacttctataatgcttgtattggtctttcttaatggtgtgctgtatatcccttaagctatctttgctgtttttcttttactcctctgatgaataattccatgtgatctttctccaagttctctcattttttcttctgtttgctttactcatacattttacccctcttttgattttttcagttcagctattggtattcttcagctccatgatttgtttggtcctttttaaaattttctctcttagttgaaattatccttttgtttttacattgctcccccaagctcatgaagtattttttgtgacacttattttgatttttctctgaagtaatttatatattcccatttcattaggatcagtttctggagtttaatctttttcttttgtttggataatgtttctttgtttcttaattttccttgattcttcctgttgatatctatgcattagaaaaaactttaccatctcccagtctttctggatttgtcttgtacaggagaagagcttcaccaatcaacctggcccaaacttttgtgggcctctcaaaccttcatgctagttcaaacttctgtctttgttcttagtggcttccagacctttagagtatgccaggttctgtcaacattcttagatagctggaaaagaagccaagtcatcaggtagctcctatagaagttggaagtctaggtgcatggtccaactctttccctctccagggataagctggttgctgaggtttttggggtttttgtttttttatccacttgctctgaattgagccatagagaggagttgtgctgactgcctggatactagttcaaaccactgctttgttctctgtcacttctagaagacagtgtatgccaggccatgtcaactttctaagacaggaagatggaagccagctcctcaggtagcacctaaataatttggggc

SEQ ID NO: 672 - DNA, 9119 bp, Homo Sapiens
agaagcacactgaaacctatccaaaagcatcccaggagggcacactgagtgccgcatggagcctgcaccaccatggggaggaagcagccaccgccttcctgaatccccaccaggcagaaacatctctcccgtctttgaacttcaccacgccgtgcatcttcctctgggtgtgcaatcgtcacctgcgtacatgattgattctgcccccaacactagactcaggcagaaagaactcaaagctcagatggtcagggtcctgttggttcatcaagctcagcctgcctggaggcagccactgtgttgttccctctcttcgtcctccctctgcactctctcttgccacgggacatttgcacaagcagttccctctaactggaacactaagaaatatggaagtaaaaggggttgggagaaaagacaggagtcacaggtgactgtgtgggatgaggagagtcgtgaaaactttttttttttttttttgagatggagtctcgctttgtcacccaggctggagtgccagtggtgccaatctcggctcaccgcaacttccacctcccaggttcaagcagttctcctgcctcagcctcctgagtagctgggattacagttgcctgccaccacgcctggctaatatttgtattcttagtagagaagaggtttcaccatgttggccaggctggtctcaaactcctgacctcaggtgatccacctgcctcagcctcccaaagtgctgggattacaggcatgagccactgcacccggccgaaaacattaagagtaggtggatgttactttggacaccaaatgaagaagtgtgccgagctgaaagagaaaaggagaagaaaatggacatgacatttacggggttcctcttgcagagagagaaccgtgtagaaggtaagctctcactactgagttcaagtcccagacataatacttgctggctgtgtggccttgggaaggcccatgagcactctcagtgaaagtgaaactgggaagtttctgctttggagagattttctcacaaatgagatgagttatcatataccaagcccttagagcacggcctggctcacaggaagccaacagtaagtgtgggtcattatcagcgctgttgttaactgggggtaataacaggggccaggggccaagaggctttatctagccctatttcagaggcaaagaaatgagggtgaaaaagttcaggggcctgcctgcagtcacacagcagagccagatatgaacatcgacgttttggctttcaaggtccacacccgccgtatcctactgcacggtgctggaaggcacatggaagactattgcagcccaatcttctcatgacaaagacaggaaaatggagccctctaagagaaagtgactgatccacccttatgctcttaaatggtaagcgtccagggatcatccaagttaagatggcccacacgcagctggcaaggcaggacccgaggctgaatgagacgtacaattggctccacggtactggcagaacccacagctagttttcaatgctgagaactgtccatcctggcagaggctcactgccctctgtgccctccctggttgcctgggcagatggtgagctctggttgccaaggagcccgcgttggcagttctgaaatggggtgcgtcagcagcctcgctccagcggcttcccacatccttgagtaaccaccacacaaaggtgctgggcatgagaccaagggtgcggcggagatcgaattagtaatacacactcggtgaccctccccagccaggtttcactgcgtgcttatgaccaacattcatcccttccttagcatctgtggtgtctttaagggccaagtaaaaaggtaaaactgcagggagtcaggagggggaaactggcctggggtacagagtccctcacaatgaaaatatatgtaactggctacttgtaggtcatgatgcattaagtgatcctgtcaaaagttgaaagtgggctacagtgggacaggcaatgcccagagggaggcagaaaggtgtaaataatccgaggtgaatgtgggtcttgttggcatggtagatttatgccctgccttcataatgtaccctttcatcttgggagcctggattccaaaaatctagtctagacaggaattgatggtgctacctctcagcttacatcgttcaaggtttctcaacaccaaagactcctgaatattgatgggaacaacccacttagccaggggatattgctcagaactcaggaggccaaaggcatcattcttccaggcacggaggccctgctcagaaacagccctacagaggcagagtcactcattctgggggatgacgctgccttttgtcttcatctccccaagtgggagacaagtcccatcacgcctgccacctggcagtcagccttgcgccttctctttcgtccttttcatgtgtgctccgtgccggtttcagcagctttcatcagagactgaaactaccaccactcccatcacctcccagggccatgggcaggccctggctgacagatccaggcctaggagcctgggcaacgataaataggtggttgggaggacctctccgagcccccttctctgcccaggcaggctttctccttgggtggccagagccagggcccaggatcccctgctgcaagaactgagaggctgaggggcttcactcctgaggaaggtcctctcttcctaatccccgtgctttgggcccagcaaattcagcctgggaactgggggctgctgtggaagagagatggagctagggagcatttatagtgcagcacctgaggctgagcagtgacagagctgcgggcctgagaattacaaaacagacttaaacagatgaaatattgcccaggcatggtggctcttgcctgtaatcctagcactttgggaggccgaggcaggcggatcacttgaggtcaggagtttgagaccagcctggccaacatggtgaaaccccatctctactaaatattagctgggtgtggtggtgggcacctgtaatcccagctacttgggaggctgaggcaggagaattgcttgaacccgggtggcagaggttgcagtgatctgagatcgtgccactgcactccagcctgggtgacagagccagactctgtctaaaaaaaaaaaaacaaaacaaaacaacaacaacaacaaaaacccatgaaatattaactgatgcagggaaaacagacaaaaactatacatgctcaaaacaaaacgaaaaagggcacagggctcagaaaccagtttgtcgtctttgtgaacagctgggaactctgactcatgcactgtcccctgttctctatgccacaggaatgaggcagcaagaggccagattctgccggagacagagcagagagccaaaccatcgccacttattggtgcatgaacctgggcaaggcaggggtatccctgagcctcagcttccttgtttgcaaaatggtgacatgcctacttccagagctgttgttaaggttaaatgatgacgcagtttaccatatgccaggcacatagtaggcactaaatagttgcaattattagccctgagcaaacattgctcagccattcccttgtaaagcctattctcaaaccaactttccatgtggacgttcaatcatctttctggatgacctcgccttacccattgcctcagattctgtgtgtgtgtgtgtatagaagaaacaaagaaaaaaagtgcttttcacatagtgaggacatttccccatcctatgagtctgtgtatgtgtgtgcatatgtatatgtatgtacacacacacacacacacacacacacacacacacacacactgccccgtggaataggcaggacggggttgcatttcccctcttttaaaggtgaggatgctgagcctcagaaagatcaagtgacctgaacaaagtcacacagccaatgtgtttctccaaaagaaatgaccaggagtcagtgtttctttatacaagggtgtccaatcttttggcttctcggccacactggaagaagaagaattgtcttgggccacacataaagtacactagcactaatgatagctgatgagctaaaaaaataaaaataaaaatcacacacaaaaaacagtgttttaagaaagtttacaaatttgtattgggctacattcaaagccgtcctgggccatgggttggacaagcttgctccaccataaacacgtgatgaacagacattgaaatcgtacctttagggctgttttaggaacacaagaggcatcatctggctatcttgagaaagcagatttcaattttctattcattaaagaaatgtgcttccatctaccttgaaatcattttgatgatttccagattcaagtccctgaataaattccagggaaagtcacgtcacgggacagaatggccgtcaccttgaaaaaaaattattttctcctggaggcactactgaggctcagcgatcccacgtctgccactccctcctactgcatgtggtatccctgagtctccgctcagggaaaacagacaaaactacacatgctcaaaacagaacaaaaatgggaacagggctcagaaaccagtttgtctggttccagtcatttccaccgcaatgacagatccagtgaccttggcagccctcatccattcaccacatcttcccattaccacctaacgtgcccctcccaatagctccgtgtggtagaggctgcacacaggctcaggattcccacttcacaggtgataatgtcaaggtgcagtgacatgcagcttcttgtcccaggtcaggtgtctcatgattgttgagccactgtcttctgactcagccagtgatctttcctttggaccacaacccctctgaaaagcactgtgctgagaaacatgggtttactttacctattgctattttgtacgtttgaaacgatctttccaaaacagatttaataattgaaagttttgctctctgttccttggagaaaagggacatgctttgaggaaggaattggaacccgaacagtcatgttttataggcattcatgtttatttctctgatattatggcttcctctggaaaaatccaaccaacacatccgtttcaagtcttgagaaactcccaaatgttgaccatgtgtctgattcctgtgtggtcaaaagagtgatgtttcttaatgtccacaacttatttccatgttaaaataattccacgctcagctaaatcccacttacacacaagtgtgcacctgttaaaataggtcatttttcactgctaatcttccagattccatgagtatgtgtgggaaccccagacaaatgcaacttgaatgtcacaaaaggcatttttctttgctgagtgaccctggttggcccagacaccctgggtgccttgctcccacagatttgtaaaactaaggaagatccctttctgctgagagaatggattggaattaaatcttagcatagaaggccttgggtgaaactgtatggaattttgtcttacaactgggttattttttaattagatttttgtcgatcttttttcaactctgaagtatgtcagtatggaaactcagtaacttttctcaatgctccccataaagctaaaaattaaaaagaagagaagagaaataaaaagggaaaaaattaaaatttcagagcaagaagctctagcctctgagattttgttactgttgcaaaagtaataggtcatctttgccacaacctcaatgctaaaaagtagatgcacaaaaaagcaatttttatcccaaagtcttcttggcgatgagattttttttcctgcttcagatttggcatgcttccagaaacccaagggccctaaatcaatatcaagtgaccgcttccaactcgtaagagcctctagggctcattgcaaatgtgggctctgggttccagagagacaggcttaaagaaattgatggcaaaaatgggaagctctgtggctgacctcagttgcaggatccgtgctgggacagcctgtcctccgctccatgatttgtgagggcctgcctggtattgctaatcttcctgacagtttagtttgaagagaaaaggggccagtggcactgtaggcaacatcagacaagccacagatctcctgggagatctaagctctccaggaggcagataacaacattttgcctttccacggggttgttaatatacatatgaatcccaaatacaagaatgggctcttcaaactggtttatttaaacactttttctgagacacacgtttcaagaaggggataaagagggtgtgatgtggatcctgtgctgtcttcaaagaagggaaggtggactgctatgtttctagtgtagaatctggcacagaaaccacccatagcaggtgcgccacggacctgctttagctggaaggatcctttctacattccttccaccacctagtgagtggccacgttgatgatgagacctgggcctttaaaaatcctctttcaggtctccagccaaccctctccattcaactcagtttcacaaaccttttcttagcagccacccattcccaaggactgtagtgggtgccgcaggggagacagaggtgaaggagacacagtcctttctgctgattctgcggctgagtcagctgatagcctacgtctatttgccaagaatatgatcaactgagtgaaaacaacaaaataaaaaacgctgagttggggagatgactcgactcgggaggataatgagaatgtccaagctgtgagtcccctggaggccaaggcaagtttgcagctggcatggtaacagcagggtggttgctgagggaaactgaaaccatgtcacatggaaaagatttgtaggagtggagggcctttggcctggagaagaaaagccttggagaacagaaaggctggtttcacatacctgagagactgccatggggaagacccatactttgttctctggggccccagagggggcccaccatagaacaggactatggtggggatacgtagggggaccgattgcagctcgaaattgcgaagtcctgtccttgtcagagctgtcccaggtggagtgggatgtaccaggaggtggtgagttcctgtcattgcagggatttcagtcggggtggagagcccactaaacaaagacgctgtggagaagaaccaagcatggaggagggtggagggcctgatcttctaagcttcactctctgcctgggagtcttcgattcctccctcctcttactataacttaatgagctgctaacgccaacacctggcttcttattcaaacatgcttaaatgtgaacggggaagactggcatcagaggtgggcagattaacaacaaactccctcaggggtctccaaaatgagagagaagggacaaaggcagaatcgttctgcgtgcctgcaagttggatttggagtctccacactgtgcctctggccgttgaacagaagaggggtctctttgctgtgtctttagcaaggtgacaagcaagagagctgggtagcacagcctggggctcacaggcagcagatcaccttcagctccccaggcccctctgtcatggactcaggccactgctgggactcagtcaccaggacagggagagcccagagggcactgctccacagggtgggcacagcaaacagcccttccccacactcccactcttcccggcagagagggtgcctgcggtgtgactcgagggaactcggcctattcatctcacccgcttctgcctatctctccacacacacttttgtcattgttaaaaccatgagcagctttttcctgatatcacagtctaggaaatcgatgcctcgttcagtgagccagcacttgctgtgctcttgccacaggttgggactgtgtggatggatgccccattgcttagggagcacagaggagggacctagctcgggctggggctttacagaaggcttccgagaagggatgtcattggcctgactcttaagaggaaggaaaagaagagcaccaagtacaaatgattagcactactcatcagcaaatcaggagactgggcgtgtagggagatgaggctgaggaagtcactctgaacacacacgaggggcctgattgtcacctgaaatgcctgatgttttcctgttggttatgggaaacagagggatgacatagattgatttatagagatttttctgcctgcatcaaaggcatcataaacaagagggtaggactagtggcaaagaaacgagtcagaattgtttagtcgagacatgagaagaccctgagctagctcagtggtagcagggtggaaaggaagggaccaaaaggagaaatattttggatttaaaaattaacaagactgtccaacaaatagaagatacagagacaaatgattcaataaggcaagggtcaaaagacttgaacaggcacttcacaaaagaagataatgcccaattaagcacatgaaagagtgttcaacattaaatatcagggaaatgcgagttaaaactacagtaagacagcagttcataccccttagaatggctaaaatcaaaacaaatgatcataccaagtgctggtgggaatgtgaggaacctggaactctcatgcactgctggtgggagaggccaatggcagaaactctttgaaggactctgagagtgtcttataagtgtacatctaccctataagcaagcaattccactgctaggtatttgcccaagaaaactatgtttatacagacttgtataagaaaaatatgttcccaataaaattgtaaagaatgtttatggcagtcttattcaaatattgaagaactggcagcaacccagatgtccaccaggaagtacatggataaacaacctatggtatgtccatataatggaatatcactaagcaatagaaaggaacaaactatttatatattcagtgtaacatggatgactggcaaaaccattatgggaagtgaaggaaaccagacccagaatagtacacactgtatgattccatttacatgaaatccaaatgtagacaaacgaatatataatgttagacaccagtttgtgggtttatgtaagtgttttggggtgttaggtggggggttgttgaccagttagaggcatgagggaacttcctcaaagaatagaaatgtc

SEQ ID NO: 673 - DNA, 3929 bp, Homo Sapiens
gtcttctgacacaggcatctcacaacaccagtgcagccggaccgttgtctgatcaaagaaactctagtaacgtggaaattcatgctccgagtagtgacaagccagtgactttttctatagaaagggtacaagactccaatttgaaaatctcaagcagctttatattcaagcaagttcaatccaatctcttcctgactcactgtctcatcaacatgcaaagctctcgaagagaaatcatctcttacttgcctgagggagttctggcagacgttttgaatgtggatgtggaagttctttcctcgtctccatcctgtcaagagccgtggagcaaacagcaggatgaggaagacatggaagacaaaactgataacgcacgtcacctcgctgcagcgggagacagaatgtaacttcaattcagcctctttggggtttgggttctgaccaagtaaatcgggaatgttgttaacatatcaagccagcctttattgtttgtcttaacccaagaaaacacaaaatgacacttactttgttgctcatttaggttttaacttgttgatgtcctccccacaaaaatcaaacttgaaaatgcctggcagggacccctgagatctagggtttgaaatgctcttttgacaagttaagaggttaaaaagaattcaggaacatactgtagagtctcatgggggattttagaaaaaaaatatgcaaagcatctttaaatatgtggaaaatccttaggagtgaaattgcactgaagtcagattgttttcctattgaggttgcattgctcggctgcaagaggtggggtgggcacatcgtggggggagagcagaagtgcctgttagggtgctgccagacctcagtgtggaattctgcttctcacagttggccataatcaatcaatcagactctctctttctcctcccttctccctctccctttctttccgtggttgaagggcccctcttaaatcgctcttgagcctgcattctaatttgctctctctcccacgtgaaatccacttctcccagctaagctgcgttttgcagctttatgacggtactgaaagcactttatttccacttaaagagctgcctgttctatttaccatcactctcggggtacttaacctcatttaaaaggctaacttttctcctgcattataaagttgctcgggagtctcaaagcctctttctctgcccagcccgcagccagccctctccagccaccccagcctcgccctcacccctcccagcctctgttccaaggcccaggcgcgcccgcgtggggcacgtgtccctgaacgccccgcctccggccagcctgaccgctcagtgctcggtgtcacttctggcacgtctccacattcctcaaatcccagagaggacctcgaaataggatagaaaacaagaatttaaataagaagcaacagggctgcccgctctggctggggagggcctcggcccccgcctgcacctgcggcccttgtttcttgcgcggttttgcaacgtcagagccgtccacactcgcaggccatttttagcggcctgttggaaagggaagacgatgaagtcgggctaagcagggcaacgccttgccctctgagaggcgtggagggcccttgggaagctcagagagctacgataaaatggctaaacgaccttcctctcctccaagtcaccaaatacgaggcaggagaggtgcccgatgagctcccagtcatgtggttcagggcgggctctggaagactcacagaggagactcctccgagaaaccaagaaggtttctgtccaagtcgggatctgctctgctcaggatgctcctccaacacacacagtgaaaaactgagcacctagagagcaacaccaaaaacccatggccaataatggagagccaaatcaggagagcattcagcaaagcaattcttgctgtagaaggaacagcacaaaaagctggaaggaaactgaggcatgcgtgaaagataacttgtcagtgtttgcagtctactgagatccccgctgcaagaaaaggcaggatttccacttgcttcttggcccgcctctgttgtccagaatccaggacaggtgacaagagaagcagatgtgatctgcacaagctggctcagctgggttgggagttgctcttcctggacaggccgggaagggtgctggaggggagggaggaggagagaggttttaggggaggggtgctgagcagtcaggtaggttttctgtgtgtgagaagaaatgcttgaacatggaaatgaaaagttctaactgtaggatggagtttacaggctcaactctaagctttcagaaagcatctcttgaaaataaaatcttggatgttgtagcaagtgctgtgtacatgctcttcagctcctagccccatcctactactgtgaaagtgcatgcctgtaaactgccaccctccagcatctttttctggccattagagcctgattttcctgaagattcagcaggttggaatgccagagaagtaatgccctacctgcacccagcagtgttccaccagtggctatgggagtggctcacacactccagctaccttccttcatgggactggaacctggagttcccaagagggattaggctctagttgtccatggggcagctgttttactgtcaccttccctgtcctgtctctcttcctgtctccactccctacagtgctcccagagataacttcccaaatttgctgcctgcccttggatgttattttagggttggcttctgaaggaacataaacgaagacagacagatgtgctgggtagctatgtgtaagatcacactgaaacatagccaagaacaaggcactcagccactcccaggtttaaaatcaagtttcctactttgtctctctggtctgaatctgagtgaaagcccaggctcctgcgtcacctgggccacctaaggatctccctccagcctctgggtgctgaagctccacctgccctcaccacatcacaggaaaccgcgagcacatcctcctgccttctccagcagtctcttcagtgagcgcctgcagaactgcatctagagcaccgggccaatattgtcaccttccctgtcatggcttccttcctgtctccactccctacagtactcctgagagccgggagcactccctggagcactccctgattcgttttatcttctgcacaactgtttggctggaataggaagcaaatggcatggaatttgcatatgaaaagccattcccacctgtgtccttgtgtctgtaaggataggaggatccaatcttcttatctgaccagccctgtcaacaccttcatcttgtttcacatttgtgaaggtcggggaggcatctggagcttcttgatgtgtcagctcggaatgctgcctgtgggctgggtcggcttcaggcctgcaggtcaagagagaagcacagacaaaggcaccacagagatgcacagtgacactcaaagaggcagcgagacagagatgaaggcgtcgtgctgtgagagccatcgcccggcagcatcccctctcctgggtgtgaattatgtcctccaagggcctcagccactgcagcttgaaagttacttttatgctatttccttaaaaccaacaagaacacttgacatttctaggaggctttgagtagagaacactggtggttctcgttggttgtgtaactctgccaggaatttagaatattgttagaatctttattacatttcagcctgataaggagatgaaatagctaatgaatccactaaaaaaactgccaagtagcaaagctggaaactttggcctttggttgtcgtataataacacaccccaggcacagaaggtttagcacatttttccttactaaaacacaaaacaacaacaccaataacccaatgaggagtcttcaactcctcccaccccatagccctgggc

SEQ ID NO: 674 - DNA, 1623 bp, Homo Sapiens
ccctgtgaagaggtgccttccaccatgattctaggtgtcctgtggcttccccagtcacttggaactacaatagctgaagaatgtgagaaagaaaaatcaaaagcacacaaatgagactgtgcagtgaagaggccacagagacaaccatactgtctttttgtatcacaataagcaaaaataccaaggaaagaggtttattgagcacgtggttctctaggctgggaagttcaagactggacagctgcatctggaagcttctggtaaaggctttgtacagtatgaaaatatagagaaacagaaggggaagcaggtgttgttaagagaccagacatgagagacagcctcattttataacagccagggtaactaaatcagtctgaggagagcaagaatttactcttggaaaaaagacattaacttctcttaacgatctaatcttaaggcacaatgtctcaacaatgtctcacttgggaacaagcatcaacgtgagttttgatgggaacaaaccatcttcaaattatagcagtttacttttcactctattaattgtgttctttgatgaatgaaagtttttgattttgatcaaggccaatttatctatttcttcttttttgttatctgtactttttatgtcatacctgtaaaatcattgccaaactcaatgccatgaattcttttatccatattttctcctaagagttttatattttagctcttatgtttaagtctttgatacattttgagttaaattttgtacatggtgtaatataaatatccaacttttgcatgtagatatattttcccaagcaaaattgttgaaaagactgttcttttcccatcgaataattttggcacacctgtaaaaaataactggattatgaattcaggggttgatttctggactgcctattactgccaattagtatttatgcctgtaccacactgttttgattactgtagctttgtaataacttctgaaattaaggagcataagacctacaagtgtgttttttctcaagattgttttggctattcaggtcccttgagattccatgtaaactttaggatgtatttttctatttctgcaaaaaacatcattgaaatttttatagggattttcactaaatctatggatcattttatgtagtattgacattttaacattattctaatcagtgaaaatggatttccatttatttatgtcttctttaatttctgtcagcttcattttatagtttttagtgtacatgtctttagcctgcttggttacatttatttctaagtaaatgaaattgttttttatatttccttttcagattgttcattattagtgaacaatgatatgcagctaaatttcatgtgttgattttgtattctgcaacattgctgaatttaaattagaactgagccctattagttttttgccacatttttaggattttctgtgtgtaagatcatgtcttttaaaagaaataattttagttttatttttccaatttcaatgtatttcatttatttatttgttgcctaatttccctggtgaggagtctattaaatagagggatgaaagtgggtatccttacattgtttgattctaagtttctttttaaattataaacacag

SEQ ID NO: 675 - DNA, 3965 bp, Homo Sapiens
cttcctgccatgtggtgacagattaaaagctgctatacactttggaactggaaactgagctcccaatataaaggagataagccatcatgcttacaatatgttgtgcagagctcactggtgggcagtttttcttaacaatgcatcaggacttttgctatttgtaaaggaagcttaaaggaagctgagagtgctgagggcacatctgaaaccactggaggttggcgacgtggaggtcaggtagtagtgctctcccaccaggagtccctctgcacccctggagagagcagtcattatgcaggacaacccatctgctcagaactttcagtggcgacttgtggtgtgactctgttcccattcatctatgtgctgctgtaggcttagcttcccacagcctccccagctttgccatttgtcattatcatttactcttaatatttattctatctatgaccctgatgcacagagtgatagctgatagtctcttaaaacaacgtttacaattattttgacagtttaccgtgttttgttctctcaacaatacttagaatttgtctgagttatagttgcatagacggcaattttcctgacctagttttctgactatgatttatgggtcagtaaactccttaaatgatggaatataacatctcaggccacagggaacacttactatcacatgctcactgttgcaggacggatgcgtggccagcctcaggttgctaaatgttagggtgatctgccttccttctggggcggtgattctccacttgtagatccggccatgaggatttaggttcgggtagttgggagaagtagatgttccagcagagccctgaagatccccaccacactctgatgtgggggaagaaagccaagaaaacttccaatcaaatcaaaatgtctccttccatcaggaaagctctcaaaattcaggtgtcctgcgtgtacaaagaaaataataaaaaacaagaccttgcccatgaagaaatattaatctctctcaagaaaacaggaaaacatgaatgaaaattaacatattcaaatatatgaagaagtgaaaaaaatgcaaccagttaggggaaggatatctcaggataatgaggaaggccagttttttggttgaaaaagtggtttgagacaacagagtgacaaatatctgccttatgctactgccaggagacatgcatgaccctctttctgcctcaagctatagaacacccctcaaataacggcatctggcaatgggatgtctcagcagcaacaggttgccttcccactaccgttgctctccccaggtggcctccagggtaggctatatgacacctgggctctggacatccattgttaatggtagaattgaggtagagaatcactggtactgcccaaagcccattaatctgcacttctttgcagagtatagacatgctttgcctttcttggaagtgaagaaacttcagaggctgaataagtacatgcgaaaataaacaccccaaagagagcagatatatttcactaaccagaagtatgatagtcccaggtctccacaaagtctttttcacagccagaggaattctgaaggttaaaatcttcaaaagagatggtgagatagtgtctggagagcccctggagatgccaatcacagaataagttgtctctatatggaagcattagatggccaatgctttcaacaacaccactttgccctgttactcttcccccacactgagctgaaaaaaaaaagaaagaaagaaagaaaagaaagaaaggattctattacaaactgtgtttttttcatttcaccagcacatgtgaaaacttttaggtgccaagtgactatgaattgaagtttttaaaattctgaaaatgcttagtgctttcctcattatttgaattctagggttgatgtaaacagaagtgataccacaagtccaatccaataatgggaaacaagatgacgaccaaatggcacattctgtaatgtcacattaattcttttgggacactatgtaagagctatcagttgcaagcaagtttcatctcaagaacaaactggtagactcatctgacctgcctagaaccttgtgttgattctaaagactgaacccaagctcacctggaaggggggacacctgctatatctagttttactatcaactaaactttcactactgtaactgatatctcagggccttgaaaattactattcaattatgtcttattagctggatgtggtagctaattgaattatatgcagcttgacccgggatataatatgatctatggtgtagttaaatactgttacaactagcctttctgaacttttgctatattaaatatttgtttggtttgtgtctagacctatcagatactaaattgtgtgctattgtgaccatactatagtgaatcttcaacaagcaaagttactgctcaatttttaagtaaggaaatcaaaatcctgaagagacatatttgctttttatccagtgactgatttggcactagagactcagagaaaaaaaaaaagcttaatcattttatatatgatgaggaattcaaagacattgttctaaatatagttatctggttcttaaatagttgtattacttaaagtaataaacatactgtagttcttccttttccttggcggatacattccaagtccccccagtgagtgcctaaaaccttggatagtaccaaaccctatatagacatatagacaatttttttctacatatatgtacctatgataaagcttgctttatcaattaaacgtagtaagagattaactaataataaaatagaacaatcataacaatatactgtaagaaaagttatgtaaatgtggtctctcaaaatatcttggtgtactgtactcacctattttttgggcctctgtttaccaagtgcattgaaaccatggaacatgaaaccatggataagagagaactactgaatttcatagtaagcagaagaaacaggagtttgatttaactacacatatttcttcacaaataagttagaaaaaatataaaatattcaagtttactaagattacattttaaaataaaaattaaaagagaaattaaagttgatgactgtggttttaaacatttacactccttacttatttatagcattaaaatatttttaaaattatgcagatagaatgacttctttttaaaaagtcatggttttaaaaaaagttttaacatattcatcctgtaataactcttttatttaatataaaaatgttttccagggtttttatagttttgtgttttacagttaagtcttcaatctatcttgaattgatttttgtatatggtataaggaaggggtccagtttcaatcttccgcatattgctagccagttctcccagcatcatttattggatagggagtcttttccccattgcttgcttttgtcagctttgttgaagatcagatgcctgtaagtgtgaggccctatttctaagctctctattccattttattggtctatgtgtctatttttgtaccagtaccatgctgttttggttactgtacccctgtagtatagtttcaagtcaggtattgtgatgcctccagctttgttcttttagtttaggattgccttggttatttgggttctttctggggtccatatgagttttaaaatagttttttctagtactgtgaagaatgtcatggtagtttgataggaatagcattgaatatgtaaatttggggaagcagtatgaccactttaataatactgattcttcctatctatgagcatggaattttttttcatttgatagggtggagggtgggagaagggagaggggcagaaaaaatagctattagatactaggcttagtacctgagtgatgaaataatctttataatgacccccatggcacgagtttacctatataacaaacctgcacatgtaaccctgaacctaaaataaaagttaaaaaata

SEQ ID NO: 676 - DNA, 7985 bp, Homo Sapiens
gcacacacgcacgcacacacactcgcacacacgcagaggcacgggagggaaagaagccgatgaataattttgctattttttaaaatactggccgccatcatcaagcagcgagcagcagcagaagcgttgaagggagaggaggcatcgggacaggcccctcttaggagaggatttatatctagttggaaaaaaaaagaaagaaaagaaaaagaagaaaaagaagaaaaaaattgtcaagcccccgaactgaaggttacgagcggcccgtcagcagcccacatgtaaccgaactgtcgtgtttcatggctttttgccactccagctgtcaatcaaagcccggaatgtcaaggtagtgaatgaatgatggttgatgatgatgaagaggaggaatctttcagacccgtttttttcttccagtaaaactccgcgaggggtttctgcttcttgaattttttcctcccccctccccccttttttagctttgcccccgcggtatctataatacgatcctctctctttaaagtattgttcaaagaaagcagtgagaaaaatcaagaaaaaaaaatgaatagtttgcaaaaattggacttcctccccccctttcctggaccagaagagaccagcttaactcagagcacactccctccaagcggtgcggacaaggggccaccccgagagtctttgggggccgcggcggaatcgggagggaggaaaactccaagattaaaagtatccttatttgttgctgagttgctcgtcgacatttaagagaaggtgagtaaaaaagaaaagaagatgaaagagaaaagaaaaagttggtctccagaattttatttcaatcgacagttacgcgaattcagtttagccgggaccgggaggtttgagagtgcggcggggtggggaggggaaaaaaacaaaaacgctgcggagcgttttcgactttgcaaagctgttgatgttggtgggtccaagttcccggtgcagcgccgctggctgagaaatttgtactcagtttttactcttctaattattcttaaattcaatttaagaatttaagtttatcgtcgccaataggattattgttgttttaaatgtcttgttcaataagtgccagttacgtttctttttaaaagaaattcctcagtgtccttgataaacctttttttgtaaagatcaacttcatgcggaacctctgccttgcagggtttaaacattcaacattgctaccttctgtttctttttctgtttttatagtgatactgtaaagtgagttagcatctctatagctttcatttagaaaaacttaagtcgcatttttagaaaaatattccttcccttgcagtgtgagtaaaaacaactcagacagattgatgatttctatattttcttttctttctttatcttctttttctttttttcttttcttttctttttttttctttttttttgagacggagtctcgctttgtcgcccaggctggagtgcaatggcgcgatctcggctcactgcaacctccgcctcccgggttcaagcgattctcctgcctcagcctcttgagtagctgggattacaggggcgcgccaccacgcccggctaattttttgtgtctttaatagagacgggggtttcaccatattggccaggctggtctcgaactcctgacctcctgatccacccgccgcggcctctcaaagtgctcgaattacaggcgtgagccatcgcacccggccgatttctatgttttcaaacaattgtaagctaataatgagttgattatctggtgataatcttgggttttacaaaaaaagaaaagtttaaactttattttcatgtgtttttatcagatgcagaaggcatttttaaccttaacgcctttctctgtctctctctttcatattcttaacttcttttgcattttattgaatacattaaagcaaacaacaggaacaatatggttaggtgtaggagggagagagaaatatgacattttaagatattgtcaaaaagtcatatttaacttcaacgacttttagttaaaaaagtgtgagagtgttgaaagtgcattcctactggaggaaatctatgtctttttaaaatttgccagttgtctcaggggagaacccagaatttctttgaacgaaagagatcttactgatctagttgcatgtcacttatgaaactgttagtttaaaatagcagtcctagtgtagtggattacacatgaggagatcaagttggagtcgattcaaggtattggttcttggtcagtctgctgaattcaaaacactattacctttaatcagcaacttgcgggtgttttattaatagagctgaaaaaggctcatctaacatataagaatttcctggtttccctcatccccaattttccagtccaatagaagcgattccaaaggagtagggtacccgcacttactgatttccatcctggtggcattttgctaatgccccattgtcagcgttggcactcccacccaggcttccaggctcatctgctctcccatatttggggtgaaaggaaagtaggtggggcaggcccgggagacaggcacgaaatgggggtcgcaggaggtggcacacacctccgtcaacagtcagctccttctgcccaggctggaaatggttttaacaggcggtaaaatttcatcttgcggtgtcaaattggggtcattttggggttagagttctcagtgtccgagaggagctgtccagctgcgtggggactcattaactgcaaaagatctgtttcagtaaaaacaattcaaagacaatcagaaggctaaagaccctctacaaatcgcattttacaagtgccccagaacaaatatggatggtgaaacctatttcttcagaatcccaaatcagctacttagctctggagtgggggtgggggtactgcataaaaaagaggtgaaaaggaggggaccaagcgggtggggaccagtggaagggggaatcgggcctctcaaatttaagagtctgtttttaatcacctctttcttattgaagcagccccaagagttctgaaaactgctacttttctatttttcattttctttttttgagccaacatggaatgctattataggtaacatttaagatttaaaaggaataattgaattccactatagtcccttaatttgaagggcattggctttatggggagtgtttaatttgaaccaagaatttatgaacccagactctaggtgaatttgcccacactccttaaggagcttgtgtagctgtttctttttcttttccttgaaagttatagcttcttagcacagataacttcaaattcctcagaactgagaagtccaaagtgttaatctgtgtattaaaatcgccaggtttaaatcctttttgtcttcttacaacagttagaacaattgacgccttgctagagaagcaaataagtccaaccttaatcttatctgtaactttatttaatgttttgatttggaatattttggattaagcatatctttaaaaactctgtaaggttaatttttattccgggagggaagttctctttactgattttgaaaaaagacatgaattattactttgattttcaaaaattccttcaggtaaaaggaaaattcaggtttaaaatgagaagctagatatgtgaaatgccagagattttaggataaaaccaagtcaatacttaaaagtaaagtatcatttgaaagaaattttatttcttgcattactgaactgagcaagtaacagtgatcaaaaatatgttattctctctccatctctctctctctctggactccacttctgtcactaggtcttctctttccatccccagcacttttctttgggttctgaatgacacagtgattttttttttttgtagtctagttattttctccaagcgtctcagagtatttctaaattgttattcaaggagtttgatttcagccctgcagaaacagccctgagcccagcatcgctgggacaaaggcagaaggggctatcttctgttcaagacctgctggctgacagttggaatttttgatatatattttatttggcgtttccaataacgtgtttgtctttccctctccaccccttgcagccatctattacttttaaaacatcccttctccataaacatcggctcatccttgtgaactattcttgaccttcccagcagtgtaaccagcagctctgaaagttggcctagaaataattccactggcttccttacctgttaactttactcactcttcctagctgggatcaacagaaggaaggggacttttttgtttgcttttgttgttgttggtggtggtggtggtggtggtggtggtttttggttctttggtccttttcccacttaaactttctataatgatttattctccgcctcctcccattaataacgtttaagcaccccacactttattttttaaataaaatggagtaaaattattatacttttttcctttatgcccccttttcttttatttctcccaattttaggggcttcaccatctcatagaaaggacttcaataaatagccctctagcgctatctggcggggctccaaacacgacgtgcgcttgctctcactgtttcttcctccttcccgcgctctcttctttcctctctttcttcctctctcctgctttttctctcgtctcttccgctcgattgttttcctctttttttctgtcctcctgcggcctcttgtctagttcctacccctacttcagcgcaggcggcttggaaagccccggccagaggctagtaactctcgcaagtgggagatgctctggcgacggatctctcttttctgatccctcctcccccttacccagcgcggatcacacacatcctttgcctttgattagcatcttaaagttgcttagcgtgccgcttaagtcccagcgtctcagctggcggtggtttggagaggcttaaaactgcattcatgaagtttggaggaaagaaatcagacactggaattcagggctaggagcccagctcagttttaggtcagaaggccgagtctcagtgcgagattgaggaagggtcggggcttaacgggggaggtgggggtggcgggggggggaacagcacggcgcggcgcctagcctgcgagatggagtcggagtgggggtgcgagcggtcctccaccgcctctgcccgatccgtacctcacaatggactgctcgagtttgtatctaggcctgtccaggattgtttactccttcaattaatcagctttatctcttttccccctccccccacctccaccaaatctggagaggagtgggaaagaactggaaaactcacagggcaaagagagaaagccaacagtcatagtgcgggaggaggcacgcctgggatgcaatacccaacagtctcctccctgctttcctgcaatttgcaggtcattgtctttcttatttgtagctttttttttttttcttcagtagccggtaaacaatcgaacgccgggtagggaggtcagaggggatggggctgtgggagagattctactcaggctaggtgctttagatttggacctggctgtgtccctactttattaaaattctcatgtggcgcgcgctgtcttctctcttctctctctctctctctcacacacacacgcacatacacacacagcccgagagaaatttccaatctttgagcaaatctcttccatctagtccttgaaacagaggaaaggacatgggacctgaaggagagttatgattgaattttctaaaatttagttttgacattgcaaagtaaaagtgaggaccgtattcccaatacagacccagagggtggttatttcaggtgaggggacctcagcctgtgacgtctatgatcaaccagacaaagaccccttcctaaatctgaagtcccacccccacccgtggcaaacatggaatacaagggaggggaaggatggcacaatagtgggttctgttttccaagaactgccccccacctccattgcagaaggaaaaaaaagcacggttcgggtgtaattaattggggactgttattaggtcatcattagccaaggtacaaataatagcagcacatttttacttaaaattgaccagccccagagtgatagatcgatttggagtataaaaagatgtatcaaaacatcaatgtcgattatttgaaatattgtagtcgaattttttttattgcttcatcggttaagtgtctgaaaatgcagtgttcaaacatatatttatgttgtcaatactgtcagaactgtcagttttactatactggatttgtactatatttcaaatatgctaatttacataaaatgcccaccctaggattccccccctacacccaccccatctctggaaaatccgtgtcagtttcttcaaaggattcagcaatctttgcctaagctaaagtgtgcactacctcttttactcaattttccacatcggattacatgtctttttcaccatctctaactttcaaagagatccttcttcctttctccccaattctgcctactctaacctcttcttcaaaatagtactgaggcacttggaaagcttcgaatttaaatatccacatcccagctccaaatataccattggagtaaaaaaacggaaaaactggacttgagtgtacttggccgcactcgggtaaaccaggcttcaccaggtagacgttctcataccgtaagggtccatcatcaaattacctggcagattgaaatcttccagggaaaatgaatttggaaatgtaaacaccttttctttctttttacttaaaagcctcgatggtagaaaaagaaataatacttataaatgatcggcacgttttaactttaaaagcttttgaactcaagtgaaagacacacgttggaaacagaattgatagttttaattctacccattttcacctggcacatcagatcagtggcaatcatttattttatggggtgtggaggggaaagggatagaaagcggatagaaagctagaatccactgaagtccctgtcctaaaaatctcagagaaattaaagacttattgaaacacaaacattccatcgctccatactctccgtccagatgaattgaaacttataaatccacgctctccccaattttatgttttttatttattttttttcagggtttgataggaaagatacccaagtctgatagggaagacagggccacttctggactagctgtgaggatgtgttttcatttccataacactgaagcactttctgtaaaccttttgatgtacttaaataagtctatttggacatttaaagaagctacacatacaaacatagcttggctttttgccgtcaatcccagcattaaaaaaacattcataatctaactgagaagctctttcatacccatccttctttcaaataagtaaataaataaagaaatagaagtgcaaaccaaagaaagtttccagcgtgcatctgtacgtcttcgtgtgcgagtttataaacaacttccagtcggtacttgggtgttacctccctcctgccacacaccccaaggcagaggcatcgagggatcgcccccagagagctgtgtttacttagcttgttttaaaaaaaatctcgccgccatgtatgacaagtgttactgcaagaaattcatcagccttctacagatacttccagttttgctgtaatgatctgcagaagagaactgccatcactttctcacatcccaaggtgttgcaggaactcagagagaggggagagtggctgaaacgcttaattaccggaggcgaaggaggggcgcgcgggggaccgaaggagaggggagtgaagaaggaaggtcctttaccaggcttgtacctggagaaagctttgaatcgcttctctgctatatttggaaaaggtatgcttgctttttaaaaaaatgcctttagggcaaagtgatacccttgtgtaataattaactcagacaataaaaataattgga

SEQ ID NO: 677 - DNA, 1903 bp, Homo Sapiens
attgaacatttaatattttggatgtaacttttgaagaaagtatgctttggtgcttaaaattgtatatgattttaggtaagaaactttgataatattggcataatttagatttattttctttcttttttttgagacagtctcactcagtcgcccaggctgaagtgcagtgacacagtctcagctcactgcaacgtctgcctcccagattgaagtgactctcgtgcctctgccacagagtagctgggattacaggcatgcaccaccacacaccgctaattttttgtatttttagtagagacagagtttcaccatgttggccaggctgcgaactcctgagctcaagtgatcctcccacctcagcttcccaaagtgctagcattacaggcatgagccaccacacctcaccagatttttaaaaaatatataactgcatctctcttgattctggggcttggtaaaaatggatagataagatagtattctaaattcaaattcgtggctaggcacagtggcccacacctgtaatcccagcactttgggattccaagacagaagactcacttgagtacagtatgagaccagcctgggcaacatagatcttgcctctacaaaaaaaaaaaaaaatagccaggtgtggcacatgcctgtagtctcagctgcttggaaggctgaaatgagaggatctcttgagcccaggaggtctaggccagagtgagctgtgatcgtgccattgcactccagactgagtgacagagtgagactgtgtctaaaaaaaaagtttgaattaaaaaaaaaaaaaaaaaagtcggctgtgcacggtggctcatgcctgtgatcccagcactttcggaggccaaagtgggtggattacctgaggtcaggagtttgagaccagcctgaccaacatggtaaaactccatctctactaaaaatacaaaaattagcctggaatagtggcgcatgcctgtaatcccagctacttgtgaggctgaggcaggagaatcccttgaacccagaaggcagaggttgcagtgagctgagattgtgccattgcactccagcctgggcaacatgagcgaaactccatctcaaaaaaacaaaaacaaaaaacaaactcaaattagcatgatagatcaggctacttagattcagctttctgagatgttatttgttaacattaaggctaatttattataatgaaaatgtaaactttgaggtatgttaatatataaacatctttttcctttggcctaaaaggtctttagtattcagcacactgggtaaagttcagtttagacacaatcaaattggcatcttttaaacataagtgaaatatagagagcttgaacttgagttacttaaagaagatacagtataattaattatacagaacaaaacaaagatgtgtttagagtgactctggcctgactcttgtccatcagcccctagtagcctatcttcagcctttgggaagtcttaacttcccaggttaaactagaatattctggaactgagctgtccaaatttcatcttaaagtggatcatttgactctgaaacacgattctcatggcagaaaaagccctggtgtttccttggagctggggataaaggccagtgagccagcctgtgatgagagctgcccctggcactatctgagtggaaagctcattgggacagccatgcagctatcagagccgactgaagccctgtcccttacccctcaggcacctgatgcttaacttgcctcctgggaaataatgatctagcatttacttggaacaatgattaatcatgttctttaataattgctgacatttgtattttaagctgtataccaatgttcgtatttgacattgattttctaaccattagagatatttaattaaaacttggaaatgaaag

SEQ ID NO: 678 - DNA, 2018 bp, Homo Sapiens
ctgtgccaacttgtttcaccatgttaaactgcatacatacccatgaactatttatttacaatacatttgatctcgttaagaccccagttctatttccaaggcatgcagcccaaaaccaaaaagttaaaagatgataacactctgtggttgaattacctatggaaaagaatgaaggcagttcactctgtttaagatgtggagaatttcctacaaatagttaaggtgaaataaaatcattaatagagagtaggttccttccatttgagtaagtgatctagaatatgggataccacggttctttttagagcattttcagtgtagcctcattaacttctccaatttaatacgacatacatacttcttccacctgaacataaaattcaagaataggagcatcctacatctttcattctttccaaacattacctctttagtaaattcgggttgctataacaaaataccatggactgggtgactaaacaacagtcacttgtgtctcaagttctggaggctaggaagtctaagattagggtggggcagaataaattattggtgaggatctgcttcctgatttgcatgttggagaaagggctctggcctcttcctcttctaataactacaataatttcatcatgggggccccaccctcataatctcatctaaacctaattacttcccaagcgccccaacttcaagcaccatcacactgggggttagggcttcaacatatgaatttggggggggatataaaaatttagtttatagcactcattttcaggtcaaagagcccacttccctaatcacatacttcaataactagttaggtaattattgttttactcttttgtagattagatcagagacattaggtaacttgtccaggacacacaacatgcatttttaattaaattggatttaataacccttgaactttccatttatatcatgcttatctccagaataggatctctcctaaggaggcagagtgatttaaacaaacatgtgctgcttcaatctcctttactcctaaacttccattgatattgctagggacaaaaaattaagcaatgatctattttaggaaatcaaaatactgttcattgaaaagcagttttaaaacaattattgacatttaataaatacagaattttcagagggcatctcttctatttcaaggttacctcccagaaaaactgacattctaattttcttctcttgaaagcaattagaaaaaatgctaagaaatgattttatattttttaaagtagagggccaatgaagtgtctaacaaaaggaaagcatacagtaaatgaaaaataaactagttatcagattgtcttatatctttccttcataggacattgatacagacatcatcaaattcctgtttgtattgccttatacatacttaaaaaacaagatatttacaaaaatattttagatattcctgtctaggaactaaaattacagctgatttagaatttgcttaattattcagaaggaattgaagtgaaatgaggaatacaaatttacttgtcctaaatttttaaataaaatgtattatattttgtagtcaattatatataccaaaataatgtctgaataagacgtaatcctgtcatgagttctctcttccaaaaaagaatgcaagagaattgattatcttagttagaccccatttttaaggaaaaaatacaccctgtatgatacattcttagatatatgggtttgagattattaacattgataatagtttttttaattcatcatctctaaaactctaaaactttagtgagaaagataataaatagaaaattaccctggaaattaaaatttttagcaatattgaatacagtagtataattttttgtggctcttgatttcctaagaaaaatagtgatttttatttaatgaaaatttctcaatttggttaatattctaagaaaagattgatatatttaagcatggtgattagaaaaatatgcatatttcctgctcataataaattttaaaacaac

SEQ ID NO: 679 - DNA, 9590 bp, Homo Sapiens
agagggcagcaaccgacttgtgcgaaaggagggaacgtgtgggtctgccagggtcctgcaggggggatgagaccctcgctccgctccggcgatcccttcgctctccaccctcggccagcccctcctgtcctccatcaggcctcgctgaggatacctcctgggttccaaagcgcgagttgaacctgagcttgacattcattccgtctcgtacaaaagccatgcctgcggggagagggagaaaatttcctacaggagcctcaagactgcgtttcaggaagccctaggacccactgatcctgcagctgcgcctctcactcgcctcaggtttggattaattgtcactttctgttaagctgacatttatggagggcctagtgcgtcctgggtgctgcgctatttaggctgttgcacagaggagtggccaactccagcaaggctcttgctttgctgcttccccattcttcctccgcctgtaatccagacaaaagcccacattgtaaccaatccaggggcagcttagcagtgccaagcaggcagctcagaggccactggtaggacagggcatgatcaacaggcctcctgatattttctaacatacgtattaacaagaaagaggaaattaaaaaacgaagatggacaacagaacttcactctgacttgagtgacttttatcctcatttggataatagttttcaaaaattatttgtgagtgtatatgtgctattcacaaagcaatggctactgacccaacacgtatttacatctcttcttcattattgcatttcactccgtaaatgtcttagcctagacaatcaacaaagccataaaccaaatcctgatttgtagcatttgctgacttctgtgtttaaattacccatcataggcgattttaagttacaatatgtagtcgttgaatacagatttggagagagtcacaattgcacactcttttatatttttccacctaaaaggtacaatagacataaataactctaagaacacagataacagcaaaatgtagcaactaattaggaagaaatgaattttgtgtctccattacttttccagtaaaattcatctaacaagtgtattacaaacaagtgtatgcaattgaattttaactcaaaattttagaatttgaacaattgatgctagttagggtgtgagctagctccagcacataatcctgtcccgtgaagagaagttttatggcttacatttttagatatatctaagtttactggaactcaaatacagaacaaaatcccaccaaaattaacatatactgtcatatataaatatatacacttttatatgtgtacatatatatgtgtatacacactttaatatatgtatatatgtatatatactttatgtatatgttttacatatatttttaatatatgcatgtatctgtatatatacttttaattaacagtcatgttacagagggcctactctgacagaaatgtacatctctcagaatcattatcatccagtgcaagtgtcagctaactactgccaataggctagatatctctagcttgccacctggttttgtactgccagagagctatgtatggattttacacatttatactgtaaagaccattatcttttccacatgaacagttgcttgaagagttgagggtattggcagtagcaacaacagacaactaaagaacaaagcaaatatccagtatgtttagatgagttggcagcaatgctgttatttccttgaggagttaatgttgagtttgaagtcactaaagaatcatctcctatgaatagtctgctgggaacaactatacatgagaatatttttaaagaagttgagaaaatatgaattcattacaacctgaagtacaatctgctaagatctctttcaattgaatctgagacagtatgtggaacagaaaaagtctaatttgaaaaaatttacaaagcttgtgaaaatatacgttgtttatttatttattcattttattattcatcagcagtactttgcataaaacattttaatctatcatttgttatttaaaccagcattgtcattgctgaactacattcactctggtgaacagttcagacaactagaaatgaaagatgaataccctgagcttgtcctactgcatggcagtttgatgggttaggactcaatttttttgaaatttttgagcttaaggaagagatcaaaatatttttctgtatgaaaagaatttcccttggcctgtactaacaaccactgaatgactttggaaattagcttttgctacagacttgataatgcttcttatatctttctttcttttttttttttttttttgagatggaatctcgctctgtcacccaggctggagtacagtgactcgatctcagctcactgcaacctccacctcctggattcaagtgattctcctgcctcagcctcctgagtagctgcgattacaggcacgtgccaccacgcccagctaatttttgtatttttagtagagatggtgtttcaccgtgttggtcaggctggtctcaaactcctgacctcgtgatccgcccgcctcggcctcccaaagtgctgggattataggcatgagccaccatgcccggccttgataatgtttcttaatgaattcaacctgtatatatacaaggcaagatggtgcttatatatggaagttatactgcaatatatcctttagataacgaatgttatataaatccctagtaatgttgagttgatctgtaaatttcttatgttggaaaaagtgaaaacaaaatgaactccattcccacactatttgaagcatctataatttcccagatcaagctacagcttcaattacatttttctcatctttaggaaaggacagaggaaattctgatatctcagaatctgtttaattttccaattgagaagctgccacctaacttttcttttctttttttttattttatttttcacagagtatcttttttttattattatactttaagttttagggtacatgtgtacaacgtgcaggtttgttacatatgtatacatgtgccatgttggtgtgctgcacccattaactcgtcatttaacgttaggtatatctcctaatgatatccctccccgctccccccaccccacaacaggccctggtgtgtgatgttccccttcctgtgtccatgtgttctcattgttcaattcccacctatgagtgagaacatgtggtgtttggttttttgtccttgcaatagtttgttgagaataatggttcccagcttcatccacatccctacaaacgacatgatctcatcattttttatggctgcatagtattccatggtgtatatgtgccacattttcttaatccagtctatcattgttggacatttgggttggttccaagtctttgctattgtgaatagtgccacaataaacatatgtgtgcatgtgtctttatagcagcatgatttacaatcctttgggtatatacccagtaatgggatgcctggggcaaatggtatttctagttctggatccctgaggaatcgccacaccgacttccacaatggttgaactagttgacagtcccaccaacagtgtaaaagtgttcctatttctccacatcctctccagcacctgttctttcctgacttttaaatgatcaccattctaactgctgtgagatggtatctcactgtggttttgatttgcatttctctgatggccagtgatgatgagcattttttcatgtgtcttttagctgcataaatgtcttctcctgagaaatgtctgttcatatcctttgcccacttgttggtggggttgtttttttcttgtaaatttgtttgagttcattgtagattctggatattagccctttgtcagatgagtagactgcaaaaattttctcccattctgtaggttgcctgttcactctgatggtagtttcttttgctgtgtagaagtctttagtttaattagatcccatttgtcaattttggcttttgctgccattgcttttggtgttttagacatgaagtccttgcccatgcctatgtcctgaatggtattgcctaggttttcttctaggatttttatggttttaggtctaacatttaagtctttaatccatcttgaattcatttttgtataaggtgtaaggaagagatccagtttcagctttctacatatggctagccagttttcccagcaccatttattaaatagggaatcctttccccatttcttgtttttgtcaggtttgtcaaagatcagatagttgtagatatctggcattacttctgagggctctgttctgttccattggtctatatctctgttttggtaccagtaccatgctgttttggttactctagccttgtagtatagtttgaagtcaggtagcgtgatacctccagctttgttcttttggcttaggattgacttggcaatgtcggctctctcttggttccatataaactttaaagtattttttttcaattctgtgaagaaagtcattggtagctcgatggggatggcattgaatctataaattatcttgggcagtatggccattttcatgatattgattcttcttacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagatcactcatgatttggctctctgtttgtctgttattggtgtataagaatgcttgtgatttttgcacattgactttgtatgcttagactttgctgaagttgcttatcagcttaaggaaattttgggctgagacgatggggttttctagatatacaatcatgtcatctgcaaacagggacaatttgacttcctcttttcctaattgaaaaccctttatttccttctcctgcctaattgccctggccagaacttccaacactatgttgaacaggcgtggtgagagagggcatccctgtcttgtgctagttttcaaagggaatgcttccagtttttgcccattcagaatgatattggctgtgggtttgtcatagatagctcttattattttgagatacatcccatcaatacctaatttattgagagtttttagcatgaagggctgttgaattttgtcaaaggccttttcggcatctattgagataatcatttggtttttatcgttggttctgtttatatgctggattacatttatgatttgcatatgttgaaccagccttgcatcccagggatgaagcccacttgatcatggtggataagctttttgatggtgctgctgcattcggtttgccagtattttactgagatttttgcatcgatgttcatcagcgatattggtctaaaattctctttttttgttgtgtctctgccaggctttggtatcaggatgatgctggcctcataaaatgagatagagaggattccctgtttttctgttgattggaatagtttcagaaggaaaggtatcagctgttccttgtatctctggtataattcggctgtgaatccatctggtcctggactctttttggttggtaagctattgattattgccacaatttcagctcctgttattggtctattcagagattcaacttcttcctggtttagtcttgggaagtgtatgtgtcgaggaatttatccatttcttctagattttctagtttatttgcatagaggtgtttatagtattctctgatggtagtttgtatttctgtgggatcggtggtgatatcccctttatcattttttattgcatctatttgattcttctcttttttcttctttattagtcttgctagcagtctatcaattttgttgatcttttcaagaaaaccagctcttggattcattgattttttgaaggttctttgtgtctctatctccttcagttttgctctgatctttgttatttcttgccttctgctagcttttgaatgtgtttgctcttgcttgtctagttcttttaattgtgatgttagggtgtcaattttagatctttcccgctacctcttgtgggcatttagtgctgtaaatttccctctacacactgctttgaatgtgtcccagagattctggtatgttgtgtctttgctctcattggtttcaaagaacatctttatttctgccttcattttgttattacccagtagtcattcaggagcaggttgttcagtttccatgtagttgagcggttttgagtgagtttcttaatcctgagttctagtttgattgcactgtggtctgagagacagtttgttataatttctcttcttttacatttgctgaggagtgctttacttccaactatgtggtcaattttggaataggtgtagtgtggtgctgaaaagaatgtgtattctgctgatttcgggtggagagttctgtagatatctattaggtctgcttggtgcagagctgagttcaattcctggatatccttgttaactttctgtctcattgatctgtctaatgttgacagtggggtgttaaaatctcccgttattattgtgtgggagtctaagtctctttgtaggtctctcaggacttgctttatgaatctgggtgctcctgtattgtgtgcatatgtatttaggatagttagctcttcttgttgaattgatccctttaccattatgtaatggccttcttcgtctcttttgattttgttggtttaaagtctgttttatcagagactaagattgcagcccctgcctttttttgttttccatttgcttggtagatcttcctccatccctttattttgagcctatgtgtgtctttgcacgtgagatgggtttcctgaatacagcacaccgatgggtcttgactctttatccaatttgccagtctgtgtcttttaattggagcatttagcccatttacattgaaggtgaatattgttatgtgtgaatttgatcctgtcattatgatgttagctggttattttgctcattagttgatgcagtttcttcctagcctcgatggtctttacaatttggcatgtttttgcagtggctggtactggttgttcttttccatgtttagtgcttccttcaggagctcttgtagggcaggcctggtggtgacaaaatctctcagcatttgcttgtctgtaaaggattttatttctccttcacttatgaagcttagtttggctggatatgaaattctgggttaaaaattcttttctttacgaatgttgaatattggtccccactctcttctgacttgtagagtttctgccgagagatcagctgttagtctgatgggcttccctttgtgggtaacccgacctttctctctggctgcccttaacattttttccttcatttcaactttggtgaatctgacaattatgtgtcttggagttgctgttctcagggagtatctttgtggcgttctctgtatttcctgaatttgaatgttggcctgccttgccagattggggaagttctcctggataatatcctttagagtgttttccaacttgattccattctcttcgtcactttcaggtacaccaattagatgtagatttggtcttttcacgtagtcccatatttcttggaggctttgttcatttctttttattcttttttctttaaacttctcttctcacttcatttcattcatttgatcttccatcactgataccctttcttccagttgatcgaatcagctactgaggcttgtgcattcgccacgtagttctcgtgccttagttttcagctccatcaggtcctttaaggacttctccacattggttattctagttagccattcgtctactttttttcaaggtttttaacttcttttccatgggtttgaacttcctcctttagctcagattagtttgatcatctgaagccttcttctctcaactcgtcaaagtcattctccatccagctttgttccattgctggtgaggagctgtgttcctttggaggaggagaggcactctgatttttaaagtttccagtttttctgctctgttttttccccatctttgtggtttaatctacctttggtctttgatgatggtgacgtgcagatggggttttggtgtgaatgtcctttctgtttgttagtttttcttctaacagtcaggaccctcagctgcaggtctgttggagtttgctggaggtccactccagaccctgtttgcctgggtatcagcagcggaggctgcagaacagtggatattggtgaacagcaattgttgctgcctgatttttcctctggaaattttgtctcagaggagtaccccgccgtgtgaggtgtcagtctgcccctactggggggtgcctcccagttaagctacttgggggtcagggacccccttgaggaggcagtctgtctgttctcagatctccagctgggtgctgggagaaccactactctcttcaaagctgtcagacagggatattcaagtcttcagaggtttctgctgccttttgtttgcctatgccctgctcccagaggtggagtctacagaggcaggcagtcctccttgagctgcagtcagctccacccagttcgagcttctcggccgctttgtttacctactcaagcctcggcaatagcgggcgcccctcccccagccttgctgccaccttgcagtttgatctcagtctgctgtgctagcaatgagcaaggctccgtgggctaggaccctctgagccaggcaccggatataatctcctggtgtgccatttgctaagaccattgcaaaagcacagtattagggtgggagtgacccgatttttcaagtgccgtctgtcacccctttctttgactaggaaagggaattccctgaccccctgcaattcccaggtgaggtgatgcctcaccctgctttggctcacactcggtgcactgcacccactgtcctgcacccactgtctgacactccccagtgagatgaacctggtacctcagtcggaaatgcagaaatcacccatcttctccgtcgctcacgctgggagctgtagactggagctgctcctattcgaccatcttggctccaccctcactgccacctaacttttcaactggaaatgattactctgtaaagcaatgacataataaaatacaaatattaagaaaatagtctgacagaattctatctgccttttaagggataaatttgtacaattgaaattatatgctaatggattgatatcagtatttggcagttctcttaaatgtgaaaagctatttcaaagacaaaatctgtaaaatctcgtttcagatcagcattaacagatgagcaattatttatgatgagcacaactttgaacactgattacataaaatgttaataaaataattatcaaattgtacttgatttctattttgtgtttcatctataatactagcaagaatttttcttgttatacgaggatctgcattttatccttaattttgccttcagcctggaaacctaaaatatgtagtatctggccccttaaaacaattttgctgattcctgatctacttgaaaataaaattag

SEQ ID NO: 680 - DNA, 2954 bp, Homo Sapiens
tcttggctcactgtggatcctcttcctcctgggctcaagccaacgtcccacttcagcctcccatcatgcccggctaatttttgtaaatttttttgtagaggcagggtttccctacgttgcccaggctagtctggaactcctgagcccaagtgatccgcccgtctcggcctcccaaagtgctgggattacaggcgtgagccaccgtgcccggcctcatttatgaaactcttatctggcaggcaatgtgcaatgtgcttggcataaatatctcatatcctcacaataatcgtgtaaggaagaaactcggactcaacctcaagataagcaccaaagctcattttaaacctcactgccctctgcaagataactatacagatgctcctcgatttatgatgggttgcttcccgataagcccatcgcaaagttgaaaaatcccctaagtcgagccaccctaagttggggacgcctgcatcatgctttcagaggtgaatgtaaagtgggtgaagcggctcagtgattgagcgctagccaggattccacgccaggcctttccgtgttcaacagctgctttcagaagtgtggaagcctcggagagggtccctgaggtaagatgggctgagcgtcgccgccttctgcaaggacaccagccttgagagaagagaggagataaggtgcaaacgaagaaaggcagggacgccgcggtttcagtcgaagcgtgggctccttaaggacaggggctgtgtccgactcggctctgaatccccagcgcctacacaagctctgacacagcgtatactcagtaaacatggagtgaatcagttcattcaatgaatgaacgaatgaatgaaacgccagagcccgccacaggggtccgctgccgctccacgcccgggcctctcaccggccaatcaacactgtgactcgtacgccctgccccctgatgccacgcccatcactcgcccctctggattccctccggctgcgtggaaatcccggagcactggatttcccagaggcgcctccggtagcagtgcgcatgctccagcgccggtagctgaggcatcaatttcccgcagcgcctaggggacggattggaaagcgattggcttaggggacggaagccaagctccacctgcctgacacccggctcttcacgcagaaccgaagattcattttggacagcccttccccagtaccactcccaccccgacgttggtcccaatcggaacctatcctacacaaggctgaaaaaaagaggggagcgaccggaagtgacgcacgagcgcgagcggaaaaacaggggcccagcgcctgttgccgtggaaaccgagccctcggcttgcgtcccgggtgcgtcacagctccggctgaccacgccccgcgcgcggccccgaggccctgaggcccagggcggggaccaaaagccgcgcgcttgtgacgatgtcgctgcggggcacgctaaggggcggagaggaaatttagggcctgccttttgtacattcggttattcagcccagaaatatgtattcaaccccaggcgcgtgcctggcattgtggaaggcgacacgtgaggagaattgtgactggcccagatgtcacccccccccagcccagtagtcattcttctctggaagtccttacccatctcacctgttcattcttcaacccccagtttcccgacctttttcctcaagccacgcccttccacgctttcttgtcttttctgtggtgttccttcagtctagaatattctccacctagtacaatcctgctcctcccctgacattctgctgaaattgcactcttcagccttcccagctaccaggatgagacaactctactcagacccaagcacaccaagccaggaatgcacaaaggacggctgatgtttgagataagaactgtctcaaggactttctataataaccacacaaggaattcctcatgtacgtcacaagtctcatgcgtttctccacctacgttttgcacatgtgcacacatttattgatttagaggcagggatcttgctgtgctgcccagaccggactcaaattcctgggctcaatcggtcctcctgcctcagcctctagagtagctgggactccaggcatgcgccaccctgttatttctgtgaccaggcttagcactaggcattctttcggacgacagcaattcaaataagatgctctccaaagaacacttgcctagtagcggcatctccaaaaataaattgatgccgctccggctttgagcctccagaaccaaagaaacctgtttccagacagcttatgtgaacttctacttttggccaataagagctcccacttacccctgccctattcaggtgcacctgtggcttgccatagccatatagccaggtgcaccatcctttttgcctgctcctgaataaattaattatattaggagacatctttctctgatgtcttttttaggttagcaactctaatatgttggaagaatacaggccagctactttgtagaatgttcctcaatttgagtttgtatgatgctttctcatgattagattcaggttatgtatgttttgcaaaaatacctcagaagtgatggcatccttggtgcggcatccttggtgcattatatcaggaggcaaatgatgtgggtttgtcccattgtttgtaatggtaacattggttgcttggttaaggtgaagggtgccaagcttctccactgtaaagttcctatttttttctctgtaattaataagtaatttgtatgatactttgagataacaaagtagactgttcatcaaactttcatcaatgaatttaacatccaaagacgcctcaagaatgatcatcaaaagcagcctactaatgactgtcatttaccatttaatacatttcaaacagtgcacgtgctctgtgacatattctgggaaggaacatgttacctgatacataataggtgatcaa

SEQ ID NO: 681 - DNA, 1101 bp, Homo Sapiens
acgtatttgcaatccccttatgccataattaaagaaggactttgctgctttgggccaggatctgaacttaggtgtaaaccattgccctggcagagggaacctacccagtccattgctgcctgctacaagatatgaacagtaatggcacatattttggttatgagtcactcagaggactgtggattgaatgaactgtatccatccccatcatgatgtacagaaccaagtctcttcactagtaggtatttttttaattaatatcatgtacacagttatatgttgagattttcaccagagtacctacttttataatgaaaaatgtgtaaaacacatgtattagtgtcgccggtatgaaatatggctagatctagtctatttctgtatcaaccaattgtaaaatgaagaggcatgctgagctgtatctattaggtataagtatataaatgtggtaattatgtatacctatataggcagaatttagaagtatagcatcttccctcttttttaactgaattaagaaacgtcactggacagtttcgatgtcttctggtcaatatcatatagatctggtgccaatgtaagcttaaactttttaccgagtttatgctttgcaacagtttaattttattatacagggtatttgatgtgcttccactcacagatgcaccatattaacagttggtgtatgatatttacggtgttgtggaaagaaaattaaactcagtcagaagatgttaatttcatttcagctccagcatttatcctcatactagtcccctaatctctaggcctcagtttcttcatttgaaaagtgaaaggaatcgtttctgctttacctagttcataagatttcctttgaaggtcaacagaggtaacggatgtgaaattattagctaactctcaaactctgtaaaaataaatggtgttgtctgtggtcaactaacagcacaagtagagagctggaaaaagttgtgaccataattgtctcttccaattaattaatgcagtctactattttatatgctacttgcctaagagataaatgataaaatcctcattaattttaatttatgacccaaattaatttttggtatatttgag

SEQ ID NO: 682 - DNA, 27538 bp, Homo Sapiens
acacacagagacacaccgcgacacacacacacacacgcgcgcatacacacagcccgacacacacgcacgcgcgcttcttaaaggagacggctcataaaggattccccactacgccagcagaggggaagaggagcccacgggaaagaaaagcaggcgaggttaagaataaagagtgttccaggatagcacagaagcagagactttaagtctaaacagacctagattcagagccgacccgatgctgcttgaagaaggctggaggtatgttaaggagacaagggctgtcaagaagcagggatgtctctggaaaggttccccttgctgctgccatgtgaagaaggacatgtttgcttccccttctgccatcattgttattcatgttaggctcctgaaaacaccacaaggacctaccctccgggagccagccagagaacccttcttcctgcactgtctccgttatgcccaacatttctgggcataagttttaataaaccttacctgggaaaagtttgtttggcctcgtgttaattgctattatatggagagccaagaatctcgaaccagtaagagttgtgaagtcaccctcaatatttcccaagtcttcaaaggaattgagacactataatcattacccaggactccacgcttgtcaaatttgttgatgacctcctactttgcaaccaaactgaatagaatgcttgtatagactccctaatccttctgaaggtactgactgagcaaggctacaaagcctccaaatctaaatgtccatgggtacagacaactgacttatttaggccataaagcatctcggagcactaaaaaactcacagtaaaatatcttgaaggaattttgacaatcttttcttaagaagaaagaaaaaaaaccagaaatttttagaggcagctggttattgccatcaatggattcttaattttgccatcctagccaagcctttatatgttttcctctcaggtataacctcagaaccccttttatggccctctgagacactggcctcctttgaagcattaaaataagcattatctacacccccagctctcagtttatccaattttgacaaaccttttcaacaatattgccatgaaattaatgagattgttgctagtattctagaacagccgtttgtctctcaattactttttatggcatatttcttatttcgatcaaccctgtgacatcaggcatgcctccatgcctgtgtgcgaaagccacagctgccaccctaatggaaaaagcctttattcttacattaggcctccctactcacctctatgttacccttgatgtgtcagcgctcttacaagctcataaaacacagcaccctctttatacaatggcagaccactgatgaacaggacctattaacaattctctctctattgtatcattgtaacaccctgaaccgtgctattctattactcctccttgatgatggacagcccattctattctacgtgattcctttgtagctatataaatggtctcaaaactatgattttttagacatcttcttagacagtccagacttctgttttgtcatggctgtcaagcagaattctcaccgatacatagtaactgactgtgccatggtttccttaaatgaaacacttgagacaaattctgccttctatataatcagcctgaaccactgagtctagatcttacacgagccttggcaaagagaaaactgacactatttacacttgagatgtgctttggactctgccatactgttggctgtattgaaaagtcccgtttctgacctctgctggtacccctattgccaatggccatgtaattgttaacctattacgcctattcatcttctaattgaggttgcttttgtttattgttggcacatgccaaggagactgacactgtatctctggtagacaatacgtctgacaaagctgccaaacatgaacccccaactctggcaataacccattttttaacccagcttacaaccctgcctttaacacttactgacgtcaataatatttggcagataccctacaatgaaaaaaaaggctgcaagaagattccagacaattgttagaaggattatacgttggaccaaatggacttcctatagtcctttatcttttattgttttgtgcttctatttattgcccatcaaatggaatatatgtgtaaagaagggcaaatcaaagaggtaaatgacagtgattttgccctggaatccacagaatttctgatcaaattatttaccaatgtattacttgtaaatcttatgatatttctggatgtaagtagcataccccatgaaatcctctgagacccacattccctttgcaacactcctggtggactttatagatttccctcaggattcaggttattctcattataggttgactatacctaatctgaaaatccaaaatctgaaatgatacaaatccaaaacgttatgagtgttgtcataatgctcaatggaaatgctcatgaaagcattttttatttaaggtctttggattaaggatgctcatccagtaaatatgatacagctattccagtgtccaaaactatcccaaatctgaaacacttctggtcccacccaagcatttcagataaggaatactcaactcataattggtgattacctgcacagttagtagatggactgagtactatccaactagacatgctgatgccacatggtagtaatgaaaaaaaaaattgagattattcttcattttggcattacttaatgtattaaatcagaccaaggaactcacttaacaacagaagtaaatcacatgttcacaaaaactctaggatagtcattaaaattctatactctttaccatcctcagtcctcagagaggtggaatgtgataatttagacagcaaaagaactataaaatatgtcagtacaatagacctaagtggccagaagcatcacccctgaccccaataaaatctggaaaaccccaaacaagagagatggattaactgctttttgaataatttttgatagctttatgcctattagcatctccaaactttttgttcctgaagtgagtgagcattatggggacctgagtgaaaggttcagtattatgactagatatctaaaagaactatctcttgtacttggagcttaccattaacaggcaaaaaagtcatggccattgtctaccaacaagctttctatcccttttgaccaagctatcaagtatacatcaaaattttgacaagaaagcatacactgtcatctttctgggaagtaccttgtgaagcattgctgaacacctacatggccatcaaaataaaaagaaatatttcctggattcatgcaagtcatgccaagctagacccagatcataatttccagaaaaattgaaaagctattcttacagctgacttcaaaccaaggattttcagggccaattcacagggtcccaaagcagatgacaacataaagtggactattttttccaatatcttggatcaagaactacctttccacctattttcccttgatatctttctcttctctgaccaaaggaaaaaaaagtaaataaaaaccttaaaaacctctttgagctttaaacagaaaccttcccctttatttattgatggactgtctagagattgctacttttttcttcttctgtttcttcacaatgagatattttctaaactgtgtcttgcttcaactaacccttatggctttttttgacaattctagcataaatccagcacctactcgcgccagtcttctaaacactggcaactttcatcaatccgaattttggttatgtcaacatatcggtatacagaagaagctaactagtttttgtttctgccaatgcaaacacctggtggacacagactggactatggatgtacaaaagggtatggtatctacaaacaggaagacaaaaatcatgccacctctctttctggtaaactgatttggcgcttggaaaattccatggaagctcaagttctattctttgttcaggtgatgttattgaatggacaaatttcccttttcattggaaacagaaatggtactggaccctttctagcaaccaacacagcttctcgtttgtaaaacttctcaagatgtttcaaaatggaagaaataccaaaacccacaaagaatccttgagttggtatggttatttttagttgaggacatttgagattccacagatgcagaaaagaatcttctcagagcttccttcttctgattaaaagcagccacttctgggaaataaggctggcataaatcctctcttgagagtggctttactcccagaaacaagaccaagggtaaatctaccataaatcccctctccaggggagtttgatggccataaagaagatgaaaagagttctcacacctgcataaacaaatgttatcacaaactttcttatctcttgtttgttctcccaaaaaactatttgtctttcctaaagaaatccatttgttttccttatagaagtcttttctcccggcttgcttctcctattaagttagatatataaacttctaatttaacttttaggaaactacttcttttgtaagctcttgtatgcaaataaactgttttattctcttgttaatgtgtattttcacagcatatcctccacccagatcctgaatttgagagggtagaggaaaagttttcctctccaacactttcgttctctgtcaatggcttcactggattgctagtcttcctattaaaagcggcaatttattcttccaaagttagtttctaaataatattccatagaattttctttttaaataaccaggtaatacctacgttgacatcaagagagcaccatggtcagtaattttaataccccaggaacatacttttaagtatacattgtttttcaaccaatattggaaagggaaagttccaaaccatactaattggacctacattgaacatggtaaattcctcctcaaatagttgctaatggtttgctgggacagtacttcccatctgtaataactcttaaaattaaattactaatatctttggatttctggatcatcttttacttaatatccaaaaataaattgtgaggtttttttaaatgcctgggtaaaattctgaaatagtagtttatttcaattttgatagctgctgagattcacactagcttttcttcagtcgacacagtaaacaataaaacttcagcaaaactggaaaatataagaacccccaatatatagtcccccaaaggatccagcaggttatagagtccaaagcccttattttataaatgagtaaactgaagacaaaagcaccaatgtagttgcttgaaggttataaaatggcagggatacatgtatgtgtatatatatatatatatatagctccttaaaatgtagacttttgaaagatcagaggatttgaatatgtttacatgtcaagtgattttctaaagctttggctactgaattggctctgagtcagcatggccctttgccatatcaaataagaaaaatcacaaacagatgactaacttacataatgcatttcttttggagcgaggtccttggcaacaggaaagggtaatagtgattttaaacattgactcttcagtgaagaaggtcactgtgtggtcatggatgaggaaagtaataagataatgttgatggcttttctgacttagcatgcctacaagaaatcagaattctgggtgatgacacagtctgtctatcttaagtaatcttaactgggcatcaggccatcaatcttgaaaacataggttaaagctctttgaacattgattataactaagagcagctgactttttcactgcaccataaacctcttatgactctgactcatcagatgatttggaaaaggtgtactcactgacaaagaaaaagagaaaatatagatgagttaagtcactttagtcccagaggaggacaactgagcattaataacattttagaatttattttctgcctggggtcaaatgaccaatttcagacagcatttcaaattctttttttcagcatggcagagaaaagtacatcagagcctcaccagagcctgaatactttcaacccagttgaatagtttatgcaattaattatggcttttaatagaaatgtattcacttttaccttgagaggatgagaggacatcctagaatatgggtgaaagtcctataaccaacacctatgtgataaatggatttacattaggtatttagtccctaacttggcattctacctccttcatcaccaaattttatttcttcaccagtactctttctcaaaccattactcaatgacaattcaggccatataaactcaaacttttgtgatctgcatgtctatgctttaagtttcactctttaccgttctgtcactttaataaatattgatatagcattcccaacccaaattgtacatcctttgaaactttgactaaatgggtaataattatgacaatatttataataaataattataagagcatattatcagcaactgtattccacaaaactggattataaagaaaaactgaaaaattcctgaaaacacataaattagtgaaactggctcaaaaagagatagaacatctcaacagacctatactaactaaagagattgaatcaataattagaaaccttccatcaaagaaaagccctggaccagatgtgttcacacgtgaattctaacaaagagttaaagaagaattaatatgcatctttcttaaacttttccaataaatggaagaggaggaaacattttctaattcattttatgaggccaccattacttggataccaaagcgagataataaaataacaagaaaataaaattacagactaatatctcttacaaatataaatgcaaatatctatcctcaataaagtattagcaaatctaatccaacaatatattcaaagtattattcagctcaatcaagtgggattaacagagaaaaccaagggtgcgtcaatataggaaaatcaatccatgtaatacatcacataaatagaatataggtaaaaaagaaacacatgaacatttcaatagatgcagaagcagtatttaacaaaattgaggagaatttcatgataaaaactctcagaaaacttagaatagaataattcagccatatgataaagggctcttatgaaaaacacatagcaaatataatattcagtggtgaaatggaaggctttacccctaagagtaggaagaagacaagaatgcccgctttcaccacgctattaagcatggtactggaaggccctaccagagctactacaaaagaaaaaaaaaaagagagagagaaaaagcatttatgttgaaaaaaaaatcaggttaaaaccatctctatttatagatgtcatggtcttatacctagaaaatcccaaagaacctagtagaaatccccaatagctaataaatgaattcagcaacattgcagtataaaattcaataaagaaaaatcagttgagtgtttatatgacaacatgaccaaccaaacagaaaattaagaaagcaattctctttgcaataaagtctaaagtagttaaatactgaggaatagatctaaccaggtaggtgaaatacttgtattttgaaagttatgaatattgctgaaagaaattaaataagacatgagtaataaagatttgtgtttatggacaggaagacttaacattattaatgtgttaatgccacataaagtgatctacagattcaatgcaatccctatacaaattataacaggctttttcatagaaatgggaaaaatgccctcaaattcatatggatttttaaggggccccaaatagtcaattatataaagaagaaaaataaagctggaggactcacatttcctgactttgcaatgtaccgtaaagccatagtacttacaacagtatggtgttggcataaagacaaacatgtagactaataaaatgtaatagaaagcacaaaaataacccctgcatacttagtcaaattatctacaagtatgccaaaaccactcaaagaatgaaaggacaatcttttcaataaaaggtgctggaaaaactatatgtccacatacaaaagaatgaatttggatccttaccttacaacatatacaaaaattaactcaaaattatcaaaaactgtaatagctgcaactacaaaagtcttagaggaaatcattggggaaaatcttcatgacactggatttggtaatgatttcattgatatgataccaaacacacaggtaagaaaaaaatacagtaaagttgaacttcatcaaaattaataatttttgtttatcagaggacactatcaaaaaagttaaaagattctggttgctaatattttgttgaggaattttgcatctatgttcatcaggattattggcctgaagttttctttttttcattgtgtctctgtcagattttggtatcaagatgatgctggctttgcagaatgagctatggaggagtcctcctcctcaattttttttgaataatttcagtaggattggcactagtttttctttgcacatctggtagaatttggctgtaagtccatctggtcaagggctgttttggtttgtaggattttttaaattactgattcagtttaagaacttgttattggtctgtttaggtttctacattcatctcggttcaatgtttccaagaatgtatccatttcctctagatatttgactttgtgtgcataaaggtgttcataaatgtctctgaagatcttttgtgtttctgtgggatggattataatgcatattctcatatataagtgagagctaaacatagagtacacataaacataaagatggggacactggggaataatagagggggaagagagggagaggaacaaagatgaaaaactacctatggggtactatgctcactacctgggcaaggggttcaatcatagcccaagcctcagcatcacacaatatacctttataacaaacctgcacttatacaccctgtttctaaaatagaagttggacaagaaaaaatgatgcgcagtataaattatttaaatgttttgcagaaagtttatacaatttatttcctactagtttactgtgatttttttagataccatgattgctatgaatgatggtaacttataaggtggtcacaggaatggaagtggataaaaggtgatgaaattgagacatggaagccaaaaccaaaaggatcatatattgatgtggttttgggaggttaagagatgacaagattgattctggcttctgctactgggaaaatgtttgttttctggtttgtttatagagaacaagagagaaaaataaaaataaaaaaacaaggatatgcccccccttaaaaagttaaaaaagttaaaagaaaacctgtagaatgagataaagtatttagaaattaagtaagtgatacaagattaatatctaggacatataaaacgcacttaaaactcaacaataatgacaataacaagaaaaaaagttcaaaaaggccaaagcacttgagcaaacacttctttaaagatacacaaatggacaataagcacttgaaaagatgctcaacctcgttagttattagggaaatgcaaatcaaaaccaaataagataccacttcatacctactaagagggcaactacaaaaacccctgaaaaataacaagtgttggtgaggatgtgaaaaaattgacaccctcttgcattgctggttggaatgttaaatggtgcagccactgtgggaaacagttcagcacgttctaaaaaatgttaaaaatataataatcatatgacccagaaatttcactactaggtatgtatccaaagcaattccactattaggtatgtatccaaagtaattgaagcagggaagagaaacccatacagcaatgtccttagcagcattattcataatagccaaaaggtggaaacaactcaagtgtccattaacagataataaataagcaaaatgtggcataaagacacaatggaatactattcagccatataaagaattcttttcctactttattgaaatatagttggcagttaaaaatgttatatatacacacacacatatatatagagagtacaactagatgatttagtgtatgaatgtaatatatgaatacattccgaaatgttatcacaatgaactaaattaacatatataacctcacatatttacttttttgttatgaaaacaagatttatcttcttagtaaatttcaagtacacaatagaatactattaactatagtcacattgttgtacattagatcttcagaacttacttatctcacataactaaaactttgtaccccttgatcaatatctccccatatccctttcctccagcccctggtaactaccattctaatttttgttttatgggtttgactttttcagattccacatgtgagcttatgctgcatttgtctttctgtgtcaggcttgtttcacttagcataataccctccagttgtatgcatgttgtcataaaaggcatgatttctttcttttctaaaactgaataatatttcaatgtgtctgtatatgagtatttacagaaatgtaattatttttgtattttgattttataacttgcaattttactaaaggtgtatcagttctaacagtttttaaaaaatatttacagttttctacatatatgattatgtcatcaacaaatagaaatgattttttatttggatgccatttatttctttttcttgtctaaacgctttggctaggtctttcagtgctattttcaaaagaagtgaatagagtggaaatctttaccttgggccatatcttagaggaacaacttttgtgtgttccccattaattatgatgctagctgtgggcttttcatatatggcttttattgtgccttctaaaactatagacagtcctccatatccctgggttgcacatctctggattcaaccatggagagaaaacatataatttgtgggatgcaaaatttgcagatttgaaagggcgatgtttgtatccgcagttctgcaagtgccgaccgtgagacttgagaaaccatggatttttatatccacagaaggtcctaaaaccaattcccctcagatactaagggacagttgtattttgctaattgttttaatcatgaatggatgttgaatttcatcaaatgtgtttcctgcatctattgagatagccattttttaaaaattttattaatgttttatatcacactgatcgatttttgtatgttgaacaatccttgaattccagggataagtcccacttggtcatggtgtgtgatgctctgaatttagcagaatttggtttgcttgtatattatttagtacttttattttatgtttattagaaatatattgtggttttcttttcttgtaatgtttgtcttattttggtatgagggtgattctgaactcataagtttggaagtttttgatcatttcctatttttgggaaaaatttaagaaggtttggtgttaattcctctttgatgtttgttagaattcatctataaagccatctagtcttgggtttttatttgttaggagatacttgactattgctttaatcttcttaatttttttatctgttcctgctttttatttcatcttgattttattttgttaggttatatagccctaggaatttattcatttattctaagttatgcaacttgttgggatatgattattcataatattcctttatgatcatttttattcctgagacatagattgtagtgtcttctctttcatgtctggattttattatctgagtcctctctcattttctcttagtctaacaaagggcttattttttctaaacaccagctctggaattgtttcttcttttctattttcataaaatctctattgtacttatttgtgatctactcttgattgtttcctttcccccacccccccatgacattaggttagtttgttgttatttttctagttatttgtgatgttaagttaaagtgtttatttgaggtcttttttcttttataaagtaagtgtttatcactgtaaacttttctcatattactcttgtacttttattactgcttttgctttatctcataggttttggtatgttgtattgtcatttttaattctattttgatttcctctttgacccaatgattgttcaaactatgtgtttagtttacaagtatttgtgaattttccagttttcttcctgttattcgttttaagtttcattctattgtggtcaagaaaaaatacttggaatgatttcaatatccttaaatttgttaaggtttattttgtgaccttataagtgatctatactggggaatattccatgtgttcttgagaagaatgtgtattcttatgctgtttgttggaaagttctgtttgagtgtgttagttccattggtctacacattgtagaagtctgttgtatctttcttggttttttgtctaaatgttctattcattattgtaagtggaatatcaaaagtcccctgctgttattatattgctgtcaatttctgtcatcagatctgttaatattttcttcacatatttgcatgctttgatattgggggcatatatatttatgattgttgtatctccctgttgaattaatcttttatcactatataatgtttttctttgtctttagagacaggtttagaattaaactatattttatctgatataagtgtagtcacacctgctttcttttcattatctattgcatggaatatatttttctattccttcacttgcagcctatgtgtgtctttaagtctaaagtgagcctattgtacacatatctgtgaattttttttctgtataacccctctaggccttttgattggagagtttagttcattttcatgtaaggtgattattggtaagtttggccttactattgccattttgttcattcttttcgatctatttttcatttgtttctctattctttttcttctcttgctgtcttattttgttatttaataattatttaacattttactttgattattttctctttatcttttgtatatctattacagatttttctttgtggttggcttaatgtttgtatactgtatcttattctgagatactataagttgtatcttatagttaagccttctattttaagttggtaacaacttaacctcagttaagaatgaagttaaaactacagttttactttctccttcagctttgtgttattgtagtcatgatttgcttttattaatattgtgtatgcattaaaaaattctcatcttttaacttctatattagaattaaaataaattatgcatcaccattaatgcgtaagaatgagctgtatatggttatatagttaccttccccagtaaaatttatgctttcatatgcttttgtattgttgtttagtatgggtttatttcaatttgaagaatttatttaagcatgtcttgtaaagcatgtttagcagtgttgaactccctcagttttagcttgggaaagtttttatctctcctttctttctgaaggacatatttcctgatattctcgaatggcaattttttatttcagtactctgaatatgtcatcttattttctgctggtttgtgaggtttctgttgagaaatctaccaacagtcttatagagattctcttatatgtgatgttatgcttttttagtccctttcaacatttcctttttgtccttgactttagacaagttggccataatgtatctctgaagatcacttgatgttcagcttatttggggtttatgggcataatggatttggatgcctgtttctctgcacactttgaggaattttccatcatttaaaaaaaattagttttggctcctttctttttctccactctttctgggaatttcatttatatgtaaattgtttcacttaatggtatcccataagttatataggctttcttcacttattttcatttttttcttcttttcattcctctaactggataattttaagagatctctcttcaagttaactgattctttcatctgcatgactgagttttctgttggggctctctattgaaattttctgctccagaatttctgtgtcttttaaaattgtttcttattatataacttctaattttgttcatgcattgtttccctgattttgtttagttgattttctttattctcttgtagctcactgagctttcctaatatttttttgaattcttggtcagggaattgataaagctccatttttggggtggtcagttactaaaaaattattgtgtttctttggtggtgtcgtgtttttttactttttttgtttattataaccttgcattgatgtcttcctattttagggaatagtcacctcttcctcactttacatacttctctctgtgtgtgtgtgtgtgtgtgtgtgtgtgtgtgtgttggaagctattcacctattggtgggtacaagggcactggctaaaaagtgtgtggtagcctagtttccatgcagctccatcagctgaggtcagtgtcagcatagactcagggagatctcattagccaaggctgtgggcattcttttactctcctgacatagctaggaattttgaggtccttaatggtgaaggctgttgcagttctcttgttttattttacctccacagggtgaatttatggctgagggaattcattatggtgctggttccagcatttgagtgtgcttttggtggcagtgatgccagtgtgtgaggcacaaaattgcccagaatggttgcagaattagggtcggaagcatgagcattaacagagtgaccatggccagagactatggtgtgggcttgccacctgtggtgctcctgtcagatgtgggcatacatagagtgggtgcagagacaggatcctaaacacagaagggagtagagtaacagcaatgctggagtttgaatgtgcatgtttttgcagggggatagacgagtgggtgctggttctggcccagggtggtgaagtgtttccacagcaactttgatggctactgagctcctcagcagcaacaactgctagagtcttcctgcaggccactggggaccatagtatcacttgctgcatggctgaaactgtttggccctgccctttttctttgttttcagcttctccagacatctcatctatattgatctttctggtagtctggttggtatacaaccaaaatggacccttcaagcagtgacccaaaaggccagggcagctagtcatttgccctactttctttttcaccatgagggaaaatcatgggctgagagtttcttttcgaggctgaactgtcccaggctggaggataggacgatgcaggcaaaaaaactctttcccctattttttctgtgtagttattttttttccttcaatgtgttgctgcagctttttatctgaactgaactcatccagatctattttcatccaaagatagctgtctaattgttgtttctacggggagacaaaggttggggtagcctacttcaccacattgctaatgtcatggaaagaatacaattttgatataagcttcaacatggataaaccttgaaagaattttgcttagtaaaataagccagatacagaagataaatattgtatggttccatgtttgtcagatacttagaataaacaaattcatagaaacagaagggagactataaattactaagggttgaaggggttgttgaggggagaagggagagttattgtttaacgggtacagagttattgtttaatgggtacagggtttatacaccaaaccattctagtgaatacattaaaaatcagaaaaggaatatacacacctaaaacacttatcaataccagactataaattactaagatgaaattgagagctattggtgagttggggatgataaaacatttgggggtatagataatagtgtgggttgacagcattgtgaataaatttaatgcaactaaattgtatatttacaaatggctaaaattacatcatgttttatatatatttttccacaataacaatgcgatttatcagtttcataaatatttggaaaaaataataggggatactcatacctcaatgaataattgtagatggtgtcaaggtttatttctattttgttcttaccttcagggatcttcagtcaagtgaggaagatagtcatatgtttaaaaaatggcttttttcctgaaccttgttaattccagataattctactatcatatcaatatttctgtcttttcatgctatatcttccctgctttatctagcagacagttgaaacaaggaaatgagggcttgtagtatttgtgtattagactcttaagttaatccctattttgactacctttcccccttcaaatcttaaataggatataatgactgatcttaggaatatactatagaggatcttatcttatcttatcacatctaatgaaaactgatagcactgaaaaaatatttaactacatattgtacccaaagttaaaatgtcttatactgtcagataaatagttcaaaaagggctatagtcatattttaattagtaattttcctgtcaactataaaatatcactgtcattattcagaaaattgtctcatagtaacaaaatctataatttcatagtaatactttcacttgacagtcacattcattttctctttctctaagggatagtattacaggctttgaaagttaaacataaaactatctttatgttttgtgaacactaacataaaaactattctaataagatagcttgtgaatatataagctgtgtttatatactgtgccatcactatatgtttacatgtttataaaatcttttcatttataatgacatattatgttctagagatcattatagaccatttaagaagatatcttgtaggtattacaagcttcaaaataacacaaaagtacatttcattttttggcaaaacacagcattttcatgataaaatatcttataatgcatacataaaaaatagagaaatacactgcatttttgagtgagtaaacaagagaagatatatgtgccattggcaaagagtgttctgtttaagtttggtttattatacacaatgaattagtattttttagcttccatatgctatgccttattttaatgttcataatatgatcttgaggaagagaaaatatgctgaatgcctactgaattgctacataaaaattagatttgcttcagtgtaatgttatcgataattatattattgtacaaacattatatgtcttctgaactcctgtgagaactcatcaatacctctcatttgcatcttagtaatttatagtctggtattgataagtgttttaggtgtgtatattccttgtctgatttttaatgtattcactagaatggttttgtgtacatggtgctgactacacatagttaatcaataagtagctgttgatttgaattcaccttctaactctaatcaccagaatacctacaggaaagctccattccccaggcatgtaagaaaatatcaaggttacattaattttgaaagtgctaatctggaattgattttcagttaatgaggaaatgttttatttctctaggctttctaaagtattggatgttttaaatttgtttaatctacgtatttgtatgtgcatagttgataatttctttatttttaataaacatgggctatagatttttcccactagaagtaagctacattataacagtaaatatctttttcattttcactgttatatatccagcacctttagcaggaacaagtagatgctcaataatattagctaaatggaagacttaagaatatatattcagagtataatttcatgctttctgtttaaaaaaataagtcagagatatatttcatgacaatactgaaataacttcactaagaaatgtagaacaccggacatccagacaaattcatgcacacaaacacacacactattttaaagaaataaagaaaaatttttagatagtgacatatatccttaagtaaatatgtaattagtagaggcttctatcaaaattccaatgcaattttttcaggaattgatcacatttttgtaaagctcacggggaattttctgactcaagatcactgtttttttacatctcctttcatcctagatctcattaaaatagtagaataagtatttttaaaaataagcataaaacatagaaacattggaaggataagaataagctagaaggagaatggaatactgaagaatttcagataaatatgatttgcataaattaatagcaaaactcattagaactgaggaattaattctacacaggcaaaaaggcagacatctaaaacaacaaaaatttcccaaaagaattttggaatcacaagatcaagtcaagcaagtatcagagaaggactgggccatttgtcaaggacgagattagaccaaccattgcttgacaatctgagagaataacttgggcattgctcacctagtagctaaaatagtatggtggtggttaaaaacactgacttgggagtcaaactacgggattaagtaccacatcttccacttgttatctatgtaaacttgggcaaattttataatctagcaaatttcaatttatccattggtatataagagataattgttcatatggagttgtgagtattaaaaatgttaataaatggaaagtacttagaatggcacctgaaatatattaagtgcagtattagtgtttgctcttgttatttttttaatgggatttgagtttaaactacaagtatggctctctgcagtgagaattttaacataggctatacctagattggtcacttgggaaagaaaaacacaatagaataccaagtaatttaggactgccaagagggaaaggattttctatcacccggccgggcccggtggctcatgcctgtaattccagcactttaggaggctgaggtgggcggatcacgaggtcaggagatcgagaccatcctagctaacatggtgaaaccccatctctactaaaaatacaaaaaattagccggctgcggtggccagcgcctgtagtcccagctacttgggaggctgaggcaggagaatggcctgaacccgggaggcggagcttgcagtgagccaagattgtgccactgcactccagcctaggcaatagagcgagacttcgtctcaaaaaaaaaaaaaaaaaaaaaaaaatacaccccccacacacctcgccccagttgcacaatgtgcaccctcattattaggagcaagctttctgtagcaaatacctgaacttcactaaatggtgaataaaaattcttcctcattcaaattctcatccatacatgccagagataaatactactctgcttatatgacaaattacatatataataaataattaaaaataagcattttattctgcctagcacaaagaaactgaaatagcaaacagaaaattagcccacccaaagaaataaaaagagaaaacagaattattttaattgactactgagaaaacgaaccccaccaaatattaatttagaaaaaagaagtgaatagcagatttgactcaattaaagttaaaataagtgagataaaagaaaggacttaatttttttataatcaccagagaaaaagtatacagaaaaggtatgtgatataatggctagttcaagaattccaactattcgttagtataataacaaaataacagaattgagagaatgggcagagaaaatcatcagtctaatagaaggacattttccaaaataaaagctccagtctttggaaaaaagttattgtttgacattcaggattaacacaagaaaaaaaagtttgacattcaggattaacacaagaaaaaaaattctgcaagaagtcatatcctagtaacagcaaaactaagaatttgaacaaaacaaaaatcataaaagctttttcagggaaggggtgtgtttaccttctaaaggcaatggtcagtaaactacaactacagataatgggctacatatttctgttaataaaatttcactaggacacagacacacccatgaatttacttattgtctgtggctgtttttgcactacaaaggcagaattgagaacttgtaacagagaccatttaaccacccctaaaaattcaaacctagtgtatttactacctgacgctgaagaaaagtttacctacggggttctgaggaaagatgaattatgagctgcaagactaggtgcaagaagataatgaaagaaggcctttcaagttctacagaaagttttgaaactagtgcacaataaatacaacataagttggagataaaccaagaaaaattgacaaagccataataaacttgagtgatattaataaataggtccctgaaactaaaggaaatcagggaaaataggtcagtcttctctattagattcacttctgacagaggcctttggtacaattgtctctgattactccttgcaaactactgatattttgagaatgagatattgtgaagaacttcagccatctgacccaagtctattgattctctctccctttttgtcaatccctattttcagggcatctgaatttttcttctgtctccattgttatgcttagcaaatttccccaaacgactggatttctatgatggcctcatgatgattttacttctacatatatataatctattctgctcacccaagaacagattccctttgtttcttaaatattatttgaactcaagtgggttggaaatacctatagtactctaagaactcacacttagttccttcttgagaaaatattactgtttcaattttcttggtctctgctcttttccttgcactcctttctccactcagccttgtccctcattgacactcagcacactaaaaggctgacgtccccacatattttgatctcatgtcaatcctctgatgggtgccaatcttaatggaagtatatgagggaaaggcagggaggcaccacatactgattaactatgctttttgaataaaaatctatcactttggaaagcttaacttacaccattaaaaatcaattaaatgaacttttgagttgtgaaatttaattttctcttactatatactgtttcctaaaattttgtttgtaaaaattagatcctatataaaaattgagtcaattagattgaaagctggcttcaagatgataaagaaaacatagtaataaatttggagtcttaatttgcagatctagcaaatctgtggtctgtttttccttggcctcttcattaatattttactgtatgaaattgaagtgaattatcacataccataggcaatattgaaataggaggtgtttcaagcagtgtaaatgagaggaaaataattacagaacattaagtataaggcaaaaagtctaaaaataaaaaactatcaaattgagtaaatcaccattaatgattgttttgaaaagattataaaagtaagcaccactgaaaaccttgggtttacccatggcttgcagatatgtgaattatgagatttattataattagagcaatttattataatatcaactatgtgctggactttatctactatatgccttatcctatgtgttccttataacaaccctaggtaaaatctttttaaatctctattttaccaacaacatcaaacaactagataaagatgaaaccagaaatttaattttaatggtctgaacccagagtccacatttttaaccactatttacatacctattattagctcatattatatgcatcatggttaatccttctatgaagggaaacaagtttcacacctgatttgctgcaatagattataggcgttgctatggactgaaactttttgtcaccctgaaatgcatacattgaaattccagcccccattgtgataaaattaggaggtgaagctttttaccaataattagcttatgaggatggaatccttatgaatgggattataaaaggtatcccaagagccaggcaacgtagcttgtgcctataatctcagctacttgggagcttaaggtgggaggattccttaagcccaggaattctaggctgcagtgagctatgatcatgccactgctctccagcttggggtggcaaagtgagactctgtcttgaaaaaaaaacaaaaaaaaacccaaaacagcaacaacaacaactgtagagagttttcaacccctcttttcctctttttaccatatgagatcttatagcaagaagttgtcagtgtgcaatctggaaggaggccctcaccagaacttggccttgctgtttactgatcttggactttgagtctccagaactgtgagaaatactaagttggtgcaaacgtaattgtggtttttgcatcaacctaataaaaaactgcaattatgtttgcagaaacctaatatatttctgttgtttataagccactcagtctatggtactctgttatataagcccaaactgactaagacaggtgtacaacaagatgttgaacttctcaactttcaggaaaacttgaagggttttcagtttgtcagaattcctggaaatgtgtctgtcaatgagaagtaccccatagatagcagagcaccgcacaggcagatgaacactccatgatcttcacagacagtgagcagaacaggtacttgctgatactcattaatatcctgggcttggccaagaaaatgctctattacctggatagctactcaacaattgtaatagattcagaattcactactgcccattacccacaaggaactggtgatgctgctgaagggggttgggtttcagggatctgtagagcataacaaacaggcaaactgtctcatgatacacatgactatgggtggcacctccaaactctatcgttgaatattgtagtggatagaaaatggtggcagtctgtgctctctcctcttgaatctgggtgaatttgtgactgtttcatcaacagaatgaaacagaagtgatgcctagtgtctgagcccaggtaataaaaaactagcagtctccactttcctgtcttttggaattgtagctcttggaacccagtcatcattgtgagagaagcctgaggatctctatgaagatgactacatagatgtaaactaaggcccctggctgacagcacctggatgagcttccagccagcagccagtattaaggtgtcagccatgtaaatggtcttcttgaaaatggatcctttagttgcacttaagctattgtagctgataccactggggtggggctgaggggaggggaataagccatccttgctgaaccctacccaaattgcaagtttgcgagaaaactaaattaatattattgctttaagttgtaaaattaagggtggctttttatgtagcaatagaaaactggaactaatagtgctatttgaactcaccccagagttaatttctcagaaagtatacaaaactttgcaaataaaggcttcattttactgtgaaatcatttatatgaaaaattcagttacatttaaaatacattcacattataacagtacatttaatatttattaataaaataagttattcaactgtaaatataattcaattgaacaattttgcatggttctaaaatgctttgtatgtctttccttcttcttttctttttttgacaaagtcttgctctgtcaccaggctggagtgcagtggtgtgatcttggctcactgcaacctccgcttcccaggttcaagtgattctcctgcctcagcctcccgagtagctgagtctacaggcacatgccaccactcccagctaatttgtgtatttttagtagagatggggttttaccatgttctccaggatggtctcaatctcttgaccttgtgatctgcccgctttggcctcccaaagtgctgggattacaggcatgagcctccacgcccggccaatgctttatatttcttatgcacttatgcagagttacatattgctgacaactaacaatattttgaaaggattattataaacatgtaagcaaacttaagacctgatgttttaaaaacctccaaaatgttatgttcatggatcaagctcaagctgctcatgaaactatttggaagtattatacaaactaatacagtattttacccaagacttgaattgtatttttctaataaatatataatataaagattacattttgccgagctccacataaatacccacaaattgccccatgtttaatctcatgtgccatacatgaaaaagtttacaaatttctgatgtaaataatgttgttctcattttaaagcttaggaaacacacatagaaaatctaagtacatcacttcaaatcacacaaatggtaggttgtaaaaagagtttgaacacaatcagtctgtttaaatttcaagcccatgctctttctagtacgttttttgttttctgaataatttagctttgagaaaatcggttgacccttatgttacagtaatgtttaataatatgagtatacaactagttttgagctgctcatgcatcaaaattaaaaatgataataatataaacattttatcttgttgagcctagatttagtcagtatctttgtagatttagcaataccctgcttcacattgacctgatactcattaggcaggggaggatttgcctctagtatagttttgatcaaagccagtcacaaagacattcaacccagggatgtaaggtaaatccgcaaggtaatgcctccaaatttacactgttaaaccctggattgaaacagcttttgtgtgagctttgttaaccttaacaaatagcatttattctgagtacgcaacaggaaaaaaaaaaaagcagccctttgtgcatgtaattctgttacattctctacttgcaaattgattatattctcctgcatagcaacacaaaaatcatattttatattgtcttgttcttgaaaatatcaactaattatgagagtcagtgtagtagctatattaattaaaacaaacctattattttaaaacatctaatcactttcacacagttttggaaatgagatatctttctagatttattccctttcattactccaatttaggattactggttgttggtgatggtagcagtgttcatgattcatggtgatagttgcagtgtggctgtgtatttgcgattctgtatatgtgtgtatgtttctgctctccaatttaatttacctgtcattttgttgtatctatattttcactacatcacaaataagatcttagtgaataataagcaacaatacatgttgacgaatgatttgcagaagagcaggatgaagggtggggaatgtattatggattaagcctgtgggtttctatagcttagtagaaactagttgtcaaagtcactacctctacaaggacttctcttgagaagggccaaaaaacagagcatctttcgccaagaggtgaaatttgaatgggagaggcccttactcctctcgttctgacttaacaagtctttttataagaccaaaaaaatgttgaacctaacttacaaaaatccattgttttttttttttcgagacggagtctcactctgttgcccaggatggagtgcagcggcgagatctcggctcactgcaagctctgcctcccgggttcacgccattctcctgcctcagccttctgagtagctgggactacaggcgcccgccaccacgcccggctaattttatgtatttttagtagagacagggtttcaccatctctatctcctgacctcttgatctgcccgcctccgcctcccaaagtgctgggattacaggcgtgagccacagcgcccggcccaaaaatccattcttaatggctttctcttctgatgcaaaatcctgattgccttcaaatattactattagatagaaatctccccacctttagctgaaagagataaggaggttttgcactgaggaaacaaacaaacaaacaagcaaacaacattcatcaatttttaaaaaaagtatgtattgaactatagtcaggttcaatgaggaaatgcattacattgtcactaaactggccttagttggagaaagaacactggcagattaattaaagttattagcgcttatggtaggaaactgcatgatatatgtgaaagatcttttagggactggaaacacagtgtaaattcaaactcctcccaaaactttaacaaggctggatgaaatgaaaggaatactgtgatttctacaattgacaacagtgtcaggcatgcaggaaacaaacaaaaccttttgatgaaggaaaagtaacttctggacaaagtataattggttacaggtaaacagatatgtcatccaggcagatatgacagtttataggaaaaatataatgttatgatctaaaaaatgcaagccacaaacctattgcctgggcaataattagcctgaagttgggctactaaggagctggctaagcagcagtgataacaccagatactggaagaaacttctgtgatcagaaaccaatacaactagtgaacaattcacagtatttctaaatccgggcaccaaggaagttgtttggttagtcatgatggaagccaggaacaaatagatctcaaatgtgtgataataattatcaagcggaatgtctagaatattatagtgagtgccaagatttccatctaagacattaccaacatagcaactgaggcatgaattacaggttttacacaaaaaaagcattataagaataatacatataatatattaacagttcaaaagtgaaacaaacatttatgaatgggctactcagatttaaaataaaatattgcctgttcattgaatgctttctggattttactttctaattgtatacctctctttctttcttaagataactactatcatatatttgttttggactgcatgttaataaaattatataatatgtattttattaacttcataataaaaatactttttaaaataatatattgagattaatccctggtggattgtgcaactgtatttcattcattttcactgctttgcattcaattcaatccatgtacagcgtacccatctgttttactgtcaattgatatttttttctagatttttaaaatgacaaagcagcaatgaacattgcaactttaaaatttttggacctgtttcctggttcacatgtgttaagagtttcttcagagtgtgtaccttgaagtggaattattggattgttttgtttttgcatgtgaaactttattacatattgccaaaagactttcaaaaataatagtgccaacttgcagtttaagaagccccatgtgaagagacttactgcatgtacatacaacatttggtgttctcaaaccttttaatttttactgttctagaaaatattcctttttaaaattgtatatttctttgattttttaataatgatatttgctatccttttaatagggttttttttggccattatttgttattcttctctgaattgacttcttatatattttgttcatttttcttctttttttttttcttgagatggcg

SEQ ID NO: 683 - DNA, 2572 bp, Homo Sapiens
gggtgggagtgaccaggtgccgtccatcacccctttctttgattaggacagggaactccctgaccccttgcgcttcccaagtgaggcaatgcctcgccctgcttcgggtcgtgcacggtgcgcgcacccactgacctgcacccactgtctggcactccctagtgagatgaacccggtacctcagatggaaatgcagaaatcacccgtcttctgcgtcgctcaggctcgaaagcactgtattttatggcgaaatgttgaaagctatgcttgaaatggaaataggtgcagtggatgagatactgtttgataacatgagaagaccaacaagatcagaacagaaaccctcaggctacaaatacatggaaatagcaaatagtgccaccacgcccagctaatttattttgtatttttcggggtctcaccatcttggccaggctggtcttgaactccttaccttgtgaaacacccaccttggcctcccaaactgctgggaatacaggcatgagccaccacaccgggccaatacatagttttttataaagagatattcgcctgtgaaagaaattgaatccatggttgtcagaagtgaatagaaagttaaaaaccattaataagttaatattttcattaattcaacaaatatgattgagtacaatgagatcccaggcactattcaggatttccacagacatgaatgaaacaaaagtcttcctaatgtcagagctaaagtaataaacacagtacttttcaataaaatcacagggattattggacaaggaatgagtattcacacctatattcttttcttgaagacaagaatgttcaagcacactgaagatgaggaactaaaactaagacaatgtaaagaggtcaaatcgactttctctataagcaaagcaaaagcatcatcagtctaccatgactctcagtgaatcaaaagctatttatcagaaaaaaaagtacattcggccgggcgtggtggctcacgcctgtaatcccagcactttgggaggccgaggcaggtggatcacaaggtcaggagatcaagaccaacctggctaacacagtaaaaccccgtctctactaaaaatacaaaaaattcccgggcgtggtggcggttgcctgtagtcccagctacttgggaggctgaggcaggagaatggcatgaacccgggaggcagagcttccagtgagccgagattgtgctactacgccccagcctgggcgagactccgtctcaaaaaaaaaaaaaaaaaaaaaaagcagaaaaaagtacattcatggcttgtatctcaggtatatgtgggctttgattttttaaccagtctggtaagttgatgaaagaaatccctgctaaatatcagctccctacaaaaaccagtgtactatctgttgacaatgcaaagttaagttcattaaaagtaccacaataagaaagaactctactttgaaagagtcttaaaaagggcaaattatgaatgaatgtttacatggttgttgaatctgagctttggttgtcttttaaggggactgctttttgagattggataattttgtcacataatcatttagggttgtttgacttctttaagacagaaaccttgaagtaattcttggtaagaaaattgttagattaatatttaattgctcggatagcaaacaatttggttagataaattggtttcattactgtcttaaatattacagtgagggtttatagtcttattcttgtcctcttaagcaaaaatttcccagaccaaagactcagccctgatcatttgtcatcctgaactagaggatatataatcgtcatctgtggagatgatcagtccagatccgaactgctgattgaggagtggccgttatgtgttatgtttctaatggtgatcacttcaacgtctaggaacatcaggttttcttatcccttttctggatgatcaattgtggtttttaaaatttttttttatctttttagtggggcagcaaatgtgcaacagcattcagactttgcagagctcatctctaaacaaaccaacatgaccagcgtaaatatctatattcagagttcatatccaattctaagccagaatccaagtgtgcctaaattaaaacaggagttggattcaatctccaacctgaagagaacagaaatctacatattacattattctattatgatagcacatgtttcacctgttgagtataactgtctgcccaatcttattaaatttttatgtgatgttttctaaagctttagtgatattttcttgattccctgtcagtttttgaactggatggtttcccctgttttccaggctttgtgtaaaggataaggaggaagatgcttgaagaaaaaggaaagcaattcaaaattacctgtgagtggttaaatttgtcagatatcaagtaaacatgaggacaggtgattgatgataaaaggagctggatattgatcaagaaaaaatgtgacaaattccacatttgatttaaatgtataaccactttacatttcctcactatctttctttcattgttaatgtccataattctaaaaaataaagttatattgtta

SEQ ID NO: 684 - DNA, 2464 bp, Homo Sapiens
ccgaggccggccacaagcccacggtcccttctgcacggtccctgccgcgctggggccaccgtggaggcccggagggccctgggaggagggaggaggagcagaggctttcgggagaacccagcccttcaccggccaggggaggccgcgatgcatcgcgactggttgtgaagagccaggggaagaactttaccgtgcaggtgagtgggagacatcagaacacctgcctgtcctaaatacgaagcctcgaatcctaacctataaaaggttaccttagggtttagggttagggctacagattagagctagggattaaggttagagttggggttggggttagggtttaggggttagaagttagttttggggttaggagtggggttagaattagggtttggggttagtgttaggggtaggggaaggattggggtagggttagggttgggctagggtcggggtaggggtagggttttacggttagggtcagggttttagtgttggggttagggtattggggttagggtttgggggctaggggattagggtcaggggtgggggttagggtttgggatttggctaaggtttgtaagggttagggttttagggtaggggataggggttagggttacgtgttggggttgggattagggttaggggttacagtttagggtaaggggttagagttaagggttagggttagcattaggagttacagttgggttaagggttaggggttaggcttagtgttgttagggttagcttcagggttcggtgtcagggtttggggtggggtagtggtaggtttaggggtagcgttgtgtgttaggatttgtggttacggttcgggctagggttttaggggtaggcataggttcgagtttgggtttgggtgttaggtttatggctagcattagggtaggggttaggtgtaggagtaggggttgaggttatgagttgaggttagggttaggggtcaggggtccggtcaagggttggtgttggatttagggattagggctagaattaggggttagggttaggggtttgtgtcggggttgggttggaggcttgggttcagggtcaagtttagggttggggctagggcttagggttatgggttagtgttagcagttagggttaaggtttaggcttagggtttagtgcttgaggtgggggttaggtgttaggggttagggttaagggttagtgttttgcgttagtggttagggttaagggttatggttaagggtcagcgttagggtcaggggttaggggtaggggttgtgcttagttttagggttagggttcctggacggatggttttcctgcttgggaatgttcctgggctgtgagatccactcttctgggcaggtggttagcacctaacgttttccccttacttccccccaaattcttaagtcctttggtccatttcattacttcttttggggagggcctgattcctcagggcctcagtggcagaaccagcctgaggtcacctccctgtccatgggttaccacggcccctgggcaggcatggggagctggggtggcttgggttcctggccttggcacctccctttgggcggctctggagtgtggctgggctgttggtacaggagccacaggccactgcctttttggctgaggggaccctaacatcctggagcaggtggggcagggcccatggtctcctctaggtgggaggtgggaggctgaggcggcgtgggcaggcaggtggatggcgaggcagcatgggcaggacggtggatggcgggtccacaggggcagccagcagctcctgcacccactggggctccaagactgtgggcaagggaggaagggggagcccaggccggaggatcctgggggacggtgcggcccgggggccagatgtggtcaccgagcccagccaggcctagggccgcagcagccccagggcactgagggcgccacccagcccgacacagaggcacaggccgcccgtgggtccagcgcccgaagtccacgtacagtagctgtagatgccgagccggtcctgttgcctccgggaacccagtcctcctcgtcctccaggccgcgttccccgggtcccgcggcccttctccagcctgagcccgccgccccggccgcagccacgcgcagggaggagcccggggcaccatagcacagcgccggcctcacacacaccctcgaggcccctctcgagcccccgcggagccctccgcggccgcacgcagaggaaggctgcctcctgtagcagagcccagccattcgcgggtgcccagttcatcttcatggggctaaacctgcgggaagagagggaaagggcccttagtttccatggagatcgggtgcccagaggcggagggctcaaggctggagagcagagggacccccatcttttgtgggatcagggtgcccccagcatcttggaggcccactgaggcctgggggggcgcggttt

SEQ ID NO: 685 - DNA, 4526 bp, Homo Sapiens
tcttaacgcaattcacgggaacccactggcagcttctggaaaaccaaacaactcatggtgtggagctcctgattggggaagggacagggattggtctgtacctacattttgttgcaaaagagctcaggacactaacagagaggaaaactagggtggtctaggtggtaataaaatctctatgaaagaagagtatgattgtgtgactggggaatgggcaggtgctggactctggtgcagaggctgcctggcctgcgccaccccacggctggctagcagaccaagctacgttctttcattggctcctatgggacacagcatgggccaatgcctgcctggcctgcaggaaccgccagtgttgtttctagcaaggctccttggaatagatgtgaacacacaatgtaaaactgcatagcaggataaacacgtatggagtaggacaagctcacaacccaatgctgaccactactgacaagaccaagtatccaatcataacagatgagactttaacagttttgcataaatacatagtatttgtaaactattattaaggcactcaattgtaaaacaataattacagtgtaggaaaagagggaggaagcagctatcttctcatgcagcaaggccgacaggaaggacagtggaggactggtgatctgcttatcgggactcctgtctgagacagtgactgaagccggggccccagcacctatggccaaacaagaagacggcagtctctccagaaccacccagggcggcactggtcacagtttcattccagatcgttaaggccaggctattaagcatcaagtccagaatgcttcactctgctctgtggacgggaccagcgctctcgtctggatgttgatatgctagctgtgcttccaaaaatgaatgggtaagtttgccagaagccaaagaccaacttgtactctccagattccacaccccaccccccaactctttagataagaaaaattatggctttcaaaattaaagttttcaaaaatatatcattctcatacatagacgtggttaaaaaaccaacaaaagcctgtcatcactaaatttaaaagattattttgacacaaaaattgatctaccacatgaaatttgatttggcaaaacataccgaacttgatattttttgaggctatgcttttgttggctgagggaaagggggaacaacccacaggggtttaggaataagtggataatcaccttttaaggtgattttaattgacactagtgggaaaacagctccctataaagtaatgtatgtatttttaaaaatcactccaaggagacaaagtcctggagggaggatttttgcaaaaactgtgctcactaggtaaaatatgaactagccttgttcctgcagatccctcctggggtgctttctagaatagctttggggaacacagttctggccaatgttaagatgatggctcactcactcactttcagaattcagctggtccttgaaggctttctggtttcactgagttaatctggcggacccagctgagggcaagatggaattgtggaagagcttcagccaactgtgttcacctgccttcccccatgtacgcaacctactccatcctgcacaggtgaggctagtgcggggctggcaaagcttgtggtcgggaggagggaagggtctggccttaggtgtcagagaggcagagggcttcacatttacccagtttcttcctacagggccatgagcagccctgtgtggcaaatcaaaccaggggtcagcaactttttctacaaagggcctgacagtaagtacctcaggctttgtgggccacatgaattctgtcacatattatttcttttttttacaactccttaaaaaggtaaaagccatcgcttgagccagggaggttgatgctgcagtgagtcatgattgcactactgtactccagcctaggtgacagagccaggccctgtcttaaagaggaaaaaccattcctagctcacggggccacatgccatagtttgctgacccctgaattcaacctttctgcttttctgcaagctgcctctctctcgaaatgttttgacatctagcttgctgacacctttgattcaagcctggcgcagcgggactggctgagctcacctgagtcttaaaggggccgcccacagagccaggcagcgactacagatccctcttatactccctcactgctgctgggaagagctggagggaaacaggaagcagtaatctcactgcaggaaggggcaactgtagacatccgggaagcatcccgacagtcccgttcctttcggggaagccgctgaaatctcctttcccttccctagatgggccctagtggacctaagcatctgggctctcagcaggacgatgtgtctcagaaccaccacctgagccagacacttgagcaatttcaaacctaaacacaatcatgtgtttcagcagcagacactcaacaatgcaggtgggcccttccccttgagatttaaacttcagcattagcaacaactgagaacaacccatacattttccccaccggacccctgtgctggtcaaacacgtaacaacacaaccaggacagggcgcctgcaccaccattcgggcacagagtcagctcaacaacagcgtgggactactcatctgatgactttactcagcagtgcttggggctgtcgggttaaaagtcttgacacgtctggggtcccaaccaaaacacaaaacgaaaaattctttttttggaaaaacgctttcagacagagcattattccctggaacaagccttggtcattcgtgtgttttaaaaataaaaagcgcagcgagaacagaggtaggacttaatgttgccatccgagagttttctgcgaggccaagaatgagctagaacgtgtgccgcggtgaggctgccaccaccaggactcttctgcaggatgcgaagggaacagtctggatgtgtgcgcctatgtgtgcacgttcttcctaaaacatggttcttcttgaagacacggtgggagcggagttttgtgtctcctggccggcggctcctggttctcccaggccacacgactgacagctccccttcttgtgctgcatgttggttagtttcttctcctcctctctatggcaagagtaggggaaaagttaggatgacttcactcgtttaagggaaatcaagatgtaaggggtcgatccaaatccacagtgaaagtgagggagggatcatatgaaaatatccgcccagcctgacgcagcaaaaggcgggtcagcttttgctcatccacgaagggctctttaagttttctggggcgggtttccctgatggtttggaggttgcagctgggtccctcggggttccctggggctcatgcaagaaggaagattcactcaaagtggtgtcctgggagtcagcgacggtggacgggtcagcctcactggacaggtcttccgttgagaaggtgagactccccagcttggcaagagagtgtgagcgcttcagtggggaagagacggtgaggcccgccagccggagccgggtctcaatctcctgtgtccgctgcttcaccagcccgggcttcccacggacactgtggatgctatcgctgctggagctccgggtcaggttggagctcatggaagaggaggtgggggtgtagcagatggtcttcagaaagtcttttgagaaactactggtgtggtccaggcggtagaagaaaggaggggggctcttcagtgagcctccttccaatgaagcgggggcggcctctgacttctcatcactcccggcctggctgggcataaccagggggcccagctcgtggagcgcggctggatcctggctctcctcggggatgctggcctccagcctgctggcagggccatccctggagggaggtgctgggtctgcaggcacgctcttcagccgctctagctctttggtgtgcttgcggaccaagcctgccttctgcagctgaatgatggactcctggtgctgcatcaggtagctgttggttgtcggcttctcagattcattactgaacagaagcctcaggtccttggctggcttcatatctttcttgggtgacgattcttcctttattaccacttctgtgctgggagggttcttatcacagtgagaattcttcaaaaggagggactttggcaggacttttggggtctctctggaaggttccaaaaggctggctggtggctctagggcagctccagccccagggccactggtgtctgccctcctggagcctgctggtggtaggaacgggggaggttcggttgggccagaggctggcttctccggaacacgggacctgctggccaagtgggccacaggggaggacgtgatgtggggtaggaaggctggctgggtgcagatggcgggagcattggggtcctcacatcgctccctggaggcctcaggagccccgctggctgtagggtacatgcagtcggcacaggatttataggaaggcttcactttgttaaggatcccaaatatagcatcatcctgcaa

SEQ ID NO: 686 - DNA, 1649 bp, Homo Sapiens
tgccgtctgtgggaagctgccctaacccattcgccttccccggcttggaaaaacaatgtcccagtgatgaactgccttgcagatttattttgatttaaatcgccttcccttcaacccaaaccagggcacagaaaggtggttagaatgttccagcacaaactcatatgagcacagcagctattccagggaaaagcgtcctccctacctgcaagaagcttcctttcaagacactgatattatcaagaacgtgaaggaagagtggcagcggcccacctgaggcacagcagagctgggggtgatgagagaaatttaagggaaatggcccctgttggacacgggcttcctttgactgtgtgggaatcccacctggccacagacaaagggtagaggaagcaagtgccccaggagtcttgatctcagcccagctcagcatgaggaaagcagcaagcaggaagagtgagtgttcctggtaccacggctaccaggctcttcccagtttagagtgctcaacattctaaaacttgaccagccagctgggagatttgggtattcagatttttgggtgccttaagattccactggcagtagagaatcactaaatgtccatttctgaatgaattctactccccagagacattaacacacgatgtacttggcttgaatcctgtttgatttaagaaaatcggccaagagtccttcataagttactcacatctgaggcaccatcgggctgaccgtgggacactccagatggggagtgctgtgtaccctctgcctctcctgtgacccgaacacctcctctctctctccatggacgacgttttcatcttatggtctgggaatgctacctgaccaccctggagggtcacccaaggaaagagttcgttccaaagacaggtgctcctctgagttcctctggaatctggcaaggtgccgagcttggacgcaaggcttccatgaggctgtgaaggaggttgcacggaaactggtggggatctgaaaagcttttagtggcctcgccacacacagcacttcagatgctcaggtgatgagcaacattttccaaacccagctagtgagcaccccacctcctctggcttccagaacctggtgtggagggccaggagaggcttcgggactgaagggcagagcagcagactccggggctcatgtaggaaggaacatgccttcagccaaagattatccacgctgcatggagactcttgctaaatatcactggtaaatgcacaattatgtcccatttagagatctctagcagagtgtcttgtgtttgatggatttgtcctgcatttaattataacttcctgctaaagctcagatgttttctttcaggggtaagactgaagaaaagaaataaactatgctacctgctcttaataaagatcattttattttaaacaggaggctgaataaaaccttttgactctgtatttcagacaaatgcagtggcttaatttcattcaatcatttactgaggatctgaaatgcatgcggttagtggtgagaatactgactcagggctgtcccttcctctggagttgacagccgactgcgcaggaagggaaggtgagggtcaaacacacaggtcaacatcagaaacagcacttccgccttccattggccccgat

SEQ ID NO: 687 - DNA, 7804 bp, Homo Sapiens
aaagtggtactagccctgcgcaggtggggacgggtgctcggtttcctctagggagggaaggcgagagggggcggtggcagcgacaacaatgcagctaggtgccgtggcttcctgcgcgcggcggccgccaggtgcgtctccagactcccggcggcgtcgggcaggggatggttgctccgccgcaacggccgccagtgcgtacagtgaggcgccttgcagcgcagcgcggtgcaggctccacgggcccagacaccccgcgcgctgcacatccgggtcctggtgtgcagatggggcgtgggctcggcaaccagctggctgggggcgcccggcggagaaaagcgggacccctgctcccaaattccttggagatcgtacagccctcacctctttgcaggcgccccccccatcctgcctccccacccatgggaaaccttggatctgcaccagttgggacctcttctccaaagcgctccttggctttggagctaagtggcttcgtgcccgtagaagtggatttcaaacttcaataatcaagtattttagtgcaatttattttttatttttatttttgtagagacgaggatctcattatgttatccagggtggtctcgaatgtctgggcttaaatgatccttctgtctgggcctcccacagtgctgggattacaggcgcgagtcaccacacctggctagtccaacactttaaacataaaaaaatcagtgcaaaagagtccatgatggatgaaataccaaattgttatttatttatttattttcgagacggagttttactcttgttgcccaggctggagtgcaatggcgcgatctcagctcactgcaacctccatctcccgggttcaagggattctcctgcctcagcctcccaagtaggtgggattacaggcgactgccaccacgcccagctaattttttttttggccaggcttttctgcaacccctgacctcaagtgatctgcccgcttcaacctcccaaagtactaggattacaggcatgagccatcatgcccagccttttttttttttttttttgagagccttgctgtgttgcccaggctggagtgcaatggagcgatctccactcactgcaacctctgcctcctgggttcaagcgattcccctgcctcagcctcccgagtagctgggattacaggtatgcaccaccatacccagctaatttttttttttttagacggagtcttgctttgtcaccaggctggagtgcagtggcgccaggctggagtgcagtggcgcaatttcggctcagtgcatcctctgcctcccgggttcaagtgattctcctgcctcagcctcccgagtagctgggactacaggtgggcaccaccacgctcagctgatttttgtatttttagtagagatggagtttcactgtgttggtcaggttggtctatgaactcctgacctcaggtgatccaccggcctcggcctcgcaaagtgctgggatcatgggtgttagccaccgcacccggcctgaaataccaaaattttaagtaaagagccagacgtaggagtgtgcgcctgtggtcccagctacttaggaggctgaggcaggaggatcgcttgagcccaggagttggaggctgcagtgagctttgatcatgccactacactccagcctgggcgacaaaattataggaggcggttgttttagactaaactcttgtgctaggcaccaagacacaggaataaacaaaatgcagctagtcacactcagattctaagtcacaatgacgaagctaagttgttatctgacctttgggaaaaccaggagggagccctatcagcccattttctcttttattttattttctctctttctttctctctctctctctctctctctctccctttctttccaggaggagtctcacatttgtcgcctaggctggaatgcaatggcgcaatctcggctcactgcaacctctgccttccaggttcaagcgattctcctgcctcagcctcctgagtagctggaattacaggtgcccgccaccacacccggctaatttttttgtatttttagtagagacggggtttcgccatgttggccagactagtcgagaactactgaccttagatgatccggccaaccaattttccaaacaggccagtttcagccttcagtggccaatgtcctaaaattccctctgcttaatttctttaatccttacacaaaaaaactagcctggccgggtgtggtggctcacgcctgtaatcccagcactttgggaggccagggcgggtggatcacgaggtcaggagatcgagaccaccctggctaacacggtgaaaccccgtctctactaaaaatacaaaaaattagccgggcttggtggcgggcgcctctagtcccagctacttgggaggctgaggcaggagaatggcatgaacacggaagtcggagcttgcagtgagccgagatcgcgccactgcactccagcctaggcgacagagggagactccgtctcaaaaaaaaaaaaaaaaaaaaaaactagcctgaaacaacctgatggtaacactaatgagttaacacattctttgctgttgggtttttgttgttgttgttgctgttggttttgagataggtttctgtctcccaggttgttgtgcagtggctcagtcatggctcactacagcctcaaccgcccgggctcaggtgatcttcccacctcagcctcctgagtagctgggactacaggtgcacaccaccacgcctggctaattcttgtattttttgtcgagatggggttttgccaagttgcccaggctgctctcaaacttccgagttcggggatcctcccaaagtgctgggattacagacatgagccaccccgcccagcctgttctttgattttgctctctacaacccctctcttcctgtagagccaacctcctctgcccaactgattggaacagttatcctattttatggaatgaagtgtagcaaattgcaatgaagccggttaaggtccttagatttgttgaaatgttgtccattgacagcaaaaccccagctctgccattgcacgtatgagtcttaccttcattccggccctgctgattctgcgggggattgggtttttttgtttttgttttgttttgttttgttttagacagggtcttgctctgtcacccaggctggagtgtggtggtgccaatctcgactcaccgcaacctcggcctctcaggttcaactgattcttgtgcttcagcctcccgaatagctgggattacaggtgtgtgccaccatacctggctcatttttgtaattttatttaatttattaattttcttgagacagggtctctctctgtcactcaggctggagtgcagtggtgggatcttggctcacttcaacctccacctatcaggatcaagtgattctcctgcctcagcctcccgggcagtggggactacaggtgcacatcatcacaccggctaatttttggtatttttagtagagacgaggtttgaccgtgttggccaggctggtctcgaactcctgaccttaagggatctgccagcctcagcctcccaaagtgctgggattacaggtgtgagccaccacacctggccaggttttgtttttaagtataatttgtatttgttttggtgaagattcagattcacaagaagttgcaaaaatagtacagagagatttgtgcacctttctcccagctttccccagtgatagtatttttataactggctgggctccatggctcacacctgtaatccctgcactttgggaggccaaggcgggcgggtcaactgaggtcaggagtttgagaccagcctggccaacatggtgaaactcctgtctctactaaaaatacaaaaattagctgggcatggtggcgggagcctgtaagctcagctactcaggaggctgaggcaggagaatcgcttgaccccaggagacagaggttgcaatgagccgagattgtgccatcacactccagcccagacaacaagagcaacgctccatgtaaaacaaacaaacaaacaaaaagcttgaacccaggaggcggaggttgcagttaactgagattgcgccattgcactccagcctgggtgacagagcgagactccatctcaaaaaaaaaaaaaaaaaaaagattcaaaaaaagttttacatagccatgttatgttgtcaaaacctgggcgttgatgttagtataatggaatcaactcgagtgcagacattatttcgattgcacccgtttttacatgtaccttcctctgtgtgtgtttggttctattatttattattattattttttgagacagagtctctattgccgagtttggagtgcagtggcgcgatctcagctcactacaacctccgcttcccaggttcaagcaattctcgtgcctcagcctcctgagtagctgcgattacaggcgggcgccaccacactcagctaattttggtatttttagtagagacggggtgtcgccatgttgcccaggctggtcttgaactcctgaccttaaatgatccacctgcctcaatctcccaaaagtgctgagattacaggcatgagacagcgtgcttggcagttgagagaaattttgtctcacttgtagattcctgcaacccttgtggtttgaaggttctgtgtaatcatggtactgtgtctgtgttttaaaatatgttttgggctgggtgcctgcttcaagcctataatcccagccctttaggaggctgaggcaggaggattgcttaagcccaagagtttgagaccagccagggcaaaataacacgagatccccatctctacaaaaaaattattattatttttttgagatggagtctggctctgtcacccaggctgcagtgcaatggcgtgatctcggctcactgcaacctccgtctccttggttccagcaattcttctgcctcagcctcccaactaactgagactacagccgcgtgctaccacacccggctaatttttgtatttttagcagaaacggggtttcaccatgttggccaggctggtctccaactctggacctcaggtgatctgccttcctcggcctcccaaagtgctgggattacaggtgtgagccactgcgcccagctccccccccatttttttttttttttgagagagtcttgccctgttgcccaggctgggtggcacgatctcggctcactgcaagctccacttccagggttcacgccattctcctgcctcagccacctgagtagctgggactacaggcacctgccagcacgcctggctaattttttatatttttagtagagaaggggtttcactgtgttagccaggatggtcttgatctcctgacctcgtgatccgcccgcctcggcctcccaaagtgctgggattacaggcgtgagccaccgcgcctgaccccaaattttttcttaaattagctggccatggaggcacatacctttagtgccacctactccagagactgaggcaggaggatcactggagcccaggactttgaggctgcagtgagctatgatagcaccactgtactctggcctgagtgatagctagaccctgtctctaaaataattataataaatcaatgaagagtccttatcagttacaaataactgccaagcatatttacagaagaaatggtataggatttgcattgaaataacaggaagaggctggccactgtggctcacgcctgtaatcccagcactttgggagcccgagacgggcgaatcacctgaagtcaggagtttgagaccagcctgaccaacgtggagaaaccctgtctctactaaaaatacaaaattagctgggcgtagtggcacatgcctgtaatcccagctactcgggaggcagaggcaggagaatcgcttgaacccgggaggcagaggttgtggtgagccgagattgcactctagcctgggcaacaagagcgaaactctgtctcaaaaaaaaaaaaagaaaagaaataatggggagagtattgagggagaaaaataaaacaaaatggaatatatgtgttgccaattgttgaacctgaagggtggatcaggagggactcaggatgctctctacctaaaattgctgagccgtggcctggtgcagtggctcatacctgtaatcccagcactttgggaggctgaggcaggcggattgctagaggccaggagtttgagaccagcctggccaacatggtgaaaccccgtctctactaaaaatacaaaaattagctgggtgtgatggtgggcacctgtaatcccagctactcaggaggctgaggcgggagaattgcttgaaccctgaaggcagaggttatagtgagctgagatcgcaccactgcactccagcctgggcaacagagcaagactccatctcaacaacaacaaaaaaattgctgagccctgtcctagaaactgtcagaataaggtgtttccatgttagctgcgtctgtatcagcccccattctgtgatgatgaaagccagtatcagatgggaacacctgcccaggcattggctaagccactatcttttttttttttttttttttttttttttggattcagagtctcactccgtcacccaggctgggtgcaatcttggctgactgcaacctccgcctcctgggttcaagctgttctcctgcctcagcctcctgagtagctgggattagaggttcgtgccaacacacccagctaatttttgtatttctaatagagacggggttttgccatgttggccaggctggtctcgaactcttgacctcaagtgatctacctgccttggcctcccaaaatgttgagattataggcatgagccaccacatctggcctttttttgttttgttttgtttttttgtttgtttgtttgtagatttgggagggggagttttactctgctgcctaggctggtctcaaactcctggcctcaaaccatcttcctacattgacctcccaaactgctgagattacgggcttgagctgccatgcccagcctaaaccactgtcttaatctgcatccagctgtctccaaaggctaaaacacctccccttcttacatcagatatacaagtaatgaccaggcacagtagcttaacgctcataatctcagcactttgggaggccaaggcaggaggattgcttgagcccaggaggtcgaggctgcagtgagttgtgatagtggcactgcactccagccagggcaacagagcaagaccttgtctcaaaaataaaaaattaaaaagacatgcaaacaataatctttctgtattatcaagcacctactgtatacaaggcactgttttggttcagggatctgcaaacgttttctgtagagatccaggaaataactattttctgcttttggaccacatataatgtctagagcaattactcaactctgccatctaagggcaaaagaaaccgtagactataaataaacaaatcagcatggctggccgggagcggtggctcacgcctgtaatcccagcactttgagaggccgaggcaggcggaccatgaggtcaggagtttgagaccagcctggccaatatggtgaaaccccatctctactaaaaatacgaaaattagcagggcgtggtggtgcacacctatagtcccagctacttgggaggctgaggcaggagaatcgcctgaaccgggaggcggaggttgtggtgagccgagatcacaccactgcactccagcctggccgacagaacgaggctccgtctcaaaaaagaaaagaaaagaaaaaagaaaaacaaatgagcatggctgtgtgcta

SEQ ID NO: 688 - DNA, 1383 bp, Homo Sapiens
gatatttgggttctgggtctggatcctggtagccaccacccaggtagcaaacccattgctgcaaggatgggtgatgtatgtctcactcaccttgtttctcatctccctggtgttcctgttgtcttccttgtttggatttgaatcctggagagttctgttcttcgccttcgtcaccatgctgctctacattctccatgccttcagcatctattaccactgatgcacaggcaccaggccaagggggaaatactctttgaaagccctgattatttctccccgaaagcagcttccaatgcttgccatctggatgataaacagaagatccactaaaacatccacaggattaacagagcttccttgcagactaagcgatgacaccacactttggacatttaaattcactctactgaataggaggaagcctttattttccttttcctgggaaagtaactgtctcttggaattatctgaccgtgaacttcctcttctagcaaactcacatgaaagccctcactgttgagaatcccagctccactgtcaagcctgtttggggattttgcctcagctgtgggcttccctagagtaggttcaggggaatactcagcctgattatcttaaaattgaagaagtgccaccaaggccttcagatctaatgcagatccacagaccttgctcctggtacttgttcagcctgtgctggggagccatggtcctgagttcccggggaggctggcagggtcaagccaccctgcccaccaccctcccacttcccctcccctttcctctccagcattgggatccaaggaaaatctgcatgaagccaattttgagggtagatttgtgtggaaaataaatcattatacagtaagacctggggcttgaggggtggggaatggggagggaagggcatagcctgctcctccatgagtctgacatctcagaaactgtgcagctgccggacgcctgggtcaggactccaagaccccacctcttaaggacaagaaaatgcctggttcctcagaaaagaccctcagggaagaaggtgaaaacattacatccaaggattctcctgccacaactggattggaagaaaaggctgccgcatcatctcagcgaggagtgaaggaaccatgtcccggggaccgcgctcctccacctgcactcaccccctcacattctcttaagcaccctgtggcccttcgaggcctggcagaatggtggtgcccaccgggttgggccagggctcaacgggcaaagttgtgcacactaaaatatcaaatcaaggtgcttggttttaaagtaaatgtttttctaaagaaagctgtgctcttctgctgacccagatgagtagggcacagccctgtaactgcacttgccttctgt

SEQ ID NO: 689 - DNA, 13997 bp, Homo Sapiens
gagtcttctccagaacatctctcgattaaactcctcggtggtctcctgggcttcgccgacttgtgggtgtggcgtgtgggggccgaacggtggcgaatggaaaagctgaggtaagcggagccacctccctcgcccaagcccggctccccgccgccgccccagcccgccctctccgcgaccccgagcccggcctctccccgaccccgagcccggcctctccccgaccccgagcccgcccctgccgtcgcccgttctaactccgtcagctcaccccgcactcgaggcaggagcaaccgcagctcctccgccaagtgccggagctgctccaaaggcgaagccagggtggggactgcggctgcaggtgcagttgcgctcgccatctcagtcgcttgccgaaggccgcaaacacaggcctccgctgccactgccggagccgcactgcgacagccgctccacttccgggccacagcgtcaagggctcgtttccgtcaacaagccgtccagccccgtcccagaggccctgccctgcctcctcccgccacgaggcccggccccgcccgaggtccagcaccacccatcccgttatcagagaccaggcctggccccgcctcctcccgccccgccctgtcccctgaggtacagcaccaaccatcccactctcagaggccaggacaggccacgccttctcttgccccttaggccaggctacacaagcaagcctcaggctcaccgtctttcttattcatcattcattcatttatttgattagttgaaaacacttccgactaaggaagcagagagcccacaatcctgtgggaaaacaggcctgggaactaatatctcaggggtagtgagggtcgggcccagatcctcaaaggttccctgcccctgaaattgcacctttgacagctgctgaattccaagcacagcggtaagtgctttacatggggtaaccctaaaaaacacactgggcctcagacactcccgtacacacacccaacctctaccctgtggatgtcctagataagggttttctcttcacaaaggtaaatcaactctttgcctccttagggagggaaggaataaaggcattatttttgagacttttctgcagtccattctgcaggtatcagtagtgggtaatccctccaacgtccaggactccaaacgagcagctgctccctaaagctcacccaccaatcctggccctccacctgctactggggtagaggcctgggctacagacacagaggctgggcttctgcccagctgccagtggtgagacatggccttcaggagctcaggtggctttttaactgcaccatgaagattccaaacttggtggagttcagtgtccacacataacgaatgagaacaggtgtcagcagtgtcaaccaggtccgcaaaggggagaataaaaaagctagggtgccgtatgttgcataaagaaagtagcaggaataaacctgccagatgtacagcagtagcataagtaggtgaacaggcataattttcaagtattttctttgatggagatgagacctgaagttgtgaccaaagcaccgctgcagcaagctccaacacatgtaagccatcaaggggatgttaaaaaacgccagctggaaaagaacagaaccatagcttactcccaagtccttggaagagtttggtcttaataatgcattattagtggatcctaagactatgctgctatctgtcttggcgttagctaatttacttcaagcacagttgcttataacacaacagctgacttgtggctagttgtgtatttgcccatgtccttttattcatcttagaggcaggtatcatttaatttatgctgaagtcccaacttgtagtacagtatcatatacacagttaatacccaatggtgttaagctggaattgaactgagtaaatgtatacacacacatacaacaacccctcttttttggtggagtgaggggaggacttggctatcagtattttttttcttacctccatttttgtttgaggtagcatgataagtactggaatataaattagagtatctaaattataatccaagttgagctgctgtatgattcattcatttaacaaatatttattgagcacccattatgtagcaggcatgagctaggctccaagttggggacacaatggcaaacaagttagaaaaggtccgtcatagagcttacattctaacagggagaagacagacaaaaaaaaaaaccaaaaaatataattacagatcgtgattagttcaatgaaggaaagaactgggtcatgagaaggtaactgggagaaaggctctcagaggccagaaggacaagaatgaatcagcggagggaagtgcattctaggcagaaggaacaaatgaaaagcccagaggtgggagaggtcttggcctctttaaggaagtgcatgcagagcatgagccaggtggaaattggggcagtcggcaggacccagatcactgctctgcttcaaagcatttcaagctgaaaagtaagtgagctgattgtaaagtttttaaaagagcacactggatgctctgtattaagctgagagtaaggaggcaagaatatcagggagaagacccaggcaagaaataattacaacttagattaggaaaacagaaatggagagaagtggatggattcaagatatgcattggaagcagatcaaataaggtagagcttgctggtgaaatagatacagggtatgaaggaaagggaataattgaggatacatcttggagaaatcaggtgaatggtggagtcatttattaaaactggaaaaacagagaggaacaggtttggggtggaaataatgttcctatcagagagacatcacatgaagttgagatgcctgttagacatctgtggccattggatatagaggcacttgaagtgcagagaagaggtctagatcagagatatagatttgggattcatgggtctggatgatacataaaatccattattagtgtactatttattagaatatgaatgtaaacatttacaaaggaaaaaaccctgccttttggtaaggctcaggattcatttggtatgagagagctccttagagacagcctccatcaacataatagaaaactgcaatgaggctgggtgcagtggctcacgcctgtaatcccagcactttgggaggccgagacgggcggatcacctgaggtcaggagttcgagaccatcctggccaacacagtgaaaccctgtctctactaaaaatacaaaaattagccgggcatggtggcaggcacctgtaaccccagctacatgggaggctgaggcaggagaatcacttgaattagggaggcagaggttgcagtgagccgagacgatgccattgcactccagcctggacgacaagatcgagactccatctcaaaaaaaaaaaaaaaaagaaaagaaaagaaaagaaaactgaaatgaacccaggacctactcatgtatataatgctgctatgcagagaatattctggacttgggtcagtgtttgctaggcagaagtctttcctacttggctgtctctaatcctgttggatcatgttctactgccctgttagaaggccatgaacttattttgaatgtttttggatctcttccaaaacttcaaattttggtccactaactccattaggtgagtaaaataaagaaactgttagataaatacttttcaaatctgtttatgtagtttttctatggatcaaggttctttgtgtgtttattttaaaggaatcaaatgtaaacctaatacatcagtttgtttcctaaacaagtacattgctaggaaagcccaggtctggtttttgaataatgcagtttccactgaataactgacccatttttttaatgtgtctattttttagtttcctccctctaaaatattttccttcttcatcatcataatcagttttggtttactcagaaatctaaaactttttctaccataatcccttgtttcatttttttgtcaatgaaaaagcacagtgaaacaaaaacaacaaaaacttctttcacctcttataaacacttcatgacaaaaatgtattttaggctaggcatggtggctcacgcctataatcctagcactttcggaggccaaggcaggtgaatcatctgaggtcaggagttcgagaccagcctggccaacatggtgaaaccctgtctctactaaaagtgcaaaaattagccaggcatggtggcacatgcctgtaatcccagctacccaggaggctgaggcaggaaaatcgctggaacccaagaggtggaggctgcagtgagccaagattgcaccactgtgcttcagcctgggcgacagcagaacactgtcttggggaaaaaaaaatgtattttagatgtttacatgagagtggtggaaggagtttaggaagcactttaaaagcaaatgaagcttttattaaagactgccctgcaagtaaagtaggaaagatgatctatggtacttaattctggattttggatttaattcataactgttatgcaattagtctgacaagtccaagatgttcttaaattgcttttctgacttcttacctggagaattccaattataaatgttatgctgccttgtaggaaatgtccattaacaaatatcccaaaggaaaagcagcaaccaaatttgccatcaatgatttcaccaaaaaaccatggacctaaaagaggcaatggacaaaaaaggaggagattaaataactataattctgattacatatatcatgagatacatttataggaataaagcagagatatgagactagccatctataagcattttatttcatagccttccctctttgctagtctctgtgttgtacttgatatccttgctaaccaactattttttggattgtgaaattgtcttagtagacactatacctagaacagatatgtgtcttatagattctagaaacaaaaaaagcacactcacatttttgaaaattccattgcaataataacctcaatataatgcattaacatttcctttaagatgtaaagaggtattccacagaagttaaatttccagatgattgagatttactccttaaagcaaaaaaacttcaactactttttgaaagaaatctttctaagatgcactcgttaatataatgaatgtattttaacctcttcttgaaggcccacagtcattactttgtatatcaactacataatcacggttaccatgtagaaagtttaacttgcttcagttttctcatctggaatgccatgctgacttttctatcctccctattattatttactgccccattctcagtgtgtgagtttctaggtattattattattattattgtcattttgtcttgtaagtgtgctggtctccataagagtgtcaagttgtttgtcaagagtgataagggacagttagatttccgtttgcaaaatgcaaatactaggccaggcagggtggctcatgcctataatcccagcactttgggaggccaaggccggcagatcacctgaggtcaggagttcaagaccagcctggccaacatggtgaaatcctgtctgtactaaaaatacaaaaattagtcaggtgtggtggcacatgcctgtaatgccagctagtcgggaggctgaggtaggagaattgtttgaacccaggaggcagaggctgcagtgagccaagattgcaccactgtactccagcctgggcaacaaagcaagactacatctcaaaaaaaaaatgcaaataccatcatttgctggcaagaatagggttcagctttaaaaagtcagaggcaattttctcagatatactttatataaactgcattaaagacatatgagtctaaaaaggtgttttgtcttcagatttcaactttctgaatggaacaattcttccctattaatgtattttgttttgttttgttttacagcccaggaaccaaattacttgctttacctcattgtgtaagacaagcgtcaaaaacagcttcaacctatcttgaacaagagaacttacctccaaaggtgatctgccatagcttacacagaatcataaagtgttatattttcatttgttctctggtgggagttactaatgagcaaagtgcaaagggaggataaaagtgtaaaataaagactaagactaggcaacaaataggctaatgtactcctaattgacttttagtcactaagaaacataagcaaaaaagcctaaaagatttatggtgatttctgcttttataagtgtggctaagtgactttataagtacagtcatgcattgcttcaccatgaggatgcattctgagagatgtgtccttaggcaattttgtccttacatatcatacacaaacctacatgatatagtctattatatacctccagctccactagagtcttatgggaccaccactgtatatgtggtcccttgttgactgaaatgtttgtcatatgccacatgatactactgggtataataatacaacagaagagtgcagatatgcctgaactattgctcatctcagtttctctcttttttgagctgaatttttgagagccacacattagtaaatattcaatgaactacatactaagcaaaataggcaaaataccaatggatagatatatatactttttttttagatggcgtcttgctgtgttgcccaggctggatttgacctcctggactcaagcagtactctcgcctcagcccccaagtagctggaactacaggcatgagccaccgtacccgcctaccagtgaatattttaatgagttaatagataataaacacagaagataggtataaattctgataaaggtaatgatggaagtaaaacctgtgatgagatatagactaaaactttaagatagacaaagaaggttgctctgaggaggtgctatttaagcttctattaggtttctacacaaatactaattctgtagcagtcttctcagcacccttaagttaacttggtgttaactaaatgtcctttaaacatgttaggcacgagctttattttccaaaaccatgtcccagaaaatgatttatgaagaatccatgagccatttgttataccctcaagagtctaattctattgtcaaaattgttaatatattctttggcaaaattccccataatctgtactaatttacttacccagcactgtatacagggtcaacaacaacacagaatagtagaagatgtttattttgctcaagacatgaagagaaaatgaggtcagatttataaaccctgaaggttctaaaaaacataaagttgaaaaacccagtgaacacatgcaaagttcagtttctttatgacattttctagaagattttcatgggctatctaccatatattcagcaaatcctttgttagatggtaactatacagatgacaccactttaaattcagaatttggcaggaatcctggtgagacagttcacttagaattgcaaaaggcagagagttcgaagaaatggtgtagttgtgagatattttatatatatcataagatacataattgttatatatatcacaatatatcgaactcatatatatatgcacatatatgtacatatacatatatatataataactgaaagcaatggacacacctaccagagcaccatactattttatctttatataggtttgaaagatagtggtttgttcaaaggatgatcaagtctctgttttctatggaatttagtgtccaaatgtacaaacttcaaaaaggtatatcaaaatacttcaaaagtaaattaaaagaaatatcaaaatatcttcattctaatcataaatatgagtatctgtccaaatatggtcctttcctatacattatacagttctttttttttaatttttattattatactttaagttttagggtacatgtgcacaatgtgcaggttagttacatatgtatacatgtgccatgctggtgtgctgcacccattaactcgtcatttagcattaggtatatctcctaatgctatccctccccctgaccccaccccacaacagtccccagagtgtgatgttccccttcctgtgtccatgtgttctcattgttcaattcccaccgatgagtgagaacatacggtgtttggttttttgtccttgcgatagtttactgagaatgatgatttccaatttcatccatgtccctacaaaggacatgaactcattttttatggctgcatagtattccatggtgtatatgtgccacattttcttaatccagtctatcgttgttggacatttgggttggttccaagtctttgctattctgaatagtgccacaataaacatacatgtgcatgtgtctttatagcagcatgatttatagtcttttgggtatatacccagtaatgggatggctgggtcaaatggtatttctagttctagatccctgaagaatcaccacaccaacttccacaatggttgaactagtttacagtcccaccaacagtgtaaaagtgttcctatttctccacatcctctccagcacctgttgcttcctgactttttaatgattgccattctaactggtgtgagatggtatctcattgtggttttgatttccatttctctgatggccagtgacggtgagtattttttcatgtgttttttggctgcataagtgtcttcttttcacatagcagatttggtcttttcacatagtcccatatttcttggaggctttgctcgtttctttttattcttttttctctaaacttcccttctcgcttcatttcattcatttcatcttccatcgctgataccctttcttccagttgatcgcatcggctcctgaggcttctacattcttcacgtagttctcgagccttggctttcagctccatcagctcctttaagcacttctctgtattggttattctagttacacatttgtctaaatttttttcaaagtttttaacttctttgcctttggtttgaatttcctcctgtagctcggagtagtttgatcgtctgaagccttcttctctcaacttgtcaaagtcattctccgtccagctttgttccattgctggtgaggaactgtgttcctttggaggaggagaggcgctctgctttttagagttttccagtttttctgctctgtttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactccagaccctgtttgcctgggtatcatcagtggtggctgcagaacagcggattttcgtgaaccgcgaatgctgctgtctgatcgttcctctggaacttttgtctcagaggagtacccggccgtgtgagatgtcagtctgcccctactgggggtgcctcccagttgggctgctcgggggtcaggggtcagggacccacttgaggaggcagtctgcccattctcagatctccagctgcgtgctgggagaaccactgctctcttcaaagctgtcagacagggacatttaagtcttcagaggtgactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcactgctgccttgcagtttgatctcagaccgctgtgctagcaatcagcgagactccgtgggtgtaggaccctccaagccaggtgcgggatataatctgctggtgcgctgttttttaagcccatcagaaaagcgcagtattagggtgggagtgacccaattgtccaggtgccctctgttacccctttctttgactaggaaagggaactccccgaccccttgcgcttcccgagtgaggcaatgcctcgccctgcttcggctcacgcacggtgcgctggacccactgtcctgcgcccactgtctggcactccctagtgagatgaacctggtacctcagatggaaatgcagaaatcacccgtcttctgtgtcactcacgctgggaggtgtagaccggagctgttcctgttcggccatcttggctgccagcgctttccctatttctacagttcttaacgcacagctaacctcttactccaactgaaaggcttccctaaactttccaaattaacgtgcttttaaaatacagtgccaaaaagcccaagtgtaagggcttgactcagagaagctccattctgcggccacagtctacagtaccacagatcctcagccccaaccagccatgtcacccatgcatgtggctggccataaaccagtcagctgaggactatgaaaggaagttcagtatacactgagcaacactactggtaaaaaatatttaaaggactagtctcaatgaaagacagtctgatgtaagttaaataagtcatgtctttgctaaaagaccagcacattcattttatacttataaccttgctcagcctaacacttcattttatgcaaagcctgataatgcatgacctttcctactttgtgttactctctcagcttcttttttgttctagtctgtacttctcaaagtattagcctacatattcagatagaataataattatttattattttaaaaaatcctttagccttagaggcagctattctttaaattttaagtaattattctccattttggctgcacattagaataacctaggggaacttttagaaaatactcatgcttgtatctcaccctccagagattctgatttaatttgcctggggtagagggagatcttaggcagcaacccagtgattctaagcagtcaggattgagaaatactgctttagacaaagccgtgcttctcagtcttgactgcacattggaatcatccagggagctttaaaagatactgatgcttaggtcccaccctagagattctgatgtaattggtatagaatgctgttatagctattgaaatttcagaagttcccccagcagtttctaaggtacgaccaaagtggaaaagtcttgtttagaggaaagaactgacctggggtcagaagccttgggtttggagtctctcctctatctcttattagctatgaaaccttggacaatttacataacctcccaaaacctttgttttctaatctttaaaatggggtcaatagcacctacctcacatgattgttttaaggattaagtgaaacaatgtaggttaaaatatgtttcaaatttaaataactatataaaaatattgagagcccccatataagaggctggggacttcaaatatttatttacttacattatgttcaggaaaatacacatgtataataatgcttcttgaactttttcgtagaatttttaaaataaatataagaagaaaaacattcagtaggatgtgtactgtacctattcagttaatcatgttactgtttaatcattactacaatactccccttctctatcatcagtccttaatcccagggatttcatccaaattaagaagggatcaggaaaatttgattcaacaagtatttattgtctattatacacaaatttggtgctgggggctgtgggaaacagaagagaattaggaagcaagagttcctgcattgaagacaggcacagtggctcaagcctgtaatcccagcactttgcgagtctgaggtaggcggatccacctgaggtcaggagtttgagaccagcctggccaacatggtgaaacccatctctactaaaaaaaaaatacaaaaattacctgggtgtggtggtgcatgtctgtagtcccagctacttgggaggctgaggcaagagaattgcttgagaacccatgtggcagagattgcagtgagctgagatcataccactgcactccagcttggggttcacagcgagactgtctaaaaaaaaaaaaaaaaaaaaaaagttcctgcattgaggaacttatctggttaaggagaaaatgtatatacattcgaagtggttatataaagcaaagtggctgtctaattaagtatagaattaattgtgagaaaggactatagggattcagataagcaagagctcattatgacctggaatggctggagaaaacagtatgataaaggaggtcttcaggtaagccttacaggaggctaagatttagataagtttagaaaaataacttaaagtagggataatactatgagaaaaatacagaagcagaaatgagcatggcacgtatagggaacagtgaaaaagtatctaggctaaaatacaggtaactggttgaagacatggctagttaaataagactagactgtggaagatttttagtgtcttgcagagatgtctgacctttattcagtgtgttctggaaagccacttaaggcttttgcatacagaagtgatctatggatgagatgccataagaaggataattggctaataatgaagaggatgaattagatagagagactggatataagagcagcagttaggagtctattcaggaatccagagaggtgatactgacatggcattggtgacctctcaaaaggaaaaggaacatttgaagaaataattaatgggttgttttgtttttttgagatggagtctcactattttgcccaggctggagtgcagtggcgcagtcttggctcactgcaacctcagcctcctgagtagctgggattacaggtgcatgccaccacacccggctattttttgtatttttagtagagacaaggtttcaccatgttggccacggtgctctagaactcctgacctcaagtgatccatccaccttggcctcccaaagtactgggattacaggcatgagccactgcacctggcctgaattaatgagttttaatatgttgccattaggagtgaagactgatgcttactgaaaaatgactagatttttaaggtaaaaactgtagtaaggtcttcctgtaaggtctttatttttgatagtctatatgtttttatttttttaatatcagtatatgtatatatttttctatcaaaatatagtgatttcaaatgcctgaaagttcatgtgacttaagtaaatctttcataaaatacctgattttaaatttgttgataaaaacagaaatgtcttcagaattgtcagcatacattttttgcctgggtttactgatcagatagttttgcatttctctgtgctagatgttttaagcaggatttgaccaaaaggtcacaaaactatatatccagcctaaaatcagaatgatctttgtgtaactctttgataagtaaaactaatttaatatagttgatttaatgaagatagctgttttcagtttttggcaaaatatttatataattagctttaagatttctacttaggtgaacacccgaaattcacatgctgtaaaactgattaacagaaagataccttgacataatgactaactctatctaatatcttagttttcataagtaatctatgtgtagttaaaaaataagttagatgaatgtaaatgggataaatttataaatgaacttttcatgtgattttaaatcctaaagttacattatattaaattaagtaatagatactcatgaaatgtctgagtcatttctaagtaagataaaatactgaaacataaattgctaaacattagtataagttggttcttggtttcttaaattgcatagaaagacaaaacatacttgggtctattagtaaatagtaaactccacattcaaaaattgttccataaaaaattttttttagagattataaactatatattcatgagatgttaatatataacagttcaaaattacttacttccagagtaacctaaagcttaaggttactaaaaattaagtttttattaaggctgggcacagtggctcatgcctgtaatcccagcactttgggag

SEQ ID NO: 690 - DNA, 3242 bp, Homo Sapiens
attagctgggtgtagtggtgcatgcctgtaatcccagctacttgggagtctgaggcaagagaatcacttgaacccaagaggtggaagttgcagtgagctgagatagcgccattgcactccagcatgggggacagagtgagatgccgtctcagaaagaaagaaaaagaaattcacaggaagagacagggaggcaggattatccagagctgtctatagcagagctgctgtgcacagagcctggtgctccagccctccgggctgggcggttgggaggagctcactgtaagcataccactctgaaatctctggtttagagcagcctagggcctttatgtcatccacgatgccataaaaaagttttctatgtatgccatgacatggaagaggtggggaaaacattggcatgaagtaacagcagaggactacatcagtgttaaggaaatctgaacacaatcctgtcagagttccagtgctgccgttctagaattttgttatcttataggtaatactttgaaaacaaataatccacatatctataaatccgtctggaagaggaacaaaaatgaatatacaaagatgtcattgttgtgaaaaaattaaaaaaatcttcaaagtagcaaaataaaataggtaaataagttatagtaaattcatgctatgaaatagtatacagctctttaaaatggaatttttctgaaaaggacacatactttaaagtgagaaaagcagggcacaaaatttgatacaagatacggattttgtaaaccgcactcagaaaataaaatcagatcattgcatgcaaaatagtgttcctgggtgatatgattataactattttttcaaaatagtttacttttttcaacttaaatataaaataaaacataaaaataaaaacgtgataatgtattcgatggcagttttaaaatgtaggattgcttgtatcccagaaatcttaagaaaatgtgtctaatcatttcatttctactttctatacctgtaacttacatggttgggaatacagtacggatgtccttttttaaaaaattaaaatatatacaacaccgtgaaggacttccttctagtgcagatgactgacaaaatgaagagaagatgcacctgttccagtggtgtctagtgatttgaacagaaagaaactgtgaagaaccaggaatgaaatcctgagatatgaaggggactgtctgaaatccatgtgcctttttgaggtagtttcgtatcatctcctggaagcagaaatgctacaaagcagtggaaggaagctggggttttccctgtcattggggagtttaactctggggagcttatttttccccaactttattaaggtatgatggataaatgaaaattgtatgtatttaaggtgtaccatgtgatgatttgatatgcatatacattgtgaaatgattacataatctgtctaattagcatatccatcccctcccataattaccttttttccgtggggaacacacttatgatttactctctcggtaaatgtcaagtatgcattattactaactataatcgttatgctgtacattagaacctgctcatcttatcctttaaccaacattgccccattaccacaacagattagagatttaaatctcttataatgcttatatttagacattttagaactctaaacttaaaaaaaaaacaattctgcttaataagagatttatccccagattatttgaagacaccaggaagagagaggtcagggaagggagtgtggcccagggtgaaggttcagcgaacacctgctagatgcatgcaggaatgaacatgccaacaagccttcccactgaatgcacccaagtagatgacatgagaatgcattctctgtctgcaacattcttggcttaacttgccactgactttagcaagcagccatgcattcctgtgatgcagctttaatggcctttcatttgctcacattggctgagccctgtgcagagtggatgccacctcccttcctgcagccctgccatcatgtccccaactgtcctcccccaaccctcctccactcctgtcacctcagttccaacaatatccttccttctctttttagcaggggatggtgagactaatttttccccaccccatctcgaaactaaggacttcagattgcatcttggtgttgcacttgaaacatcctaaagctaacctgtaagcttgtggcagctcctgggaggtggcatttcatagcttggtttatttgccaagttccctacactcttaggtatcaaagaatccagatgttcagtttctcctaatccctgttgataccctattttttttaaaataatagctagccctgattcctgtatgtctgaggattacagctattttttaaaatttaatttttaaagttctactagagatggggtctcactgcattgcccaggctgtcttgaactcccagccacaagtgatcgtttcaccttggcctcccaaagtgctgggattacaggcataagccaccatgcccagccccgattttgagttatcaattaataccagcattaaagtaggtgaagttctatgacagttcatttggcaactcaaagccctgctttccaagagcttattccagtgctttcattaaaagaggtaaactgaaacttttgagttcatgtcacccacattagcaatgtgtacgtgggtgcagccttcttcaatcgctatctttttagaatgagtcccttatttcctaggctaatgcttagtttctttgcaaaagtgcattcagactgaggtagcatccacttttaatgcttctgtgcattaaaagttgttgcgggaagtcagggaccccgaacggagggaccagctggagccacagcagagaaacataaattgtgaagatttcatggacgtttatcagttcccaaatactagttttataatttcttatgcctgcctttactttaatctcttaatcctgttatcttcataagctgaggatatacatcacctcaggaccactgtgataattgtgttaactgtataaattgattgtaaaacgtgtgtttgaacaatatgaaatcagtgcaccttgaaaaagaacagagtaacagcgatttttagggaacaagggaagataaccataaggtctgactgcctgtggggtcaggcaaaaaaagccctatttttcttcttgcagagagcctataaatggacgtgcaagtagggaagatatcgctaaattctttttctag

SEQ ID NO: 691 - DNA, 12044 bp, Homo Sapiens
gagcttcactggaggtgggtaagttttgtttcagacctgtagggctgaaagtgttgacgaacacctgggagaaaatgtccagtcaccgtcactgcaaatgcgggtccgaccttcaggagagggatttggactgaagatgtgggtaggagcaccctctcttagacaagaaaaattgagactaagaggagatgagatcgctgggggatcataattaagtaaaaacttgtatctctaaaatccgtcctgacattttcatttataggatatacatatgtatgtatctgttataatctgaaatgtgtccctcaaaattcatatttgaagccctaacctcctcatacctcagactgggactgtatttggagatgaggcctttaaaaagataattaaggtaaaacgaaggcattagaatgggctctaatccaatatgtcaggagtccttataggaagaggagatgaggacacagacacccacagagggaagacggtgtgaggacacagggagaggacaccatctgcaagcccaggagggaggcctcaggagaaaccaatcccgcccacacctggatgtggggcttccagcccccagcactgcgagggaataaagctccgttgtgtaagctgccgcatctgtggtattttattatggcagccccagctactaatacagtacccctaccgatacatacatatttacccacatgtagccacacacatgtgcacatatgtaatctttttgcctataaaaaagtaagcaatgcctaaaagtacaggtggagagaaggctaaaaagcacaggctcgaagagactgccaagatacaacgatccaacaaagacacatcgtatcaacagtaatgatttcctaaatgtgaaggtaatttggatggctggtttatagttttcatgcccgggagttttccaaggcacaatgtataccctttgcggcagcttactctcctgaaatgtgccttcatgaaattagataaacagggagaagatatgaagtacatctgcctaacaccacgttagaagaatccccgggcatttgcatcttatgcgatgatatgctggcaaaccttggccaacttccagtcttgtccttatgacaggggactgctgtgttgagttcccgtctcaggcctcacatccaccttggccctgccttgggagcctgtaggtgtgggcagaaaagagggacgctgccttcctggctgggcctttcttcacacacaggcacgaggacccaagctctaaaggatgaagtccccatggtctccgaagttttcattatcatccccctcctaaagctccaccttggaggcaatgcactgtaacaaaaggaccagcacagtgcccagcacacagaaagctatcaatcaatgtcagccttaaccattatgttggttgacttgccatccctcttcctcaactgcaaactatgtgagagaaagattcatgtaaccttggtattacacaactccatcgtggtgggttcagttgcatttgtcaaatgattcagagtaggacaacgggaattttctttacaacatcacagcattgtaaagtctttgctttgcacgaaagtgtgggactgaagaaatgattgtgcaggttgaaactgtgaagcaattttaagaagcaacaaggaaaattatgattgtttcataatcttcaaaaaatttttaaagtgttaagaactgttttactactggtcgtaaatgtataagaacatttaaagatagcaaattgaatacttatttagcctgtcataatttaaaaaatgagaaacattgagaaatagtgttttatttctttgtaaaagacttatggagagtaaattgaaaagggctttgccaccttctcattgtgaaacttacagtatggaccaggcatcttttctatgccttggcaaattgtcacattcctttctatatttggataggcttcctacattttgtcctgcacactttcagtgctgtgaaatatctccaagagtttctttaatatgaagtttttgccagcatctttatcctgagtccctcaaaagacacatccagaatctctcaaaagacaacagcatcaactttcccaccatcagctctttcttctctaaactcgtttacgtctgagtcaactttcacctcctgcattctcactttttgtttctttgctatactttcctcttcattggctacctacctctcttgagtattcatttctgtgaaatgtcacgtgggtttgtcactgggagccaagagagcagcacgaccacacgctttgctgtctgtgtgggaactgataacacggaaggactgaaggacgtgatgcggttaatcactgatcatgatgcacatctgttattacgtggtggtctgtggactgcagagcaagcagcagaggttgtcccccatgcaatcactcacagttaatggtgactgaaattggaaccatgttgttagggggctggtgttatttaacctcagttgccacagggcaatgaaaattcgtgcgtttgggaactatgcaaggtgaggactgcctgaatgttccataatgtgatgagtgcctcacaaacagggtgtatattatcactgagttttttcattattcttgaccttcaatatatagacattcttgttgatggtatcaggttgtttctgcgtgaatgagctttactcctctgagaaatggcattcctgaccctcctctttgaatcaattgcacaaaagtatctgaaggaaatttgcttacctgctgctttctatggaagctttcctgcagcatgacctagtgtctgtttctggttgatgattaaccatggggaacaagcgtttgagataaagaagttgcagaactttttagagaatgtaatatgttaatgtgcactgggactctccctgagctatatcaagtttcctggattctgaaatgctataattttaaaagtgtcataaggttaaaacagctttctaagaagtgcctttgttggaagaatacccaggaatggtgcgctggacagcttttgtacaagtcttgcattttctcagaactatctctcatcttggccatggcatcagtcacatcctgagtggctcaccttgacttgggttgcctcctactgcagttctcctaaactctggtgggggacacgggcacaacccacccaatactcgtatgtgctttacctggaaataaggagcagaggagctaggggaaggagccgatggctaaatgttcctgccttttttccctcaggcagacagttctaaggtgcacgctgtaggttgctgggacaaccctggcaagatcttcccccagacatccaccttggcggccgacttattaactcattggtctattgacttttgctccttgcctcgcccctgatccctgtgccctctttctaataagctacctgctggtgaggctctgccttgggggaaacccaggctgaggcaggtgggatgttataaccagggaggcctgagtcctgggtctttgcctggggtccccaaataggagagggattggaggaggtattgtgggggagagtgttgcaaaagcccagaggaaaggagtgctgttaccacaacagaggagacatgaacctgcacagaccaaaaacaggagagagagagggaaagagaaagagaagggggagaaagaaagggagagacagaggaagggagagatggggaaagaggagaggagaaagggagggagagaaagaaaggagatggagagagaaaagggtggggagagagataaagagagaggtaaagagagagagagaatcatctactacatgatttcttttttttttttttctgagatggagtttcgctcttgttgcccaggctggagtgcagtggcgtgatctcggctcactgcaacctccatctcccgggttcaagcgattctcctacctcagcttcctgagtagctgggattacaggtgcctgccaccacgcccagctaatttttgtatttttggtagagacggggtttcaccgtgttgaccaggctggtctcgaactcctgacctcaggtgatccgcccgcctcggcctcccaaagtgctgggattacaggtgtgagccaccgcgcctggccatgattttttttttaacctataaaagccttgagtagtgatggacgcgattcctagtaatgtggtttactaaagggtcaggctgtcagttcaccacaaatacgccacagtagtgtttggtattctctcaatgttccacccaccagagcatacaaaacagccacattccccaaacacttaattctcaaaacatacttgtagaggagggaagcctattactcccattagaaagatggaaaaccaaggtgaaatgattaactgagctaccagggcctcagaagaaagtcgctgctgagtttgggattgtgttttcaacttcctgcccactgtgggtgagctccaccttttactggaaccaactccaaggaggaagttttgctgggtttcctggaaggcagaggtttgcatctgcatgccctgcgtggaggcattgtatttgggggcaggcaggagaatactgtagctggtgtgcccacagaaagggagggagagaagccactgggagtgagctgggcttgggatcgggctgtgtcctcaccaactgtctgcccaggcatgaacttgccactgctgtggaagagtctgactgcatccaagaatgccaaaggttgtggctgaactcacttctcaacagacttggatcatgttcatatactattctttaaaagatcaccatttgtagtagaatgtcaaaaacccaaagatgttgctcccgatgttgagctgtaactattttctgtgttggtggaaaaatatgagagaattagttgccattcatgaatctcagtgatacacagacaaaagcatgcttcaattttgtttctttgtttttgagtggttctgatttattttcagcttttgggtgatgtctggggctgtttattgaggacgggataaatgggggggggaccaaaatatatttggcatttattggtggtgttttatatttgtgacttgatttacttcttatcacaacccagtgagacacgtactattatcatccttttaatagatgagcagcctggagcttagagaggttaggtagcatggacatcatcaggcaagttaaatgagaaagccgccacccattcccagctggggctgaccccagcgcctgtgttatttctgttgccctgagcctccccaggcttcttaacccacatgtactcctagcttccagcagtgctaatttacaccgtgtaccagctggagacattctggagtgtagactgacgcaataatccccaatgataggtttgccatgttttttttaaatgtgttttttcctactttttattatagatgtcagaattttctccttccctgagttatctttggacttagatgtatataaatgtatctggttggaggtggggggaaaagtggaagtggaagaccacaaaagtaaaaattacatttgagtgtatttcaccgattctaagaggaatgctttcttctgctccaaccactctgaaatctccgggtcccatactcccatcgcagctgtgtgacatggttgccgtggcctttgtgtgaacatcaaagctcagaggatgggtgtcagaggcttagatgaaaatcctgaagacaattgtctggcacttttcaaagctatacggcctcaccaaaaccctcctggaagctcttgatggctcgaggttcaacagtgtctgggaagacatggatataaaagatccagaatcaaagagtgattccaaagagttagaggctgactgtgaagtcttaggcatactgtaacccagtgatttacctatctttgcttttctgctcatgcagaagagtgatatatgatgaataaattctaagttcaattaggcctaaaagagctcttgtaatatgctttaaaaagtctaagtgataaaacattgtgacagatagagttctgtcagtgtttatattttcttagtccttcattaaataacagtgtgtcttacaccaaggcagttttggattccataaaatatggtagtagttatgtttcatgtttcaatagtcatcaatctgtttttaatgtattcatggaaaaatatgtgggccatcttgctatttaactatttttgaaatctcatggaagcctgccaatgtttttgcaatttagctaagaagctgtcttgctttttgagaggggaagttccaatattgtaagcctaggtttctgaatatatttttgttttttaataaatgtagaaagaatgttttttgttaatcctggcatttgtctagagcaaaagcaaaataaatgaaaagtgaggaaaattaaaaggctcacgttataacatgtgctgtctagagaataaaaactcatttgtgcaaagttggtatggcttttatgaaaatatttcagtccgagcaccttgcctgtttgctgcagtgctgactgactcatgattagggatctgtgttgcctttattgctctcggtttgccctatggcttgatttattaatatatttaaatatacaattttaaccttatcattggtgtgcaggtgtatttatttatactatctttgcttttagaaaaacactattatatcataaaaatattttaaccttaaattacttcccacaggcttcaagttttatgcagttcatatctgggcataaagagaaatcaatatactgtggcctgcagggcaccagcctttggtgtttgtcaaacgtttacagataactaatgtcccacataaaatagatccattctttccatcttgcacatcttgcacctttcttttttttttttttgtatgaccactgccgtgtagccatcatgtctggactgatagtagtttctaggcttggaggaaactgcattttcaagaaagcaggatgcagacatcccctgaggaacacctgcattaaacatagcctcccacctaaaaagagctccctgagttgggaagtgtcttattggcctctccttccggcctctcccactccctatgctgaaaccaagagcttcggggctcccctccctgcccaccctggcagggagcccagggccctcgttgctctccctgtctcctatgctgtccgagaacccctgcagctccaggccctggaccagccacagagtttacttctactgttgcaatactttgaagggagaagagtttcagcctttttgatcagtggggcttctacttaaaatccttccatggcaccccattatctcagggtaacgtccagactcctaaagtggcttccaaagtccttcattatctgatgggcctctgtgtactttctctctcttctctctccattcctggccctcctcatcaattctctggccattttgaacttgactcagtctccccaatgtgccaggctttccctggcttcccggctctgcgggaggatgagagtgggctcaactgtcttttgagggaatcctggaaacacacccaccctgagagtcattgttttgatggaagtgacattccaaaccaacatttggaaccaagtcctgtaagccagaacctgcacaggttttgttaaaggaatcaatttaggcctggcactgaactcctttctgctgtaagactcttttagaactttggaagtttctatgcaggggactgagccatcctgtccctgcctggttgggcatgagaagtcacttggaataggtctgagtgaatgctgatgaactccgacttagctctggtaaacagtgcaagttcccatgagactgcagggcaagaacagggcaggctgcacaccgcggggagaggcacacctcgttccgtcaagagacacctgggcctggtgcaggcgcattctccgtggttaacgggtgtgaaatcggcatttatcatcagtgacttttcattgtgtggcttctgtgagtccccaccttccttctaaacctcagcaggacactttcccttccctgtagttcaaatatgcgccgcaacctcagcttgatctcaagctttctattgccatgtaaacaatcagggagccctggaatggtgggctccaggggtgggtgggtcagggccacccccaggggtgcagagtctgaaggggctaaactccgggcggaggctggggggcctcaaaagcattttcatgcaggtgagaaaaggaaaatttccagggcatcttggctgaagcacagaagtgactcccggaagacctggcatgtgtgagatgtaggagggatgctctgtgcctgcttgtgtgtgtgcatgagtgcgtgtgtgtgtatgtgtgtatgcgtgtacatgtggtgggtatgatgagcctcggggctccctttagcatctgctggtgagtttactgtgcctgccgaccgtttcccaggtcaggcctccgcccatgataactactgtttaccaaacacttactgtaggtcagtgactcacatatgtgatctcatttcactctcccaacaaccctgacgtaaggactattatccctatttaacacatgaggaaagggaggtttgagagctctggttactttttcacattctgaagctaggtgcctccacagcacatgaaatgttctgccgtcgttcgtctccctgggaccatatggaaacgggggctgcttcccctggagatcacaaagggcttctgcagtagagaaaggagactaagagcacctttctagacttttccttagcattcttcaagatgtactatcagaagttcaataaaaacaacctaatgctgagattcatggatagaaaattgactcaacttcctgccttccgacgagcttattttcttcttagccattgtaaattggtggagccgtgttcctccttgtcttagaaacttttaatggtgctgttgccctcaggttaaggtctggactccttgtggctctccaaatccctcagagtccttcattgtctgagcaggcacactcatcttctgtagtttaaaaggtggcagtggctgggcgcagtggctcacgcctgtaatcccagcactttgggaggccgaggcaggcagatcacctgaagttgggagtttgagaccagcctgaccaacatggagaaaccccgtctctactaaaaatacaaaattagccaggcgtggtggcacatgcctgtaaccccagctacccgggaggctgaggcaggagaatcgcttgaacctgggaggcagaagttggggtgagctgatatcgctccattgcactccagtctgggcaacaagagcaaaactcactctcaaaaaaaaaaaaaagagtgacagtaatgacatgatcattaaacatctttcagggaagactctatgagaccgatgtttgcatgctaaagacaggtgttgctgccggaaagtgattcggtttgaggactcaggacttgggaacatcagtctcatctcaacagaacccttttttcagttccctgctgtttcctgcacaaactgggggaatgtgcttggcctccctggagctcggattgtctagcagcttggattgcttagtccccctttccacaccttcctgccaccctgagggggaggcctgatggttcatgggcttccgcagaaggaatttgcccactctgcttcctaaaatgtgcagctgcattttgctgctgggaaaatattgattgaaggtctggaggagtctgacaacttgtaaggcacatacagtttttatctgcaggatgaagttagtttttgtttgggcctggtgttttcgaaagaaggaaatcactttcataagcatcagattagatccaggaagcgtccgcaggacaatgagaagctgatagaggcagtgtctcaggattttgccattggttactaccgccacctcctggctgaaattgtgaactacacagcatgggcttcctgggcaaactggtttaagaaaaggtagccccgttttccccattttctgcaagttctgtgtggcgcaaaaaggaaatgagaagacttattgtttagatagagtatttattggcatattttatattaactgtgatgataaagcagacacaagaataagaaataaaatcagagtgaatttttctcatctgaggcaacagggaaaataattcattggaacaaccctgtgactcagtgttagctttgcccaaaataagtgtcaaggcccttatctgagtttccaagaccccctgcccattctcttaagctgacctcttagcatattgagggaaatctaccaaacattttggaaaattagtacaaaattaaggaattaaaatgaaaattgcaatataaaaaattattgggtctgaggcatgtcttcaggttgtacaaggaaaagatgtaagatttggtatctctcctcttcattattttatattggttttatacataagccctcaccctgtagaaatataagttctaagttaggaaaaggattatttgtaacatacatgcaatacacatacattgacagaaatagaaacaggctttttctgttatttaaatagtatttttggagtagattggtttttcgtttgtttgtttttgagacagagtcttgccctgtcgccaggctggagtgcagtggcgcgatctctgctccttgcaatattttcctcccgggttcaagtgattctcctgcctctgcctcccgaatagctgggactacaagcgtgtgccaccatacccagctaatttttgtatttttactagagacagggtttcaccatgttggtcaggatggtctctatctcctgacctcatgatccgcctgcctcggcctcccaaagtgctgggattacaggagtgagccactgtgcctggcggattgtatttttaaaaatttatttagagatggggtcttgctctgtcaagcaggttggatggagtgcagtggcgcgatcataactcactgcagccttgacttcctaagtcaagcaaccctcctccctcagcctttccagaggacagcagctggggccttcagacaattacgtttccttagtcggacatctgagaggcataatttcatggctaccacagaaactgagagcaaatattacatttctcatccccccttgaagcttgggtcttgctgaatattgttttcataaagcaatctgccatattgaaaaagccatgtaatgagaaactgtgtgcaacctccagccaacagctaggaaagaactgaggccctcagtcttctcaggtggcctactggccaatatgtacaagttgtatatacaacttccagaagggtccttaaaagaagagggctatcactttcttgccttcttttctttcttgctggctggaatgtgatgatatcactagatctgaaacagccattttggactaaaaggcagaagccacaggtgaggatgatggagttacaaaataaaagaagtccaagtcctagtgaactgggccaccatgaacttcccaggtttactggagagagaaataaacctctaacttgtgtatgtctctgcttgattttcagttacttataacagaactttatccaaactgaaaaaaattttacattttatatgtaaagtccgaagtttaacagagttagtatttcccagacgataaatcatgggaaaaataaaagtttaattacctaggactattactgggagatgatatttgctgcatatagtgaaggtgctagcaaatctcccctttttgttgctaagagggtgttccacttagttagccagggcaacagaaggaaaccattgatgttcctcacggagaagtctttgaaaacagcacatgagacagcagctaagagcgccccccaccgcattccaggctaatagcattggctccagaggctaacagggtttattgagtgaagggaccaagggggaaaccagcttgattttaattgtctgtctagtctgttggaaactaactttctctaaatgaatgctttttgaagttttcaaagctcgagaacataataaatattaccctttgctgggtt

SEQ ID NO: 692 - DNA, 2023 bp, Homo Sapiens
gggcggcggtctccgactcaagaccctggggctccgggtcttcttagcagccgccgcagcagccgcggcgacgtcactgtcctctcggcctggcacacagcgctccggccgccgaatgcccgtggacgcgcatctcttcccagagttcctgcttcctgggccagccaaagccgcaggtgagaacgtccgcggtagaggtgacacccagggcctgcgggtctcagaggcccggtggcctgctcctctcctccttgcccaagaaacccccacgggggcgcctgcagcggggacaccaagtgctccccggagccctgggagcacttcttctgaggcatggagcccctgctcaggtgcttctgaaagttcctttgtggaccccagaaacccctaggcaactgtctgccccgccccgcgcccccgccgccccccgcccccgcagtacccctccggcccccgacatccctgatgcgcatgcccaggggccctgtgagctagaaagtagctgagctggtgcagtacctgctggttaagaaccggaagacggtggcgatcaaaagggcagacatgctgaagtatgtcatcaaaaggtacaggagcttcctccctgagattttcaagaaagcctctgacctccccgagttagtctttgggttctatctgaaggaacttgatccagcagagcactcctatgtcttgatcagaaaaatcgatcctgccctggtttggggcctgacaggcgaccagggcacaccaaagacccggctcctgatgattactctggactcgatcttcatgcaggccagctgtgtccccgaggaggtggtctgggaggtgttgagggtgttggaggcacatttcgtctaaaaagcatttcgtctttggggagtccatgaagctcatcaccaaagctagtgtgcagcaggagtatctggtgcacaaataggtgtcccacagcaatcccacgctctaggtattcttgtgggggctctcaaaggaaacaagacagatggaagtcccggagtttgtggccaaagtgaatgacacccaccccagttcctttccgtggcagtaaatgaggcattgagagaagaggaggagataccccgtgcccgagatggcagctgccgttggtgacgtgacaagtgccagtgttagtgccagttccagttccagggcctatgccatggctgaagcaagcatcagcaccagcaccaatgcaagtgccagttgccagtgccagggctagagccatggctggagcaagtatcagtacctgggacagtgccagtgtggttgcaatctcaggctagtgtcagggactcctcctgccagcagtgaaggctggggctgagtcttcactttgttttgctgtgggtagtcaaaagggccccacagcagtgggtgctggggtcctgacttttcaagagtcgaggggtagagtggggttagggagaacctgccgcccatggtatctgtgttccagttctatttgtctttctcagtgatttagctttcaatttgcatactgcaaagttttgtttgccttaattaactttcttttataatgatgatcattttacaggaaataaactggttaaaactacatgatgacagaattatatcagagttgaaacaaacgccatacctaagcatttttttcaaaatcctttgttccatagacacttgattgagtacttaagttgaacatctaggtctatgaatgacgttggtcaaatgttttattgttctctgtttcggttttagcaggagagatttgctgtttcataaaagaaattgggagagtatatcattttatgcctgtaacttattatagcattggaataagctgttctttggaggtttgagagactttaccagtacaatcattccccccctcccccaaatataaaaagataaaataaaaagccggtcagtgtctgttgcacaaaattacaaccgctctctgcttgtatttgcctagttctccagaatgtagggaaaaataaaaattcaatgaattaga

SEQ ID NO: 693 - DNA, 1420 bp, Homo Sapiens
gtactgagtttaaaaataagctggggttatttatatctaatatgattttcacttaacaagaattactaaggtgctagaaaaaatatatgtatatataatatagtttatgaaatcttagttataaaatagcccttttttcctcctaaaaaattatattctcttcaacttggatgcaagactctattgtctatgcctttgaatactgcaattttagagtgttgattttgacattttattttaagggataagtgagcaatttttgttatcattaaaacttaaagaacttggatcttgtcacaaaaacatcaaataataggtaatttaagagtaaaatacaagagatttttgagagattgagagagccttagaatgtgaaagaaatgttaaaatagagttttcacttggtcatagtttcaaagaaataaaatcagttcttaggacttaatgattttctaatataggaagtcaaaagtatgtaaaattttatgaggaaacaagctaatatctacttcagttttcatttaaaaatatttttaaatagagacgtgatctcaccaacttcaattttcataaagtacaattttcataaatctttttcaaatagccagtggacatttttaaagcattaatgggaaaatgtctagctcttttatttatttatagttacattggtaaagcttttatcaagaagtaatactgagtttaccattttgaatagactctgtatttgcttttgaaagaagtagtgagagaattgtagatattgaataacaaactccagctgcctaactgaaaaactaaattccttatagactatcgtaaagaatccacaaaaaacctattagaggtaataaatgaatttggcagttgcaggtactagatcaacaggcaaaaaccagttgcatttttatactgtagcaacaagtggcctgaaaaatgcagttaagagatcaatttcatttacaatagcatcaaaagtcataaaacacttaagaataaatttagccaaggagctgcaagatttgtatgctgaaaactgtaaaacattgctgaaagaaatcaaagtaaacctacacacattgaaagatattccaggttcatagaatggaatactaaatactgttaagatgtaggtatcacccaaagcaatatgtagattcagtgcaatccctatcaaaatgtcagtggtctttgttgtaaagagggaaaaggttatcctaaaattaatatggaattacaagaggctctgaatagccaaaacagtctgaaaaagaacaaagttgtaagactcagactttccaattttaaaaataaattggactacatcaaaaacaaaaactttcgtacatcaaataacatatcaagaatgtgaaaaaagggctggacgcagtggctgatgcctgtaatctcagcactttgg

SEQ ID NO: 694 - DNA, 6026 bp, Homo Sapiens
tagatgatcggaaagaacaaatggtgcatgtgtgcgcgaacgagccccagtttctctccatccaggtccccagcggactcagagcggccgccgcactccacggcctgggaggacagaggccccgcagcctcccaacctcggctcatgtggggggcgcgccgcgcagggtgggcgagtccccaggccccagagtctgccggagccagggtgcgcggtgcggcggctgacaaagagcctgggaacttggagcttgtgagttttatggtcccagctcactccaacaccgaagccctctgaggctgttcagggccggggttcccaggcctaccaggagtttccctctgatgcctgctaggggctttccgtgagcaggcctggccatgcccacacatgatgaggagacccgacttttcacccagaggttgcaacctggcagctcacaggttggattcattctgcaaatgtgttttgttggatccacatagtgtttccaaacattctgaatcattattttaaaaatcaggaatatttaaagtctggatctctagcttctgtttcaaaagtcagaccatctggcaatactgtacctgcattccacatgacaattggtgacgggaagccctgtgaacctggggaggctatgaacacatctgcggatgatcctcaatcagaaagcagaccatgagaaagggcagcacacggatgcctgctcctgctctgctcacctgtgcctctttgtgcagctggatctgccagcctatttgaatctaatccccgttcaatatttgcatttttgtgaatacccctccctttgattctttgcaaaggggcttgaacttgattgactgagaccgtggagcaatgtatgcaccaggacactatcacaaacaatagagcaaccaacaggcaattagtagagtctaatagctggatgagatatcaagagacatagagatagacagcttacagacagatcaggtaaacaaacagtgaaagagaatcctgctaaaaccactgttatcccatgatgactatgtacgtgctcaaggctgtgctttctaaggagcaacatcagtgcctttacactgcaggaaaagtggacttcacccagatgggccagtcaaattactaaacagataaacaacaaagaacaacaatctccagagacaggggcttcagggaaaatcagtattctgagtggctatagtatattatctaaaatgtcaaattttcgacaaaaaatcatgaggcacacaaataaacatgacagggaaactcatacatgggaggtaaaagcagataacacaaactgtcagagggcccaaacacaagacttaacaaagataatcatcacaaatatatccaaaaaactgaaggcaaccatgcttaaggaagtaagagaagagatgatgatgctgtctcattaaatagagaatatcaataaagagacagaaatgattaaaaagattcgaatggaaattctggagttgaaaagtataataaccaaagtagaaaattcactagaggagttcaacagaaggtttgaactgccagaaaaaaagaatcagcaaacatgaagatatattaatagagactgtgaaataaaaaacagagagataaaaaatgaagaaaaatgaacaaaacctcaaagaaatgtgggacaccataaagtgtacagatatacatgatgattatataagaagaagagggagaggaaagagcagaaaaaatatttgaataagtaatggctgaaatgtatcacatttgataaaaaattaatatacatatccaagaaccccaacaaactccaagtaggattaatgcaaacaaatccatgcccagacacatcatattaaaaatgttaaccctccaaaacattaacagttgacttctcatcagaaatagtgccatccagaaggcaatgggattccatattcaaagtgctaaaagaaaaaatccaaccaagaatcttatatccagaaaatcaatccttcaaaaaagagggtataataaaaatattcccagataaacaaaaactaagagattttattgctggaagacctatctcacaagaatactcaagggaaaaattttcaggttgacaagtgaccccagatggaattttgagtttacataaaaaacaaagggcatcagtaaaggtaagcatgtaattataaaagacgtggatgtaattataaaataaatggatatttattctttcttctcttaacctatttgaaaagcagtggtataaaacaatatgtatttaattgtattgttgagccaaaacatatagaaatgtaatatatttgacaagaacagtatcaaggatgtgaatgtgaacaaagctgtatttgtgtaagacaataacaccagatggcaactggaatgtacaggaacaaatgaagagggctataaatggtaaataataaggttaatgtaacaaacttcataattataaacttgttctcctttcttctcttctttaaaagacataaaattatgtaatgcaataagtataactgtaccattgggtttgttatatatatatatgtatatgtgctattattgttatatatatatatataatagcataaaaaaggatggaaaggtatagagctatgtagaagcaacacttctatatcttattgaaattaagttactataaatctgaagttgattctaagttaaggtgtatatgataaaccatgtaaaagccactaagaaaataactcagaaatacagtgaaaaattattaaagcaattaaaatattacacaagaaaatatttacttaatgcaaaagaagcagtaaaggagaaatagatgaacaaaaaagacatgagatatgtgatatgtagaaaacaaagagcaaaatgacagacataagtccaactttatttatttatttgtttttttaattatactttaagttctagggtacatgtgcaccacgtgcaggtttgttacatatgtatacatgcgccatgttggtgtgctgcacccatttgtccaactttaaaaaataacattaaatgtaaatggattaaacaatccaacaaaaaggttgatattttcagactgaataaaaaaataagacctaactataagctgtgtgtaggagacacactttagaactaacaatacaaataagtaaaaagtaaaaagatgaaaaaacatttatcatgcgaacagtaaccataagaaagaagtggcagctctgctgatatcagacactgtaaaacaaaaaatgttactaaaggcaaatacaaacatttaaattgatcaaatttatcagaaaaatgtaataattataaacacatatgtacctaataatagagcctcctaaaaacatgaagcaaaaacagaaatgaaaggaaaaatagacaattcaacaataatagttggagacttcaatatcccactttcagtaatggctagaacaacaaagcagaaggaagtagaagaagcaaggaagtagaagacttgagcaacaccataaatcaactaggtctttgaaatacacatttcacccaagagcaagatacacgttcttctcgaatgcacatggaacatttgccataagagaccatatgccaggcagtaaaacaagcctcaagaaatttttttaaaaaactaaaatcctataaagtatgttctctgactacaatagaatgaaactagaactcaataacagaaagtttgggaaatttacaaatatgtggaaattaaaaacacatccctatgtaaccaatacatcaataaagaaatcacaggggaaattacaaaacacttagaggcgagtgaaaatgaagatataagatgttgaaacttacgggatgcagctaacgcggtgtctagagggtattcaatagctgttaatacctctgttaaaaaagaagaaagattttaaatcactagcctagttttccaccttaagacactgaaaaaaggagagtaaattcaatctaaaacaagcaaaaggaagaaagtaatagagattaggtcggctattaacgaaccagaagaaaaacaacagagaaagtgaacaaaaccaaaagttgtttctgtgaaaagatcatcaaaattgacaattagctagactgaccaagaaaaagaagactcaaattactaacatcaggaataaaaaagatgacaattctattgacctcacagacataagaaggattataagggaatactataaacatttatatgctaataaattcaaaaaacttagacgaaatgaacatgtttctaggaaactcaaactactaaaactgaatcaagaagaaatagataacctaaatagacccgtgaaaatgaagaggttgaattagcagtttgaaaacttcccacgaaaatggcctaggcccaaaagccttcactttttaattctccaaacatttaaaatagagttaatacaaattatttttttttttaaagaaaaagaataggagggaacagttaccaaggtattctttgaggtcagtattacccagataccaaaaccaaacaaagacatcataaaagaaaggaaaaaaaaataggaaatagccttaaaagggcaaatccaagtgttgttggccttgaagaggtggtagagagacaggagcagaacgtttattcaaagtgataataacggaggactttccaaacctagagaaagatattaatatccaagtaaaagaaggttctagaccacctagcagatttaacccgaagaagacgacctcaaggcatctaataattcaatcatgaaggtaaaggataaagaaagtttccaaaaagcagcaagggataagaaacaaacaacatacaatggagctccaatacatctggcagcagacttttcactgaaaaccttacaggccaggagagagtgacataacatattgaaagtgcctaaggaaaaaaacttttaccctagattagtatatccagtgaaaatatctttcagacacgaaggagaagtaaaggctttcccagacaaacaaaagcagagggatctcaataccagatctgtcctacaaataatgccaaagggagttctttaatctgaaagaaaataacattaatgagcaataagatgtcatctgaaggtacagaactcactagtaatagcacacagaaaaacacagaatattataaaactgtaattgtggtgtgtaaattactcatattttaagtagaaagatgataagataaactgatcagaaaaaataactacatcaacttttcaagacatagtgcaataagatataaataaaaacaacaaaaagttaaaaagtctgggtgtagtggcttacgtctataatcacagcactttgggaggccaaagcaggcaaatcgcttgagcccaggagttcaagaccagcctgggcaacatggtgaaactctgtttctacaaaaaattataaaaaaatttagctgggtgtggtgatgtgtgcctgtagtctcagctactcgggaggctgaggtgcgagaatcacttgagcccaggaagtcaaagctgcagtgagctgtgattgtctgcactccagccagggcaacagagtgagatactgtctcacaaaaagaaaaaggtaaaaagaagggagacaaagttgaagtatagagtttttattagttttctttttacttgtttgtttatgcaatcggtgttgtcatcagtttaaaataatggattataagatattatttgcaagtctatggtaatctcaaatctaaaaacatacaactggtacataaaaataaggagcaagaaaagaaacaattccagttacaaagaagaacaaactagaaggattcacactttcttttcttttttcttttgagatggagtcttgctcttgtcgcccaggttggagtgtaatggcacgatcctgactcaccgcaacctccgcctcccgggttcaagtgattctcctgcctcagccttccgagcagctgggattacaggcctgtgccaccatgcccagctaattttgtatttttagtagagatgaggtttctccatgttggtcag

SEQ ID NO: 695 - DNA, 2431 bp, Homo Sapiens
aattggcaacctaaagttataagttagatgtattttgcttttcaagccatcttctgagccttttttaggctgaaatgatttgtttatttcccaaattattgctagctacttgattttttatggctacctaacatccacatttggtagatacttttcctctctgcatgcatcccaaagaagaatttgctatttgtggaagaagagaataagggtatcagaatgaaggaaattacagtgactacactgtttatgactccattttgtgaattcttaaatatgctatggatttttttttagaaaaaataatgcaaaaattgggatattacagaatcaccataaagatgatcaacaagtaataagtcttttcatggagttcatttttcttttaaattcatgatttggccacaaaaatatatatataagtgtctgatatatgataacagcccagtttctcggccactcatttgcattatcttaaatcacaaataattacttaatttgctggagtgtgtgctttgcaacttttgtaccagagcaaaatttgtatttaaaacaaaaaataagaatgcccatcactaggagaaacactcctcacagaaaacacacacacacacacacacacaatttaaaaactgagtaaatttaaatgtatgaaagtaccccacaaattgatttcaacaaataaatttcatttctctagctacttatgtctggccttattttgagcgttacaattttattgccttcatttgcctatttagactgatgtagtttgatatgatgaagttgtgaataaaagccttgtgttcattatttatatatactacctggtatgctatggactgtgtctgctgtagtgctattccctaatgagcaactaagagaagacacaacaataaaccatggaagtgttgggaggccatggaaatgatttagaggtataaaatattcccaagtttttattataaatttttattcataggttaaaacatataagcataagtgattgtacaggtgtgactcccttttctaggagagaaaatagctttatttgaaaactccaaaagctacttaatcttaccagaggtttttaataggggaactgggtttacttacaatgaaagcatattttcattctgctatagaaaaacatatccctgctcattcagtaaatctaagattggaatgctttctagaactatgcaatatttgaataatttctagaaatgtctaagaaacaaccttttttattttaaatcatcacttacaaacgtagtctgagactgcaaactagttttcacttgactaatccatcattatagattagttaccatttgctctatataatctattgaagaaactattgttattcatattttgattaattttactagcaacaaatttttattttagtagcattgcatttaccttaaatatgtaaaaatgaagttgtaacaggatcaaatatggaaatggcaatggtaactctgcctagaacatagttgaatgtccttggttgtcggtaagatgcaaagatctatacaaattttatcataggtcaaaattatttctaaatatacaaacagtttcaactatttctttctccctaaaactaaaaccaaaccaaacccaaatgaagaaacctaaacttcttttcatctaatagttatacccaactagataatagtagcttctagacatcaataaaaagatttcattttaactgtctttttaatttgtaaaatatatgagtatggaattttgtatctaacttgaaatttcagatgttttaataatccaaatacgttcttctttagcatgtcaaagtactaatagttaaaaaatttctttagatttaagcatatacattacttgactttttcaaaagtatcaaaaaattgatagctgcagaaatgccattatttgattttctaaaaaacattgattcattcttaaatgtgtattctttaaaaaatagtaaatacctcaagagtgacagaaaactttccttttctgttctgtaatgctaatttaaactttgagtcttagtttacatggtcataggggttaaataaaatgtataactgtacaattaattgtgttcttgtgacctgatgattttttgaaaatttgcttttctctttaagaaatttaagttttcaagggccgtattagttatctaaatattttgggctaatgttgacttataaataaataaaaatttagaaatatattcatgatgacaattttgttacttacactgcctattctttatttcttttttagttcaaaggtgaaattttgacctttgtattaacaaagcctcaagaaaagagaaattctgccttttaaacattggttttccttgcattttatggtggtgtgattttgcctcagcaataataaaacataaaatatgttgttgcatcaa

SEQ ID NO: 696 - DNA, 1686 bp, Homo Sapiens
gaatcaatgggaaaataaaaaggaaaatccagacattaaagcagcatttcatgtcatcaacatgggtggcttctccaccttcctcaaagtagaatagcaaacttttaagttcccaaggtgtttacctacttagccacacataccatgggcccacttctcagtggctttgatatacctagcatggtctaaagaagtgtcagactaactcatcttacaaaaggaaccgcttaataataaaagagctgtgcaagtagcttgtttcatcttaattagcccaagatgatgcttctgaagtgctgtgctttcttatctatccttcctgctgcaagggaagaagactttgacatctttaacaactcagcctcaggaaccagaatcaggagtagcagatcttgcattggcattgtcaaagaagctgtaaaaatgggtgcctaaaataaatttgcctttgtattggaataagctgtcatgtgcaatgtgagagggctgggataagctatcatgtgcagtgtgagatagcttactgtccagtgtgagatagctggaacaagctatcatgtgcagtgtgagagggctggaaagtgacttttagcatctgtgttcaacagtggaaatcacacatctactgtgtgataggaggatgccagaccctggaggggagaaaaatacagtgcctctgccatcagagaatctatgttgactgcattagaaggaaaagggaagcaatggttgaaagtgaaaatgtagatgatgatatttttactttagaaatgcattagtcacttgtaagaagtctgcccacctcttttcaattattgcttgagaccaatgttagtcaacaggttagattcagaaagcttcagaggtctctctttagtattttgtttccacctggcaccagcaacagtgtcctcagtggccttgagtgtttgcgcaaccagaaaataggagtggaaatgccccccgctgcaattgaatcagcatcccatgtaacctgccagctgggtagccaccccgagcctctgccattaacttcatttacacattgttctcactcagccactcacaggaaggcatctttatgaaagcactgcaaacactatgtgtgaaaaaatccagatggtataaatagcttttcacttctaattgcaacttgcccctcacattttgtttcctgagagctctgaaaagagaccgatccaaaccactaatagcacaggagctctgggagggtgagtcagtgtctactgctgaaggagaacaaagatgaagagagaacggcaggagtcccagaaggccatttcaggcttgaaggagtacttttctgcagggtagtgcccagccagacaaacagggaatggtttcctggagtacctgataggtcagctctttgatgcatcgctcaagtctgcgggctcccctctgggcctctgcactgcgacggatttcaccctccagttcaccttccagttcacgaacctgcaaccaaaacgtgacctcagaccagacgctgccaccaagtctggcattctatttgctgattggcacaatcatttgaaagacagcaaagtgtcaagggaacatgcacacactgtttttggtgcttaaacaggacagtgtctctgggaaaactctctcgccaaaagtaagatcttttatggattcataaaagaactatttagactg

SEQ ID NO: 697 - DNA, 2213 bp, Homo Sapiens
aggggaaagtccctttcacaactccctagaagcagaatgtcctaagaattttatggcattacctacttccaattctgctcagatttatagtacatattttttatcaccctgacaatttcttagtgcctagagagtactgatgttcttcagcagctggaacatgatctgtcttcaaccagaaatgatatgtgattggttccttcatcaagcccaaagccaaaggaatccagcccataacctctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttattgacacttctgctcacaggcatgttccagctcataccctatgccccttccttatttggaaatgttattgcttcctatggtgaccagaatgtgtggcatttgagccatcagcccctttccctgcagccctcccagctctcatggaagctgccctggggactccagtccattggatgcagtgaaaaatcgaggctccttctgtctccatctcccagctgggaatatgtctgcactgcaagaggagcagcatgccaatgcttctgtttgcctctgccccatgttgcctgcaatgcggacatattcccagctaggagatggagacagaagaagccccgatttttcactgcatccaatggactggagtccccagggcagcttccatgagagctgggagggctgcagggaaaggggctgatggttcaaatgccacacattctggttaccgttaccaaatacagtaaatattgtttaatgaatatttctccatttgctgtatgtccttagaacagtttccacagactttttaaaaatcatttactccagtgaaatcattgctttgctgctgagaattctgttgcactcttctctcttcccatctggaaccccattacaacagatgaatggataaagaaaacgtggtgtatggacccagtggaatgccatgcagccatagagaagaaggaaagcctgtcatttactacaacatggatggatctggaggactttacgttaagtgaaatcagccagttacaggatgacaaatattgcatgatttcactcacacatggaatcttctaaaaaatgatattatagaagcagagagtaaaatagtggttaccagacactgggaaggggaggagatggggaggaggaggagaggttaatcagctcagctctggctctgggaatcctgtctgcagtggccaacggggtcaaggggcgagtgcctgtgggtgtgagtttgtgtgcggcacctaggggttggctcatggggcatgtgtgggtcctttgtggggagtacaggggctggttggctgggggctggtgtaagacctagcagtgtttaggtaattccttacctaagtccatgtttgcccaagactagggaggacagaggaagcttgtgttgctgatatcttaacctcagccagtgctcatcaaggccaccctgcaagctcctatttcccaaatgtcttcatctgtaagggctgccatagcaaagccccatggacagggagccttcttaaacaacacaaactcttcctcacaattctggaggctggaagtccagggtcaaagtgtcagtagggttgcatcccctgaggcctctctccttggtttacaaatggctgtcttctcccgtgtcctcatgtggtcttccctctgtgtctgtccatgtcctcatctcctctcttatgaggatactagcaagattgcattaggacccaccctcctgaactcattttactttagtcacctcttgaaaggccctgtctccaaacagtcacattctgaggttctggaggttactactttaacatatggatttaggtggagcaaaactcagcccataacactaactttcctgataacctgaagccctgagaagttgccacttgtcagccttctgctcttgaccagggcctgccatctctgcagctgcctcccctgcctctaccccagtccccatctgggggctccatggaaacagctgcaccattaacccctgacatagccccaaatctttcactgcacagacca

SEQ ID NO: 698 - DNA, 3151 bp, Homo Sapiens
aaatattattagtatagtgttcaatcaagtaggaaggggtttagaaaatgcaacaagttgataaaaatgattgactttttatttctttttagaattcctgactcttatcataactgtgcattttgaaattgatgttctaacaaccaatagtggttaaaatatactatccacttaattacattcaattatggttatagtagcatgtctcattcaaagaaccagatctacatggatgcatacttaaaacttatttatcaatttacttcacatattcttcccaataacatccttctgtcctgtgtccctttttccttcctcctgtccctccccccttcttcctttcattcctccttccttcctcccatttctcttccttcctttctcctgtcctgcctccctctttccttccttcattgcaaatgccttatcctagactgtggctttttttttttattttttttaatggagtttttccatgaacagaagttcttcatattaataaagtataaatcgtctttttttattttattatcatatttgctttttctgtatatgtcctgtttaagaaatcttggcctaccccaaggacataaagataatttcctatgttttattcctgaagctttattattttactctccacaattcgtcctaagacatttaaaaaaataatgtttgcattaattattaattcattctaagacatatttaaaaataattatgtgatgaaagggccaagacttatttttccccactataatgttatactgataatataatatgatagtggccatttgtgtctttttcccaaccatcagaggacaaatatttgataatttaccaataagaattatgtttcctgttcatgttttatagatttttcttatgggattgagaatgttctatttttttttaagttatcctagggcagtgaagtctgtctcaaagattttggcatatatttacttaatcatatccatttttttcttcttttttcttattttgaattaatcaaatattttttcccatttactctcctctgttatctcttaaattttacatagtcttgtattaccttttttagggtttaccatagaagtttcaatatgcatctttaaattattgcagcctaacttaagttttgcttttgttatgttttgaacaatatctcataatttacccatgccctttttttctaatcttattatgttcttttatatatgtcagtctcccacagaatagtattattttgtgtataacactcattattcttgtatatttgcccacatatttgttctttctggtaaattttattttttcagcagtaccatactcacatctagaatcagttgagtccaggaaagaattttcattttctaattattattattactatcatgtttcttataggatgaattcactcaatgtttgcctgaaagcatttcattacatatttttactctaaattagctgtattgagagacaatacaaatccaataatattcaccaattttaagtggaatcagaacacataatttttccatcacctcccaaaatacccttgtgtggtttttgagtcagtctcctcctttttggctcagtcctttgcagtcactgatctactttttgtaagtatagtattttactagaattctgtatagtcacattcattgaacacaatgcatttgagagtcatttatattgctgtgtacaacagtactttagtcctgtttattgctgactagtattttgatataggggtataccacaatttattcattcattcaccagtgaaataaaatttgggttttttttgtttttgttcattattaataaagttgctatgagcatttatgaataaatactttttattacatgcttttaattcttttggaaaagcacttaaaagtgaaattgcttggccatttggtaggtataaagttgtataaaaagagcaaaatatttccccactggctataccattttacatccccatgagaaatttataagaattacagctgctctttatcctcatcaaaattagtattgccggtctttttactttagccattctagtgactgaagacaggtattctatagtggttttaattgaattttacctaataattgataattttgagcattttttgttatgaccattttcaattcctatattctttttgatgcactattaaaaactttaccttttaaaaatttgattatgtgtcttatgaatattgtgatataacagattttaaatatattctgaacacaaattcttgttcagatatatatttgcaagtggtttccagtttgtggcttcccttttctttttctaatggtgtctttgaaaaggcaaaaaaaattgatgaaatgtaatttattgatttataactttataatttgtggttgcctaattcaaggtcataaagatattttttctagaaattttataggttaagctcttacatttaggtgtattattcacttctagttaatttatatgaatggtgagaagtggatgatatttatttttccaaatggttatctatcttttctaagacaatatgttaaaaactatatcatttcttattgtattacactgatatttttgccaaagatttattgattatatatatgtgggtatatttatagactcttcattatgttcagttaatttatatatgtattcttataccaataccacgctgtcctaattactaattttagagtaatgcttaaagttatatattagaaagcctccaaatttgttgttaattttaaatgttgatttggctattctagattcttcatttacatgtaatttaaaaaatcaactaaccaatttctacaaaagggtttgctagacttttggttggaattacattaaatatatagatccatttggaaaggctagatatattatcaatattgaatcctatgctttgttaaattcttgagtattttataattttaggctactatatatgatacttctaaaacttttaatttctaaatatttatcatatatataaatgcaattgattttcatatattgactgctatcatttgaatgttccctccaaaacttatgttgaaatttaaatgccattgtactagtctaaagaggtgggatcattaagacctgatt

SEQ ID NO: 699 - DNA, 28468 bp, Homo Sapiens
agcagcgcgagaccctcgccaggctctgaagacgcggcctggccctggccgttcggcccttcgtctgagcgcaaaggctccagcacctccgcggccgaagccgcgggacttttcgtggaaaatgggacccagcccgatcgccagcggcgctgcagcggactctgcgggaacctagcttctgctccaggacctccagggccaccccagctcgcagggcgttcgcagcggctcagggcgaatcacgctcatggtccccgtgcgcattttcagccccagccggtacctccttactcgccctcacgacattcattccaccccctaaaggtcctgccaaccccaggctcttcccgagcattcccgcccttcctcccttttgaaaccggagcaaatcacggccgggcggaagcgggggagcccgggtgagagtcagtgactcagctgcggactccaagtgtcgccggaggccctggggcgcaggcccagcgggctgtcgcacagctcggctgtcctgtgccccttcctgacgaggctggggaggaaaggcggcccagagaaggccggaccagctctccccgtcagccccaggctctcgaatgacagcggatgccagcgaccggggatggggtcccggaattgctgggttaaacaagctccggattcaggcctgggcctgggctggggttccagggttctggaccgccctcaaagaaggagctccctggggcggcacctggctctgcttgatagccccagggacagggagctcactacctatcagggcagctcccccagtgccgagaccagctcggtcctggagaccctaacccagcggtgctagaggaattaaagatacacacagaaatatagaggtgtggagtgggaaatcaggcgtctcacagccttcagagctgagagcctccaacagagatttacccacgtgtttattcacagcaagccagtgataagcacagtttctacagattatagattaaaagtaccccttagggaaacaaagggatgggccaaaataaaggggtgggtttggctagttatctgcagcaggggcatgtccttaagtcacagatggctcatgctattgtttgtggtttaagaacgcctttaagcggttttctgccctgggtgggccaggtgttccttgcccttattccggtaaacccacaacctcccagcgtgggcatcatggccatcatgaacatgttacagtgctgcagagattttgtttatggccagattttgggggcctattcccaacaccctagcattgctcacacttgtccctgaagtgtcaccttgtcgtagctgggctctgagccctctgccccagggaggggtggccttttgggctgaagggactgaggacatagccgttgagcctgttggccattgctcaaagaatgcagcctcctggtcacccatgttgtccccttgccaacaaaaagagtgaaacactgtgcaatgtttgaagagatttattctgagccaaatctaagtgactgtggcctgtcacacggcctcagaagatcctgagaacttgtacccagagtggtcagcctgcaactgggttttacaaattttagggagacataagacatcaatgaatacttgcaggatggacattggtttggtccagaaaggtggggacaactggaagtgacagagggacttctaggtcataggcagattcaaagattttctgattggcaattgattgaaagagttaagttgaccgggcatggtgggccatttctataatccttgccatggggaggctgaggaccatttgagcccaggagttagataccagcttgggcaacatagagagacctcacttctccaaaaaaaaaaaaaaaaaaaaagttattttttaaagacttagcattaatagaaaggaatgtctggttaagataaggggtcgtggagaccagtgtttcatgatcagatgaagcctccaggtagcaggcttcagagagaatagattgtaaatgtttctcatcagacttaaagagtctgttctctcagtctttaaggggtgtgttgatgttactgctggtcagctgggcctgaaatccaaagggaggagggtacagtgaggcatatccaacacccatttcctgtcgtggtctgaactagtgtttcaggttaaccctggactgcccttggtcaagagcaggggtgcattcagatggtgggggtgcttagaatttcatttttggtttacaccactgtgtcctctcctgccaggggagggacccagagctggaggcttagccctggagataccggtgaagatggatgaatgagaaaccagttggagcttccaaggtctctacccaccctccagacctcctctgctcctgcccctgcccattcattcccaacttctgctctcccagctcccctcccacccacatgctgttccctcctcttccatcttccgcttcctgggcccagagactgggcaagatccccagggctctccttgcacagcgaacctctcccagggtgcatagccttgctgcaatcttacacagggaatacataagcaaggaatacttctgtccctcttggactctgaagccagaaggccagggcctggttggcctcctaactgctgtgtcccagggccagagcagtgccagacacccagcagtcttagcacccacgaaagctggagggacccacaccttccccatcactcagttgcatcagtctaacgcaatggatttgggcagcttgtggtggttcactggcagtttattgggggacttgaaggagtcaaggtcaagtgggggacttctgggtgccagacctggcccttccttggcctgggcttggggtgtccaagcccacagagccatgcagggggaaagagctaggcaagcagggtggttgaggaggtcattagcgtggcctcgagggaaaacaattccaagaggagcccaaattcgaatgtcccctggtgtcattgagaatggagagatttaggttatgaattgtgcagttggtgggtagcaagccagggtcctgaagatagtctgcatatcccctggtgtcattgagaatggagaggttcaggttatgaattgtgcagttgggggtatcaagccagggtcctgaagatagtctgcatatcccctggtatatatcatttatataaggatgttacttaactattgctgtcttccagaggcagcttcttgaacaaatacttgaggtcctctataggtttacgggagtagactgttttctccaagcaggcctgtcgtccatcaggagaagcaaaaggttttattctagagacaagtccttccaactgtacagctgatggagtagccaaggaaacctggacaggaggtagcttctgacctttgggagccagaagggccagtaaatggattctcttctcggaggtactgagacttatattgcatcccctggagggaaactgaggctcccaggttggataataaatcataacctattaaaggaaggggacactcagggatatataggaaagaatgagtaatacccttaaatccaatttcacaagtcaaaggaaaggcaaatcattttaccttctcctggccatctattcccatcaccatacagttggcattgcagaggtcccacaggttgggtcaggacagagtaggtggtcccagtatccaatagttattcaggtttcctgcctgctacattgagagtgacctgaggctttgcggtggtgatgccaacagaacgcttcaagactgcagctgggagagcacttgggctacatccagcagagagggtggccttttcatacaagagactagcatcaagaggagtgggttggggagattcatgctgtcatgacttcacaggatggaatgaacagtcccttttccagtgcccctctttcttataataagaacattggttgtccctcagtcctattgctgctggttgaggtctggtcaccccttgtctggagtgtttctcctgcctagggtcaccttgaggcagacctgtaattatggcagccaaaatttttgcccgatttttcattctctcatcctttttttcctcccctgcctggtccttattgttaaaaaccttaaaggcctccgctatccacgtcacctgaggtgtcttggggtaagcttccagtttctgaacctttctccaaatgtcgggtggaacttgagttatgaaatgcatggtagttgtatgttcatttttataagaaactgtcaaactgttttccatagtggctgtaccattttaaattttcaccagctgtgtatgagtgatccagttactctgcatccttttcaggatttggtgttgtcactattttttattctagccattctcataggtatgtggtgatatctcattgtggcttaaatttgcattttataaaggataaggatggcctgggcgcagtggctcacgtctgtaatcccagcactttgggaggctgaggcgggtggatcacgaggtcaggagattgataccatggtgaaaccccatctctactaaaaatacaaaaaaaattagccaggcgcagtggcgggcgcctgtagtcccagctacacaggaggctgaggcaggagaatggcgtgaacccaggaggcggagcttgtagtgagctgagatcgcgccactgcactccagcctgggcgacagagtgagactctgtctcaaaaaaaaaaaaaaaaggataaggatgttgattattttttaatgtgcttatttgccactcacatctgcttgctgacaaaatgtctgtttatatgccttgtccatgttctcattgattttttttttttactgttgagttttaagagttctttgtatattttagataaaactctttgtcagattgtggcttgtaaatattttctcttagtctgtagcttgtcttttcatcctaataacagagtcaatagcaaagcaaaagtcttaatgttggtgaggtccagtttatcaattgttccttctatggattcagcttttggtgtcaattttaagaactttttacctagccctagatggtatctttttatgttttttagtctagagatgtcatctttttattcctgatattgataatttgtgccttcttactcatgatcaatctttctaaggatttataagttttattagttttttcaaataagcaaccttttatttttattttttgatgaattttctattagtttgaatttcttctttctgtggatatatttgctattctttttctaatttcttgaagtagatactcagttctctgtctttaagaatttttcccatgaatggattattttagaccacaagtttctcttaagcatatctttgtcactataccgcaagtaataataggtcatgtaaacagtataattcttttttggagaaacagtgtaattatttttggacactatgtcatgcaggttggagtgcagtggcatgaccatggctcactgcagccttaaccttctgggctcaggtgatcctcccacctccacctccatagcagctgggactacaggtgggcactaccacaccttgccagttgttaaaattttctgtagagacgggttctcactatgttgcccaggctgctaactcatgggctcaagcaaccttcccacctcaccctcccaaagtgctggaattactggcatgagtcactgtaccttgcctcagtataatttaatacaaatattttccaacttcctttgtgactgtcttctgagacttagaatatgcataaatttatttcttatcttccaaacctttggggatattttattttttgatatcggtgttttatttaattgcattatggtcaaaaacttgccacacgatttcaagtcattgacattgtggagatttgctttatccccagcatatggacaaaaatttgatgaacattccatgtacacttgaaaaaattgtgactttttagttgttcggtgcagtgccctgtatatgttagtgggccaaggttgttaatgatgttcaaatattgcatatttttattaatttgctggattgttctgtcacacactgaaagaagtatgttgaaatttaccatttcatcttttatttctgttaatgtttgctttatatattttgaggttatgttaacagatgcatacacatttagaattattgtatccacctgttggatttacccttttgcaattatgaaaagccctccattatagtaatgtttcctgtatcaacatcacttttgtctgacagtagaaactctgccagattctttcacttagtgtttgcctggtgttgactcagctccacaccaaccatccccactccacctctgtggctggccctagctccgcaaactcatttctgctgggccagctggtgctgtgctaaattctcccactaggggcaccagagaaagcacgcaaggctggggaagatggggaatgtgctcctttcagtttgcttccggtttctttcccaggcttccggtctacctgccactggggccacgtgtcctctggatgctgctggttcacctggcagtggcacttccccacctagctgctaaaactgggttgctggttcccgactctgcagaatcagcttgatctccccgctagagacctcaaaccactgctagggacacctcatctcgggggtctgggtttcaggccgtaggcccttccagctcagaccctggcagcagctgccatccctcttcagaggccagatcccagtgtggcagccgccctggggcacctggggagtgactcattttcatgaattccagcttattagttttattaattctcccctttgtaccccagactgagtggtggtggctgccttgtgtggttgctattttcctgatacgtgggctggcaaaccaaaacctgagaccacagccagctgcagtcctgtgttcctacaacctgtgagctaagaatgttatttattaagtagaatattaataaataaataataaactatactatagtatctaaatgtgaatttttttttttttacttaaagcatcttccatagatatatatgaaattcaaatacattttattgggacacactgttttaattcattttcatatttattgcctcttagcacaatgcttgagccttggaatacttttaactcctttcattcctctgtcaccttctgtgttactgtggtcacatacaattattcacactacttatattcattatattaaatctgctgtatgattttttacttctatatattatatccctaaagtccttgttattattgtcttatacaatagatttttatttatattaactaatattctttccattgcttatgtttgatataacttttcatccacctttaggatttcctttagtgtggtctgatggtgatacattctatgagagtgtgtttctttcactttgtctttacttttgcattttgaagggtattttgttttgtagaacgctctagaattagcagtgattttcttccagcagtttcacaatgttcttccattgtcttttctcattgcttactttctctttttggaacccgggtattattcttattgttgctcctttaagtattgtggctgtttgctctgactgcttttaagactttctctttattcttgggtttcagaagttttgcaatgatgtatccaggtatgatttttccttgtatcaattctgcttcagtttctcagagtttctcaaatctgtggttattttctatcagttttcaaaaatgatctcctgtatcttcaaatattgtgtctgtccctttctcttagtggatccatggtctatcagttagctactgctgcataattagccgccccaaagcccactgatgtgaaacatccatttttgtattatcactcatggatctgtgggtaggcccagctcagctgggtagctccgcttctcactacagatcttgagtctactgggatggttctacaacccacgtctctcttcctcctggtacaagtggtctagctgaagcattttcttctcaggatgatggtgggggcacgagagaaatcccaatcacacaagctcatctcatgtctttgcttgtgtcacttctgctaatgtcattgcctgaagcaagtcatgtgacagtatccaacgtgaatatcagggaactaaaccaagtctttggctggaggaactgcaaagttacatggcagagggtattgtatagcaggggtccccaactccacagtccatggcctatgaggagccaggccacatagcaggaagtgagtggcaggcgagcaaggattccagcctgaggtctgcctcctgtcagatgagcagtggcatcagattcttgtaggagcacaaaccgtattgtaaactgtgcatgtgagggatttgggttgcatgctccttatgagaatctgatgatctgaggtggaacagtttcatcccgaaaccatccttctgcctcatccatggaaaaattgtcttccatgaaactggcccctggtaccaaaaaggttggggactgctgatgtatagcaaaggctgaagaaacagagtcaataattacatcgacttatatacaactatgccagaccttgtctccatgtcccaggtaccaaggctttttctgtattttccattctctttttaaattttgtgatcttcagtctgatggttcctacctaccattcttcttgtttactcttcctttctctgattgtctaatatgccattaaattcacctcttgggcctttctgtcatacccttgatttctatttcattaacttctaccactttgttattttcttcatacctactttctgacttttaaagcggaattttgttgttgtttgcttttgaagtagggtctcgctttgtcgcccggctggagtgcagtggtacgatcacggcttgctgcagccttgacctcctgggctcacggcatcctcccatttcagcctcctgaatagctgggactacaggtctttccagagacacatagaaggtgccatctatgaggaacaggccttcaccagacatcaaatctgttggcatcttgatctttgacttctccaccgccagaactagatcaagacatgaaacccatgttcaagatactttccagtgtgtcttcatgtgatcctctgagtccagccatcaggctaccagcagctcttggaaaccctgacatacttattcttagaagactgctttccggactcaaagtggaacctcaaattttcaattttctttgtttttaaagcctacacataggtgatgatatatacatgcatatatattttggagaatttataattctgaaaacaatgctggtcttatggaacccatccattcccctttccccgtgtgtgctccgagctgtggtggcacgtgaaaaggggtccttccagcagtggcccacagccctgggctgcttacttgctcacttcatttacaagagcaagaaatacacattcttgtgttgtttaagtcattatgatgtggggatttccattactcacacacctgatctagtagtaacacagtagcctattttagcaatatcatttattcaataatccattctttccccattagttttgagccttcatttattgtgtactaagttctggttatttttagtggttgtaatctccttctttcctactctcttaatcatgggattgccaatatctgctctgtgtttctgtgccatctatagcctctggccttggtactgcttcaaaactgatatttctaaccttactttgacttctccattcagtgaagttcccatagttcatcactcaactgctctctttccatcgtgaccttctgaactagctcacacccagatgtacttttgttatctgcctttccccctcataaacatgggctgctgctggggaaaatccactaccgaactcttgcaggtctctgcaaatgtttaatgccctgtcttagccatgacctccacaatgctgggctatcctatgttatgtcccctaagatatcccttctctcttacctttggggatagtcctaagcttccatcatggcactcaaagtccaaccttatttgtaccctcattctctgagcagacaccaccgtattctgtttcacagagaaaatgtgactgctggggataattctttcaacttcctggcctcttcctatacatgatctttctctgtattcttgcctattgctcttccatgttgatagaagtgtctgttctccttgtcagtgtctcggccttggatctgtcccctagactattctgcctgtgtaaggaccttccctgaccagctgggccaccatctcctgcttctccaatccctcactctagactgactcttaacctttggtcaacaatacttgagcttttacattcataatggagcatctgtgttgaaccttgttcttttctagacactaccctccgttctgtcttccatccatggtgacttttctagaaagagcatctatcacactggagacagcaaactccttgatccattctaattcctaaccctgcaataattttctatctcccttactcaagtaattgggagtgctcctagtgttaccagagacccagcagttcccaatttcgaatttttccgtattcacatttcttgacttgctatgattttacatcacagattacatccttcatttgaagagactctaatggaaggctgccatggaaactctctcatgtggctgacctcctacctcacttgctctttctgaatgaagttcccacttttgcctgccttaatgaaagtaatgctccccaaactcaagcccagggctgcgaattggaagcagctggggctactgtttctgggtgctggtgtgaatggcaggatgtgaacaccagcctgtgacgggcaaaaagatggacacacaggcagagcctgacaggtgctggtggtcctatctggtcctgagttgctgggaccctccttgcccactgcccctagaatggactttggcctcaggttcgaagtgttcagatgtgactgagatgagccttttccccatgcctcaggaatagcgaagaaactctatctggaaggttccccaggcttccccacccagcagcctctggtattagaccaggcagtggctggccaggatggtggggacagaagggagacaaaggtgagcagtgggtggggtcacatcctccctgacattgaatagacaacatggggaggaaggatgagtgatctttagaatgttcatggaaaatgcatattgggaaaaagaatgcatgaatttcaaattgttttgcaacaaaataaacttgtactaacttgtgaaaacacgtccgaacaggatctagtttgaggccctaagaagtataagacaacagtttgaacagagctcctatcagacacatgaattctgctaaaattgaaaccagaacaaacatgcaattgatggtgaagcttggctggaaacatggtgaaatcattgatgatttattgaaagtttatagggacaatgcctcaaagaaatcagcaatttaagtaagtggataactcattggaagaagagaagagatgatgttggagaggaagtccacagcagcaggccagccacatcagtctgtgaggaaacaattcatcttgtttgtgccctaatttaagaggactgattaatagcagcagaaacaatagccaacgctgtaggtatcccaaggtgttcagcttacacaattctgactgaaattaaagttgagtaaactgtccactcggtgggtgccaaaactttctcccagctcagctgcagataagagaaaagcgttctatggccattttaaacaagtggaatcaagatcctgaagcatttcttcatataattatagccggagatgaaatgtggcttaaccagtacactcctgaaggcaaagcacaagcaaagcaatgactacctagaggtgggcgtggtcccatcagagtaaaagcagacatgtcaagggcaaaggtcgtggcaaccgttttgtgaatgctcaaggcatcttgcttattgactttctggagggccaaagaacagtaacatcttattatgagagtgtatagagaaagtcagccaacgatttagcaggaaaacacccaggaaatcgtcaccccggaaagcttcaccagagagcccttctccaccatgacaatgctcctgctcattcctctcatcaaacaaggccagttttgtgagagtttcaatgggaaatcactaggcatacaccttccaggcctgatttggttacttctgttttataattttaaaaaatctttaaagggcacccacttttcttcagttaataacgtcacaaagactgaagtggcatggttaaattcccagggtgcccaattctttagggatgaactgaatggctggtaccattacttgcagaagcgtctcgaccttgatggagctcatgctgagaaataaaacattttttaatttttatcttttaattcaattttttcgtgaacttttgaagtccccttgtatttgtttttggtggaactttgagtctgatttctcagctccccatggatggctgcatcttaacagagaaatgaacgccatttaccctgatgctctctacttggcctaagtttcagatgttgaacacacacgtgtgggaatttatgaatctgtgcacctgtgccagctggtgggtgaagtctaagtttcttcaacacaattagttatcttctgcctcctggaatctggtaggaaaggttgaggaaaagcagccatccacagcgcctccaccactggaatgggggcagccctaacgtgtgccccactgccccccatgctgaggagtccttcactccagggatgtcttcaccccaatcattcagactcccccagtgttcctgcgtcacctgaaaggtcggaagcatctcagcacatactctccatgagtggtacttaggcctccctccccatcaatactgaagccctcagaggcagaggggagtcaaggaaaagagtggccatcagcaataaatgagttacaaggtttgatttcaaagagaaaaacttgtcaccaaaatcactactcaggagatctggacttcctctgaatgtgagttaaagaacccttgagggttaagagccaactgcacctgatccccactctcccatcccaagaccctgggaagtcaaaccaagaggtaatcaacagaaaacaagtttaatgcaacaggtgacaacggtctggagcgagtccatgctccggaaggctcagtctgtggcagtcccgtggctcaagacaggctgaggccggctgcaatggaggccagcagcaggaggatggccagccacagcccaccacagctctcacccatgctcccagcatattctttgaacactgatgagttgataggtggcccctctaaattgcagtagcgaattttacaacacttgaggtaaaagaagggcatgggctcttccaggagaaaccgcttctcctctggcttgggtctctccatcgctgcacaaccagcggagcactgcttcgcaaccatgaaaaaacgtggaaatatttctaataggaaataaagaccgagagaaggcaatcacgcaattccaatgcctgacaccgaggcccttctgtctgggtcaaagcctcacccctggcggccctgctcaaaggtgcacagtcaactggggcaccaagggggagtcgggaggacgagggccaggcctgtgtgttgaatgctgcttcagggaagggctggcttctgcgtggtatggcctgtccatatgcactgggaatgcgggtctaggggttgctgtttgggaacaaacaggtctcaacttctcaaacacagggttggctcaggcctttgtgaccacagacagacacatgactcccagccattctggccatcacccagggtgtggagctggcctcttggtgggcctggctcgactctgagctgggggtcttgtctcatgaccacacttcatcttatacatcactgtacaaatcattttgccatattaagttataaagtcgatgtgggccacactgagtctgaagcatcacctcagcaccccaccaacttcgtggataccgaagggctggagagtgactgctgggcggaatcagaattcacgagccctgaagatctccctgtgggcagaatgtgctgggtgtccagattccccttggggagggcttcatgtacccagaggttttcaggggaatcacagatgacagagcagtggtctccacaatttttaaggcatgcaccctcctttgagaacacacttgaaggctgtacaccttggttttgtgcatctcttgtaagagtgacatagacactgttctctgtggcgcatttaacactattaaagcttaatttttcatttaaaaatggatgatatgaaatccagattttcttcctacctcccagtatttcatctggacccactgtagcaggcactgccttacactagcacagttcctacacctctctctggcctctgaggactttgctcttcacattttaaagggaaaaaaaggcagggcgcggtggcttacgcttgtaatcccagcactttggggggccgagggcgggtgggtcacctgaggtcaggagttcgagaccagcctgaccaacatggtgaaaccccacctctactaaaaataaaaaattagccagtgtggtggcgcgcatccataataccagctactctggaggctgaggcaggagaatcgcttgaacccggaaggcgaggttgcagtgagccgagatcacaccactgcactccagcctgactccgtctcagaaaataaaaaaaaaaaaaggctactttctattagttattccccattgaggaaaactagacagccctgattcctgaaagccctctgttcacctgcctttgggtccccaacaagagcgaagatactcactcacggccgctataacgcagtatggctctgtccatttgcacctccttgggttctggcactcgaaagtgttttctctctcacaaacatgacaccacactctattgtcaccctcgtctgaaaggaggaataaaaaagaaagcagaatgttccagttctccgtgcctatctgatgaacacagccggcatccgaccagcacaaactcggcgggtccccatccttctccccctgagcagtggctggggccacatgactcgagtgagccgcatggggagaaagcaggaggggtctccggccacgtaagagctgcccgcttccccttcgccttcccccatgattgtaagtgccctgaggcctccccagaagccagcaccacgcttcctggacagcctgtggaactgtgagccaattccacctctcttctttataaattgcccagcccccggacttctttacattctgagtgatttttcttctctcctgggggctcccccgtcctcccacatccaagcacacaacatgagcgcacagcgcacccccactcggccgcagcaccctgaccccaggtcggccacgcggcacccacgggccctggcatctcccggccgacggctgtggaagtgaccctggggcttgggtctgctcccacgtgccctcccgcccacctcccaggtccacccacctcccaggtcctgccccccgactccctcaaaggagttctcccttgggtctgggttgggcctggcctagctctgcaggaggagccggccctcctcccgcagcttgaacggttctcagcccgtgaagcccccggaggccaggccggcgggagcctgcagcctgagggctcccggggaagcgcggccggagcggggcaagggctggggaagggccgggctcaggctgccccgccgccctggtggaagccgcacgaggcgaggctccccagaggcttccaggcgccacgggccgcctgaacgctccgttctcacggcctggtcggggcggtggccacgcggtgccaggcagacgccgcccggccctgtcctctcggcccgtggctgtggagggcgagccaggctcacccgttcgctgggagtcctctggatctcgttgtctcgcagtcaggttggcgtctgtccacacccgcggtagggccacgaccagcagcaaggcgagcagcgccatcgtccccagcggtgcccagggagggtcagcgcgcggcgccccctccccgcccttctggaaccttcgcagcctccgcgcgcctctccccgggtctggccggtagggggagccccgcccgccccggggcgcgcgcctcccacccgccggggcctgtcggggtctttggagcctcatctcagggcctcgcggccgctggcggccctgaacgccggttctgagtcccgccttgtgctgctgttggagcggccggcggccaggcaggaacgggcgcgggagccctgggaaaggcgcgtgtggaaacgcagcccctgagcccaagggccgtctccttgaggaccccacggcccacagaaagtggccggcggccaggtaggggatcttctccgctgaagagcacgggctcacctctgataactcgcccctgaatagcttttagctcattataataccaaaaaaaaaaaaaaaaacaaaaaccacatccctggggagagattccagatgctaatgacacactccagcgcactagtgtgtgaggtcacggtgcctgcgtgccctgaggacttcccaaaacgtgcttactagtaaggcccctgcctgggccgttcgtgagtaatcctgtaaaactctcatcaagagggtctccccagcgtgagtagcgactgactcattcttttgagcagttcctctttcaagctgtactgttttccttaactaaaagctcaaataagaattcctcctggcgcctgtagtcccagctactcgggaggctgaggcaggagaatggcgtgaacccgggaggtggagcttgcagtgagccgagatcgcgccactgcactccagcctgggccacagagcgagactctgtctcaaaaaaataaaaaaaaaaagagaaagaaaagaattcctcctaagtcactagcttttggctctatctcctgagtggcaggttctgtcttgtctctctgagatcctgactctttaaataaaggttacttaaccctatacctcttgctaggcatctcttgtctgaattccttcctccaagaagactaagaactggaggatttccatgcctctcacagtgacagtgctacccaaacatcagggttgtcatctaggccccctgccctgcacagaaagccaatcaccaacagcagtgccagggaagaaggcctcattcaagtgctacagcccagagatgggcgctcagtcacaaatccctctcctcagcccactaaaattagaagtttccagagcagggaagaaatgtcaccctgtgtgggaaaacaggaattagggagagtgaggaggcagctaggcagtcatgactggtgaggggtctggcctcaaggacctactgagtttcagcgccttgatactgtctgggaggcccgatggttggtttcctgagaaaggagctcagataagacaaatgtaactttcccaagttttaagacagggtgggccaatttctatgtttattcaaaagaaaccctaaatactagttttacgagaaattgggcccatgtgagtaggccccaaagggcaatccacaggtggtgttctccaccctgctttctcctctcaaccctctgtatagaggccctctgttaacacaggcaggagcaggaatttcacactcttttcctttctttgctttcttctttgtcttttttttttttttacagttgtgatatagtttggatctgtgtccccacccaaatctcatgttgaattgtaatccccagtgttgggggtggggcctggtgggaggtgattggatcataggggtggtccttcatgaatggtttagcactatccctttggtgctgttcttgtgatggagttctcacgagatctgttttttttaaaagtgtgtaggcaactccctttcttcctcctgctcaggccacgtaagaggtgcccgcttcccctttgccttccatcatgattgtaagtttcctgaggcctccccagaagccagcaccatgcttcctgcacagcctgtggaactgtgagacaattaaacctcttctctttataaattgcccagcctcaggtatttctttatagcaatgggagaaaggactaatacaagttgcatcatattccatggcctggatgtaccatagttaatttaaatagcctccttgaatgaacatttgtgttgttcacagtgtttttatatctcacatgtcaaagtcaaatacattataggatgaatctctaaacgttttattcaggaatcacagaattgtaattctgggcgtacacagaccagaaatgtgtttggtgtgtctgacgaacaaagagaaggttgaaagttttatttaagaaatgttacctattgtttagaaagaaaacttgtgggccctggtagaggtttggggagctggcaggctctgatgggtgagtgacacagtaggtagaccttgtctttgagtcacggcaggtcgttccagcagctgttaggtgcacctgattgtaaagttgcagcaggcgtttcagcacttgggcttgcagatggttcttggagcaggtgctgtctgcctgagtggttttcctctggccctctgccttgacttagtcgggtatgaccagaataactcaatttatgaagtcaactttcatatacatgacgctgcaattgtccctaatgtcattccttacatataccattataccacagctttccagaaatgagatcaagggacaaaagttaaatatatttgcagtttatatgagtattgcccagttgctctatctggtctttggacaattttgtcattgaggagtgagtgcttgttttcatggtggtgtcagaaagaatgtcctcttatttactctttggattttcaccaatgtgacagatgaaaatgaaaatagtatccgggtgtatttttaatttgcatttttaaattataagtgagcttgagcacttgatatggtttgatatgtttgatatggctagtggatatttgcattttcctgtgatctctctatttatgtctctcgtccattttcccgtttaacagacattgcttaacagaagacaatatttgagttgctgaccaatcccgaaatagttgtgaggtatgatatcagcaggacttgttttccgagccttgatcatgaccctgtgatcaaaacaggatataacaaagaaactggcccaaaccagctaggaccaagatggtgacataagtgacttctagttgccctcattgctcattatatgctaattataatacattctcataagacaccacatcagcaccatgacaatttacaaatgccatggcaatgacccagaagttatatggttcatatatgatgccaaaaaggctcattacaatggatcttgggagtaatttttcaaggaatatgaacaaagtcttccctctgtggttaattcatgaatgctgtgttggaatattctggatggtccagactttcctctgtaatcgacgttgagccctgcacaacttcaggagggcgccagacctcactactctcaaggaaaaggctgaagtggaggaattgattcccactgatttttttttttaatttttttgagacagagtcttgttctttcaccaaagctggagtgcagtggcatgatctcggctcactgcaacctctgcctcccaggtccaagtggttctcctgcctcagcttcccgagtagctgggattacaggcatgagccaccatgcctggctaattttagtatttttagtagagacagggtttaccatgttgaccagtctggtctcgaactcctgacctcaaatgatccgtctgcctcagcctcccaaagtatagggattacaggcgtgagccactccacctgaccttgattttatttttaaccatcctgtctgagagattatttgtggaggctgacagcagatgtgcagggttcaacagtgcagtatgctgcatttcttcagctatacctcatattgtaaagactgtccaggtaactcaacaagcgggaggtaagggttgcaggtgggatactgtagtacaccccattggtctaaaggcacatttccttcttttccacccactgttgcagtccagccaggcataactttaggagaatgtggttaggtaaacatgtgccatttggcacagggatatttgaatttcctggcatgaggagtggcgggacttggactagctaaccatgagagtgagttagtagagatgtggatgccgtcatgctgatggcctgctcagagtagcactgggctgtattcgcccaaacacccaacagagcctggccaaatgcaaggcccagtccggtctggggacttctctggaatgcctgtgccagtataaccgggaatgtccctcaaacagagagaagcaaattattatctcttactgagccctttgctaaacaagaagcagagccatgtggacctatgagagatctggagacacaacattccccattgaggaatacaccgcccttgctattctgaattcaaatgggtccctgaaccaataaaagcatgaatgtattttcaagaggtggtgcatgcagcttcatgcaggcctcctgagccagtcgtccagatgtggttaggaatgtctgctatcaggacacttgctgcctgggaacccttggcagaggccagcactgccacccagcagggacctctggtgtgttgcagctgctcctcaaatgcctctggaagacaatagcaacttacgacttccttaccaggaaacagcatcagatagccttcaaaccagaaatgcctctcatgtcttgatgtcagagaaccattctaccaagaggaggagcagcccagcaaagtccatcaaacggtgagagtatattccagagcagggggcaggaggacgttaggggagcctgtggcttctgcagcagaggcaatagcagaaggagaggagagggaggagcagaaggagagcagagggagagcagagggaggagccttcaagggctgctgtgtgttcggagcccagctaaagccaagcaggcctctgagctccctgctaggagttcatgtctgcagggcatgtggctgcttggaaattagccatgtagacctcacagtctgtctttgccagagaaaggcagggcaaaccatattatacacctttataacattgtttcaaatccagaagtgtgatgcctccaccgttgtttttctttttcaaaattgccttggctattttttttttttttttttgtggttccatgccgattttggattttttttcttttctctcttttttgatggggagggatggagtctcactttgttgcccaggctgcagtgcagtggcacaatcttggcttactgcaacctctgcttcccgggttcaagggattctaccacctcagcctcctgagtagcttgagactacaggcgtgtgctaccatgcccggctaacttttgtgtatttagtagagttgggattttgccatgttggccaggctggtcttgaactcttcacctcaggtgatccacccacctcggcatcccaaattgttgggattacaggcgtaagcaaacgtgtccagccagatctttcttctatttctgtgagaaataccactgaaattttgatagggatcccattgaatttgtacattgcttttgatgggattactagagaaacaggagtgtaggagagccagagtgacgccattttaaagccaattccattttaaaacaagcaaggcaattccttgccagtcacagcccatggtcacaggtgttgacagctaaggagggagtttagtaatgcctgcaaggactaactcctacagcaacaaaatgtccaaatgcgccaatatctaataacaatatgtgcttttaaaataattagaatcatgctttgatgtacttactcactaaaatcccaaggatagtttactttaaatcaacaaagtaataagttttgtcacgctgtcaacccacccacacatagacttaacttagcttttacatagataagacccctacatgagaggagtttaaaacaaagacaatgcgttcctcctcttgttttctgaggatgccctactctgcatctgagtagctttcaataaatgatctcttctcactgcactctgtgactcacctgaattccttcctgtgcaagactgaaaaaccctcttccagcaacatctttctggcgatgcactaagggaccataagatgagactatgtgctggggaagttttgtctgcagcaccagttggccacctctggtaaatggggtccttcttggcatcctatgtcatgcttagacaaggatgctcgcctagaaactcaggttagaggctcagcccacaaggttagatgccctggggtatatctggaacaatggaagtctctttgcaagatgtttgtcagtacatgatctgaactaatccaccttgtgccctctgctggggatgggaaagctctacttctcatcatttcccagctcattgctttgctgtactgcagccttggggcagccccaaatggctggtccagaggtttccaccttccagtggcggattctaatgttctttatgtgtttctctctgttcttttctgcctgctttggatctgctgttactaatctgctgccgagtggcaactctgcttatctcacggtgttgaggtgagactcactgtttttggtattactaattcaaggctacctggagattgtcttttcttgtacagttcagccagttctggctaaaatgtatacattaaaaactcatttaaaactgaagaaaaaaatgatgaaaaggttttttttttttttaaaccaaacttccttaaagactactttaccaaaactttggtccacagctttccttggattgcgtgttggatgtctgggtcatttccaattaagaaaagtttatgctatgggaaacatgtttctagaattgtggaagggtcttatctataaagtgctaacatctggcaaacagtgcaggatctcttgcttcctcagttttcccactcacggatgagcgagtgcgcttagctgtcccttcccttcccttcccgctctggtttcctgtatgcaatgtgctcagccttccaagccttgggacacacagggatgctcatgctcctttatgttcccctagggactaggggttagtggacctcacccagaggtgtgggatcctttgggttctgtctgctggggagcctggagccggggatcctccaggtcagccaccatcctgttacatggggctcttcagcctttcgggtcccagggctgcagtgccaccccagtggaaagcccatttgagactcagagggatatttgccagcatgtcctgctgggtctccctcgtccccttcattggctgcatatttgctgtctgtgcctcactagtgatgcccgtcatcctgagcttgcatgctctgaagtttatgcctgccattttccttctcctggtgattttctttctttgggttatttaattcagcatgtctctgggcagcattggaggccaaaagcctcccaggaactagtcttattgagaagaaaaataattttgtctaattcagaagttatctaaaggtcaattcaaatgatgaacttgaaaatagttacttatgaagcaaggtagaaaggagccagtaagtaggggagcgagagatgtgaataaaagttatggatatgaagatgtatttttggtaaggaaggttataaagaatagcaaataatgtatgaaaaaggatctcgtgtggtaaatttttgtcctaaagtaaaatgactaatgattattagtcattagccattaatatgactattattattagttattagtcattaatgactaaatgattatttaggaaagagagaaggttagggcaaggcagaaagtccaagcacatctaagatggtctgtgtacactgggataaagttcgtgaaggggaatttatgaaaggaattttgtatatgattaagttggttataattgaaaggaagccatttataacagtctttctaaaaattggtcgcctacgttaaaacaaagttttcttgaggtactgatttgctgtgaatgaagttacaagaaattttactttcaattttataccccgtttctcttctaaacttctcagatccatatttccgacattccattttttctgtctcactgctttcagctttttcccccttgagcaggcctgagatgatgaccttctccttcagcattttttgtcagctcctgcaccccttttttcctccagttttaactgttggaatgacctgatgctaaagttttatcttgaaggtctagaaaagcaatgttttcttctagtataacttgattttatattcttggcttttcttgctgtgtctaaattttcagtgtaatcagaaaacttctcatgctgttcctaagggtcacatatgctcataaccttaaacactgttcctgtgtctgattgcattcaagcacttctttcctcaagtttgtcttccaggttatctaaatgggcttcctgtaagaagaagcggtctcactgcagaaggttttccctgcctttttattagctggcttaaaaaaaaacaagattttatgtttttttcacgataattcctatactgtctttattagctttatgattgcaaaaaaactgaaagttaaaagggttaaggtttttacctccatgtgactttctctattgcttgttaaagtctttatgattattactcttggttaagtgtataactattacaatgacctgtgattttatgttaataaaatgttttgagccttttaacatcttagagaaatatcctcaaaatcaaaatcttaaatttagtctctgatttagtcttattgctggggcttattaagcctatagaaattaatctctgcaaggtcatagactctttctagaactttctggcagaccatgaagtccagtatcaccacctccagcctgaaaattatatattggaagaaaaatcagttaaaggattccctcagcccccttgaagctgtccttatcaagagttattaaccaatgcttgtgcttagttaataacctgttgtagggctttgactcctggacacacatatctaaagatggcactgacttctaccagtatctgacaaaaactcaagttaactgaaggctcgtctttagacctgggcaaaggggacaacgtaaactgctttcatgagacacaaggacaggtctgtattccaaaacattatgattcatttcataattttgcctttatctgaaataatataatttgttctatgtctatgtggaaggaaaatatcttgggcccccagaatcactaaggtagagggaaaattcaagctgggaactgctcagggcaaacctgcctcatagtcatccctctgcttgtattcatagtcatccctctgctcactgagataaatgcatatctgattacctgctttggaaaggctaatcagaaactcaaaagaatgcactgtttgtctctcacctgcctgtgacccggaaaccccctccctgctttgagttgtcccacctttccagacggaaccagcatgactccctaaaatgcagaaaaccaaactgtgctctgaccaccttgggcatatgtcatcaggacctcctaagtctgtgtcatgggcgtgtgtcctcaaccttgacaaattaaactttctaaattaactgggacctgtctcaaattttctgggttcatatttggtaaccatggggggattctgagtggaggtgcccctgagctttgacaaatcttgtattgatgcttggtacatcatgaactaatttattgctcaaatcaataggacaatttgctgaggtctgcgagctgcccctccagagaatccctgctctcccaaaatttggtcaagatctcaagtttattttggtgtacaactcctttattttggagttttactttcttccaacaaggaagggaagttttcctgcttccgtgataatggaaggcaggtaactcctttatggagtttgagctcacttccaacagcgaagatgagatttttcctgcttctaggatggtggagagcagtcttcagcctgagacccatccctgggtaagtaactgaattggggtttgtcttggctaaagttaaagttaacaaccagctggtcttaatttctttttaccattagagtgttcagtgatcatgtaagttgtgccattgtttgttttgcttaagggttttttttttttttttggtgtttgtttgtttctgtttttcctactgtttctcttgttgtttcagtcttttgcccattgggtttaatcaactctatccaacttgatcaactctgaagggaagttccaaattatggggaacaaggcctctgaagtgactaaattccaccccccgcctcccctccacacacacacacaaaaggtggtatggttgggggagaaaaacagccagcaaaaggagaaaaaaaggaaagatttttgattttgactactaaaggggttttatttacagaacaaggccacttttttgctagcaggccaaactgaaacaatggcagttgccccacgctgtagttccatacctaaggctctgctttcttttcaccatgagagcctgggtttggtgggtttggttcctaaatcaagccctttctggtttgatacttggtacctctgaaatagcagcaattttttctgactaaaatacggtaatgaaatttaaatggattattttaaaaagagctcaatggttaaaagtcagtttaattaaaaggctaacatccaagatgtacgtgtgtgtgtgtgtgtgtgtgtgcgtgcacgcatatgtgtatgtttgtctttgaaaggtcttcatgtgtttgttttttggttgtttttctcctctaggaccttgccttttttttttagcaaaagtttttttcttctcagttgactgaattctgttattacctgattgtttgactaaaatagatactgcacagaggctactctggggtttttaaggaagagtgtagtttagacacttaaaaatgtctttgtttaaaactattttttaagtgcactgtaaaagcatcacgttgtctagcctcataataattcaccctttttggagacccaggattcagtgtgggctctacccagagctcagatatctggttaaaaaaagaaaaacaggtagtctctatctaaataaaatcagtcttcctatgtaatccaacaataaatttctgtaattttattactgagttggcatccatctttaatctttctctagcaccaccagacattttctctgtgtacctgataatgtaaattttgctatttgactttcacctgatatgcagatttaaggctatttagctgacaactgtctagggttctgaaacaggttatcaagaatctgaaagtctaagatatgaaaaaagaggtttttatgaatctataagatgtacttttatcagcatgcctaatatgtctgtatttatgtgttgtgtacacaatgtttcactatgaaaaatatataaaagagctctaattaattggctcaaagtgaaataattcaaaaagcagctatattcattaaatcaatatcaatgatttatacttaatacgtaaatactttatcaggaaaaaaggaaagattagtcaaatgctttttcaagtttgcataacttaagtaaaattattaataaatgagctcgctttaaaattattggtaaagtaatattagaaatgtcagcatacatttttgtttgcaattattaatcaagcaatttcatacttacccctgccaaatagtataagttgtcaaaatttggcagagggtttacaaaactataaacccggcccaaaacataatgatatttgcttgtgtaatctttaataaataagtcattgatattgatttaatgaatatagttgcattttgaatttagtaagattatcataacttctaattctgtggctttaggcagtctagtgcacaggcagtaaggaagtttgttttgagaaaggactgttatagtgtttgtttcaaagctaaactataaactaagttcctcccaaagtccaggaatgaacaaggacagcctggaggttagaagcaagttggagttagttagtcaaatcttttttccctatctcagttataattttgcagtgatggtttcataactttaaatcatgactatcacagttttcataaacaatctaggtaaacaaggtaattaggtaaatgtaatgtgatacatacttgtagacaaatttgtcataatttagaatagaaagttatattaa

SEQ ID NO: 700 - DNA, 1799 bp, Homo Sapiens
cttctcgctgcctccacctcctactccattcaatgcatcttccacagcgcctcctgagtttgtttcctaaaagagcaacctcaagactcagctgctctgcctgaagaactctgctgcctccagcagaaagctccacctttggaaacagatatgatcctccagcaatcccaacactcggaggctgaggcgagaggatcacttgagctcaggagttcaagtccagcctgggcaacacagcaagacctccagtgaaattcaaaaaaattagccaggcgtggtggctgtaagaattaaagaaagaggagagaaacatgaagggtggtttgacagtcatcagggacaggtttattttgaataataaacttggcagctggccgaaatgcatgaggctagaaagggagctgtaacttaaaggggcggtgtttgtcccagatgacagtgctcttgctccgtcagtgtcatatggttgtagtcccagcaccttgggacgctgaggcaggaggatcgcttaagcccaggagcttgaggctgcagtgaactgtgattatatcactgcactccagcctgggcgacagagcaagatcttatctcaaaattaatgtattattatcattattaattttttgagacagagtcttgctctgtcacccaggctggagtgcagtggcagaatctctgctcactgcaaccttcgcctattgggtcctttgctgctatgattccagggctggaagggtccttaaagatattccagccaacgccctgggtgatgctagaattccttctagactttaggcttgatccacacactcccagaactagtaaagctctcagagacctggggacctggtatgcagggcccactcctgccttctctgggggaattttccccaccgcctcctttctttgcctggtccaagtcccagcttccagaaagaggtccatacctgagatacctccacttcctcctcctccagagccagcttaaagtcaggaggcggcacaagtccgcgaagctcagaaagtcccccagattcctctgtggtcaagccagtttcattcaattgaagcttgttccctgaggatttgttcatgggggagttattgtgtacttgattatagttcccatggctactggctcacagtgtgaagggaatgggcatacatccacgtcctcctgcaaaattgggatttgacctcatttataaccaaacatgcagcaggcaaccttgcaaattacacagcatgaagagagtccagagagttctgaatgacttagtagaaaataacattaaataaaatagtacatgcggaaggatgtgttctctccctggttcaacttaggtgcataatagctgttcatagcagtattaaccttgacatccaggagggagaccattcaactgaaaggttgcaaactggcaaccctcagtgggaatctcacccatagacctatatatccaatttcagagtactatggtttgaatgagtccctcaaatctcaggtgttggaaagttaatccctgatgtaatactgttgagaggtgagatccttaagaggcaattaggtcaatggattaatgccattatttcaggaatgggtttgttataaaagcaaattcagccccctctttctctctctcatgctctcttgccacgtgatgatgtctcaccagaggcagctcctgtatcttggacttcacagcctctagaaccataagccaaataaatgtctattgttcctaaactacgcagactgtgatattctgtgatagcaacatgaagtggacacagagtgt

SEQ ID NO: 701 - DNA, 2732 bp, Homo Sapiens
ggcacacatacccctgtgaatgccagaggcaaagaagagcctcaagccacaggctatagctgacctggcaccctgggcacagcaggcagattcaggggaggtacagccatactgagatagaggcagggctgggccctggtttctccactccacagagaatgtgcattgtaggcttcatggaaacagagactgtatgttatccacttccgtactttcagcatccagcacagggcctggcacagaataaatgctttggggcgcctgacactgatcacactacccctgccctcctgaggctccacatctatgtatcccatggaaaccagagtcacaaatggagacagattcagagactcagcctgaaaggagacagaagaggccgagagctacaggttgcatggcccaggatggcaaagactccacggttaatatcacagcagctggacagagacaagagcagagtcaggcatcctgggctggcagctgcctgttgggactacacagccccaagccagctccctgtctccctaggcagaacacacgttggcagagacacttgctttctcctctggctgtttcaagcactggcctaagaggtggggacttgggaggaagagaactgacattgcggagcccaaggaagcgaccagaggaagctaagtccccggaggaagtcatgaggaccacactttccagctcccccatcctcttctttcagccccaaatcccacgatccactggaaacatgagcacttggattgctggaaggcccattaacattcagctcatacaaaactggctttgcagccaggtgcggtggctcacacctgtaatcccaacactttgggaagctgaggcaggcggatcacctgaggttaggcattcaagaccagccaggccaacaatgcgaaaccctgtctctaccaaaaatacaaaaaaaaattagccaggtgtggtggcgtgcacatgtaatcccagctacttgggaggctgaggcagaagaatcacttgaacccaggaggcagaggttgcagtgagccgagatggcaccactgcactctagcttgtcagagtgagactctgtctcaaaaaaacaaaacaaaattggctttgcagacaggacactgggccccagagtccacccatcctccaaggcccagaccaaactcccccatctccatgacacattttccaagtcctcggggcctgtaacccatagttagcaatcagatgcctcctgtcacgcattgtctaataactgctttgaacatttccaacttggaaatcaagtccctggaggaagagccccaggtcacggtgctgaatgcaccctacagcgggtcctccaggattctggctggcaagccccagccctttccctcctccctcccatcctcaatcccacactgctccctgcttgcctgtgtcctgaaagcccaggcctcgatgtttcccatttgtagcctcagcattcgccacaccatccttctgaggaccaagaaagaaaacctgagcctctggccccggcttcccaccccaaccctgtcatctggtggggtcaacaggacaagttttcctaacccagcaggggagggaatttatgtcagtcccagtggttctaccatcccttggccaaccaggcaagagtgacccatgccccagtaagaaatctggatgcatcagcgtgggctgacttaggagctcatggagttgcccctcaaaggaatctccttttctcctgcctttttcatctttggtaggcggccctgctgcctcccagcaggtgaccacatggccaagaggctgctccccctctgaaggtctcaccttacccttctgggactccaggaacatctaaaagggaacccaaactgctgtagtcatcaagcccctgaggactgtcccaactggggttccccctaagctggatcctaacactagggggctcaaaactgcttgctgtcagcctccagctcccaagaggagtccctgagggaagacatgccttcctgcggccagtcttgcggggtcgtggcttgctcttggtgaagcagatgttgtgcttggtggacttaaaggactccagccgccgcttcatgttctgctggaagacctccttgtcctgccgctcctgcgcatcctctgagatgaagtggcgactgcagctggctttgtactggcaatgacagccccgcctggctatgaggatggatgccttggcctcccacaagaaccccaggccacagccccaacatattcaccacaggacctgccagcccagcttttccagaattaacaatggattgaaaaacaaaacaaaaaatacaacaggaacccagccagagaccctgtgttctcagttccctgggaaaagcttccctttatcccagaacttattcccccaaacctggccttccccaacccttgccatcctttcccgattctctctggtttgaaggtgaccctctgtcttgttctactactgtgacaacatgggggacattttctttgtacctccatttatctgagcttcgcccacacacccagcctacctgcccccttctagctacacaggatcctttctccagctggaatctcctatctagccatttctacaagaaccaccatgatatcctgggctgcactttgaactttcataactatctcccctgacaccctggaccttctcagtcccaataattcaggatcacccccatcatctgctttttttt

SEQ ID NO: 702 - DNA, 4361 bp, Homo Sapiens
tgtgctcagtgccaaaatatctgatcaaaaaataaccaaaataagcaaacaccaagacgactgttctggggactatggtcagggagagccgatggctcagatccaggaaaccctaggctccagggtacctgtttcactacccctctcccccagggaagctttgctgaacgttctgataacctagaaggcccctttccaaggaatcccccacagcacaatctcccaggactctgagatttccaatagttcctgtccaaggggcagctttgcctgaggtgggagcatcgggagagggtgagggctggggatcacttcccaggagctggcagatgaagcttctaagaagctccctccctgccctagccacaagcatccgcactcactcattcacccacccctcttctggcccttcttgccttaggcttatctccctttctgtgcacccaacccccactaggccacttttgttttctcatagcccaacgttctgatgggatgaacagaggggaggaagctgacagtctccagccccctaccaactcctcagtggaggtgccagagaggggtaccataaaagtagctgacattccgaggcctctgcccacctctagctcaccttcctaggggagattcctgaacatccctgaccactcacaccgcactccaattttccctcccacttcttgggagccttctagttccctggagacctcctctcaagtgggcatgtccccaggaggggtaaaaggatagagcctcacataagttagaaatgggcagagctcttggtactacctgtctcttttccttcttcatccaccactttcccctctgaggaggcttgtctagatgtctggagcactgggaattgggggaatgaggaggagcccctcaactctgtctcagtcacatcacttaatcacacctctccttctgccccacccctctggcagtgaaggctcactcccaacagatctccacccgcttccgggaatggccagaactcgcctcctgcgtctctctttccatttctatcttcccctccccccaagagctgtagtggccttggcctcctggcagtgccttcccagcctgtttccatagaaactgggtaggctgtgcagtgcaagaatcggaggggagacaggagcaggaaggagggaccaagccttagggacagcccccgatgaaaggaccgagagaaacggggagctgccccatgcaaactgagggtgggaccccgatttggggaaccaggcgggatggagcgtggagtggggggaagaggtagcaaaagcttggtagctggctttgctgcctcctgaggaaggggcacagaatctccccttccctgccacaggtagtgggggttcctccctccccacccccttaaaatccttctttaccaggaactgcctgatccagatgaatctcttctccggggcccactagtctctaagaaagggaccatggaattcctttcttccccgaagagctccccactctccctgaccagagtctccttgatctggaggctgggcagcccccggggacccggtggccgccgctgaccccgtggcatgcggctctcaaaggccccattcatctctgggggctgaaggcgccattgtccccagcggggggtggtgtggggagtgaaggggtctggactcagaaggaaggaatgcgtctggagaagttgcccccggggctccagtctcaaggtccccaccagatctccatcgggaccctttcacgaccccgagccctttccccaggagctcccagcaaccttcgcgcttctccggagggtggggtctgccgcggcgcgggggcagcctcaccccacctcactgctggactccggagaaccatttctgggaccgggagctgtccagcgcctcgggtcctgacggaccgctgattcgcctaggtgccatcggacaagcgggtgctcagagccagctctggtggctcgggagctttcccccaaccaggctaagaccactaaaccacgcctggcccggatgagcttggatgcagctccgaacgtggggatccatcggtgctgagaactgacctagggagcaccttgacccctgccctatctgggcacaattgaagggccaagtgccaccagcccactttcctggaaccctgtctcagacttgggcaggaagaagagccatgagaggtcaggccttgcctctccccgcgttccccatctttctctgtgcctctgtttctgttttcctccggctctcctccctcctcctctctttccttccctgctgggttgggggctgctgaattatcatttctcagctctgctaatgtgctccccgctgcgggaagggatcataattctgggagatgattaagtttcaaattgtttttctttgtgttgttgaagatgaggctttaatatggtccttcctcagcccgggagcctgcccccattcctccactcctagtactctcctcactaataggctaggtttggtaccatgtcttttgtggtccttgccaaacttttatgtgtatggggtggtaaacgagaggggtatagacctaccctttactcaaaggggaatttttttgtttttgtttttttttgttttttttgagaccgagcctcactctgtcgcccagattggagtgcagtggcgccatctcagctcactgcaacctctgcctcccgggttcaagtgattctcctgccttagcctcccgagtagctgggattagagctgcgcgcctccacgcctggctatttttttatatttcactagagacaggtttcaccatgttggccaggctggtctcgaactcctgacctcaaatagtctgctcgcttcagcatcccaaagtgctgggattacaggcatgagccactgtgcctggctaggaatacatttaatatagtggtgagaaacactggtttggaagtcggacaagtcaacatttaaatcctgactctgccacttactactcaggtgaccttggatgagttacttgaactgtctgagcctccgtttcttcatctactaaatggggatactgtgaattacctcatggagtgttggtgaggatttaaagtgataaatcatgtaaagtggttagccgggtgtacagcttatggtaaaactcagtgaatgttagtagatattactacccacataccttaccctgtttgatcctgcttcccatagccttcctgactttgttcttctgttcaatgtttatctaatgcctactgttttccaggtactgtacaatagagagtaagttatccaggagtgaggaagttggctttcttacctatttgttcctcaaacaccccttcctttacctccttccttccttcctttcaactgaagtttactctcattttaccctcccaccggcttccagttcttcctgcattgttcctactccatttttccttctttcactgatgtcttatcacttcactttgattcttatcctcctaatacacatacattttttcaccttctacattattcttcatcccatttggggccatcatagtgaaaaaaagggctgaattttcaaactaggaaagagaattctgtcatgctgtgtgtatgtgtatatgtgtgtgtgtgtgtctgaggaacacacacattaattcacattcaacagtaactctatagctgacttctgaactcctacgtttgaactgtgtgcttgtttgcctctctatcccctctatttaagctcttaaaatacaagtctatttctttgcctgcctacctgtctgctctgtccttgcctctctctcttttggaatttgttgttttaaacatctttattgagatacaactgatatacaaagaactacatgtatttaatatgtatgatttgatgaatttggatgtctttgttatattctaaatgggaatgcttactggttgttagtatgagaagctgatttatgataatgtgtttttgtgtttgcttaactggcctcctacctatcaccatactggtgatgggttcaggatacactacaccaaaatgtggcaacttgacatttgagaaaacagcagaagcaggaaggtccctctcccttcttcctggaagtgggccaaaaacctctgaccgtcttcctccttttctcctgaggtagaacataaaaccctaattccagaggtatcctccccatacccagaggaaaggagcatccttgtcctcaagttacacagagttactaagtagaatttgaacaaagagaccttgctaagttttctccagttcactaccactagactatacctcctttgtccagtcatacttctgcttgcctgtccactcttaataagaatcccagtctggcc

SEQ ID NO: 703 - DNA, 2494 bp, Homo Sapiens
tcagcaaactaggaatagagaacttcctcaacctgctaaaaaaaaaaaaaacaacacacaaaatctctgatttaatgggagaggctaggagctttccccataagattgcgaacaagacaaggaaatccccactcatcactcttcttcagtatcatactggaagtcttagctaatgcagtaagacaagaaaataagaggcatagaaatttgaagggaaggaataaaactgtttttgttcatagatgacatgattatctatgtagaaaatcccaaagaataaaaatagcccctcctagaaccaataagcatttatgacaaggttgcaggatataaggttagtgtatataaaaagctagttgcattcctctgcagcagccctgaactactggagtatgaagttaaaaatgcccgcacacaattgtatggttaaaatgataaacttcatgttccatgtgttttacaattttaaaaatccattagaatctcagcaagtttgattttagttgatatctattttgtggatatcaataaactgattttcaaggttatataggaaggccaaagacctagaaaagtcaaacaatattgtcaggactgacactacctgacgttaagacctcctctaaagttacagtaataaaaaagcaaaagcaattcaaggaaaaaaggatattcttttcaacaaacaaatggcactggaacaactggacactaatatgcaaaaatattaatctgtacaatgactttacaaatttaataaaaattaacttaaaatgaatcacaggcctaaatataaaatgccaaaccataaaacttctacaagataccacaggagacaatccaggtgccttgggtttggcaatgagtttttaaacacaacaccaaaagcatgatccatgacagaaaaaaatgagttgggctttattgaaatttagaacttctgtcctgtgaaaaatactgtgaagagaatgaaaagtcaatccacaggctgggagaaaatatttctaaaactcatctctgataaaggacttgtatccaaaacaaacaactcttaaaatgcaataagagaacaaacaacccaaataaaaaaaatgggcaaaagatctggaaacttcaccaaagaagatcaacagatggcagggccaggtgcggtggctcacgcctataatcccagcactttgggaggccgaggcaggcggatcacgaggtcaggagttccgagaccagcctgaccaacatggtgaaaccccgtctctactaaaaatacaaaaaattagccaggcgtgctggtgggcacctgtaatcccagctactcaggaggctgaggcagaagaatcgcttgaacccaggaggtggaggttgtggtgagcagagatcgtgccattgcattccacctggatgacagagcaagactctgtctcaaaaaacaaaaacaaaaaccaaccagatggcaaaaagcacataagatgatgctcagtatcatgtcattagagaactgcaagttaaaacagtaagatatcactacacacctgcaagaatggataaaacccaagaaactgaccagcaaatgatgatgaggatgtggagcaaaaggaactctcattgatggctggcagaatgtaaaatagtacacagccacttgggaagatgttctggtagctttttacaaacctaaacctagtcttaacttacccaactgagatgaaatgttatgtccacataaaacctacacaagagcatgtaaagcagcttcattcatgatgccaaaagttggaagcaacccagatgtccttcaatacatgaatggataatctaactctgatacatccatacaatggactattattcaccaaaaccacaaaggagctattaagttataaaaaggcatggagaaaccttaagtgcatactgctaagggagagaaggccatctgaaaaaaagcaaatactgtatgattctggctatgtgacatgccagaaaagccgaggatctagcaatagttgagagaagtggttgtcagggttttggggagagtagaggagggatttttagggcagtgaagctctttggcatgatattgtaatggtggatacatgtcattatgcatttgtccaaatccgtggaactgtataacaaaaagagtggatctttgttttttgcggtttgaagacagggtctcactcccctcacccaggctatagtgcagtggtgtgatcatggcttcctgcagtctcaacttcctgggctcaggtgattctcccactacagcacgaaaaatattaggtttggttttaagaatgaatctactaaaggaaaagataaaagctggcaaatcctgacaagctctgttatttcagagcacaaactacctgccatgactgttctactacaacagcttttcataatcacacttgaaaagtaataccagtttttggtcaaccttccttttttggtgtagtgctacgcatttgccctaatttcatgtgttttaaag

SEQ ID NO: 704 - DNA, 11683 bp, Homo Sapiens
gtcccctgcctgaatccgaacatgctggctcctgatcctggatttccagcctccggaactgtgagaaatcaatgtcagttgttgagaagcacccagtttatggtgttttgagacagctgactggactaaggcagaacgaaagaggggaagactcacttgtttcttcacaggattaaacaggtgagcaggtggatggaaagaagggggaggagggaaaagggggaaggggagacggacaggtcaaaggagaggagaaaaatggactttctttttacataattttctgtatttctgctttctgtaataaggttgagctgcttttgcaataatagtattacaatttatgtaaagcactacataaaaatattaaacaaatcttccactgtgctcgtcacaaaagcattagttaaagatctaactagggaggccaggtgcagcggctcacgctcctgacctcaagtgatctgcctgcctcggcctcccaaagtgctgggattacagccgtgagccaccaagcccagctcccccactcttgtattttaatgagcagttagcaggtgttccacccgagggggcctcacccaggtgccagagggagcacaaggcctaggtttgtgcaggcaccggctgcagactggccacagggctctcccatcctaggcccctctgggacatgctgggcaccccccgaaggttagcctgccatgaatggcccagtgagctgggttttggagttcatttttaaggagctgtttatactcggtgagacaggagcagcctgacatgcgcccagaacctcctgcccttggccccacaccgccctccccactctctctgccctctccacactgtgctggtcccgctgcccactcctcagagactcacccccggctgccttttggtgtctggccaggtgcattagaggtccacccttcaggatgcacccctctacccactacgccatgtgctgaccccaaaatcctggggtgcagagccagagagtggtgaagacacgctggcagcccagatgtgtgcagccccagagctcttcccgtccccccgcatgcgcgtggatagcatggctgggacagatgctggcctccagccccacggtgtgaggctctctcagaatacctgggtcctggggaggcctcagccaccattgcctgtgggactggccaagccgctcagcctctcttaagcctgcactcacctacagataatgatccctgccgggtgatcatgaggggatggcaaaagagaaagtgcctggtaaatgtgtgtgtaaaagactggtatagcagcccagtgtgtgccaggctcctaacccaggcagccttagacaggggaggccaggctctgagagcagatgaaactagggttcagagattccacctgggagcagggtcaagctgccctctggtgccccatgttcgctgccgggtcagagacacgccaccttccccctcgaaagcgcttcctcccgcagggcaaatgcttccgcagccccagtggtcatgctaccctgcagccactgtagcccctcaggcctcctcctttttacttttttaaaaaattgtatgatttttaaattttttgtagagacagggtcttgttatattgtccagactactcttgaactcctgggctcaattgatccttcagccttggcctcccaaagtgctgggattacaagcgttaagtcaccacgcccagcccaggactcctcctgagccaagaggctggggcctccaggtaccagtagggccggaggcctcaggaagcccctggtaaaggagctcccagagcaaacaaggtgaccagcgtgcagcacacaggcggggagtggggctgtggggtagcccctggggaggctgcacagaggagctgtttcccgctgccccttcccaatgccagagcccatcagggccgacactgctgctgcctgtgggcaggacaaggtgaggggcacttcctgaggaagaggggcttagaggccctctccccgaaccctgggccagcctctggggctgccatctcacagacccttgatgtgggggcatgggcttcagcgtgactccctggcaggtgccacgtgctcaatgagctgatctaggtgctgaaagggagatagcaaggcgggcctgagccctagcttgaggacttctggggcatggcttggggcagataacacaggcaactttggcaaaagtaaagagagacttcctggacatgggggctgttgctctgtactagaatgggctgccaggtgatgtgttccagtcgggtggcactgattctcaaggagaatcgcttgaacccaggaggtggaggctgcagtgagctgagattgcaccattgcactctagtctgggtgacagagtgagactgtctcaaaaaacaaacaggccagactcggcggctcatgcctgtaatcccagcactttgggaggctgaggtgggcggatcacctgaggttggaagttcaagaccagcctgaccaacagggtgaaaccccgtctctactaaaaatacaaaattagctgggcatggtggcacatgcctgtaatcccagctactcgggaggctgaggcaggagaatcgcttgaacccgggaggcggagattgtggtgagccaagattgcgccattgcactccagcctgggcaacaaaagcaaaactccatctcaaaaacaaacaaacaaaaattgcaaaaatagtacacagtaccacgtaccctccacgcagttccccctaatgttaacgtctcgcgtacgtaaccgtggtgcatttgtcaaaactatgagattaacattgattcaatactatcaccaactgcagactttcggtggatttcaccagttttccactaatgcacttttactatttccggatccagtccagggcgaccggggtgcatttagccatcgtgcctcctccgatgtgagatggtttctcagttctttctcggttttcatgaccttggcccttttgaaaagcagtgacgaggcattttgtgggtgttcctccatttgggtttgtcagatgtttttttcatgattaaactggagttctgcatttttggaaagaataacatggcgatgaagggcccttcccatcatgtcatatcaggagtaggtaatttcaacacaatttatcactggtgatattaaccttgtttcttgattgaaatgatgactgcaaggtttctccacggcaaagctgctatctccctttccatactttatttgttagaaatgtgtcactaagtccagcccacactcaaggggaggaaaattaagctccatttcgtggaggggagttctctccatatattatttgcaattcttctgtacagaactgtacctttgcttccatttgcttatttacaatgcattttcgttatctcctgtcccctccctctaagctgagtggctaggtgagcccctcccctggggcatgtgctaagggagagctccatccctgtgctttctccttgcatttcgtgaactataccataatcattactttccttgtgagcttccttaccaagggacagtttttaaaaagtcatttatttagtagtcatcggcaggcacctttgtcaagtatttttctgagcatgatctcattttactcccatgatgtcctgtggttatagtttccatccccattttacagatgagaaaacaggctcagagaggttaagctactggcccaaggtcacacaggaactgtgtcacacccctctctccccagtgcccagcccagtggctggcagcatatccggctccaacaggaacttgcttactgaagagcagcccacacgtgaatgggcataaaaaagcaaaacagcaaactcccaggtggttgtccatcactgcctctgggagttgagcctatagtcagggagttcagtgagttcagtccagggtcttgccccctcctgccatggcccaacaccatcaaacagtaagaggggtccttcttgtagtagagcgacagctcccactttttctttttctttttttcttttttattttttttaagatggagtctcactctgttgtccaggctggagtgcagtggcgtgatctcggctcactgcagcctccacctcctgggttcaagcgattctcccacctcagccttccaagtagctaggattacaagtgcacactaccacacctggctaattttacccactttttcaagttcccacacagcagtggtaaactggggagaggacagctagggttagtgaaaggaatgacgattccgtccaaactgtgagtgccagatgattgcagacaggcagactgtgcttctctcagctccccatgccatgcagagtgacccagagtgacccaacgagacccagcatggatctatgagtgacactgagccaggaaggtgtccagggaggggctgcagaccaacctgggcacgaggcctctttctaagcccaccctggttaagtgctttgccagtttctaggtgaggatcagcctcagcctgcactgggcctactcagtaaaggtttccacggtctttggatttggagcccccaatttagggcagagacaagtataaactgaccaagcaatagaagagatgcccacatgaggactcctgggaggggcactgactgcagcctgggtggcggctcctgggcagagggggagctgctgtggctacggaacaggccagcaggaggagccagtggtgatgagtgccctggtgccaggaaagcccctggcagagggcctggcctgtctgggggaggctggtgactcctggttccaatgtgctcagctctgagccagaggccagcctgcctcagacggggcatttccttcaagtggttaaaattcgtttttgtgctgagtcaggaagctagccggcttgggcctccccacctccaacgctgagtggcacacagtaccagtcatcagcctaagcagagacctgggtaagtgccccctggctctgcccaggggacaggaatgacagcagcatcccaacagattcctgctcaggccccgcagggatccacaccaagtcaccctgtgagatgtttctccactggtcactctgtcagtgccttgagctcctggcctggctggccctgctgccctgtctgcgctggtgccagcactatgctgggtcactggggaagtcgggctggcaacatacccagatgcaagcagttggctgagcagatgggctgggtagccacgaggacccttggaagcctgccctcccaggccagtcggcggtttgttctgttgcccagagacatgctggcctcctgaggctttcttctggggctgctcctggggcactctgtccaagaggtggcagggtggcactgcagtgtggttcggggtgggactcagcgtgagtctggaggcagggcatccagtcattcctctgcccacactttgagtaactaggacaggctgcttctgttctctgtgtctccatttccctttctgtaagatgcagagattggactaaatcagtggttctcactgccgcgattcctggaccagtggtgtcaacaacatctgggaacttattagacatgcatatttggccaggagcagtggctcacgcctgtaatctcagcacttagggaagccgaggccagcagatcacctgaggtcaggagttcgagaccagcctggccaacacggcgaactcctgtctctactaaaaatacaaaaattagccgggcatggtggtgggcatttgtaatctcagctactcgggaggctgaggcgagaaaattgcttgagtccaggcagtggaggttgcagtgaactgagatgatgccattgcattccagcttgggtaacagagcaagactccgtctcaaaaaaaaaaaaaaaaagacatgcagattcacagaccccaggaagacctgctcagtcagcagccagtgggtaggcccggcaatccgtgttttaacgcgccttctgggctcatgctggagaaccactggcctggacaaaggcctaagcgtcttcctaggcttatttcaattcactgggcacccaccgcataggaggggcttgtgccaagagctggagaatgcaaaggcggacgaggtatgaagctggtaccaaaagggcacctctgtttcctgggtggctacctcctagctgtccttaacacccagctcaaatgatgtcttctttgggcactgtcccagaccagccctcccaccagttcctcagacacgagtaatcgggtcccacctcttcccccgacgcctgtgccagcacggctcttggtatataggatgtaccattgtttgtgagtcagtttcctgctgaacagtagggatgggaagggccgagggtggctcctgttcctccacggtcccacagccctgagcaccaaggggtcccattccccaacatagactgtactagcccagcctctgcaaggcccctgccaagtgcccatgtcctcaaagaagctttcagggcccactacacccatagccccattctggggctttcctttggcaaaagttgcagattgggccatgtggcccccctactctgagcctaaaagcctaagccaacctggttctccctcttgggaggtttgaagacgtatcacacagtgaggttgtagcgcagcctggagacacagaaagaaggccgagtgcagccactgaggcagccagaaccacgtggcaggaggtgtgtccagtgtggggaggggtatggcagccacagcaggaacaaactgcactggcctcctcaccctccctggagtgatgggactgagcacccccttttgtgcctggtgggagctgcccacagcccccgactctgggccagcttacaaggactcagcacgtgctcttagcagcctcttttccaggggcaggcagctgggacaaagcagcactggacccgagctggagggatggatcccgggccctccactcactggccgacaatgacgggcaagtggcttcacctctcgtccctcagtgacttcatctataaatggggctgaaatcagggaatcaaaaggcatgaagagctagcccctagcatgacacttggcctacttttggtatttaataaacgtcttctgacctggtcctccttcgtacctcaaccacatcagacacagcgtcatgatgatttttcccctgagcaaagtggctttgtgtgaagttgctaggcctgagtttccccatctaaaatacgcaggttgacctggatgatctgtgcctcagctacacctacagacctctctgctcaccatcatgagtgcccctagcaaagggagacaggggccctggggtgttgggaggaatggacactcaatttccagtcaggcattgaacaggtcagtggattagtgggtctgtgattcattcatccatccattttgtcaaccatttgttagatcatttgtcaaccagccagccagcccagtggctggtcagctcacagcatattctggtccttgtactgcttccagcccagtaaactcaaccaaagagaaagagaacagaagaatgagaataaacaaactccaactgcccacaacaacacactgagtgaaagaagccagaccccaaactgaacatactgtatgattttctttgtattataaaagtgtcacacacacacaaaaagtgtcagtacatccaaaaccaaccgaaagtgtcagaagccatgataaggattatcctatgcaggggatcagggaaacggtaagtagtgactggacggcagctcatggggcttttgggattctggtaatattctgtttctaaatctgggtgctggtgacacagtgtttgcctagcgaaaattcattgaattgtacatttaagtttttacactttcctgtatctacgctatgctatagttcaataaaaatttacccaaaaaaataataaaagaaagaaaagaaaagcaagaaaaagcaaggaaatgcacagagcagttaactcagcaattccagttctaagagctgcttatcctgtagttatccttccaggtgggcaaatgatggaggggcatgatgttcctggaaaactggaaacctaaaagtcttggttattcaaccagaatgttaaataaacaacacatccatatgatggaatattacttaaccattacaaagtatgatcgttatgtaccaattgcaataagcccttagactgaaaagtcagtaagtgagcccaggaggtatacagcactaccctctgtagcagcaagcgtgcatagccacaggctctctctggaacgacacaggagaaagtggtggcattctggcctgcaggctcacgctctccccttaggggatgttatctgtggccacatccagtctgcctgccagaccatgctcttcccgagggtctacggagcctggtgccagtagtcttagttcagtctccaagtgaatgattcgcaatagtctgtagcttacaaattgccatccctctgactgcgggcagggccagattcaggggtttggcgacgaccacagactgtctgtccatctggaagatgggctagatgtgcgcagaacaggggctcatggctgaagagggcacagttcccacatgcgcctgctgtccaaggagcagaaacagaccctggggcaagagaagccagagtgccagttcagggagagctgctgccgccttctgtcctgcaggaaagaagacttggcaaggtcacaccggcaaaacaaggatttgtatgcaggtctgactccaaagcccgggcatgctgccttctgcagaggccaatcagggagggcttcactggggagtcatatgcagtctttttttctttttttttttcttttttgagacggagtttcactcttgtagcccaggctggagtgcaatggcatgacctcggctcactgcaacctctgcttcctgggttcaagcgattctcctgcctcagcctcccgagtagctaggattactggctgattttttgtatttttagtagagacggggtttcaccatgctggccaggctggcctcaaactcctgacctcaggtgatctgtctgcctcggcctcttgaagtgctgggattacaggcgtgagccaccgcgcccggcggtctcatgcagttttgcaaagtcaaagcagacgagggttggcatgttccacgcagaaggaatgctgtctagaaacagaagagagtggcgtgaccttgagagtacagggttctgtattgggtcagtgggggcaggaaggcagcagggaaagcaatttgggaaactggtcagaaatgatgcaggaagtgctggctggagcctggctacaaagactcatgggttcctggccatggagcctgaagtcagtcctataactgtttggattccaactgacggcttgaatacaggttcagctccacctctgcttccagaagatcattctggcagtgaggtgagggcagattgtagggcgtctggctggagggagggagacctgttgggaggcagtggcaacaattcaggtgagcaggtggtggccaggacaagggctggcgtgggtgacataagagtttgagaggaactgagaaggaagaagggcatgtaattggcggaagacagcaactgtgcgaaagggaggaggtaaaggtgacgctcaggtttctagatcaaggaacagggtctccagttgtacccttcacggaggtgagaaatccagatttggctggaatccgagttcagttttttgtttgtttttttgagactgagtctctgacgcccaggctggagtgcagtggtgcgatctcggctcactgcaatctctgcctcctgggttcaagcgattctcctgccttagtctcctgagtagctgggattacaggcgcctgccaccgtgccaggctaatttttgtatttttagaagagacggggtttcatcatgttggccgggctggtcttcaactcctgacctcaggtgatccgcccgcctcggcctcccaaagtgctgggattacaggcgtgagccaccgcgcccggccctgagttcagtttttttaaggacacaattagaggtgctcacgggatgttcaagcagggaggctggtggataccttcgattcgctcgttcacctacgtggacttattaaacagccaggctccctggccttgggagagtccttctggtggggagacagatgataaataactgaagtaatggaaaaggggcagttcaagaaaagtgttgtggaggaagaaaacaagaaagcccgccagaaggggactggaggtcggccccgagggtgtgtccgctagagggggcctctccaggtggactgcgggtgagagtaaagggggcatgtgggggaaaagcattctagggaacagcaagtgcgaggacctggagacggcagaggggctggtgggacaggcgcccaagaggaggcccaggctgtccctccggggcgtggggagaggcatggggctgggtccctgcaggagctcacaagccacagtggggagcagaagcgttacgctgagtacagtgggagccactgaaagggttaaagacccctgggggtgctgagtgggaagaggctctgggagctggagtggacgcagggagaccagttataaggcgaatgcaggagtccaggcaaaagagaatattccagtgtgtatcttaagacttaactttttacacacagaacaccctgcgcccctctcagagcctccggggtcttcatgcgagcagtttatcacggttctttcgtcttaaaccctcttactatttcagcaaacaccctctcctcagcctggtcaacccctctgcccaacccgagtgggccccgaaggaacaagtggggaccagagtcctgctcatgtgagtggtggggcccagcccgttcccctaagaccagaattctctcgctcagagcaaagccccggggtgccgggattctctctctgctcccgctccctggatggagcttttaaaaaaggaggattcctcactgcggcctctgccccttgcactgagcgccaacccgcatcacagctcagcaaaggcgcgcgcagtgaacagacggaggaggggtggctcctcgctgagctgaaggctgcggcgacgaaaataaacagcatggttcctgctctccacgaacctggcgctgcagacgtgggcaaaccacaccaagagacgcgagcaaccgaaatatagggagaaaaaaaaaggtgccctggacagcgggctagatgtctcctgcaggctcgaggacttcccggagggggcggcgttttctcggggcctgggaagaatgggcgggtttcagcgggcgccttctgggtgactgcccgtttcggcttcccctgaccccgtaacagagcggaagaggcccagagacgccagaggaggggcgtcagcgggacactcaggccaataagctctgactcccgctgtctgcaaaaatgaccggatgcaggaatgtcacctagaaccggccagctttccgacctctccggtcaaggacgcattcctaagagacgaagggagaatgacagaagttaaaaacaaccaaacaaaagccaggttgaggcctctaggtgggtctccgctaccgatggattcagccggtggggctgcaggaggttcctataagcgtggtcccctctccccgcaccgagtccggccc

SEQ ID NO: 705 - DNA, 1397 bp, Homo Sapiens
ggctgaggcgtgagaatcgcttaacctgggaggtggaggttgcagtgagctgagatggtgccactgccctccagcctgggcaacagagtgagactctgtatcaaaaaaaaaaaaaaattttttttaactgtaaaacggcctcaggcaggtccttcaagactaatgctttaggcctccacgttcactcacccacccacagcaacttcccaccctgcaagctccattcataattcatgccctgtataggtgggctgtactttttttttttttttttttttttgagatggagtctcgttctgtcccccaggctggactgcagtggtgagatctcggctcactgcaacctccgcctcccaggttcaagcgattctcctccctcagccccctgagtagctcggattacaggcgtgtgtcaccacacctggctaattttttgtatttttagtagagatggggtttcaccatgttggccaggctggtctcgtactcttgacctcaggtgatccacctgcctcagcctcccaaagtgctgggattataggagtgagccactgtgcctggcccagaattcttacaacaatgaaaagacaacccaattaacaaatggccaaaggacctgaatatatagtttcccacagaagatttgatttctgccatgaattcaaagatatacaaatggccgatagggatagattctcaacttcatcagtctcagggaaatgcaaatcaagaccactgtgacagaccacttcacacccactgggatggctatttaaaaagacagctaacaagtgttggtgacgacatggagaaactggaaccctcatactctcttggcgacgatgcaaaatggcccagccactttggaaaacactctgggagttcttaatgttcaacatagaggtaccctatgacccagcaattccactcctaggtatgtacccaggagaactgaaaacacatgtccacacagaagtatacacaaatgttcatatcaacattattcctaataggcaaaaattgaaagcccaaaatgtccatcaatgaatgaaatacagtctatttatacgatgaaatattgtccataaaaaggaacgaagtactgacgcatgctacaatgaggatgcaccttgaaaacaccatcttaaagaagccagtcacaaagcacacagagtgtatgtaattctgttcttacgaaatgcccagaataggcacatttagagagacagaaagattagtggctgcctggggcaagggaagctgaggagtgacactaaggatttggggtttcttttggtgggaggtgaaatgttctaaatgtgattgcagtgatggttgtacaactctgaattgtacacttaacggattttatgggatgtgaattatagctcagtaga

SEQ ID NO: 706 - DNA, 18004 bp, Homo Sapiens
agtggctggagtggaagtgaggaagagggagagctcctgggcaccagaatgaatggggagggtcctttagggcactgtgaggccattagcttttactcctactgagactggacatcccaggagagtttcagagcagagaagtgctatgactgctcttgaagtttaagaggaccaggtggctggctttgctgtgtgtcagagaacaggagcagaaacagggagaccagctgggaggtgactgcaaaagtccaggtgagaggcgatggagctagtgaggagtgccggaggcctggtgtattctgacgacctgagtatttgcagattttggtacctgcaagaggtcctggaaccaataccccatggatactgagggacaactgtaaatagtgaagaaggtccttgcttcccctttgccttccaccatgattgtaagtttcctgaggcttcccagtcatgcttcctgttaagcctgcagaacttgtatcatctttcttgctgcccttgaagagtggtgtccagtgaatctttcaaagaatgatactgagcttcattgttgatgaacaaaaatgcaaatctcacccagagcatgcaggaacatgctataatcactacactcctagaatgtgatctctttcaatattgactgcatccatgccttccacacacttgcaccagttgggaggatggagatgtcatctgggcagagggagaagagcagtaccattcagaggtctgtccctcttaagatatattctctctgtcaacctagaactcaaagggctgtgtgaaaagtttactgtggaaaaagaaattgaaaaaactgccactaagtagcaatggaaggacttttcccgctaagatgaggaactgctcagatcaccagctgcttcaggttaccagcccacacctgtctgtctcacctctgacaaccttgatataaattaaacaatgaataagaacaaaaacaatttaaaactgcgtaatggtccaaaccaccatggatggtgttctgacgatgatacacggggtgaggtctgactcatgagccgctgtccgtgatgacttgacattctcaaaaggaaatcccgaatgttctcactgcatgctgctgcaggccctcatggcagggcatccacaccactggctcaggtgctggttgctccagaatctctcttcagctggcctttttctactgaactgtctgtgagaacatcactgcaggcacggttttctccaaccataattgctgctgccaaagccacctcggacttgggaaagggaaacaacactccactagagagcgtagaatcttagaattcatctacttcattctcctcctggtactctactttcttctacaacgtcccagccgagctgaggtctgagctgtgctgctcaaggctgtcccatgtgaatacagatgcggagaccctgtaagggtaacagaggaagctgtgaacccaggggaagaagataaacttgtggacatatgtgcaaggagcaattttaagtatattgcactaaccaactcatgatctgtaactcctttgttaaggaaaagaatgtatatctacgtcaaacttccatttcagaaagccgaggtcaaaataatgagtcctggggaattcaaacttgtgttaagaaaatgtgtcccagtgtgcaatggctgcaaacagcagcttccttggtagtgtatgcagcctgtttgttgtacgggttgctctaaagggccttggagacagtcctttcagatggatgtacatgtttttgaccttgcactaccccagtgtaggctccaaacaggcatgcgaggtgcctttggaaagccccggggcactgtggccagttggccaagttatcatctccatccgcaccaagctgcagaacaaggagcacgtgattgaggccctgggcagggccaagttcaagtttcctggctgccagaagatccacatctcaaagaagtggggcttcaccaagttcaatgccaatgaatttgaagacatggtggctgagaagcggctcatcccagatggctgtggggtcaagtaccttcccagttgtggccctctagagaagtggtgggccctgcactcatgagggctttcactgtgcttccccctcttaatactcaccaataaattctacttcctgtccacctaaaaaaaaaaaaaaagaaaaagaatgctttaacttcaattacccctctctcttatgtacgtttagtctgttattttagttttatcctgattccctcgcataaacattattattatattaaaaaaaagaaaagaaaagaaaatgtgtagagccgggcacggtggctcatgcctgtaatcctagcactttgggaggctgaggtaggcggatcacaaggtcaagagatccagaccatcctggccaatatggtgaaaccccgtctctactaaaaatacaaaaattagccggacgtggtggtgcatgcctgtaatcccagctactcaggaggctgaggcaggagaattgcttgaacctgggagacggagatgcagtgagccaagatcatgccactacactccagcctgggcaacagagtgagactccacctcaaaaacaacaacaacaatgacaacaaccccaaaaacaaacatgaataaatatcattctccaataaaatcattcatgccagttagggaaccagttaggaggttgttactggaaaccaggtgaaagagattttattggagaatgatatttattcatgttttccctaatgaaccctttaactttactccagttacccttaagattgagttcaagcccttggtatggctgacaacactcagtgagatacggccctggtctcctaatccaatcccatctttttcctctgtcccctctttcaccaacttctttcagttctttgaacaggaaaccctttgtttttactcctttacatcagttgctcccttaaaaactcttcctcattccctactctgccctgttttaggtttcagcttagagtaattttctccaggaggtttcccgctggcctccccaatgggagttagtggcggtcaaagcatgctgttctcatcacagcccttagagcactgtattgcaaaagccatttcagttgtctacgtcttctgctagattgggggtttcttggtctttcttgtttaccattgtatccccgcagctagcatagttctagcttgggattaggtgctcaataagaacctgatgaatggccagacagatgaatgaaagaaggttttccttttctgacaagagaaggtggtgaatggaatagttgggaaaaaatgtagtggctaaaaataaagcaaataaactttttcttacctttgaccagctatatttttcttaaaatagggaaaaaaccaaaaacaaaacactgagaaaagtgtttgctgattggttagttttaaatttttccaccaatgaaatattactgctatgtgcctgttgcttctgttttcttttctattaatatcatgggctttttttttttcacaaaggaatttgttataaaaggacattattcaaggtatcactgtatagaacctgacatttgtaaatggtaacattcagtgaatataatcacttaaactccagagtagataatatacatatatattgaaacctagaggcctggggtttggtcttgtttgtatcattatctgtgtaactagcattaggacattaaactttctatgtttcattgcatttaagtaaatgcatcatcttcaaaatgaactgatgccttttctgatatctcacatgtgaagatataatgaaatgactcatataacaatactgtaagctactctgtaaaacataggtaccaagaagtgtgataggaagggtaacggcccagaagctaggttgccagtagctagtcccattcatactgataattatctactttttctctattgtcttcttatcaaacaaaataaaacataagataagaaggttacacagaatgttgttttgagattccttttagactttatcttttaaaattattattattatactttaagttttgggatacatgtgcagtacgtgcaggtttgttagataggcatacacatgccatggtggtttgatgcacccatcaacccgtcacctacattaggtatttctcttaatgctatccctcccctagctccccaccccatgacaggccctggtgtgtgatgttcccctccctgtgtccatgtgttctcattgttcaacttccgcttatgagtgagaacatgcagtgtttggttttctgttcttgtgttagtttgctgagaatgatggtttccagcttcatccatgtccctgcaaaggacatgaactcatccttttttatgatgcatagtattccatggtatatatgttccacattttgtttatgcagtctatcattgataggcatttgcgctggttccaagtctttgctattgtgaacagtgctgcaataaacacatgtgcatgtgtctttacagtacaatgatttataatcctttgggtatgtgcccagtaatgggattgctgggtcaaatggtatttctggttctagatccttggggaattgccacactgtcttccacaatggttgaactaatttacactcctaccaacagtgtaaaagcattcctatttttccacaccctctccagcatctgttgtttcctgactttttaatgatcaccattctaactggtgtgagatggtatctcattatggttttgatttgcatttctctaatgaccagtgatgacagcctttatcattctaggaaatgaaatgagtactatattctgtacataatcctattaaatttcttaaagaatttgttgccatttaatccatccttgcgtttcatgggttgctgtagttcagtggctgttgtagggaatttgtctcccttctttttctatcccagttattttgtgattttttccagatgtgcatgttctccattgatatatctatgcattgtcttagaaagtttaaaatctacccaggaatctatactagctaaaagctctttgagtgtcccttcacagctatacaagatgtttttagtaattgtgttctgtagagctcagcagctgttatgttacccgagtatttttttttctttcttggcttttaagttgatgtttggaagtctattcccaagtgctcagcctaaaggagagacagttttctgttccccctgctaatgctaaacacacaaataaacaaaacagaacaaaacaaaattccaattaaacagtctgggagattctagttgaatggtggatattagcatctttcaaagctagaccacctgtgcctagacaatttgtggctttctattcttatgtaatacaaggaatagatgtctggcaaaacaaaaaagaatttagaaagtagggatgaaacatgattccttttcagggaggaaaatcacttcattcaagtaccagcttagtttcattgctgcatttgaacctccaaggagagaaatgtggagcagttgatccacagttgtaccttccattgttggtttattaaatgggctcttttgtgcgtgtgtgcaatttcattcagaccgttaatcactacttggagtattcttagctttctacaaattgacaaacatagctgtagggaaatctatgtggaaattctgtttttcagaggtttggcagtttctctttaatgagtcctcagggtatctcaggtttcactaatttgtgtttaattagattggaaaaattcgggcagtaagcgacaagaaccttctgccccataagttggagaaaaccatcactcaggcactcaacaaaaccccttccaaatacatgatgtaatacattcactccagaacagggtatgagccctaaaggatgattcagacatagaaacaaaagttgctgttagaagataaaaagaattatcagtggatgtgtttttgcttgccgctttgacattgctgtggcaggcaagagcaaaggaagaaatgatgccctgagctgatgaaaacaaattccagaagcatttatgaccaagttgtggttagaggaacagaatgaaacataatttttcaaagtttccagaagggcttgtgcatgctgaaacataaccagaaacaatataacatgctacaggaggaatcagtgataaaagtgacattccccacatagacctagttatttacaaagagctgtaagaacgaagggctctgaagcctttaagatgaacaatgttgtaacaggaaaggggtcctgattcagaccgccagagagggttcttggatgttgcataagaaagaattcagggagagcccatagagtaaagtgaaagcaagtttattaagaaagtagaggaataaaagaatggctactccatagacagaacagccccgagggctgctgggtgcccatttttatggttatttctggatgatatgataaacaaggggtggattattcatgcctcccctttttagaccatatagggtaacttcctgtcattgccatggcatttgtaagctgtcatggcactggtgggagtgtagcagtgaggacaaccagaggtcactctcgtggccatcttggttttggtgggttttggctggcttctttactgcaaactgttttatcagcaacgtctttatgacctatatcttgtgctgacctcctaactcatcctatgacttagaatgccttaaccttctgggaacgcagcccagtaggcctcagccttattttacacagctcctattccagatggagttgctctggttcacatgcctctgacaatgtcatatatagagtcagtacagcttcaggattaaaaagctagactccagagtcagacagacatggctgatatcaaatcttgcttccactgatcttgcccaactcacttgacaattttgtgccacaattttctcgttagtgaaatggaataatgattagccctttatcatagcatcaatttgaggaattaggaaatgcttgtaagacattggtaagtattcactagtgtgtgttaacaaatgatgtctattattgctattgttattaacaagatattctggctgtggactccatgtagttccagaacatttggtcacagactgaacatgtccaaaactgtagtctgttaaagcctagacttgggttagaaattgcattttccaaagaatttaaacattgcaggttgtactttccaaagatggctgctacaatagttcctatcccacatgctatgtgataatgtgaccttgccactccttccatgaggaggtggggtttatgttttctcccctttgaaactgggtaggcttgtgactacttcaaccaatagagtatggtagaagtgacactatgcgacttcagaggccaggtccaaaaatgctttcatttgttgcactgaaatactccttctgggagtcctgtctgattcccctggggctgccatgttatgaagaagccaacccacacagagaagccacagatgggtgctccgcttggcagtcttaacctttgagccttttcctctcaaacaccagatatgagtaagtcttcagataattccagctccagccattgatgattagtcttctcatctgagaccccagacctcatggcagagagaagccagccctaatgtctcctttccaattcccaataaatccttgaacataataaattcttgtttgaagccactaagcttttgggtaatttgttacatagcaaagaatacctgggatagaaattctccctggtctggccagttctcccatctatggattttccaacttttctcaatcaagtaattagcatttaccatggccttttaatgcaagtcactgtgctagaacagggataagccaacatagttaaacagaaatatacacaaggataaagaatacttaggaatcctatggtaagaactgtgtagcatagagtagtgcaggcaggactatggtgtaaacttaaaagaggctgagacaatctgggaaggcttcatggtaaagaggcttgcatagggccttggataagtggtactcggataaatagaaaagggagaaaatgaattcctggcaaaagtgtgaaaaaatgttttggaaaaaaaaaagatttaggcattgcctcttataattaatctgttaaagtcatatttgtcttgcaaaataatatttacaagaaagaatgcttttagatatatttctaattctaagagaatttacttagtactttatagaggttgagttatgtcagtggtgtcttaaattggactaatttccataggattgatcagcaaactttgcctcctatgtaaacataatttacaactttattagaacacacagaattttctttccttttttttttttgaaatggcgtctcgctctgtcgcccaggctggagtgcagtggtgtgatctcagctcactgcaagctctgcctcctgggttcacaccattctcctgcctcagcctcctgagcagctgggaccacactttttttttattattatattttaagttctggggtacatgtgcagaacgtgcaggtttgttagataggcatacacgtgccatggtggtttgctgaacccatcacccgtcatctacattaggtatttatcctgatgctatccctcccctagcccccaacccccagacaggccccagtgtgtgatgttcctctccctgtgtccatgtgttctcattgttcaactcccacttatgagtgagaacatgtggtgtttggttttctgttcctgtgttagtctgctgagaatgttggtttccagcttcatccatgtccctgcaaaggacatgaactcatccttttttatggctgcatagtattccatggtgtatatgtgccatgttttctttatgcagtctatcattgatgggcatttgggttggttccaagtctttgctattgtgaaccatgctgcaataaacatatatgtgcatgtttctttacagtagaacggtttataatcctttgggtatgtacccagtaatgggattgctgcatcaaatggtatttctggttctagatccttgaggaattgccacactgtcttccacaatggttgaactaatttacactcccaccaacagtgtaaaagcattcctatttctccacatcctctccagcatctgctatttcctgactttttaatgatcaccattctaactggcatgagatgttatctcattgtggttttgatttgcatttatctaatgaccagtgatgatgaggtttttttcatacgtttgttggccgcataaatgtcttcttttgagaagtgtctgctcatatccttcgcccagtttttgatggggttgtttgtttttttcttgtaaatttgtttaagttctttgtagattctagatattagccctttgtcagatggaaagattgcaaaaattttctcatattctgtaggttgcctgctcactctgatgatagtttcttttgctgtgcagaagctctttagtttaattagatcccatttgtaaattatgacttctgttgtcgttgcttttggtgttttagtcatgaagtctttgcccatgcctatatcctgaatggtattgcctaggttttcttctagggcttttatggttttaggtcttacgtttatgtctttaatccatcttgagttaatttttgtataaggtgtgaggaaggggtttggtttcagttttcttcatatggctagtcagttttcccaacaccatttattaaatagggaatcttttccccattgcttgtttttgtcaggtttgtcaaagatcagatggttgtagatgtgtggtgttatttctgaggcctctgttctagaacactcagaattttcaactaattccaacaaatataacgtcttataatagacattcgtcatctcaaagttacacatcggtagtctttagaactgttacatcaaaaaattcttgagaaagctctttgccctttttaggaaatatatttagataaatacccaaattttaatgacaagatatagcatagatatagctataacttacattttataaataacatataaatattcacaaaacaccttccttttaaaaaaacaaaaacaaaaagtaatggctaaaccaagcttttgcgttcttaaggtcctgtgacaacttttcattaagtaccgtagaaatgtgtgggcttgcattttttctttttctttttttttttttttaagatggagcttcgctcttgtcacccaggctgcagtgcaatggcatgatcttggctcactgcaacctctgcctcctgggttcaagtgattctcctgcctcagcctcctgagtagctgtgactacaggtgtatgccactacacctggataatgtttttgtatttttggtagcgacatggtttcaccattttggccaggctggtcttgaaatcctgacctcaggtgatccacccaccttggcctcccaaagtgttgggatgacagttgtgtgccaccacgcctggcctggacttgcattttaactataatttaaaattttttgcaaccggtttgaacataattagtggctggagtgtatcacttcttaaatagtgaattctgctgaatagctcaacttcctgctcatgcttacattggggcatcctatctccctttaagtcctcccttttgaccttagtccttctctttggatagcatagaataaggattctctttcctgtgtgacaagcattcaattgctcaagggcagcacctataccacctttgtgccttctcttttggctaacaattccatgtcttctcatatgaccatctttccagaaccttctttatctttattgttgtcttttaaatcgtttccagaatgtcattcttaaaatgttgcctagaacaaatgaatactctagctgttaataattgccttgattatcagatagtagatatttagcttgatctaagtctaaccattgggaagcgattcctttttttttttttaattttggaaaaagtgttttatgacaactaatttggtgatataaaaatgtccatcagcttggattctttgagaacatcccaaaatgtattggaaatccataatctctgtatccaaaggaatctttgaaactttggcatcatcctagatattaggtagattttcttgggaggatttttggctaaaatgagtcacttacctcttccttaatctagaatttttttttcaggtaatctagagtctctattatatatgtgtgatatatggtatacctgggtctgccgatagacagacaggccaagataggcctgcagtattatctttggttattccaatgccatagccactagccccatatggccatttacgtttgaagttaaaaacatttgaataaaattcaagtaaaaatttagttcctccattgcaccagccacatttaagtgctcagcagtcacatgtggctagtgactgctatattggtcagcacagatatagatcatttccctcattgctgaaaatcccattcctgccacctagataaaaatgtagaaaatgtgaaaatttctgaatatttaaaatggaaaataatatgatgaaaatggatattggcataggctaggcattaaaagcattaactattttattattttgtataatgcctagttcaatgttttacaagggaagcctattgaataagactttagctttgtagacaggccacctgagttcaggttctgccttcaccattttctgcgtgatcttaacctaggctttgtttccttaactataaaatagttttaatgaatttcttaagatgatcattaagctcgaatgaaataatgcttgtaaaagtatttagcacaatgtctgacacatataagttgttaatataaacataaggcattattgcaattatttggagaaatgtaattattagctccaaagtactaattgcagaatacgtgcataaacaccaacacaatataacactttattaaataaattggacttgttaaaaagcaaacagaaagcacagatacaacagcctgtgccacctaacttccaggagacacaggtgtagtgatctgggtgggtttccaaagccttcctcatttggtttggttggtaggggagcacaagcacttccttctcctacactattctgtgttgagggaatgcataaaccactgacaagtctccaagaacatcttcaccactcaggttcttagaagtgatgaaccaaaactccatctttgtatgtgtcaggggcccatatatcaagatgtatagggtcttagtactggtttgggcataattatactcagtgtttgggcctctgctaaaattctaagacgataagaatatcagtttaagttctgttacagttgttttcatgaagcttgtaagattgatatttaagtggacaaagtgggaagtagtcagttttcagggctccaggggtcatcactttgtgctcagagtacagctgtcaactagtgatttggtgcatttagacaaggaacaggagcaaagggcctatttcaagagggtcatagacactgccttgtgataagtgaatggctagagggtttcttggtaaactgaagtccttttcacatttttagctttttctgtggcaacctgtcttttacagaagctactcatgaactctggcttttcattttcagggttgggctggacattctttgtttttttgttttgttttgttttctgagacagagtctctctccatcacccaggctggagtgcagtggcgtgatctcagctcactgcaatctctgtctctcgggttcaagtgattctcctgcctcagcctcccgagtagttgggactacagtttcatgctaccacgcccaggtaatttttgtaattttaatagagacagggttttgccatgttggccaggctggtctcgaactcctgacctcaagtgatccacctgccttggtctcccagaatgctaggattacaggagtgagccaccgcgcccggccttggacattcatttctgattcactgatcacactgtgtattaaaagaaatgttggtccagtgacaaagaaaaacgacctattctattcctcgccatcacatagctatttggagtaaagtattccaaagtaatgctttactgttcactgtctgtgagaatgatgccatgccccactgtccttgattaaccatttatcatttctcagagatacagagttaggtgacccttcaaattaatgacattctgttcacacataaaattacctcccagttcttgatctgctttcttaatgcccttctgactggctagaaacacttagaattgggcattaagattgaagaatttacttataattatttgaaaatcatataaagagagatggcaattctttttctaggtaggaagcctattggaaatgatgatggtaagcatactggtgatgagaaagcaagcccagaacattcctagaagcatgtgggaacacttggtatctcccgcaaccctctgcttcaaataaacaactagcttttcttggacctatggataagactgttctttaggaatgaactagggagcagctatctgaataagtgatttaatgatgttacgctgttggagtatattccctatctgttgactcgtgccaaagatgccattaataaagctttattcttttgattcttattaaaatacaaagttctcaggatctcaatttccttaccttttaacttgatcattttagaatagatagtctataaaagtggctttaattctgaagtatacatttttttaaagcactcctggaattatttcaggctgtaatcagttaaaatgatcatttagtatatgtttgttattgaatgaatgcatttacatcttactgcaaataaattatacgtccatacttaaaatcaggctttactacagagcaaggaaagagtctataaaagatctaattcttctccaggaatccaataaatatatcttgacagattattttggataagacaccatttcagtactaggttgcttagtagtaatacaagttgcagatggtgtctgcaacttggagactaagaacaaaaaagacaagcttaggccagcgcagtagttcatgcctgtaatcccagcactttgggaggccgaagtgagtggatcacttgaggtcaggagttctagactaccttggtcaacatggtgaaaccccgtctctactaaaaatacaaaaattagctgtacatgtttgtgcatgcctatagtctcagctcctggggaggctgaggcaggagaattgctagaacccgggaggtggaggttgcagtgattcgagatcatgccactgcactccagcctgggtgacagagtgagataccattgcaaaaaaaaaaaaaaaaaaaaaaaaaaagacaagctttacccacttcatagtttttctcgaactcctgacctcaagtgatccacctgccttggcctcccagagtgctgggattacaggcatgagccaccgtacccagccaaataaatatgtgtgttaattagccttgatatatattagccttatttctctttgattatatttaatacctagatcatctatatctggttgcataatgtagcctgaataaaaggaaagaggaaatatgaaaaaaatagcatctattgagggtttaatatagtgctaatcacctcatatagacattttcatgtaatcatcgtagttactctatcaaatagatactattattatatcttttatagataaggaaacagaggctcaaagaagtaatgtaacctgcccaaagtcacatacctagagccagtattatgatattagatggtcttactctagaaccaatagcttaaccattactctagaggaaaaatcattcattgggtgcatatcatatgagctgcaatgttacctaactcacacagagaagagagtcatttcttttcaagaaactgcaggtgatatttacagttccaagaatagtttaggtaaattttgaatgacagagtttcatttggcttcttagcaaggtaatcttttaattttggaagggctttttggaaagcagttcccagagatgatcctggagtggtcctggtaagattaacctgtgttcaagtcttggttctgttgctcaaatgtatgcacatttgggtagcattctattttattcctttatctataaaatgggaccaatgctcatggaggtgtggtgattaatagagttaatatatatactcagtggcctataaaagcatggtgcaaataagtagattcaatagtagtatagagataatcaagagaagccattgtcatattttcacttcttagtacaatgacacatctagtttgtatatctggactacattaggattatcagatctttgaccaaataagatgcttgataaaagtttaaacatgaattaaaagattgatcaaagaccatggacaggctatttctggagaaggctaagatctaatccttctctagcaatccaataaatatatcttgacagattattttggataagacaccattttagtactaggttgcttagtagtaatacagagatggcctctgcatctttgcagaataactagctcagaaaaagtctttccagagctgagatttcaaggtttccatctcaaaagcctacttcattctggattgcgctcagccatcattctttccagttcaccttcagctccaaaagctcacagcagcattatttcacagtgggctttccattatgtgccgactgcacttgatcctggagaagagcactttccaggacttttcctagagtcctagcaatacaggtcatcaaaaacaaggtctgattttccaaagtcaatatttaggaatactttttgctcttggtcacttcaaaaatccaccaggtaactataatggttaaaattattcctttttcctagtaaggaaccctttttgagattggatctttatgcatattttgcagagagtgtctaagggagactcaactaagctccatagctgctatgattgtgaatagttatgagactattgacatgaattagtgatgcattcccacagcccttcactcctttatggttgaatttcagtggatgcctgggggctcttctgccttaagagatcctgtgtcagagccctaggatttctcatcagtcaaaacaccttcaaagtttgaactaaattcacacaaaattaaatgctgcctactggaactataattggttatgacgtgtcttctctgcagtgattcttgacagctttgaacgactttatgtcattaccttctgaggctttgcaaaccaaatgtatcatttgtacaaagcaatgccagggcttggttgccttaaacattcagaagcaactaactgatactagactcttgacttctagtacataatggatcattatgcaatctacaatgaagcccagagtgcaaaatataaatttgagcttttaagatgaaaattaggcacacaggttttctagagagaaaagtatttaggatctacttattggcatctcagacatgaatccatctgtttgctgagtgcgttgctctccactgtggtgccttggcatttgcttcacatgtttcttctgatgtgcaaaccaagcagtaatagcataatattgatctccatttttttttatacacctaggagtgaactcttccattcatttaccatttttgcaagcctataattacaatgctttgatatttggtaaagtaaatggtgcagcagaaattatatgttaatggtttcccatgatttaaatatttaatattctaggttttctatacttgaatgagattacatgagaatattctatttcttttaaaaatctttgtgtaatagtgtaaaatttctttttgttcttggctaagttagttaatgtctcatatatttgatgaaacctaattctaagagtggtggaatttttgatacctctcctttatttccaagacaggcaatattacatagtaattaagaatgtgaactccatactggagtttgaatattggctttaccacttaataatgatgtgacctcattaataaaatgggaaaaatgataatacttacctcccagagttcatttgttctataaacacttgttgaacaccttctgtgtgcctgtgtcagaaaatttgctaaccacccagaatacaaaagtgaacaataccacgtggtcactgcctttctgggatttgcagtcttacatgggaatgttgtcttctgattaccagttcacttggctttattctaaatttagtactgaatttacatttgttgaattatttagtctctgataatcgataacaaatttgactaaatgaatatgaatatactaatttatttacacaatgggttgggaaatttataatgtataaatattaaatttaaaaggacacaaagttcaaagcatgatgtgggccattaaataaaaacaaaccaataagcaaacaaaggacggaaagagaaatgaatgtcataggcaggagagtagataaaatgtaagagagacttgtatggggtattatgagtgagatgaattttcaatttaatatacagaaaaattatgaagaaagcattcaaaagtgttgaggtctatgttatcatggcaaaattaaaagcaaatattcttctgaccttaagaggctgaaattaaaagaaaacttcagtagtcaagaacacagagaatctaaaagtaaatcttttcattttaagcaacatatttgaaaacaaaggaatggaaatatctgtttgatgaaggaaaaaattataataaagtaagcattccacaaattcagttgtttcatacatttgcagttaaagaatattaatcattaaaacaattttatacagctctttaagctatcaaaactcttcccctttctcccagtctggtctccaccaaataagctgaatgatataaaggtggtccctgaattct

SEQ ID NO: 707 - DNA, 2186 bp, Homo Sapiens
cactatcatggagggaggatgggtttgtagagtgtcttaggatcaaagcctgacactatgtgtcattgtgtgtcactgagcccctcaatatatccactggggtttgatcgaaaaggaagagccactatgagtgatatagaatgaagacatttgggggaattagaccttacacaattgtgggagctgattcaacagtctgcccaatgcagctgttgccatgtccagtgttggtcctaagtcagtagagccagcagttggaaaggagagatgagtgtgaagagggggagagtaagactagattagaacccatgaagacaaactgggaccctggaggacaaactggaactcacatttgtctcactctctttcagtgatgcaagtgacctgcaggattcactggtgccccacagagctgcacaagctggcccaggatttggagaagcagaagattcgacaacttggaggtccttgggctaaatggaggagaagggtatacagagctgagagccaaggaagccgatgaggaattgcacttgggtgtggagaacaaaactacgtggccattgattgactcaggagctctgctggaggtgcccttggctccctgcatcttaatcctggcctgagaatggtcagtctacttgagggccagtaatacgatcttaaaccttcatgacttacgcctcagagacctagtgccgcacttgacccacaagaggactcttgaacaccagctgtaacatccaccccttttgcttctgttgcctcttctgggagccctgacgggaaaacccagtgaggttgaggatacaggggtttgtgggagacctccgtctctggaacgaatcccccactcctccatcatgcccaccacactggctgcttgatttctctgccacactctagcttttctctctgaaaaacaacttgccagtaacacagcaagaaggctcagggctctgaactattgtgtgcatcccaggtggactcagtccccagatggaagaaggacaagtctccatctcagagacagggagtgggaaggtaactggaattttacctgtgcaaagtgccctacatccaggtgatatttcatcctgctctgttccttcgtaaaggtctccagcgagcagaagggttccatgagccttactcctctggtcccaggccttgccaggcacatgttgcttttccctgggagtagggctgggcactcctgcctccccatgcccatcagccatggggttccctttaaaggctctggattgagcacagtcacctctaatgggaccatggaggaccagcccagcaacctagagctgcttcccaggctgcctgggaatcatttcattttctatttgcagaatcacagatgttgacttttgatctcttcctctctcccttgggggcctcaaatcagtgatgacagctatttcatttctttttaattttttttcttttccctataaagagaaaaggtcagaaagggctcagaaaggttttgaaaatattggaagagctacatactggctactggaatgcaaaagaaaagctctagccctctctatggaaagctcatggcaatgaccaggcagaggctggggtgggcactctttaaggcagtaatgttaacctttagtgtgtctgtaaatcattcaggagtcttgttattaatacaatgcaaattcagattcaataggtctaatgcactcccaggcaaggtccatgctgccagcccagaaccatgcttagaggaacaggtgctgagtttcttcctcacctccaccttgccccagtcctgaatcctgcaatctgtaaatgctccctgctatcttcatgcagttgagtcttaacaggcaagaagccagccaagcgagaatctctcagcagacactttaatcaaattaaaacccacatttagatttttatcacttttgatcatttaaacagaagaactttcagatatatatagatttccaaagaagggatcacaagaggacactcaggtgaggggtggggagttggtggcagtgttgggggggctttcttctctcaccccattctatcccctttgacttattcatttcttttaaatagcatttggctcaactattatgatcttatgctgaaccttttgccatcccatgaatgggcaagcctctgtatacccagtgaaaattaccttt

SEQ ID NO: 708 - DNA, 1963 bp, Homo Sapiens
cttattaaaaatagaatattgcctacatcacataaagggcaaactccgccctcacttggtcacagaagcaattacagcattgtctgtagtacacagcccacggcctctaaccacagtgatgggcacacttggtgatgtgcaactcagtggggcctacagggtcccagctgacatagacatcacaaaggaatttgaaccaggactcagaaatagggtctctgggtgctttaaaaaagctgtttaagagaaaaagcagaaagactgtagtgattgtcaagtgcaaggagttctgcattccagacaaacaaatgcagtgtgcagacaacagacagagcggcaagggaaccccctcagcacaaggggacggcggcagataggcaaaaaggtaattactacatgtctgcctttcatgaaaggcagccaccctccttggtgtggcttggaacttcaattctggctaccaggatacagaggtggaggaagagaaggctgaacaccacccccgtctcccaacacacaccctcgaggcaagaaagatatcaagttctcattttgttgcaagaaaactacattctccttttgataataagcaaaaaaatacttctacatttttcaaatagtacctggtcggaactgttccaaacccagagaaaaaagcaataaacactgaaatcccctggcggtctctgagttgaagatgtaggcaggaagtattccatatcttcaaggtttttagggagaagcaagaaaacggtagaggaagggtagaggaggcctcccaggaggcctgggagtgaagtgtacccatcctatgaaagctggaacctttaggaaacagaatcaggagaatgctgactttaaatttaaattaccttgctgaaaaggattggcccaacacaggacaagcagcagtctttggaatgaatgcatcttttactgacctatgcctctctttcagaggtcacggctgtcttcaccctcttctttgcatgtatctcaagcctatgtaattaacaccaatatttttactcacatctgagaaaggagaccaagggcatcaaaagacatggcagtgctgggacttggcttcagaaatgcactttgctcaaggaaattctctgagccgccagtacaaacagttagagacggtgatgcacttcaaaagttatagcagaaaatagagatgagccagtaagataactgcataattgcaccctataggagaagatccttaaggggaaaatgatggacccccatagatacagaacagctaaggcatcatgctgcaagacatcccagcaatgaaaactgaagaagagaatggcactagcctgcaatggtcaagaagggaaggaagtgttcacccaagcgtgaggctgaggagttggagcacagaaggtgacactgattatgaagatttcccaacaaagagctggctacagtgaaaagagccctagttttcaactttcattttatctcacctacattgtctatgctgacccacacatcaagcttcagaagtagatcctggatgcctattttttaggaaaataagttcaaagttacagcttacgcaagtgcagttcttcaatgtccatgctctttgcactaccctgggcttacaccaggaattcagataagcatggactgtctgcttatgtgcagggatgtactggtctcaagtcagttaccatctgaaagctaaaaaaagggagtcaaaaggaccacaaagatgaagccacttctgacaccaaaggaaatgtgtcttctgctcacctttgtaggggccaggaaagaaaatgtaccccaagtacagatccataatttggggccagagtctcatttgacccctgtgagattcttcatgatccactctaaagctttaagccaccaaattcgatgtatttataagggagtcaaaccacatcacatgtgcaagttcaaagaatctgatgttcgaatc

SEQ ID NO: 709 - DNA, 1251 bp, Homo Sapiens
cacaaagctaagttttgaatactctgtgtcactgcttccagctgatattataaaaggcagtggtgaggatttcagctaaaaaaagattcgttgtttcaaaagcccagcctgaagtaagacagtgccatagacacgaccacaccagagggcaggtggttcacaaagggccttgcattcttctttgctcttgtttactttacatgagggcaaggagtctcagaagcgtaagatataatactacactagacaggcaagcagacctaatgtgcaaagtctcatgttggctatataggtagtttatatgtcagttccaattatgaatacattcctcagcaactagagttttctcattcattcttactgaactgttagggcatgtggcagcccagagctctgtcaaaatgaattgtcccccttgaaaagttggcaatgcaaggaagtgacaacctaatgcatgttagcactcttgataacaggacccagaggagacggcgaagcaacaattggatatgtgtctgggcactggctgttgttcctgcctgggttcaaatctcctctctgccgcttatgatctgtgtgcatttacaagtttgttagcccccttacctctttgttccttataaggttgtcgtgcaaattacatgaaatgatgttacaggtgtaagccaatgcctgacacacatatgtattctacagtaatcattatcaaagtggtaagcaggaaccagtgccatttcacaactatcaggtactcttctgggtactcatcatgaaagactgcagtgttccatttacaggcattggttggtggtttactaaagagtgtgtttttgtccaagaagttcactcactacattttgctcaaccagtcctctcatttgcagcgatttttttttctttgagcgtcccttgttgtgcagcataaacatctgggctgcatggtcagacccatgaggcttctcttccatctggccacctgttatataattaagcctgattgcagatgcgattctcatttagctgtcagcagcagcctgggagactagcaactgaggtgaataaaggtagctcaccacatctacaagggtagaagggctgaagcgaagggttgaccagccaggacaacaaaggttattgcttatggcagtgtcagcctaagagctcaagttcaagatcagaagcatgagagggtaagacctctaggggagtctgcataggtccaggtgaaaccctgggtgtctcttgattgtc

SEQ ID NO: 710 - DNA, 4104 bp, Homo Sapiens
agaagcaataggagatatatctcttattacattaagtctcctattgcttctgtttctctggagaactctaatacataaaagattatgattagaattatgcttgaagaaggttaatcttataatggcatgcagagcggagctgggcaaggccagaggctaaatatggagccagaaagatactgcagaaagtgagcaaaaaggatgagtggatggcctggggtggaatccgtgaaaaagggcagattgtcagtctcaggaaatcaacaggactgagttctaacttcagctgggctactatgccctggggaaaaatgcaatagacaaaggagaaacagccagagaccttgaccaacagaactatattaaaccagtaaaacaaaaagtattccatgtgtgctccagtaagaaagaagaaaggaaggctcaacatttctatcatgaggacttcttccagcagagaggctccacaggagacctttcattgaccttcactgagaaataccgaatatgtcatgactttcttcaactccacctcttcagtccatgctatcagttgaggtttatgagagctgagctatcatttctaaagacagaggaatttgttccaaaaatatctggctttccacccccaccttcatttataaaacaaaccatctaagtctttcaggctatttttccaccagcttgtttataatgtggtaatgattatgctaataccagttgggaatacattctatgtggacatgttgtgggaatgtgattggagtgtgtgggggagaggagagggctgtataagtgcatgaggagagctattctataaaattatagtacatgccctctttccatatttactagtttttgtaagctccttctcaaatgggaaatagaccatgcttcctttccagaaggatagttattgaataacgaacaccatgtgttctgctatgtcttatttgtctgagcactctgcagctattttctaaaccaaattaataacagtatactaaactgatttccctagtgaaaactgctggctactaccaatgtcagtatgtacaccccactgctccccaaagcttaggtaatcactgcataaccaaagtctacaacagccccagagtgggggcaaggcagctttcatggtacacaagggaaaattgacagcctctaattaaatgagactgtttacacaagcgatagagtattacaacactttccctacaaaaagaagagaatgtgaaatttcagaaaagacagatttaatgtggaacttgtcaccaccgtcagcttcggcatgataaaatgcacatggaaagtcccttgcagcaagcccgctgcaaagaagattcttccttcgtctgggtcagagggtgtggatgtctctaaagaaaatgctacctctcctttgctcacacacccacttgcggcacagtgagctttccacagcatatatgggatctgtgggctgaatgctggagacacaggggccagagcctggcagtgaagactcctgggttatggaggaaaaaggaagtatctcctttctacaaattaagaaaatgcacatccacatgacagcttaacacaggacaccgggtgtgtacagaaactgccctaaaaaaaaaaaaaaaaacctcccaccttcacccaagccaagaatcagaagattctccctaacattggagtccaaagaagaggagccaccatctccttaactacaaaacaactgagagaagaaatgtctccctttagtgccagtgaagagttttgcttctctagaacaactgtttatttttgatcttatgaaacgcgtgacacttgtaactgatttgccttctttttgcttgctgctagaaatctcagaaccaaattcgaggtcatttctgaatgtgctggactacacagcatgaattctgtgtcctctcacctcattcatagatacatttttttattcctacccatcttttcctttccccagattttcctattgctcttttatcatcttgagtaaagaaggttaaactatgaataaaaagtacaatctcaatgacgagtcagggaaaagtaagttttggacttccatttagagccatttataggtcagcaatcttttgtctctgtgtcttctttctgccctgaacaaccaaggcatcctagtcagtctctcttcatctgcataccactttaaagagcccaggggtcttccaagtacagtcactactaagaaaatgtcttcagtaaattttttttttttttttttgagatggagtctcgctctgtcgcccaggctggaatgtagtggcacgatctcagctcactgcaagctctgcctcccgggttcacgccatcctcctgcctcagcctcccaagtagctgagactacaggcacctgccaccatgcccggctaattttttttgtatttttagtagagacggggtttcactgtattagccaggatggtcttaatctcctgacctcatgatccgcccgcctcggcctcccaaagtgctgggattacaggcgtgagcccccgcgcccagccttcagtaaaattttaatgcatgttgcttatcattctttgtattgtaagcaccaatccttaatctgtgctgtggtttttgttcagaaacatttctttaaaaaaatttccccagacgctcagccttcatattctaatctttattattctgaactacctacaaagctaaatataccttgtctacatgcagtgcttatgtaacaatggtgcttattttgttttacattgcttcaacctctgaccagaaacttagaggacagaatgccctgcttttacaaaaaatgtggtgaccacaacggtaaccttatctaattgagaccattttaggaaggaggggaggagatatttttactgcaaagactgagtcataagccttcattttttaccctgggttgtgcagaaactttaaactttctatattatttcatttcttccataccaggacatttatttcctattcagtgacaatcttgatgtcttcatccttcaaactgctctctaacatagtttcaaaatccaagcattaaacattattaatgctcaggggatgaatatgttcattacctttactgtagtgatgatttcctatggcaaaatgttaaatgatgtaaagataaaaataattatcatagttattaatcatagcaataaaactggactacctaaagcacagtttatggtataatatttatgaattaagagcaacacaaataataatgttaattgctcacctacagatgaatgcaaatgaggatataacagagtcgaaataaactaagcaaaggaaacaatgtttcatagctatcgtgttcattattctaaccaaaaaaaagaacacagaaatcagatatatgcaatagggtacactgaaatgattctcaatgattatataaaacatatatacattattttctcaacttcctgaaacatcaattctcttgctcataatgtagttaaatcgtctaagattagcctcatgtgaccatgtttggacttcttaaaaaaatcgcttcaggaacattacattttcatgatcagatagtttcctgaaagtattaaacaaaactaggaaaagtgtttaatagttatttggattacatttcattaaaaatctttacgatctctgttaacagtccagtacatttgaatgttaaggaggaccctgcactgaaggttttataatgctttatctattccaagttatacaacacaaaaattttctcaaacaagcacatgtgactttgcctacatctgcatttaagattctaatgtacatttttttattcttttgtttaaattattaactatcaacactagaattgagcatggtatgtattcagaattatgttcaagtaattagtggctattttgttaataaagatgaagcttcaattgtagatttgataattttaccctaaaatttttaaatatataaaaaatagcattttttaaaactataatggtaaggcaaaatgttctcatcagattcggtgggcagatgggacagggaacacagctttcctgaacctggaactcacagttctgccacgcagctatagcaaaa

SEQ ID NO: 711 - DNA, 1165 bp, Homo Sapiens
gagccaagatcgcgccactgccttccagcctgggcgacagagcgaaactccgtctcaaaaacaaacaaaaaccccaaaacacaaaaagacataaaaactatttggataactctagcatttacccaagatgttaaggaatctaaaagggagttcttaaagacaatagatgagacaaagccatttccagtgtcggcccatttaataaactggttccacctggattttctcttcattgtggtgaaagccaccacctaacaatgctggccctgcctgcatcatcgcatgtcatcatgacaacctatgggggagaacagctccattcaacagatgcagaaactgcaggttaaagggtgaaaagcagttgcgaagtccccacagcttggaaatggtggagccgagactgaaacccaggtgtgctagcatctaaagttcatgctctttccaccacattagactgtattctgagggcaccaaggaagctccatttttcttaagaaaccaaattgcagtcctccaggaccacagccaggggagcatcttcgtgggagagtggctgctgctcagagttgtgactcccatccttaagagtcctctgtcctctctggcctcctttctactgatcattgctgtccccttcacaggggagaggggccatggcctatcccctaaagagtctgccaaggtagactcataacctccccgtggcacagctcagacaagctgggctatttacataagacttgacccagggcttgaggacagcgcgaggaatgaggtgcagaggagactgctgcttctgggtgacagtctgcctggctgaccacagctggggtactcattggcctcttgaggccccccacaggcctgccctgcctgacctactcttgtgaggccaaggccatctcctccactctctgggggcctcttctgactcctccaaactcttccatgtctggactcctggcttctgcccaaggccatctattggagtttgggtttccagttgaggatctgcctttttcctggatgaccaaacctagaatgtgaccggcctcatgctccctcctcacaagggtgtggctttatccgagggcctcagcaaggcaaccaacaccagacatgaagctggtctctctgtgcctgctttactgcccttcgctttcct

SEQ ID NO: 712 - DNA, 1761 bp, Homo Sapiens
tctgtataaaaattgtattaaatgctaatatacaaaatgaagaccttagtatagttacatagcagatttctacactgagaaagcaaagttcagccttgtgtctccccagcataatctttagtagcccttcacagactgtaaagacggcctttctcttttgctctgttgatacttctcttatttgggtaaatgatctaggggaagagaaggagcagttttatagctattgtagctcctgggtgttttgaatcacttcctacttttgatctgttacttctgttcacttccagtctagaattcccttagtaggttggataagttaagggccttatgacatggtaaactggttcgtatgtgtcaaggtctgtgtgtacagtcattttggggaaagaattatgccgaagcacaataacacatttcttagctggaatgctgagaagctagggaattctgattaactggttagtcacgattcagctagactcttttagtttcatctccattgttgaaaaatttatctaaaatataccagtctattttcttttctttttctttttctttttctttttttttttttttttgagacagggtctcactctgttgctcagactggagtgcagcggcttcatcatggctcactgcagtcttgacctcccaggactcaggtgatcctcccacctcagcctcccatgtagcaaggactgcaggtgcgcacttccatgcctagccaattttttatattttttgtagagacagggtttcaccatgttgcccaggctggtttcaaactcctgagctcaagtgatctgctcatgttggcctcccaaagtgctgggattataggcgtgatgaaactctttttttatgtgttaaagatattagctctttcttaatgatgaaggcttttgcagagttttatttattatgtttttttttttgagacagagtctccctttgttgcccaagctggagtgcagtggggcgatcttggctcactgcaacctctgcctcctgggttcaagcgattctcttgcctcagcctcccgagtaactgagattacaggtgggtgccaccacgcccagctaattttttgtatttttagtagagagggggttttgtcatgttggccaggctggtcttgaactcctgacctcaagtgatccgcccgccttggcctcccaaagtgctgggattataggcgtgagccaccgcaccctgccttgcagggttttagtcgtgattttttttttttttttctggttgttgtcttttttttagcgacacggtcttgctcttttgcctagcttggagtgcagtggcatgatcatagctcactgtaaccttgaactcctgggctgaagcagtcctctcacctcagcctcccaagtagttaggactacaggtgtgtgccactgctcctggctaattaaaaaatatatatatattttgtagaaaggtggtcttactatgttgcccaggctggtcttgaactcctggggtcaagtgatcctctgccttggcttttcaaagcgctgagattacaaacgtgagccactgcacctagccctttaaaaaaaaaaatgttgttactagatagaattataattctaggtgtcatgttaccgtcaggcttttccctaatacagagatttttgggggcactgagggtgaagggaattgtttttgttttataagcctaataaatggtaggcttttggctatttttgtgcgtgaatgtatatacacacaccaaaagaagc

SEQ ID NO: 713 - DNA, 2148 bp, Homo Sapiens
aaagaggagcctgctggtctgctggcgggcaggcggcgctgggccggagcctctccctccggtgcgcacagcgcaccctctcctcccccggccgcccgtcgcagcgcggagagggcgtgtcggcaccctgcctggcgagcgcccacccctacaatggctgcgagcgcgcgggacggagggtgcaccgccgctccccggggacttgcacgggtggcgcgcctagcccagagcccgcttgtagtgagcgctcagtagggcgggaaagctgctgccgctactgcggccttctgagaagacgcccattctctgatgtcaggactgcatcgccgagtcctgattgcaaatagcgaaatatataattaaggagagttcgggggcgtatcctgcaatgggatgccgagttcgataaagttgcaggatgctgggaaagtggattgatttgctgttgctaaatgaatggaaacagcgttagagcttctgtccacgatccatcagtctatcgagattgctgattgcctatgacttggacggttgatggttttcaggcccactgagagcagccagcgttggtataaccgcagggagccctcctgggaggttgaacctgcagagcgcaaatgtgcccaggttgatttggggcctagtggtccattttcacagctccactgcctatctgcataaccaggagccctcattcagatgaacgccaaatgggccagagggaggagaatcaaatgagcaacttttaaaagatattaagacataggcacctaactccggacagttcctttaacccttgagctaaccatttgaagcacaaaacataacaaaagaaaagactggggggagtggggccaaaagaaaccaagtgcaaaattctgtacacttgtgtcagattcactccgtaatgggaaaaggtctggctttgaaaactttatggatcaaagggatgcatggagttacacagcacagctgcagaagataatgttcccctggatcactctgcccaactcttaactgcaacccaccttccccatccgtctccccgaaatcacccggaagggtgttaccttcaggaagtaactgatctcttgatcacccctgctggatcctgtccccaagggcgttcgaatgcatccgactcatcttcaccttgccaataacgggtgcttgacacatcgtttgctgccaatcattattgtgattttaatactattggtattctaactatcaagatgactgcttgtagagccagattgcctggattcaaactccagttcacaacctactaactgtatgcctttaggtaaactcagatgcctctgatggattcgaaataaccagatatatttctgaattgcttcatatgatgaagaaactgaggcacagaaggtgggtcaggagggaggaagcaaaagagctagaattcaaacatagcagcatgacttcgagcccactgtcttaaccacttcagataactgcctctaatgcaaagacccctctcgaaggtcagaagtttcacaaacactgccttaagtctcatggctaactgggaggccccacagagcaacgtggctgtgcattagactcacctgaggagcttttaaaacatacctaagcttggctaggcacggtggctcacatgtataatccaagcactttgggaagctgaggtgggaggatcacctgagcctaggagctcaagaccagcctgggcaacatagtgggaccgcatctgtacaaaaaattagacagctgtgatggcatgtgcctacagtcccagctactcaggaggctgaggtgagaggatcgcttgagtgcaggatgtcaagtctgcagtgagatgtgttcacaccattgcattccagcctggatgacagaacgagaacttgtctcaattaaaaaacaaaacaaaacaaacaaaaaaaaaacaaaacccaagcttgaagcaaataccataatggggtaacatttgggaaatctaatgaaggggaaatgagatatctttgtactattcttgcaacatttctataagtctgaaattatgtcaaaataaaaaattaaaagaaaaaagaatgaattagaataatattcattgacctggagggatttctgcagaaattattgtcttcatagtaagatccagaa

SEQ ID NO: 714 - DNA, 2337 bp, Homo Sapiens
agtttcccagcgcaccacgccggattccgggcgtcggcgtacaggatcccagagaaggcttcccgccggagcagcggtcgcgggcggttcacctggctgcgcaggggtcccagatattcagagaagagctgaggctcagcctgtcctgccctctggattaattgccctggttgatcacgtttccttgggttctggatctgctcctccagcccccatattttggaaacaagtgtcatttagaatagggggtgggaggccgggcacagtggctcacgcctgtaatcccagcactttgagaggccgaggcggacggatcatgagatcaggagttcgagaccagcctgaccaacatggtgaaacccactctctactaaaaatacaaaaattagccggacgtggtggcgcgcgcctccatctcaaaaaaaaaaaaaattgggggatggggaggtgtgggttgcgggaggtgtgggttgcagttgtgttttcaaagcaatgtttactatctggccgggcgcagtggctcatgcctgtaatcccagtactttgggagaccgggtggatcatgaggtcaggagttccagaccagcctaaccaacatggtgaaaccgcgtctctactaaaaatacaaaaactagccggctgtggtggcacgcgcctgtaatcccagctactcaggaggctgaggcaggagaatcgcttgaacccgggaggcggaggttgcagtgagaccggatcgctctccactgggcgacagatttgaatctacgctgtgcccatcttgcagatgaagatttccccaagccgttacagatggttccctacccattccagagctgctaattataaccaccagcttcaggcggtaggctgagacctttattgttttgtgtcatttagtcatcagtaaaccccatggaataaagcaaagtatgtctgctctacaaatgagaaaattgaggcccagagagactgcccaaggtccctcacagtaaaagaatgtctgaggattcaaacccatatcattttgatgccacaaagccagtgtgcccttgaccctccatcgcccaggaccttaaaatttcctgacagtgactggcattctccctgcgggttgtgaacaggaaactgcatttcagggatggacggtggcgggagcagtcgctctcgggagcctctccttcccctggctgtgggaccctagaggctggtgtccgctgagctggaaactggacttctgcccagatctttgaacgaccccacggtccagcggcagctgtggctggggtctatcccagagtccattgcccctctctgggttaaaaggatagcccacctggttgcagagattgaaaggactaattgtgaaaatgcttttcaaaggagaaagtgtaatatgcaaataccaaatattacactatatttcaaggactcattttaatactttatactctgttaactaaatgcattataatattccttccattgttggaggaaaaatctggttgctcattgtctttcatttcatgtcttcaaaactagtatcttaatcagtaatgctttccttcataatagattgtgttcatatgtattctctcttcccttcaaatttcctatctactcactttgaaaggaaatttctgaaattcatttctatgcatttccctcctcactttttttctgcacaaagttcaaaactatattataggtgaaaaaataaaaccaagaaatgaagggaaggttgaactatgaaatcaacatagcattgtgatctcccaacgctgatatacccagagtgaacaatttgccttgctacagaaaattagtcacagacttgttgcagctgaagtgagcaggatcatgaagttccttttgtttgttgaatatgttattaagtcttcctcggttttaataatgttgaactgtttttttattactcctattatgttttgctgggcatttgtttaaagataatacatcagttttgtaaccttgtagcaatataagttattgatgataaatactccccttctttctttctgcaggaataatattttcactgcagctttggggtcatgcctaaaagtggcttgaaccaaattgaaatagcaatttgaaaaaaccccagatcaatctaaaatgttatttttttaaccaaagcatgttcaagatttgaaaatgtatcctctattttcaaaagtatacatataatttatcctagaacttaatattactgaacatagataacctcagaccacccaaatattctccaaagcaaatcttaatcatacctttaattaatttaatcgcaatttctgattcactttttttttttttttt

SEQ ID NO: 715 - DNA, 3877 bp, Homo Sapiens
aagttgcaaaaacagcacagtagtttccaatatatacccctcacccagcttccacaaaaccacgggccgatgattaaaacctggaaattaacaatgatcctgtcctattaatagactgcactaaaatctcaccagttgctccactcgtgttttttccttgtctagatcttactcacatttaggtgtcatgtcttgtttgtcttccccagtctgggatggtccccagtctttttctgtctgtcattactgtgatgctttggaagaactcaggccagtggctttgtggcacatctctccttttgggtttccctgatggtttctcaggattagttggaggttctgcattcttggcaggacccccatggagtgatgctgtgtcctgagtatttcatcatgtggatgtgtcctcatacaggtgacattaactctgatcgcttggttaaggtgctgtctgccaggtttctgcactggaaaggtactatttttttttttttttttggtcaaaggagcagggtataaaaggcagggcatgaaatctgagagcaggcatgcatcaggaattaggaaccaggaactgggagctgaggctgctgctctctgaggaaaaggagactttcaagaagatttaaaaagaatggagaaagaagattcaagaagatgaagatgtcaaatgcctcattgcaaaatatagattggaaagtgttcctttaatttggcattttgtgggtcatttgtgattttggtaaattatgcaatgtgaaaaaatagacagtttctttcaaatggcaagcaattaaagaaaaaaaagtcataagtgtgggctgtagcaacagtgaggctcttattgttgtcattgtctgacagaaatctgaactctgatcccacaaatttctctgctcccttttccctgctcactttgaactgaagaacctctttactccttccttcctttccctccctcttatctccttgcctccctgtagattccatcacagcttcctccatccttttttttcaattatactttaagttctagggtacatgtgcacaacttgcaggtttgttacatatgtatacatgtgccatgttggtgtgctgcacccattaactcgtcatttacattaggtatatctcctaatgctatccctccctccaccgcacaacaggccccagtgtttgatgttccccttcctgtgtccatgtgttctcattgttcaggattacaggcgtgagccaccgcgcccggcccctgactttttaatgatcgccattctaactggcatgagatggtatctcattggggaacatcttaaaagaaaagcatataattgccatttgcacttcctcacctctttatccactcttcagcctactgcaaattgacttttgacctctttaatctactgaaatggctcatgcaaagagactttttataaaaatcacatataatttagattttttattttctgcataaatctctttaattttatgtgataatacagtgcatgattatttgttgagccgttaattttgtattagccaaagagaaagttgaacctgtcagttaaactgggtggaataagaaataatattttaaaattagcagtaaatagaaacttgcacaataaaaatatttttgtgtcacttgaaatattaccattggttgcaagttttaaagatgtaaaaggtgtcttctttcacgttcactttttttttcagtagagatactgactgcaggcagcttgcctcttttgtttttttggcttatagtcacagtatttgagcacaaatttaatgaagcattgtttaattgagacttccctgtagtgacacaacaatattgcaaatttttttcataggcatttcctcacttaattctcaaacaagttttgtcttttttttttcatcacgatatctgtagacaggatcaaacaacttttgaagggtatttgatttccccctatttacagatttaagaaactgaaactcaaaagagacaaattgccacattcatcctgccacagggtgtgtgtgtgtgtgtgtgtgtgtgtgtgtgtgtgtgtgtgtgtgtgtgtgttttctgactctaaacgtagagcagtttctactatgccccagccacttggatgtagtatgtgtacaaaagtgacaacacgatatagtgattcttcaaagtaggtttattgttctaattgacatttttcttcaaacattataggattatacatttccaacaattttaagcaattttgatgcttatcaaaatgttgtatatttaataagtttttgcattaaatgagtttaggttggcaataaggaaccaccatatactttaatagatactatttcataccacagttgtgttgtctttaatacagagatgagtgtttaatactcttttgcaatgggaagaagttaaaggagtttgagttaaaatagtgagagaaataattgaatatgattgttaccttaaatatagccacagtctgttgatttaagcttcagttagtcctaacatattcaacatattcataacaaaattttttgggcatctctggctcatttattaatacctatgaacctgcaaaacactgctgtatttgtaagactgatatgtatgggataatgtatgcgataagcaaaaatcttagttttctagctagcttttgaaatgaaagtaatggaaacatgactactcagatttaaaaaaaccaggctttacctttcgtagttcaatttatattagtacaaattcttctcaaaggtggtctccttgagaaggtgcacaggctactggaaatagtgaagacagtaataagaagaagattaactggcttacttaccaagaaaatgaattcaggaaatttgattctcgtagagatctagaacaagcaaacaggatgaacaaccacttattttggaatagtgtatttaaatttgagaaagagtgatcttttctttctccgaagggttaagaatgtgatcaaaagcctggagctgaaagaaggataatatgtatgggagacagtgaggacacttgcctgaccagagcaggtgaacacctatgtacaataaagctagattgtagtggctgcagtgggtgttgaaatacatgttgaatgcaacaaagaggtattaaaatttcttgaatgttaatagattggcctaatcctgggttttaggcagagcatcctacaaccttaacaaatggtgaatttggaagcaactagactcagggagatcagctatactgttttgtagaattttgaatttcataagccaataaagctcctagaaaattcttaaggactaacatatggttatcaattatttatcttgaaggaaagaatattttaaaaaccccaacaacaaaatataaacagtaaattaccacatactatcttcactgtttcatacaggaatgaaattttaacatcaaatcagcaggaaggacatactcccagagtaaaggacacaacactaagatgaataaacttgatgttcttagagacctaccacattgcctctgttttctcactttctcctctacctgtaactctgtgatatagctgcacagatactcagaatgatagctgagatccactgagctaagagaataccgtaattactcaggcataacataatgaaaacctgggaaagaagaagaaagaataagagaaggaagggagaggatggaagaatgatagcccatggcaacagattgaatatagaaagtaaaagaagaaagtgaaagctacctgcaaaaattatactatgatctcatgtcgttttttgtttgtttgttttgttttgttttgttttttgagacggagtctcgctctgtctctcaggctggagtgcagtggcgtaatctcgg

SEQ ID NO: 716 - DNA, 2233 bp, Homo Sapiens
aatttcagggccgttgtcgcctccgggcggtccgcgggtcccgagcggactgggactctggagacgtgcccccaaccccaccgccattcaccctgtcattgcaggggagagaacagaataaagacgggtacattttccatctcacctctgaacctcggttaggaaaacgctgtagccctgactagtgggctcaagggccgactggaaaagggcgagtcagcgttcaaagccgattcggggcagccctctctaacgcagagggccgaggataagaagacgacaatgtgttaggggccctccgggctaggactgtcctcaccactttgtacattgccaaagtaaatataacgtagaggtcaagcgcaggcgctttgtgggcagacatgactgagctccactcgcgactcctctaatggcgtgccagctgcggacctcattagccccgcctcaatcattcagtatgttttggttgtctacagtgtacgaagccctgttctcacaattagataaaatgagtgtgaagtgctcaacataattcctagtgtagtaggccttcaaagaactattatcattattaattactcatatagaatacaactttatgaaatgataggatcccattttaagatgaggaaaatgaggctatcagagacgttaaggaacttaatgtcacacagttaataaacgatagaggtgcgatttgaacacaggttgtctaataccagacctgcatttataactgctgcttcccaagttatagatatttcagcattttatgtagtcacaattgaagaccaaatatttagttacagactaagttggcatgttattactgaataagatgctaaggtatctactaaagattttaagtgcaaaaggcattagagaagaatttactgtggattttttgcaggttctgattgtaattgtatcaccttgagaaaggaggaaatgaaagcagattatcaggcatacttttttaactctaagcaactttttgcattactttctaaggaccatcagcaacaaaaatcaatggtttctaatgttgatatattttcctctaccaaaaaaattaaagcagctgagccaacaaaaattctctgttttggatgtgttagcatgaggaaatggcgaataggaaatgagcttttgcttctcatgtaggaaccctgaaggagtcagatttgggaggggttgaagtctgcttccaacagaagcaggggtggagaagggaaaggaaagacttctggtgtcctaaatgctagtcccaaagtggggatgctgtttgtccggataacccttgtaaatctgctccattctgcagctactcctgggaaacttaactcagccaaataatgcaaacaattgcatccatcatcagccacatcagccttaggagatacatccatatcatgagaaaacactacctgaaattggggaccactggaggattaaagaacaaggagatggctggctatttaagaaggaaaggcagaggctgcagaaattgagcctaacggcttatcagatgggatggataattctttaagtttaaaagaactactcattttccccaacatctgtctttgccatcttcctatctaaggaacctttcactttttagctggggacatagctttctggtatgagaactacactgctcaaacttccaatcagcttgtatgcacttggtgaatcttacctaccacaaacagaagtctggaaagtgaaaatttatttccttttcaccatgaccagccttgttcagaacatctgagaggcacagacctgagaaagaatccccaggctgaagaggtagaagttggcagaagttaaaagcaatgtctccacaatggagaagtgacatgctaaaggaacctggcatctagacatttcctaacccccaatccctccttacatatgacctgctcttagaggagtacagcgtggtggttaggagtgtggactcggcagccagaaatcctgggatctgttgcttgttagctgtgggccttaagctaagaacttaacctctctgtgcctcagttgctccatctgttcaaatgaagataatgataatgaagatgatatcacctgctgtgtaggattgttatgaaaaatcaagaattaatatttgtaaatcacttacagggtctggcacataataagtgctgtgtgggtgtttgttaaataaaataatatacaatgacataggcattgtggttgttct

SEQ ID NO: 717 - DNA, 2172 bp, Homo Sapiens
caataaccccagcattggagagagtggagcagcccttcaagaagttccaacctctgcccaggactggttttaccaacttcactaggcttagaatcgtaggaagtctatttgggacttgcgagtctcacgtattcctgcctaaatgtttatggatacctgtttagagctgaaatcttttcagctcccataatatgagggaattaggtctcaaagaagatcatgtattttgatcagaccttatagctgagcagtggaaagaaaaaaaatcagtgtgagatctcccagggttccgcaggagtggcttccttagtccaactggcagcctatcctggaatattgcctgggagagaggttagttgcttttcctggtgctaggaactgaatggttttacatattgatcaatgaaaatacttatttggcctacaataggtgcaaaaatactgctaattactaacagtatctcttctttgctgcgtgccagacactccactgggcattatgcagttaatatgtaccatgaatttcccgtggttagcaatgatgtcaggcatagaaaagacatgaaattatgatgtcaaatgaataaactggaaaaaggaatttcttgaattttctccagctgtcctaagaatgtatctatactttgatcctggcctaccttttcaacatctaaactttattcccccaagcttctagatattcaaagttaagtattaaataaaatcagtaaatatatacaagcttgtttggccattctgaataaggttatatttccaccacacaatctccaaattctctagcagaagggatcagtatgttatagataccccctttccttccctccctggcaagccaccacatctgttatgggtactcaatgcagtggctgcacctgggcctcactcattaagcagttgttgattgagtgactgaattgaatgcctgatgagctcgcaagtaagattcagactgtgcctgcaaactaataggatccctccgctttttattcactactgctgaggtagatctcaggccagcctgaagtttaggtctactgagaaataataagcctcaaaaatcgagctttgcttcacccagtctcccagtaaacactaagaaatgttcacattatttacacatcctagactgcctgtcttatggaccaaatgtttgtgttctccccgcaatttatacattggaatcctaaccctcaatgtaatagcattaggtgctggggtctttgggaggtgattggctaatggacctggagccctcatgatgggatgagtccccttatcagaagagacctgagaaggcttgcttcctctccctgtgctcttcatgatgtgaagacacaagaagacagccatctgtgggccaggaagaggtcctcactggaacccaaccatgctggcaccccaatcttgaatttctagcttcaagaacttgggaaataaatgtaagccagccagcttatggatttgttacagcagcctaagctaagtcagagtctctagaacagctggtctggggcagcggtgaagggaggtgggtgggcatatgaccctgccctgcacatgaatggcaaaggcaactggagagcctctcccttttggtgagatccccagtccacaagggcatgttcatccatagctttacttcccgaagcaaattctggttcctggggcctgtgcctccatagatggcatgatctgcagcctcctgtggtaatttaccctcttcctaaatttctgagtcttcacatttaagcaatcctagttagatatcctctacctgtatccatggctgtctttcagtcacattacagactcattgtgatgaccatgtagggacaatgtgatttcagaaacatggcctcatttgattttaatgtaaatataaatcagtgaagcagaaaaagagaatctccagaaaaacaagggatgaggctgtacagcaagttaaagtggaatcagaacccaactgtagtccattatttgtttcaatcctgctcttttctaccatatcacccagtttccaaatcgttcagcaaattgccatggtcaatgggattaacctttcccttttattctcaggaaatctcccttgtccattttgcaagactgtgtgattctttctactgttacaaggaataaaagccttcctaaaaa

SEQ ID NO: 718 - DNA, 1893 bp, Homo Sapiens
gcggggggcggggtgcggggagaggaaagcgccgcgggtggcacggtgcctctggcgacagagtagatggacccgaaagagacccgaggtgacttcgggctgggcaggacacccccgggagttgccagcggctctcagcgggcgcctctaggaccccttgtcactgcgagcagcgcctgctctggggaggggctcgaaggcgccgcgccttctcaacgcgccgctgcgtcccccaggggctccaacttggacagctagactggaaatactgctgcacaaagttaggctgagttcgaaggacaccagagaggaagcgcaaggagatgcccttctccggagccgggcagagcgccagaactcctagacgggaaactttcccccattgaagctagaaccggtcatgcgactcggctaagtgtggggaaacactggctctagactccagctataccacaggaaactctctaaaaagagcagtatgagtactatgagaaatgagccaattctaatcttccctacatgcagaaggcactgtcacagatggtgagcacacagccacataaggctatgacccttctctactcatcccctctttgtgtggttgtaccttgaggaatcagaagctcagctgctgagcacaaaacaagataatcaaagatggtggaagaagtcaattggatgtctcctccctaatggggtttccagatctgaagcagtgtcaagctgatagaagagacaagggaggatgatgttgacaacagatgttgaccatgtggatgtaacaggtcagcgctttgccctggaaagcacttgttaacagcagctcaagagagaatacccaatgaagcaattatgtgtggagatatctgaaggtgagggttcagtggatgcatgtgcaagtttgctacctgggtaaaccacatgacgctaagtttgagatatgaatgatcacgtcattcagatagtgagtatagtacccaacaggtagtttttcaatccttgccccaccccaacactcccttatctagtagccaccagtgtctattgttcccatctttatgtccatgtgtactcaatgtttagttcccatttataaatgagaacatgcattatttggttttctgttccttcattcatttgcttaggataatgtcctccagctgcatccatgttgctgcaaaagacgtgatttccttctttttcatggctgtgtagtattccatgctatatatgcaccacattttctttatccagtcccaatctgtattttaaataatccctgtgggaattctgatgcagatggttagcccctcatacttcagaaaatacagatcagaggcacatgaagtcagagaaatgtgtggctgtttttgacatgcatgctttgctcagatagcgcttggaaagaaggccacttacctggttttgttcactctacgggccaacaattggctgcatggtcaacatgtgatttaaaaattaagatacttccttaaaccactgctgaaggagtcagtgacttgaggtttcaaaaaacaacacaaaaactagttgaaaaggactcaacctggaatgtagaataaaatatttattatttactcaacagttaatgtaaacaaacatgtatacagcaaactcttaggagctgttaatttctcattcctcttcacagaatgactaaagaagctttagcgtagatgaggtgggggtaatgtttttgtcctcttattgcacgactcctcatttatttgacttggcttaatgggatctactgattcttatcttgcctcacaaatgtgaatgtcaattccggcatgtggtacactgtgctaattttaatatttttagactatttgtaattgttcataaagatcttcatcaattatacctcta

SEQ ID NO: 719 - DNA, 3790 bp, Homo Sapiens
atttgtggtctcctctcttggctttggagcccccctccctctgtctctgtacgggggtgccttcttcttttcttcttctcccttctttcttgcctattaaactctccacttcttaataccactacacgtgtatctgtgtcattttatccaatttgcatgagacaagagccctggtgcccctccactcatcagagccgtatcattttggtgcatgggccaggaaaatccaaagtacagccttcgttggagtgatagagtctcaccgttgcccaggctggagggcagttgtgccattttggtgcactgcagcctctgcctctggagttcaactgattctcctgcctcagcctcctgagtagctgggactagaggcacacgccaccatgcctggctaatttttgtatttttagtagagagtgggttacaccctgttggccaggctgctcttgaactcctggcctcaagtgatctgcccaccttggcctcccacagtgcgattacaggtgtgagccaccgtgcctgcccggcctttttaagagatgtggtcttgctgtgttgcctgggctggtctcaaagtcctgacctcaagtgatccacccatctcagcctcccacagtgctgggattacaggcatgagccactgcaccggaagtctaggtttaattattccccattactgagacaagatcttcctgagcactctaccccatgcctagcgaatgatcagtttttccagctggccagtgggaagaggtcctggccctacctcgtgtgaatcttgggcgttgtttcctcgaatcctttcagctggttctttccctggccttggagagtttcttcacacacatgtgctgattagttctttgctgaatcctctgaagtcctctggggtactctctctgtgcacctctgtcttgtaggtgttccattatctaagctctagctgctgtggtctcctcggactcagccactccatttcctcaactctgcgaatcctctgggctgcaacaacccacatcccccttgccctgccccacactttggaaacgctctcgaagcagtaaactgcacagtcctaaaaggactgttgatgtcctttctctctgggatttcattgcttttgttactttctctcattgcttgatgttcagcgttttgaacactgttgttccatgtattgggtctgtttttgtcactgtggtggtggtgattgtttcagacaggagggcggacccagcccacgtgactccatcttggctggaagcaggaatctcgggatcagtggtttcaaagctcctcaggtgattccaggggacgctgaggtgaggaccacttgcagagactcctctgcttgaaatatctctcaatcaaatggaatcttcttttgttgttcccaccccttcattttctctgttctctctttctgagttttttctttgtttttgttttttgagacaaggtcatgctgtgttgcccaggatggagtgcagtggtgccatcacggctcactgtagcctcaacctcccgggctcaaacaatcctcctgccccagcctcacgagcagctgggaccacaggcccataccatcacgtccagctatgttctctctttctggaacttctgttaaacaaatatggattgaattgattctccatctcttttctttcatattttcctttcttttctttcttttttgttggcattttgctctacatcctgagaggtgtttcaaaacttttccacccgtaccttcctttgattaattttttatttaacttaattaattaattaatttttgagacatggtctcactctgtcacccaggctggagtgcagtggtgcaatctcagctcactgcagactcaacctcctgggctcaagtgatcctcctacctcagcctcctgagtagctgggagtacagatgcactccaccatgcccggctaattattttattttttgtagagatggggttttgccatgtttcccaggctgtgatggatttttaaatttggtccgtcgtatttgtgacttccagaactttgtcttgttctccaattgcagcatcttcctggaagcctcttcttggttcgtggtgcattatcttattcattcctttcctccagggctagtgttctgctattcttcctttcttttttttttttgagacagagtcttgctctgttgcccaggctggagcacagtggcgtgatctcagctcactgcaagctccagctcctgggttcacgccattcttctgcctcagcctcccgagtagctgggactacaggtgcctgccactacgcccggctaatttttttgtattttcagtagacatggagtttcaccatgttagccaggatggtcttgatctcctgacctcatgatccacccgccttagccttccaaagtgctgggattacaggcatgagccattgcgcccaggctttttttttttttttttttttttttttgagatggagttttgctcttgttgcccaggctggagtgccacctgcagcccagtgatcttggctcactgcaacctctgcctcctaggttcacgcaattttcgtgcctcagcctcccgagtagctgggattacagtcatgtgccaccatgcccggctaattttatatttttactagagatggggtttcaccatgttggccaggctggtctcgaattccagacctcaggtgatccaccctcctcagcctcccagtaagccactgcacccaaccatctgctattcatcttaatcctctctggtggcaccgaaatgaagaggagacccatgtggatctccctgcagccgggtgagtctggttccacaggaggccttttcctgaactggctgcaggctccgcgggcaggtctgttaattggttaaaatgcttcattcagttaggtgggttttgttcccttctccccacccagaggacatttgggaatgtcgggagatatttttggttatggcagctagggggatccttctgacacctagtggatagaggccagaaatgccactaagtatcctaggacatgcaggagagcctctcaacgattaagaatcagctgtcccaacatgttaatagcacataggtcggagagacaccctgatttaaggccatctgagtacaggctccccagctctcaccaccaaaggccaagataaggagggtccctctacagccacttcagggaacttccaagggagcttgttcaattatgtttatttattttatttatttattttttttgagacggagtcttgctctgttgcccaggctggagtgcaacctccacctcccaggttcaaacgattctcctgcctcagcctcccaagtagctgggattacaggcacctgccaccacacccagataatttttgtattttttgtagagaaggggtttcatcacgttgcccaggctggtcttgaatgccatgaccgcccccagttgtgcttagaagataccgccaacaggccgggtgcggtggctcatgccttaatcccagtactttgggaggccgaggcagctggatcacgaggtcaggagttcgagcctggccaagatggtgaaaccccgtctctactaaaaataccaaaattggccaggcatggtagctcacgcctgtaatcccagcactttgggaggccaaggtgggtggatcatgaggtcaggagatcaagaccatcctagctaacacggtgaaaccccgtctcaaaaatacaaaaagttagccaagcgtggtggcacacacctgtggtcccagctactcagaaggc

SEQ ID NO: 720 - DNA, 9593 bp, Homo Sapiens
attcacagcgtatgacactgctgtcatcatgtctcctggattccttttttttttccctataacagctctatcaagctataattcacatgccttaaaattcaccttttttgaaatgtacaactgagtgatttgtaatatattcacagagttgtgcaatcttaacaactacttaattccagaacatttacatcacttcaaagaaaccccataccctatagcagtcactcccaattctcttcttccacccattccctggaaaccactaatctactttccgtctctttggatttaactactcaggacattttatagtcagcacgtaagccggactgtctaggaaaacctccccttcctgtgtctggaggtgttgaaaaaaataattcaacaatgctgcccctgctggccaccagtgtaccatgcaataattccatggcccctgccacagcccaggaaatggaggaaatggccaggcagccacattctctcatcctgcagaaggacccttctaggtgttagaggttgagggattttggctacatatggccccatacatcttcctagctatagattccaatggaagaagagaactttctttcctctactgagtgcatataaacttctgcatcttgcttctggcctcaacttgatcttcagcatcaacatcaagcagagcagcatgagatgcagtgcaatgaataaacagttcttggtcacgggcttgcccttgcagtctggaaagaaaatcctgcaactgagagagccaccatgatttcctgaagtatttggtgaagaaccattctccaaacgtgaagtcaggagatatgtattgctattatcagagctgaggaaaagacactagaagtttgaaatctcagatgtccacagcatcatgacacatagttaggattccatgctgaatagaagggggaacctactgaagagttttcagcagaagagagacccaataaaacttgcgtgtaaattataaccattgcttctgtatagcattctgattggagagtcaggtatagatgcacagagagcagttagaaggttattatagtagtctagaagtgactgtggacttgtagggaaatggcaaatatttagaaaacaaattcaataacactcagcaatcagttggacttggggtatgaggaagggagaaatgtctggtctgattccatcacaaggccttgtatatgctgttccctttgcctaaaaattcccttagctcctcttttaacctggcgaaatgttgctccttcatcaggtctcagcttgagcatctcttctccagggaaattgatcctcttgcctttcccctgtttaatttcccttcccatcacttatcacagtttataacgttatattcactcacttataaagtactttcttaaatattttagctcctctacaaggatgtataatccttgaagcaggagctgttcccacccaagaaaatgaaaatctcagtcattaagtacacaaacacgggtccagattgcttggtttcaaatcttggttctgctactggccagctgtgtgatccaagaaaagctactcgacttctctgtgtcttcatctgctcatctgtcaaatggatatatgagtagtcctacttcatggagttgttgcgaggaatccattagtacctctcctagtgcctgcagccacgcaatacatatttgaaaagtaagtggaaatctgtcaagtgtaagttactgtgtggatattggtgtgatgcacagagaagaggaagcactggaagatgatcatggaagggagagaaggcaagcttgcaaaatcagcattggctatttaaataatatctgcctatgatgctgtcaaggaaaaatgttgtggagccgttggaaatgtgacattgaagctcaaaacagaggcctgaggggattgattaatttcccagagccgccataataaggtaccacaaactaggtggtttaaaacaataaacatttattgtatcacagttctggtggccagaagtctgaaatcaggtattggcaggattttgccccctgaagggccctagggaaggattctttcttgccattccagcttctggtggtcccaagtgatcattggcttgcagtagcatcaccccagtgtctgcccctgtcttcacatggccttcactctatctgagtccaaatctcccttttcctacgaggatagcagtcatgttgcataaagggtccaactactccagtgtgacttcatcttaactacttacatctgccacagtcctactttcaagaaagttcacattctgaggtattaaggcaatcagtgtttcagtgtatcttttgagaggacataatttcacccacaacagaagtgatatacatttgggggttactggcatttgaatgctattttgagccaaggctatagagaagagcagccttgtagctaagagctcaggtcctatcaatccatacagacctgggattgacactcagttccattactgactggctcagatcttggtaaagttgcctaacatttcgaagacttagtttcttagcctgttaaaaaagggataataaaacctccaggtttcttgtaaatatgaactgaggaaatgattgtaaagtggtgagcatagcacatcttatagggtgagtcttcagtaaatggtgtctgttagttaagattttgtatggaaagaatctaacctgagaaagaaggaagagtgaggaataaatttttaaccaagaggaaacaccccattttagttagaaatgacccaagagagcaaccagaataatgaaaatactataaattattttctggtgttttggatttatatatagttcaagaatttagccctgtgcctgacctaagacagataatcaatatgcagttggatggctagactgaatgaacatcagggacatatttagccaccagaagaggagtattaagggtacataggtagggaaagaggattgaaagttacctagaaatctggaaggctctgatgcagaagagatattatacctactctgtaaatgtggaactagaactaggggatagaaattatagggagaatcatttttactcaatactgaacatttgctgaggtccccaatcctcaatgtttgcaaacagagatggataacacctagccaaatcatttatacaaggtgtctttgtactggggagatggttggattagaggtctgataaatttatttccacctgtgattccaaattgatgttaaagagactataaataagaaacatttattagatgaaaggaatatgatagacacaatttaagaagagacattaagcagtataaaattccttcctatctaatttagtttctaactcagctctattttcaaaggccaaagctaccagcccttgaattcccattacacttattctcccttatgttagattttatatggaggaggaccaacagtttttgagaagcacctctggatcaaaacaatgatccgtaattccttaagtaaaagctagtaatcatattaatgttctttagaagaaagaaagccaagccaggatagtaaaacagaaagcatttcccatcatttttggataaggcagaagacaaagtccagtttctttcgagtctgaaggggaagtttaaaattttcaggactataaaggacaatgcaagagaggcattgaagcgatgggggaagaaaacagtagggggttccctattttaaaaccacttctgaagtgaattctagcttcatcttgccttcattcccagctccatccttgggaatgaaagatttattcttctagctgcctggaattctgctggctgagagctctacattgccaggcttcttcaggaattgcccgagtggaacagggccaccttgcccacaggtattcccttccttgagcaaccctcatttagtgattgatcaattaatgcatcaaaaggtctgacatattcttcaatcattttttaagatcactgtatttatttgaaaaaattgccaaagaagattgtttctttgcgattttgtgttattattattattaaacagctttagtgaggtataatggatataaaataaactgcacttatttatgtataaatagaatgactttggatatatgcatatacctgtgaaatcatcactacaatcaaggtaatagggaaatcaatcacctccaaaagttttcttccattgcaattttaaaagatgtgttttatataccatgtagataaaaatggaaaattggagcaaaaaaaacaacttctttttatgagaacgttaaaaaaaatattttctagatgtaccaattaaaacatgcttaaaataattgcacatttatccaatttagaaatatgtccagtagccattatcattctgaatgttcacttttaattttcgacatggatctacatcggtatagaaaactgcacactttccttttctctgcaaatacggcacaattttattagttattattctcatgttatacaatagatcactggtcttgttcatcctacatatctgccactttgtaacctctaacctacttatccccattttcttcccacccccagctcctggtgacaactcttttatactccatctctgtatatttttactcttctttaaagattccacatgtaagtgagattatgcaacatttttttgtgtctgtcttatttcacttagcagaatatcatccacatccatctattttgggacaaatgctggggtcttcatttttaaggttgaataatatttcattgtgtatgtgtgtgtatattaggcagataatcaataagcaattgaatgacaaaattgaatgaatattaaggacacatacacacacttttttatccattcatttgtcaaggcatacttaggttgtttccatatcttggctatttgtgaataatgttgcaatgatcatgagagtccagatatctttatggagtgattatttcacttccttttggtatatgaccagaaaaggaactgctgggtcatatgatagttctatttttaatttcttttggaagctccacactgtttccattatggctacaccaatctacatctctaccaacagtgtacaagggttcccttttctccacatcaacatttttgccaacatttgctatttcttgactttttgataatagccatcctaaggaatgtgaggtgataactcatagtgggtttgatttgcattttcttagtgactaaaatgttgagcacattttcatatatctgtgggccattttttatgccttcttctctattcaggtcctttgcccaatttttaattgggttgcttgtttttctactgttgaggtgtgtgagtgctttatacattttggatactaaccccttatcagagatatggtttgtaaacatatttttcccaatccataggctgctgtttcatttttttgattgtttcctttatgtagaagcttcttggtttgatgtagtaatatttatttatttattgttatacagcctaagattttggtatagtatccaaatatcattgccaaggccagtgtcaaggaactttccacccatgttctcctcaaggaatgttatggtctcaggtcttacatttaactcttttatctattttgagttgatttttgcatatggtataaaaatccaattttactcttttacatatggaaataaagttttcctagtgccatttactaaagaaactattctttcccaattgtgttctcttggtgcccttgtcaaaacttagttgaccctatgtgttctaattgatttctgggctctgtattctattccactggtcgatatgtctgttttaatggcagtacccatacagttttaattactgtagttttataaaataattttaaatcagtaattataatgccccaattttcttttgcttgcttagaattgctgtggcaatttttttagttcctaagaaattgtggaattatttttcctatttctgtgacaaatgccactgctatttttacagggattgaatctttatgtagctttgaatagtaagaacattttaacaatattgattctttgaatctatgagcataggatgtcttttcgtttatttgtatcttatttaacttgttgcatcagtgggcttggttacatttattcccaggtatttatatgctatcataaatgtgattgttttattgacatatttttcagctaagttattatttatgtataaaaatgctactaattttttgggtgttgattttgtatcctgcaactttacttaattcatttattagttctaaaagtttgtgtgtgtgtgtgtgtatacactctggggttttctacgtataaaatcatgtcatctgcaaatagaaataattttacttctttttttttccaatttgggtgtctttgttttattttcttcctgtttgattagtcttgctaatacttccagtaccatgttgaataaaaaaggcaaaagtaaacacccttgccttgtgtaggattgtagtaaatatcctttcagcttttcttcattgatcatgacgttagttgtgagtttttttaaataaatgatctttattatgttgagaaactttccttttatacctaaactgttgatggcttttatcaagagagaaagttgacctttgttgaatgctttttctgtgtaaagtgggataattacgtggttttaagctttcattctgttaatatgatgtatcacatttattgatttgcatatgttaaaccagacttgcatgccgaggataaattccgcttaatcaggatgtataatctttttgttacgttgaatttgttaatattttattaaggatttctgcatcaatgattctcagagaaattgacctgtaattttcttttattgtgatatagctgcctggcttagatattaaggtgatacttttctcatcaaatgtgtttggaagtactacctctagttttattttgtggaagagtttcaggagtattagtatgaatgaattcttctttgaatgtttggtagaagttatctatgaagccatctgcttctcgggttttctttgttgagaggtgttttattacttctttaatatctttatttgttattgttctgttcaagctctctacctcttcctgtttcaaatcttggtaggttgtatttttctaggaatttatccatttcctctagcctatttaatttgtttgcatgtaattgttcataatagccctttatgatcctttttatttctgaggcaaatgttgtaatgtctctactttcattgttgattttatttattgtttttcatttatccttacttagtctagctaagggtttgttgattttatttttgttaaaaaactcttagttctatttgtttttctatggtgtttgcattttctatttgatttatttctgttttgatctttactatttcttttcttttgcgaactttgagtttagtatgctcctctttttccagtcccttgaggtgtaatgttagattatttactttgaatctcccttcttcttattttgttttgagacagggtctcattctgttgcccatgctggagtgcagtggcacaatcctggctcactgaaacctccacttctggggctcaagcaatcctcccatctcagtctcttgaatagctgggactacaggcacgcatcaccatggcaagctgatttttgtattttttttgtagagatgaggtttcaccatggtgcccaggctggtcttgaactaatgggctcaagttatccacctgcctacacctcccaaagggctgggattactggtgtgagccaccatgcctggccctctttcttgttttttaatatagacatttattgctatgcacttccctcttaaaactacttttgttgcctcccataggttgtgttttgctgtgtttccattacatttgtctccatatacttttagatttcccttgtgatttattgtttgacccattggttgtttctttatccaatcttgccttcccttccatagatattgattctgaaagcacaaccaacctttctgtactctgatctctgtcttaaagtctccttcttagcaaaccaacctgtgctttcttctttcatatcttttctcctttcagctacaatctgatttttcttgtgtttacagcaaaactgaaaagatttttttatattcatcattttcacatccttaccttccattttctcttgaacacacaacaattagacttagttgctgctgctccatagaaactgttcttgtcaaggtcaccacaaattcatcctgtcaagtcccatcatcctcatgttggattacctctcagcaacatctgccatagttaaataatcttcttcccaagaatgtacttggttcctgggatatcacactcacttggttttcctttcctcacttgctgtttcttctcagtatcttttgctgggtcaccttcatctttccaatctttaaatgtctgtgaactccagaacttcatccttgactttcttattcatcttcaattactccctaggtcaaaaatcagcaaacttttcccataaaagaccagatagtaaatattttaaactttagggcaatgtggtttctgctgcacctacttaactctgccattgtagtgcaaaagtttccatatagaatatacaaaaacaaacattttcatgttccaataaaaacaaccaatggccatatttggactgatggttatagtttgtagatctctgttctatgtaatctcatctggttccacaactttaaatgttattactgactaccgtaaattccagactgagatagttaagctgctacttggcatcgctcaaaagtagtatgtactaaaaggaaactttggacttttgttgatctattcctcaacctgtttctctcccagtctttcttactggcaatgcaagacacatcaccatttgcgccttattgataccacctcattacctttatccttcattgccagccaggttcaagacatgaaattcattcatctggattagttcagtagtattgagcaggtctttctgctttccctctaagctcccaagagcctagtctttgtagaatggcaaaaataaatttcttgaacatttcttttaaaaaagaaaattagattttaacatttccttctcattttgaacaaatttcaagcttcttcccaagacccagaaggtcccaaatgatctggtctttcctcacgtttgtggttttgtggtctgttcttcatgctcattccctcccagccacacttgtctttttgctgttttgagtgttcagtttatacttgccatgaggcctttgctgacccctctatttggaaatattttcccccaatttctaacttgcctcatatccttaactaatttgggtttttgtttaaatatcatctcttcagagaaagatgttttgattccctatcttaatagattcctcccatcattacccagttcctttttaccttgctttatcttttaaaaacgatacttaatgagtaccaaaaattattttgtacatttatttctttatttgttatttccctctactacaa

SEQ ID NO: 721 - DNA, 9817 bp, Homo Sapiens
attcacagcgtatgacactgctgtcatcatgtctcctggattccttttttttttccctataacagctctatcaagctataattcacatgccttaaaattcaccttttttgaaatgtacaactgagtgatttgtaatatattcacagagttgtgcaatcttaacaactacttaattccagaacatttacatcacttcaaagaaaccccataccctatagcagtcactcccaattctcttcttccacccattccctggaaaccactaatctactttccgtctctttggatttaactactcaggacattttatagtcagcacgtaagccggactgtctaggaaaacctccccttcctgtgtctggaggtgttgaaaaaaataattcaacaatgctgcccctgctggccaccagtgtaccatgcaataattccatggcccctgccacagcccaggaaatggaggaaatggccaggcagccacattctctcatcctgcagaaggacccttctaggtgttagaggttgagggattttggctacatatggccccatacatcttcctagctatagattccaatggaagaagagaactttctttcctctactgagtgcatataaacttctgcatcttgcttctggcctcaacttgatcttcagcatcaacatcaagcagagcagcatgagatgcagtgcaatgaataaacagttcttggtcacgggcttgcccttgcagtctggaaagaaaatcctgcaactgagagagccaccatgatttcctgaagtatttggtgaagaaccattctccaaacgtgaagtcaggagatatgtattgctattatcagagctgaggaaaagacactagaagtttgaaatctcagatgtccacagcatcatgacacatagttaggattccatgctgaatagaagggggaacctactgaagagttttcagcagaagagagacccaataaaacttgcgtgtaaattataaccattgcttctgtatagcattctgattggagagtcaggtatagatgcacagagagcagttagaaggttattatagtagtctagaagtgactgtggacttgtagggaaatggcaaatatttagaaaacaaattcaataacactcagcaatcagttggacttggggtatgaggaagggagaaatgtctggtctgattccatcacaaggccttgtatatgctgttccctttgcctaaaaattcccttagctcctcttttaacctggcgaaatgttgctccttcatcaggtctcagcttgagcatctcttctccagggaaattgatcctcttgcctttcccctgtttaatttcccttcccatcacttatcacagtttataacgttatattcactcacttataaagtactttcttaaatattttagctcctctacaaggatgtataatccttgaagcaggagctgttcccacccaagaaaatgaaaatctcagtcattaagtacacaaacacgggtccagattgcttggtttcaaatcttggttctgctactggccagctgtgtgatccaagaaaagctactcgacttctctgtgtcttcatctgctcatctgtcaaatggatatatgagtagtcctacttcatggagttgttgcgaggaatccattagtacctctcctagtgcctgcagccacgcaatacatatttgaaaagtaagtggaaatctgtcaagtgtaagttactgtgtggatattggtgtgatgcacagagaagaggaagcactggaagatgatcatggaagggagagaaggcaagcttgcaaaatcagcattggctatttaaataatatctgcctatgatgctgtcaaggaaaaatgttgtggagccgttggaaatgtgacattgaagctcaaaacagaggcctgaggggattgattaatttcccagagccgccataataaggtaccacaaactaggtggtttaaaacaataaacatttattgtatcacagttctggtggccagaagtctgaaatcaggtattggcaggattttgccccctgaagggccctagggaaggattctttcttgccattccagcttctggtggtcccaagtgatcattggcttgcagtagcatcaccccagtgtctgcccctgtcttcacatggccttcactctatctgagtccaaatctcccttttcctacgaggatagcagtcatgttgcataaagggtccaactactccagtgtgacttcatcttaactacttacatctgccacagtcctactttcaagaaagttcacattctgaggtattaaggcaatcagtgtttcagtgtatcttttgagaggacataatttcacccacaacagaagtgatatacatttgggggttactggcatttgaatgctattttgagccaaggctatagagaagagcagccttgtagctaagagctcaggtcctatcaatccatacagacctgggattgacactcagttccattactgactggctcagatcttggtaaagttgcctaacatttcgaagacttagtttcttagcctgttaaaaaagggataataaaacctccaggtttcttgtaaatatgaactgaggaaatgattgtaaagtggtgagcatagcacatcttatagggtgagtcttcagtaaatggtgtctgttagttaagattttgtatggaaagaatctaacctgagaaagaaggaagagtgaggaataaatttttaaccaagaggaaacaccccattttagttagaaatgacccaagagagcaaccagaataatgaaaatactataaattattttctggtgttttggatttatatatagttcaagaatttagccctgtgcctgacctaagacagataatcaatatgcagttggatggctagactgaatgaacatcagggacatatttagccaccagaagaggagtattaagggtacataggtagggaaagaggattgaaagttacctagaaatctggaaggctctgatgcagaagagatattatacctactctgtaaatgtggaactagaactaggggatagaaattatagggagaatcatttttactcaatactgaacatttgctgaggtccccaatcctcaatgtttgcaaacagagatggataacacctagccaaatcatttatacaaggtgtctttgtactggggagatggttggattagaggtctgataaatttatttccacctgtgattccaaattgatgttaaagagactataaataagaaacatttattagatgaaaggaatatgatagacacaatttaagaagagacattaagcagtataaaattccttcctatctaatttagtttctaactcagctctattttcaaaggccaaagctaccagcccttgaattcccattacacttattctcccttatgttagattttatatggaggaggaccaacagtttttgagaagcacctctggatcaaaacaatgatccgtaattccttaagtaaaagctagtaatcatattaatgttctttagaagaaagaaagccaagccaggatagtaaaacagaaagcatttcccatcatttttggataaggcagaagacaaagtccagtttctttcgagtctgaaggggaagtttaaaattttcaggactataaaggacaatgcaagagaggcattgaagcgatgggggaagaaaacagtagggggttccctattttaaaaccacttctgaagtgaattctagcttcatcttgccttcattcccagctccatccttgggaatgaaagatttattcttctagctgcctggaattctgctggctgagagctctacattgccaggcttcttcaggaattgcccgagtggaacagggccaccttgcccacaggtattcccttccttgagcaaccctcatttagtgattgatcaattaatgcatcaaaaggtctgacatacttccatcatccagggacgtctctgaaggccatctcagcttcagagctccccatgaagttgactgaagtttttattggattttgtgtcagtcaacttcttcaatcattttttaagatcactgtatttatttgaaaaaattgccaaagaagattgtttctttgcgattttgtgttattattattattaaacagctttagtgaggtataatggatataaaataaactgcacttatttatgtataaatagaatgactttggatatatgcatatacctgtgaaatcatcactacaatcaaggtaatagggaaatcaatcacctccaaaagttttcttccattgcaattttaaaagatgtgttttatataccatgtagataaaaatggaaaattggagcaaaaaaaacaacttctttttatgagaacgttaaaaaaaatattttctagatgtaccaattaaaacatgcttaaaataattgcacatttatccaatttagaaatatgtccagtagccattatcattctgaatgttcacttttaattttcgacatggatctacatcggtatagaaaactgcacactttccttttctctgcaaatacggcacaattttattagttattattctcatgttatacaatagatcactggtcttgttcatcctacatatctgccactttgtaacctctaacctacttatccccattttcttcccacccccagctcctggtgacaactcttttatactccatctctgtatatttttactcttctttaaagattccacatgtaagtgagattatgcaacatttttttgtgtctgtcttatttcacttagcagaatatcatccacatccatctattttgggacaaatgctggggtcttcatttttaaggttgaataatatttcattgtgtatgtgtgtgtatattaggcagataatcaataagcaattgaatgacaaaattgaatgaatattaaggacacatacacacacttttttatccattcatttgtcaaggcatacttaggttgtttccatatcttggctatttgtgaataatgttgcaatgatcatgagagtccagatatctttatggagtgattatttcacttccttttggtatatgaccagaaaaggaactgctgggtcatatgatagttctatttttaatttcttttggaagctccacactgtttccattatggctacaccaatctacatctctaccaacagtgtacaagggttcccttttctccacatcaacatttttgccaacatttgctatttcttgactttttgataatagccatcctaaggaatgtgaggtgataactcatagtgggtttgatttgcattttcttagtgactaaaatgttgagcacattttcatatatctgtgggccattttttatgccttcttctctattcaggtcctttgcccaatttttaattgggttgcttgtttttctactgttgaggtgtgtgagtgctttatacattttggatactaaccccttatcagagatatggtttgtaaacatatttttcccaatccataggctgctgtttcatttttttgattgtttcctttatgtagaagcttcttggtttgatgtagtaatatttatttatttattgttatacagcctaagattttggtatagtatccaaatatcattgccaaggccagtgtcaaggaactttccacccatgttctcctcaaggaatgttatggtctcaggtcttacatttaactcttttatctattttgagttgatttttgcatatggtataaaaatccaattttactcttttacatatggaaataaagttttcctagtgccatttactaaagaaactattctttcccaattgtgttctcttggtgcccttgtcaaaacttagttgaccctatgtgttctaattgatttctgggctctgtattctattccactggtcgatatgtctgttttaatggcagtacccatacagttttaattactgtagttttataaaataattttaaatcagtaattataatgccccaattttcttttgcttgcttagaattgctgtggcaatttttttagttcctaagaaattgtggaattatttttcctatttctgtgacaaatgccactgctatttttacagggattgaatctttatgtagctttgaatagtaagaacattttaacaatattgattctttgaatctatgagcataggatgtcttttcgtttatttgtatcttatttaacttgttgcatcagtgggcttggttacatttattcccaggtatttatatgctatcataaatgtgattgttttattgacatatttttcagctaagttattatttatgtataaaaatgctactaattttttgggtgttgattttgtatcctgcaactttacttaattcatttattagttctaaaagtttgtgtgtgtgtgtgtgtatacactctggggttttctacgtataaaatcatgtcatctgcaaatagaaataattttacttctttttttttccaatttgggtgtctttgttttattttcttcctgtttgattagtcttgctaatacttccagtaccatgttgaataaaaaaggcaaaagtaaacacccttgccttgtgtaggattgtagtaaatatcctttcagcttttcttcattgatcatgacgttagttgtgagtttttttaaataaatgatctttattatgttgagaaactttccttttatacctaaactgttgatggcttttatcaagagagaaagttgacctttgttgaatgctttttctgtgtaaagtgggataattacgtggttttaagctttcattctgttaatatgatgtatcacatttattgatttgcatatgttaaaccagacttgcatgccgaggataaattccgcttaatcaggatgtataatctttttgttacgttgaatttgttaatattttattaaggatttctgcatcaatgattctcagagaaattgacctgtaattttcttttattgtgatatagctgcctggcttagatattaaggtgatacttttctcatcaaatgtgtttggaagtactacctctagttttattttgtggaagagtttcaggagtattagtatgaatgaattcttctttgaatgtttggtagaagttatctatgaagccatctgcttctcgggttttctttgttgagaggtgttttattacttctttaatatctttatttgttattgttctgttcaagctctctacctcttcctgtttcaaatcttggtaggttgtatttttctaggaatttatccatttcctctagcctatttaatttgtttgcatgtaattgttcataatagccctttatgatcctttttatttctgaggcaaatgttgtaatgtctctactttcattgttgattttatttattgtttttcatttatccttacttagtctagctaagggtttgttgattttatttttgttaaaaaactcttagttctatttgtttttctatggtgtttgcattttctatttgatttatttctgttttgatctttactatttcttttcttttgcgaactttgagtttagtatgctcctctttttccagtcccttgaggtgtaatgttagattatttactttgaatctcccttcttcttattttgttttgagacagggtctcattctgttgcccatgctggagtgcagtggcacaatcctggctcactgaaacctccacttctggggctcaagcaatcctcccatctcagtctcttgaatagctgggactacaggcacgcatcaccatggcaagctgatttttgtattttttttgtagagatgaggtttcaccatggtgcccaggctggtcttgaactaatgggctcaagttatccacctgcctacacctcccaaagggctgggattactggtgtgagccaccatgcctggccctctttcttgttttttaatatagacatttattgctatgcacttccctcttaaaactacttttgttgcctcccataggttgtgttttgctgtgtttccattacatttgtctccatatacttttagatttcccttgtgatttattgtttgacccattggttgtttctttatccaatcttgccttcccttccatagatattgattctgaaagcacaaccaacctttctgtactctgatctctgtcttaaagtctccttcttagcaaaccaacctgtgctttcttctttcatatcttttctcctttcagctacaatctgatttttcttgtgtttacagcaaaactgaaaagatttttttatattcatcattttcacatccttaccttccattttctcttgaacacacaacaattagacttagttgctgctgctccatagaaactgttcttgtcaaggtcaccacaaattcatcctgtcaagtcccatcatcctcatgttggattacctctcagcaacatctgccatagttaaataatcttcttcccaagaatgtacttggttcctgggatatcacactcacttggttttcctttcctcacttgctgtttcttctcagtatcttttgctgggtcaccttcatctttccaatctttaaatgtctgtgaactccagaacttcatccttgactttcttattcatcttcaattactccctaggtcaaaaatcagcaaacttttcccataaaagaccagatagtaaatattttaaactttagggcaatgtggtttctgctgcacctacttaactctgccattgtagtgcaaaagtttccatatagaatatacaaaaacaaacattttcatgttccaataaaaacaaccaatggccatatttggactgatggttatagtttgtagatctctgttctatgtaatctcatctggttccacaactttaaatgttattactgactaccgtaaattccagactgagatagttaagctgctacttggcatcgctcaaaagtagtatgtactaaaaggaaactttggacttttgttgatctattcctcaacctgtttctctcccagtctttcttactggcaatgcaagacacatcaccatttgcgccttattgataccacctcattacctttatccttcattgccagccaggttcaagacatgaaattcattcatctggattagttcagtagtattgagcaggtctttctgctttccctctaagctcccaagagcctagtctttgtagaatggcaaaaataaatttcttgaacatttcttttaaaaaagaaaattagattttaacatttccttctcattttgaacaaatttcaagcttcttcccaagacccagaaggtcccaaatgatctggtctttcctcacgtttgtggttttgtggtctgttcttcatgctcattccctcccagccacacttgtctttttgctgttttgagtgttcagtttatacttgccatgaggcctttgctgacccctctatttggaaatattttcccccaatttctaacttgcctcatatccttaactaatttgggtttttgtttaaatatcatctcttcagagaaagatgttttgattccctatcttaatagattcctcccatcattacccagttcctttttaccttgctttatcttttaaaaacgatacttaatgagtaccaaaaattattttgtacatttatttctttatttgttatttccctctactacaataaaaatttgagagggcagagaccatgtgtcatttgtttcttgctctatttatgatgcatataaaagtatgtggaatgtatcaggaaaacaataaaaatttgttattgtttttcatttaagcatgatgt

SEQ ID NO: 722 - DNA, 1321 bp, Homo Sapiens
agctaatgaaaaggattatacactatgactaagtgggatttgttcctggagggtgttcaaaatacaaaaatcaaacaatgtaatataccatattaatagaatgaagataaaaatctcacatgttcatcttaactgatggaaattaagcactcaacaaaattaaataccccttactgatataaattactcaacataataaagcctacacagtagatattacttgtattggttcatgttttatacagtcagtgtttatttgtataccaatttcatttttcactgttcctctttcttctcaaacttcctttctggatttaattttttcttcctggaattcgtccttgagaattcctttagtaaggcccattgatgttaaactctttccaagttttgtttttatgaaaaatatattttgctctcatttgtgaaaaacttacatgattctatgttgaattattttgtctcagcatgtagaagataccattctactgtcttccatcttttgttattgctattgagaattctgctggtctaactgcttctttgaagttactctctttgactgtctacctcctttaagtaccttttaaactttcagattctgagttttactaaatgtatccagatggcattaaaaaatttttttctgccttgggtttcattgcatttcatgaatctccaaattcatgcccttctctctccttaaaaatttaccaatcctgaactattgctcaaataaatataatctctaaatatttcctatttcccattttatcaattctctccttttgaaaactccaattaatttttttattaaaccttctcattatatctgccatgtttctaaaactcctttcctagataatttcttcttgactatattctagttcactacttctctcttcatttgtatctaatgggctatttaactgttacactgattttttttctgaccataatttttaatttaggaagtctggttgaacataaaggaagcctatacactggaataaatatgaagctgctgcatatgattcttattccaaaataaggcctaatcagcattaggctgagatcttcattggtggcataagaagttcaaccacttgagtggacataatctccaaggtggaatggacctggtaatggactggatgacatgctggactttaggaatatccacaaatctgcatgaggtctctcctgctacaggccattggtgtggaagagaagatttttctaattgaggttgattatggaatgaaattaaagggtgggaaggaaaggttttcacatatgatcagagaacagagataccact

SEQ ID NO: 723 - DNA, 1995 bp, Homo Sapiens
cactttcctgcgagtcgctctccgaagtgtcgctgtccaccggctcctcgtccggggtgtctctcacagccagcagggccactaagtcggggacaccatttttgtcttctttggtgttcaagcggatggattcggccccagctggctccttctctgcctcttctttcttcgatttgtcggtgacggtgaccagagccaagaactcgcggggaccgtcttcttccccctcggagttgcagggcgcccactgcctaaccagctccctggcagcggcctgcagcgtggcgtacagcgcgctctggtcctcttctccgctcaggtcgccctggtcgatctcctcgatcacgatgcccaggctctcgtcggaagagtcctcggcctcactcctcgcgggagcagacggccgtcctcctcggcttctcttcttgcccttctgggtcaacctgttgcgtctggttctgtttctgcgaccccgacggcccctccttgggttcctggctgccccaagaagcgagccagcctgccctgttacctccccagaatcctgggcctgcgtctccgaagcgggaggggtgggtgcctccccgggggtcccagcctccgcggcctgcgtgggcccgtcatccagcagcaggcgtctcatctgcctcaggaccctcgtgtcctgcgcacggtccttccacagaaccctccagaccccatccttgcctgggatctccctgggaatggcagcgtgattgacgtcctccacaaactccaccagggcggcctgggccttctcgttcatcaaagccttcatgtgtcgcaacctgaacgtgcccaggggcaggagggtcggctgcaggacggcttcgacgtctgcctgctccaggccctccgggatgccggtgaccagcagggccctgtgcgcgtccacgtccaggctccggcaccagtcctgcaaaaggctcatggccatggtgcagcccccttggcgctgatcttggggcagcagggagcccgagataggggtgggctgcagcgcacggtgtcaatgcaaccctagaaagccacttgcagggcttagagtcccggttccggtgaatgtggcaaggctggagtggggctcggggctcgggggctctagctgcctgctggccggctggacgcagtgaccttcccccgggacccctctccagagctgtctgaggatccgcggggggcttacgtgtctgctttccaggacagctccctccctctctccctgacacaggcctgagtgactcggcaccgcagccaggtgcaggggggcggcgccgagtgcacctggagaggcgtgggaggtagcagccgcagcttgcctggcgctcgcgccgcgtctgagcgcgcaccctgggcctgaatctcagcagttccgctgcgacgcggctgctcgcgcgtgcgcctgcgcagagggagccgcacaccctcccctgtcccccgcccaaccgtctccatggcaacggtgcagccttgagctggggtctgcgtcgctgtggcctgagacgcttttcttaaaggtcccgatgacaaggacttggggcctggaagcaccactttcattaaccagcaaaaaacaaggccgaaaccacagagggccagaaatcactcaaggatacccgacctcattcaggggatagaggcctccttccagagggtaccggcatcactgggggttacaattcccccttccaggggccaggtggaattcaggattatataggcctaaatcaaagggcactggccttgcagcgtaggaccaggacttactcgggatactggcctcattcacagtatatgggtctcagtatcaaataggggggcccaggcaccacctgtgagcaagacaccattcagggtatatgggcctcacttgcagggtacaggccccactcgatgggaccggccctcactcccatacacgttcctgtattctgaactatgcatgcacaataaatcctgtggttttgcacacgc

SEQ ID NO: 724 - DNA, 1428 bp, Homo Sapiens
ggaagataaaggcagagatttacaagccaaggaatgtcaaagacggccagcacaccaccagaagctagcagagaggtatggaacagattcttcttcacaacctcagagggaaaaccctgctgatacctggatttcaaactcctggcctccagaacgaagtccctggagagaggacgtgatgtctgaagctatggcagccatcttgtaactatgaggccacaaacaagaaaagcaaaaaccagagtgaagcatggcagagcagaaagatggaaagaacctggatacataagagtgtcactgtgcagctgtacccaccctagactgcatatacctggactttaagtaaatgacaaatatcctttattctatctcaagccattgcttcttcatcttttttgtgtcatgacaatcacagtgggcggtaatatttgtactgccctctggggaacacagaggagactgctggcacctgaggtgaactatgctgggggcttcagctgccccaggactcctccctaccttgaagcctgaggggatacatatctctctgcacatctctttgtggctcatcaatgggcctcaccatacacgttgaaaagttctagtttaagccatacttacctgttacttggctgaatgcacttctaagtaaaacttggactcaatgctgcttgtcaatggaaagtgatgagatttataagatatcatacattctctagcaacatatgaatatgcaaaaaatactgatcttagcccaaatcacatcatatgattctactgacagaactatttgctatttaactcgtgttctttcttgtcagtaatggggccacttcctgattaactacaggcacatttcatgagatccaaacatagaaatttttctttctttttttttctgagacagagtctcctcagtcgcccaggctggagtgcagtggcacgattttggctgatgcaacctctgcctccggggttcaagtgattctcctgcctcagcttcctgagtagctgggaatacaggcacttgccatcatgcccagccaatttttgtatttttctagagatggggttttcccatgttgactagactggtcttgaactcctgggctcaagtgatcctcctgcctcagccttccaaaatgctgggattacaggcatgagccaccttgcccggcctataggaatgtttcaaacgatgcatttgagagtacattcataatggttgaagaattatagattttagggaaaaaagtttcattttatctagaagttcatcttatgggtcaagttattatgttttttatatggtcttaggtttgggtacacaatgaccttggcaataattgatttttctatgagcctgacattaatgtttctaagcaagtcccttttgtcagctccactggtgcttaccgtagagggttg

SEQ ID NO: 725 - DNA, 2763 bp, Homo Sapiens
aggtggataccaccacactgtcttgtagatgttgatgtagtggacgaagagtgctatgagctggcagaagaagagctgcaactcaaacagaatgctggcctggactggcagctcggggatcttgcagtgctgtagaggcacaacagtttgggtggccagaggagggctggagaggcctgttccagaactgctcctgacagtggggagggaacaacatcagcagctgacctgagaatcctaccaggaagggcttctgaggcaaaggattgtgggataagatcagaaaagcagctcatagcaaggacggggtcttcctaatcctgcttgtcagacaaaggaacccgacaaagccttttcctatccctaatcttattcaggtcttccaacaccccctaggagagaaagaattattaggtccatcttacagatgaggaaaaggaggcccagagaagggaggcaacttgtccaagccatcagcaaatctggagcagaactgtaattagaatccaggcctttggatttattctaccatgtcccactgcatctgtccaagtgatcaccctcaactgagctccctctggatcttttctgctgcttactcccctctaagcccccactggcatctaggatttcacatcttagaatccagtcagagagagccctgtccacatcgtccctgtgaggccacagtgaggggtgagacagagaggtggtttacctggtgcgggaacgaacactggtcaccgatgcactggaagtgtggcttccactagagccccccgaggatcccggctcacagagcggatttcgacagtaagatgtcctgttgggacctcttcgtcctcctgtggggctcaacataaaatagagcctcaagccagggggcatatatcaaggataacagcaatgataccagctgccagtcacctagtatctcactttatcatttaatcctcactgagacctatgatctggccccttcttacatcttcagcttcatcccctatcattctctacctcacacccaccctctaccacccgccccatgctctaaacatcttgatctttctttcctcagcaagccaagctcattgctacctctagcacttataatatcctatctggaaagcctttcccggactgccatttctgaagttttgaagtaactccccatcactctctctccaatttctattctttttttccaccagaattcactctctgaaattatcttactcatttgttaatatgcttattgcttgtctgtcctattacaatgaaaggtcaatgaggtcagttaccttatctttttcactgctatatcccctacctcagtgcccagcaagtatatgttgatgagtgaatgaacccagcaaggtaggtttttcacacattaggaaactcagcttacactatgtcacagtatcgtggctgggtcgtgtgctctcaactctggtacacattgggccccattcagacataagtttctggaggcctataactctgggtaactttgggacagctttttcatccagggccccatgattcagctcaaagggcattctgggatctcatgggcaggacccagggcctaaataaagggtcaaggatatggctgggagaatcctgtggctgtggactgaaaaattggacctactaggctgagcagtctagcccaagctcccacgcaccacttcgcacaaaagttctgcacaaagctcctaagcacctaaaaaagtcacaacctgactgggtgtggtggctcacgactgtaatctcagcaatttgtgaggccgaggcgggaggatcgcttgagaccaggagttggagaccagcctgggcaacatggcgaaacccggtctctattaaaaaatatatatacatacatatacatatttttaaaaagttataacctgttcatacctcttcacagtaacacagcagcctccattcacatacaccccacgccgtagcatctcagctcggaagcgtttcccacacttcggagccaattttgggcttggatgtatgcccaaaattataaacctccacaagtctctaaaaagtacctggcgaagagctctgccctccataaacccccagaccagaagctctgttcatacgctgttatacttggcttagaaaatcccacacaaacacccttagtccagtccagaagctctgcccacacccactctcctctctttagaagctctgcacccacataaagcccctcagcccagaagctccgcctacacacaactgtcagcccagaaaccccgcccacaagccaataaaagccctctcagcccagaagccccactccagaatgggctccctcagtcggaagtctccccgctccaccgcccccagtgtaacccctccaacccagaaacgccgactgcactagcgccccctgcccagaatctccacccttagcgctgaagccacgcccactggtaagtcccgcccccctttctagccccgacgagctggtcctcacgaaagcccaagcccccacagggcttcgtcttagaagccccgcccaccgtccaatgtcccgcccccacaacagaggccccaccccgcaaaacgacaggagggggcgggatcccgtctgcgctcgcatcccctccccctcccgtcaccgggctcctgtccgcgtggagcagcaattagcagcctggccatcctaacccgtgcgcccgctcgttgccaggccgagcctgagccgctctgctcacccatctcctccccccggtg

SEQ ID NO: 726 - DNA, 5998 bp, Homo Sapiens
gcagccgcctggcgtgcggagagcggcctgtcgcgcgctgggcgcggggactcagggtcccagcagtgggtcgcgcacctgagctatctccatcctcggagaccgacgagctctcagtgtcctcgtcctcggagctgctcccctcattttcggcgtagtccacctccatctcatcgtgatggttggtctccttcttatcccctcgggaatggactggcattttccagccgcgccgtcgctttccactaccggcgcccagcccggccaccgccgcttcaatgaagggcgcgcggaacgccccaacccacccagccaccgagcttgctcgcccccttggctcctccccgcccccggcccgggcctcacaacctaacccgcaggctctgcgatgggagctctgccattggcggaggccttccaccgagccagagggcgggggcttgccctgctctggtacgattggttgcccgcaattacgacgcggccttccgatgcttgccgggagttgtagttcgtaggtctcagacctgcaggggctgcacgcttccatccctcggcagccctgatcacttcttccttctggacttcaagtcccacaaggcacgaaagctgacactctggatcgcagtttataaactaaacagaaacagattgtgcgaatttagtctgtatttatctatttcccgccaagtgattgtttgacctgcctgaccatcagagatgttactgttagatgtgaaaatgtcttttgcctaaaaggatctttgcctgctcattgagcctggggaactggagaaccatctgttttactaagcacctttattacctaccattaataaactgttttatttaattattaactatagacgataacttgcactttctgtgttgtgcaaaaatctttaaattattcttgaaacttttacaatacagaaggtaaggaagttttatcttggcattttcaatctaatatttttggcatttattttttaccaaatgcagtcggaaaatgccatcagtcctgatttaactttagttttcaatgaaaaatacatacttaaccagatgtactttctcaaaaaaagggtacatagctccctctccctctccctcgccctcgccctcgccctcgccctctccacggtctccctctccctctctttccacggtctcccactgatgccgagccgaagctggactgtactgctgccatctcggctcactgcaacctccctgcctgattctcctgcctcagcctgccgagtgcctgcgattgcaggcgcgtgccgccacgcctgactggttttcgtatttttttggtggagacggtttcgctgtgttggccgggctggtctccagctcctaaccgcgaatgatccgccagccccgacctcccgaggtgccgggattgcagacggagtctcgttcactcagtgctcaatggtgcccaggctggagtgcagtggcgtgatctcggctcgctacaaccacctcccagccgcctgccttggcctcccaaagagccgagattgcagcctctgcccggccgccaccccgtctgggaagtgaggagcgtctctgcctggccgcccatcgtctgggatgtgaggagcccctctacctggctgcccagtctggaaagtgaggagcgtctctgcccggccgccatcccatctaggaagtgaggagcgtctctgcctggcagcccatcgtctgggatgtggggagcacctctgccccgccgccccgtctgggatgtgaggagcgcctctgcccagccgcgaccccgtctgggaggtgaggagcgtctctgcccggccaccccgtctgagaagtgaggagaccctctgcccggcaaccgccccgtctgagaagtgaggagcccctccgcccggcagccgccccgtctgagaagaacatctggtggaaccccatgatggcggtcttcatccgccttaagctggcccacaaccatgctgatgatgcagctatgcggcgtgagctgatggtcctgcgcggtgatgctgtgctggattttctggaaccgaaggctagacaacttctccacaatggcagctttcccctggaactgttgtccttcccacgtaaggcatgatgcgtcaatgtaaattgcgcctagttggggtctatcgttatcaaataactggtagtaatgtggaatgaagctggatcctatctgctcccaaattggcttgtctcccactctggaccgtcagccggcctcgcggagacccgaggggctggcacgatggctgcagcggcggcggcaacccagcacggtctcaaaatgctcatatttttaagtggtctcatgcattacgtatgctacaacttgactttctccttagtgacgtttttgagatttacccattgtgattcaggtagctctcatccagttatttttacctgccataacatgttccatttagtaaatatattctattgaatgaatattacagtttacccatttacctattaatggacagggaggctgctcccaattttttcactattaaaaacatttgtctcagacccagcacagtggcttacgcctgtagtgccagcactttggcaggctgaggcaggcggatcgcttgagattgggagttggagaccagcctgggcaacatggcgaaaccccgtctcaacaaaaaatacaaaaattagctgggcgtggtggtgcgtgcctgtagtcccaactacttgggaggttgaggtaggaggatggcttgagcctgggaggtccaggcttcagtgagctgtgattgtgccacttcactccagcctgggtgacagacagagtaagcccctgtctttaaaaaaaaaaaaaaaaaagttgcctccgtgaacattgcatttgtttgtttgtttgtttgtttgtttgcttttttttggacagagttttcctcttgttgcccaggctagagtgcaatggcaccatcttggctcactgcaacctccgactcccaggtttaagcaattctcctgcctccgcctccggagtggctgggattacaggcgccccccaccatgcccggctaattttgtggttttagtagaaatagggtttcaccatgttggtcaggctggtctcgaactcctgatctcaggtgatccgcccacctcagcctcccaaagtgctgggattacaggggtgagccaccgtgcccagcatgaacattgttgtatgcaccttttcttcaggcatatgtgtgagaatttctctaggtcagtgtctccaaagtgggaggagtgtattcgagaactgtatcctggggggcaggaaggaaatattaaaatataaatttataaaatttttaatttcatctttgtttggaataaagtaggtataaggaagcagttagaattccaggttttactctgatttaccctcattatattccttgtgtttgtttttaatcagcagatccagcttctgaaataaagcaaatttaattccaggctccaccacatggtggggcagagacatcagctatacaatccgtaaactttgtctactgattgactcaggccaaatgctaggagttggaaaaacaaagataggacaccagagctgctactaatagctagtatcgaatcaggataaatattctcatcattcgaactaaaggggctttaggacctacactgagaactagatgagaccaacttataattattccaactacgtgaaaatgtgattccaattgcttaagaatgaaacaatcccccaggctcagtggctcacgcctgtaaaaccagtactttgggaggctgaggggggcagatcacttgagccaaggagtttaagaccggcctggtcaacatggtgaaatgccgtctctactaaaaatacaaaaagtagctgagcgtggtggcgcatgcctgtggtcccagctacttgggaggtggaggcatgagaattgcttgaaccttagaggcagaggttgtagtgagccaagatcacaccaccacactccagcctgggtgacagagcaaggctctgtctcaaaaatttgtaagctgaaccaattgaaatgtttatggtgttggctattgtttgtgctgttaatcatcagtcctcttcaatcagggcatgaccaagattaactttttcctcccaaattgatgtggatggtctagctgtgggcttcatcttcaacatcatcttgtcccttcttaaaataagttatctatttgtaaactgctgattcatttggagcatcatccccataaacttcttgtaaagcatcagtgatttcactatccttccatccaagcttcatcataaatttggtgtttgttcttgcttcaacttaagcagaattcacattgctctgataggggctctttacaaactgatgttttattcttctcagtgcctcaaattggattctgtccagacatgttataacaagttaatataagcttattttgttgaaaaaaaattgacatctatagttttggaatttttgttttgttttgtttgttgagacaagttctccctctgtcgcctaggttggagtgcagtggtgtgatcacagctcactgcaacctctgccttccgagctcaagcaatcttcccgcctcagcctcctgagtagctgggactaccggcacgtgccaccatgcctggctaatttttgtattagccatgggcaacatgtctcaccctgttgcccaggctggtcttgactcctgggctcaagccatccacctgcctcggcctcccaaagtgttgggactataggtgtgagccactgcactcagccagttttttttgtttgtttataatacacatttttcatgaactttttgaagaccccctcatatctctctcttaattcttggaaggtaagataacaacctagtttaggtttggtgaggtgaaactttatcacaggtgactccattttgactttcagtctgatctgtgggggcctagtgcaggaacttagtccaaaacaacagcctcctataatttgtatttaacctgaagtactgttctggattcaatagattcattggtgaataaatgagacacagcttatgacttcatagaacttagggaaaagtagagagataaatattaagcagcttgacaaactgaggtatgctctctgatggtgttaggagagtataatacagagacccaattgagattgggagtggacggcaggtaagacctctctaaagtagtaatatttcagctaagacctgagagatgagtaggagttagcccagatcggaatgagaggagggacattataagctgagagaatagtgtatgttaaggtcctgaactagaaaaaaacttggcatattcatgtttgaggaataaagagaccactgtggatggttactaatgttcaagaatgaaagagacacaaggtgtgtttggtgaggtaagcaaaggcttgataaattatggtaaggaaattagattttttaaaatcctaaatacagtggctattactgggaagttggtaagaggagaagagaagatgagattagtgataaaattacattgatttgagattagctcttataaaaagatcactggttgcttagtagaaaatgatactttatctcaatatcaatcagatactgtgttaaaatattctgacagtttagacaggtagaggctgtgtgggggaaacaaaatagacaaatttgagatatttgggaggtaagactgacaaaacttgatagtaaattaaatttggggcatgagagagaagattaaaatatagtttacttgtctccatatttgagtcatttccttatgctactaaataatatcagcagtcattgcttcaacaaatctccttaacatattttgcttgagttctatgctcactgtgtatgattttcagctctctgttcataataaatcatatttcatttaatgcttcttcacttgtctgtgaatgttacttgctttctttaaaaattaaatgtcaaaagataactgaac

SEQ ID NO: 727 - DNA, 1863 bp, Homo Sapiens
tacagctgagggaggccgtgggagcctccctggactcatctctgcctctgtttctttattgattgttgcccagcaactctgatcttgttgctgttctgtttgggacccagacaatgcaagtggtggagggattttccttgtcaggtctttcaggctgaagtgtgggcacatttgattgtggtgaggggaacgcacagatgtattacaaaatcttagttgataaagcagtggaagggtttgagaggattgactccaattttgaaagaagttctactgtgggtaaaatgctatcagacagcatcatgtgttgcagagaaatctttcatggaaggaagagtccactgatgtggcaaacatcattgtcttattttaagaaattgccacaggcaccccaacgatgctgacttctgtcccagatgcagtcaccttcatgggggcggactccctgcttgtctaggcaatctcaaatggcaatttttgagtgaatggccccagcccacagctaacggcagcagcttgggcctctggccaggctggctgtgtgaccccgccaggccccggcccagctttctcactgacgtgtcaagaagggagagggtgagggtgtggggacttggggagggttggtggctgggcctaatcccactcctgtccccggatgacagtgccctagcagctcacggcagagtttctgggagccctggaagatgtcagcgcttgacctttgctggctgcgggggctcctactgctgtttgcggaagtccctaagtcagtggcaggagggtgagtaaaatgtcacccctgtgcaatgccacagtgctgaggatagtgctgagggcagtgctgaggacagtgttgaggctggtgcaatgccacagtgctgaagctggtagaatgtcacaaggttggggagaatgtggcagattccccaaacacacggaccagaagcatggtggccgcagaccatagcacaggtccctccgagggacagtgggactgcaccgggtgataacaagggctccattcccctacaaagaagtaatcaaatgctctgcctccatgtcggcaaagcaagcacttcccacccatgtcctccgtgaccaccaggaaggtgatggctccgaacagggcctccactcacgggttaccgaggtacctccacctgtgtcgtcagtgaccacaaggagtgatggctccgaacagggcctccactcacgggttaccgaggtacctccacctgtgtcgtcagtgaccacaaggagggtgatggctccgaacagggcctccactcacgggttaccgaggtacctccacctgtgtcgtcagtgaccacaaggagggtgatggctccgaacagggcctccactcatgggttaccgaggcacctgctgtcctttccagggttctgggacaaaacagcacatggacacttggatttaaattccagcaacaccatgatttcaggggctgttatttcagctcctgagcctgtgtttccttgtctgcagagtggggtgcacatggccaacctcacagagctgtgggctccatcaaggtggctgtcgctgtttccctctcagtgctcagcggcccccaggccacccctgcaaaattgctgcttcctcccaagaggtttgagcttggatcaaattcagaactccctggaaagggtggcatcaagaggccccctttccaggcatttgcattgattaaactctcgtgtgacctgtccatgactctagggagaggagcaacgggggtgatgaccgtgacaagctagagaccctcttggacagatggtcgttattccacttgctccaggcaccaccctgtgagtcacggcaggtgttggcatcccattt

SEQ ID NO: 728 - DNA, 1853 bp, Homo Sapiens
atgagagactggatggctgttacaaacccaggtctgtcttcacaaagcaaaactatctctaagtatagctcagaagcaaagatatcaccaccaagtttatacttatagcaagtgtcatgttcctcaatagttttatttaaaaatgtgcacattttttgttggtgccttctgcataaatgataatatttaacagagtatttatgtcttgatccagaattgactacttttggctttcctcagttatgtgaaggatccaaaggtaaagagatagaaataattaaatatggcagctcttttaaattatatgaatgagctactactacttcagtagaaggatcttgtagctcaggaaacacagaacctggaactgggaggtgacatggaccatctacagaactgctaaatgaaacttaagaaactggaaacctccaagagggaaatgattgagcttcaggaaagagacagttacaatgcaagaacaggaatttgaatcagctattgaaaaatgagaaggataaggtacagaaattacgaaatattattgtaagttgagctattcagtattatcatgatatgatatgaaaagagtgtgaatataacaaactgaaggaaagtctacatcaaccttttatgaaccaaaaagaattaaaaatagctttagacattttaaataatgtggggagagctgatggaaaaagaggcctctggaaaactggtaagacagaagtcaggaatttgatgaaatgtataaaattatcttgaatgattatgagtattgtcacaaacaattcctaatggaaaatgctgataatgaagaagtttcttcaccaaatggaaaaggatatgttttttcttctttctcctcaaaagaaacctagagaaagagaagatggtagtacaggaactgttatctcagatgttgaagaagatgctggggaaatgagcagagacagtatctgggaactttcctgtgaaactgtgagagaacagcctacaaacagcatcagaaaacagtggggaattttgaaaagtcatggagaaaaacttggtagccacgtttcaaaggtacacttagaaaatttaatgatgaagatttaatctcaaaacaagaccatgaacaagaagctgaaaaactcaaattagaaattcagaaatgtaaagaaatgattaaaactcagcagcaacttttacagcaacacctcactactgcttgtgatgatgataccactgcactattataagactgttatttggaagaaaaaggatgccacaaaaaatggcccctttttaaagagcaaggagcaaaaaaataattttcagagagaaagacgaagctttacagaagcagctattcacctaggtttggagagaaacatgtttgcaaaaaaaaaaaaaaaaaaaaaaaaagaaaagaaaaaaaagagccagttgattaaagcaacagcttttagatatgactaccattgaccaccagaactcaaaaaatgttaaacttttcagtgtcttctgaggaagttctgatcaggacaatcttacggcgcactccaggcaatggaaaggaaacctcagagtgtgcataatggtctccagtttgcatgtctaaacttactgaatgtcttcttgcttcaccttctactgaagatttcttttcagatgcattcctgtgtatctgaacatacttcaataaacgtactgaatataactcctgaataaattgaaccaaatcatgttgaaagagaatctacaaacgagaaatgaagcatgacagcaagacctgcatcataggaagattaccatattacatgctccctgacccacacaatttctcatggagaaaaagatgacttacctta

SEQ ID NO: 729 - DNA, 3043 bp, Homo Sapiens
gtgctcacacgcagctggcaatggcaagtcagtggatttaggataaaaccgagaataaggaactttacattgtcaatgatcaaacacctagtgcacccatggccgtgcgtccgcaggacaaagcagcctttggagccctggaacttaagatgtccagagatcagcagctctcggctcaggcccaggcagctggacagcacccagcgcctcctccaggtcctcctgggtcccctcctttctttcactttcagcccgggaatctctgtgaagtcctagctgataactaaggggttaatgaataatcacagtgatgagctctggaggagccatggcccagagcagctgtggcctcctttgattaaaccacagaagtccggaggatcaggcctcaaacctccaccacctgccagctggcacctgtgaaggaggtgggaccagcacccacctcacagtggctgcagggtcacctgagatggtgattgcaaagtgctgagccatcgggacacatatttccaagacctcctgagtgccggctggcccctggagcagagatgagacccctgtggggcctacagtccagttatgaaggcagggttcctgtgtaagccagcaggcccagttctggaaaggccaggatgtgggttcagaagctcaaggacaatggactcattctgactggagggatccaggaaggcttcgtggaggaagtggcatttgacattggcatcaaggatgaacaggaatagagagaggggactggtgtctgcgtgaaggatcgccaaagcgctgttctggggtgagggcgatcagcccctcctgcccctcctgaactatgaggctcgggagcctttggcagaaggtggctctgcacgccccaggtgcaagcttggagcttccttttctgcactccacagcaggaagaagggcagtgtgaactgctcaccactgtcttcctgggtttgcagctctgcgcctggcacagagacaggctcagtgacggttgaaggaatcggagaaataatgaaaagtgtgttcatcctgcaggcagcagagcctcgggttaaccgttaacgtcaggaaatgacagatccaacgctcctgcttggggcagcgtggaggccagcggaggaactgcaggagcctaaaggagatggcgcgcgggcctggctcaggagagcagccgtctgaaagatggcggcgaagggtgcgggaggagatgccccgggcaggggcttggcggggtctggcaccaaacttcccaaagcagctgcctctgtgaactgtgcctggcagggagggagccacaccgggagtgaccctagacgctggctccccaggggtgactggaggcagtgtctcccgcccatgtgggcctccggcttggggtccccagagctctgccctgctgctggctgcactgagagaggtggccttctgaatgggccctgtccccggggagcctctggtaaagagattcacctgcaccctcaaaacacgccatgcccattggaggctctgggtgcaggctgcccctcaaacagagaaaaaccacacgctgtttaagacccaaaccaaggagacagcccctcatgcccccttctatctccccttctgtccagggccccctgcctgctctggtccaccccgtcctgaccccctctgcctgttcatctgagggccgtgagccaaggcctgggcctggccaagggtcagggatcctgggacctgcttgagaccatgccccatacactccttcggccagaaggtcagccgtagagacaaacccccaccctgagcccgcagtgtcagcaacgccctgtcctcagtgccaggcagtgtcaggctgagacccgggccacctgatccaacgtccactccaagcaagccagagccaggtgctgccagcctgcccatgtgcacacgttagcagacaggtttcctggtgtggcacacacgtgttatgaccgcggctgctgcccccagcccagagtgcacttccgggtaatccagcaccctgaggcttcactgctctcctgagagttttctaagattaaatctccttcacaatgacagcctcctgtcacctgggccctggtgacaaagcctttggagaggcaaggacccagccggggcattcacagtgggcatgctatccaccctccgcccctgtcctggcccccacagtggagccgccaccttgggtaacaggggctgcctgaggtcctggagaaggaagaaccaggtggcccaccttcggtgcacagggaacagcagggacctgacggcagcccccgcacccctccctgggctgaagttcaggctgtctcatcccttgccaggagctcagggctgagctaggttggcaggggatgggttgagggtctgttgtccagcagattgcccgggccccacccaggccactcagaaaacacctgtgagagccccgcaggcatgcagggcactgtcgtgagcacaccagtggggacagacgtccaggcaggagggagcagccagacccccatcccgccagggtcaccaggtgagcaaggctggggaacaatggaggcggagccccgcgactgcccagctcactgcccccagtgtccaggctgtggtgcaggcgtggggacccaggtgtgttcaggggtctccttcagggaaggagaccaagctgggagtctggggaggctgaggtgtgaggtgacagcaggtaaagagtgagccacaatcagcattttcacatgaaaggaaactacaggcctgggcgcagtggctcacgcctgtaatcccggcactgtgggaggctgaggtgggaggatcacctgaggtcgggagttcgagaccagcctgaccaacatggagaaaccccatttctactaaaaaaaatacaaaattagctgggcatggtggcgcatgcctgtaatcctagctattcgggaggctgagacaggagaatcacttgaacccgggaggcggaggttatggagagccaagatcgcaccactgcaccccagcctgggcaacaagagtaaaactccgtctc

SEQ ID NO: 730 - DNA, 2035 bp, Homo Sapiens
gccttcacgatcgtgatggcccgctggtcccacttctctgtctcaaactggctttttctcaatcctttgactccgccgggctttgtcacccccatgacctggtgttgggtctgatcaccccaacgttcctggctgctcaatgtggggtgacaaagaccccggtgaaggaacgctagagcgtgtgaaagcagaggacgcatcatcagaggacacctgaggatgtctaaaagaagctcagcaggaaagctgagtgctgggaagaaccagggtagcaatgggacaaagtgaaagcagacattctgcttatttaaatttcttaaggcgtttattatgaagaggggggagtgaaagttagtgctcagaatttatcactcttcagtgcagtaaagcagttttgcccatggttcccggaacaagggactatggagttggatgaatgggagagaattggcagagatttttaaaaaaacatataaaggtggagcaaatattccagtctcggtttggtcaatgtgggcactaataaaagcagctcttgagccatttcaaacagatcatgaggcagattcagatgaggaagaggagggcgagtgtaaaaaactaacttcagattctgaatgtgaggaacagaaaccggaggaaatcaaagaaagggaaaccgaaaaaggtatgttttactagcccctcagctccacctgctgaattaagtgaatggccacctcctctctctccccttagtgggcgagaaaatgaattagctacaaaacttaccgctcctgtagttgcaacattaaaacctggagcaattggtagtactaagacccagtggaatctgaggcttgtttatttagagagcacctcaataaactgaggcatatccggcacagccagtgcccttacaaacggcaacaattgtctcccaccgcggcgggcagtgctgccgtggacctttgcagcacagttctcatttccctgcttcctgggagccactggagagggtccccacgggagttgggggacccttgccctcaggaaccgtcggtctattacttgaaagatctagaggtggcactgtgcatacggaaatgattggttctgattataccagagaaattcaattagttattagttcctcaactctgtggtctgcttccccaggaaaaagaattgctcagttgttgacataaagctgggaagcagcacagtgagaagaacaggaggctttggtagtactaatccaacaggaaaggctgtattttgggttaatcaagtgtctgacaaaagacctatttgtacagtagacctgctgttggatgcttacagactgacacacaggcctggttggcagtagtctccggaaaaaataaatcatgcgctgctttgcgtagggcaagtcaagtcatcttgaagcttcagtttcatgtttaacctgcctctgctggagaaaaacagatttaataagcacacaggcatgatatgggctgaatgtgttcattgtggtgtttgtggcctttatgatgggaatgttcaacctctactactacattggtgcaaaacaaagtgaagccttcacaacagagttttaagacactgctctaggctatatttggactttctgaagtgaaatcagtggtcatcaactataaccacaaattcattgaaaacattggttatgttatttatggagcctataatgttacaatggtcattgttttgctaagtatgttaactgccatgatcaacaattcattccagggaattgaggatgatgctgatgtggagtggaaatctgcaagggccaaactctggtttccctgctttggggaggggagagcacttcctgttcccttcaatctggtgccaggtctggggtccctgttttgtctcttgctgaagcataaagggtggatttttcagctctacccagggtcataaaaaaggtttccaagaaagatgcagagataagtcagtaagtagagataagtaagtggagacaagaaagtagagacaaatagagacagagacaaatagagac

SEQ ID NO: 731 - DNA, 2414 bp, Homo Sapiens
cttttcgcatatggagcagcaatcagcttacaactaaatcacatctgagcacaagctgtctccacaaagccaaccaaagaggcaacattcacaggctgacaaagcatccctaaagcaggaaagaaaagaagcccctgaggctgctgcccggagaaggaaaaggctttcaacattcataccagtctgttggggcattgtgcagaccacagagggagagtaactgatggaatactctctgaagttcacacttgggcgaagctgcatgtttaacatcaggagtgggaggaaagtttcactttccccaaccctccaatgccagaatccatcctctctgtgtgaactggaacgaggtgcactcagtcacgtaggatggtgactaatcaactcattacactttagagtaaatgattttcaataaattgcctcatccaaacatttctatcttaaaccattcatctctgctgctcaaagtttaatctgtttctaaaggaacttagacatctgcaagtagttgaggaaaacatttctgaaaataagaataatgtcattcatccaacacattttattataaagtttaccgttacagaatgaaatttgcccccttgaaaattcatatgctgaggccctgacccacaatgtgactccatttacagatagggtctttaaagaagtaattaaggttaaatgaggctataacagcgggcccctaatttgatagggctggtgtccttataagaagagaaaaagacaagagctcactcacttctgggcttacgtgctctctctctgagaacacacagaggaaaggctatgtggggacaccaagagaagacagctgtctgcaatccaagaggagaggccccaccagaaactgaccctgctggcacctagatcttggcatgtccagaactgtgagaaatttgtcttgtttaaaccacccagtccatggcattttattgtggtgccaggcagactaatacacttccttacctatttgtcaagcactgtgttagacagtagggatacaaaatcgagtaaagcagagcccttatttgctcagaattaatggcggtgaggaagatagagaagaggaggtgtgatcagtggcactactgattcatttgtctagcgtggtttaggcagtaccagaagggatggggcagacggtacacttctataaagtaagtcatgtttatctgtaacaattttttttttctgcttttttgagagggagtctctctcttgtcacccaggctggagtggagtggcaaaatctcggctcactgcagcctcctcctcccgggttcaagcaattctcctgcctcagcctcctgagtagctgttattacagatgcccgccaccatgcccagctaattcttgtatttttagtagagacaggatttcaccacgtaggccaggctagtctcaaactcctgacctcaggtgatccacccacctcggcctcccaaagtgctgggattacaggtgtgagccatcgtgctcggcacaaattttaaatattgtagaaacaatcatagtagactgaggctgggttggttaggcttcttttataagatagtgatttattttttaaaagaaacttttaaaagaaagcctcccacttagagataattagaatagcaaagcatttaaagaactagaaagattcttgggtagtctgggttagctgtaacacacaataagaccctcagtctttcactctgcccttcacactctccccaggaatccttctagtaatcttaactccctcatgataccactatctaccagttgctccagcaaaaaatccaacagtcaaactttatttctctctgtatttcattttgtacatctatgtcagcaacagatcccactgcttctaattccaaaatatatcataaaccgaactatctgtctccactgccacctcctcagcccaactacaatctgctctcagctagatttcattaaactctccaatgtctccaagctttcccaacaaatcgttctccctacaagagtgaaattaatcatttttaaaggatggacctctgtttacccttaaaacaaatgattatataatactgaatacacatatttaagaaaaatagagcagacatctatatagctactacacatttaaatctccttatgtgtctcttcccaattaactatgctgttcatcatcttccaactaacctgtacttgatatttattttactaacatacttcttttggttgtctaaatctatctctaagcaatatatattatttttgcatttttaaagtttggtgtaaatgatattttattgtatttattctttggcaatttgtttttatctcattattatgcttgtgacatttattctcgttcatttttgcttctgtataatattccacgttctgaataaac

SEQ ID NO: 732 - DNA, 1292 bp, Homo Sapiens
tgggcgacagagcgggactctgtctcaaaaaagaaaaaagaagtgctcactccccagcctcaggagtggccatgtcaacccggggggcacagccacacaggcaagggcagccctgggttggcctcagcgtcatgcggcattgacactgggtggacatgcactggccggccacaggcctactatggcgggatgtggggattccaggtgaggggcatggatggtggacaagatagagagaggtttgggggttcctgtcagcaggccttgttgttgggcttgacatctgcagatcttcctttcaactcggacccactccagaccttgagatccccagggatcatgcagagtgaaagtgagcttgcgtcacccacctctccagtggactagagctcctcaggactaagatattctggcttcctccaggggaggaggtaggagaaaaatgaataagagggaaatgggaaggaagagaaggaagcaaactcccagaagaagtttgcatccaacggcaaaagaggcaacaaaaaattaccatcaatagctgagccaaagtagatctagttccttctgcatcccaagcatcacgctaggtaggtactctcacaaaacacggctcattttttttaaggtggattttattttactcatttaaacagctttattgaggtataaaccccacccacagagagaatatttctatcctcgcttttcaaataaaaccatgaggaacagagaagttgagcaacttccccaccattgcaaaggttttagataacggggcagagatttggtgcagaactgtgaagtctctgaactcccctcaccccactcacaataatgctcctgttacaacaaagaacgaagaaaacgagcgttcctgggatgaatccatattgctcctgtggagtaaaccatgactaggaatgcaagcggggctgaggcacatatctgcctctctctgatctaacccttgtcaaacaatgtgatttcctttccacaccagagtggagatcctttctctgccctatggctgcacacctgcagcctttgtccataatttgtacactttacttcctgaaaataccggcctgaaatagcaaagataagatggtgctccatctgggctctgtgtccatggaaatgtcggtttcctggctgacttcaccctgtccctgtagcccttgtctgtcattcctgttgggggccatgccctgctttggagtggtgtgtgtccctgttggcatggcttcctgagagctgtcactgaacctgggaatcagaagtaaacccaa

SEQ ID NO: 733 - DNA, 2613 bp, Homo Sapiens
ccagccagatgctgtgaagtctccataaatctgtcagccgtcccagtgccgcgggcagtcacctgcggcgcccccttcccggcgctagagcggcccgcggagagacgcggagaagcaacgggaatctagcccggcagactgtacccgagggctgccgaagtcagacccaagcactacaggttgtgcggaacgcgaggacccctccctgtatccccaacctggaccgacccccggaagcctgctcctccgggtctacagggatgaaggtcagagtgtcaaattgcagattttggatcctcaataatgggccgctgtatttaacctcttcaacttcttttctccacttataagaaggaacaaaataaaatgttttgtggaagtttatattgaaatgaggtcaggtaaactaatgactgcttggtattttatgacaagttttataaccttggagttgccataactttcaaacgatcatcaataaagttttattgcaaaagggtcgccatgtgtctgaatgcttttgcacatagtaaagctatgctgccccattgtcgtagctcaccagccccttttcaccccagccataaagtcctcttcttttttattggaggttgaaaagtcctcgggtctgctctcctccatcaagttggcaatgtgggaacaacacagaaattaaactacatgattaaatgatcgtacacaaccaaatcttcaagaatatgtaataagactgctttttaataattataaatttggattttaaatgggttccatttaataaaataaatgacagtgggcggcgggtgggaaaggaggaagtcagatgagagtttcctccagaaacttgtgtttgaatgttagataagacctatcagtctacccgatatacccagagggctgccattaaataattaggtgcttagggaccgataatggtctcaagacaaaacaacgaattgctaaagactctttgagctgacccgaggatcttaaagatttaagaggcctcgcattgcgtcctaacttgaattttcccacggagggaagggttgggctacagctcatgcttgcccgattgctgcctaacacattccctaaacgctccctaaagccaaaccaagaacttcaagtgtccacttcacggcatcagctgtcaggttcaggttcgggtccgcctactccttgtccactgccgaatgctatgtggaaatgaagccgagaataatgtcctgcgatttagatgaagagaacagtaagaaaggtagtatgaaacgaagcttctactgacgcgcccttcagacaggtattccgcaggcgagggttgtgacccagggagagagtgcgggagtgctagcagagcggcgggagcggaaggagaggctggacgaaagttggaaaatcatcccatctcgggacttgagtgcgagagcccgccccggagtcggcaagtctccagggttagaaggccctagctccaaagttttttgtcccggctcaggcaggtcccccacctctaaccttccccgatttgcctggttgctctcggggaagggactggtaaataccgccctctcccggatttcctgaaactctcaccagcgcgctgaacccgctccttcccacgttcggcgccccgcactctgcgtctgcgcccactgcgcgtcaccttccctccggccgagaccactagagccctagatccgggatctgcggagggaacaggacctgagcccctgctggaccctgcaacttggctgcggagagcgcgcagccacaagcgccgttcctcacttgagggcttcgcgagagctggctcagccccgcgggtccccgccagtcctcgccagccctcgccagccccggtcggccccacgctaagtccgcagcaggcgggaaaccccgcaggccttcccggactcacgaactgcctactcccacccctaaagagctcagacctgaaggtgctcttatggtgcgtggccgcaaccccggagtggaatgggtggggggcctccatggcgaaggagacgccgtgggcgaatcggctcccagctcgcccctcatgtcctacaggtcactagccgagtccctaccccgggcgctcccatgaggcaccaagagcagccacggcccagggaagggcctgggtcttcactgctggagcgggccccagtcgagggcgcgcaggtgtcggggtccccagcaacctccgtatgcgcggaaagccgtaaacggggttctgaggccggcgccaggcacaaggatcaccccgcgccacgggccacggctcagagcgcccacgaagcccggctgccaggtccaggccgcggccgggcgggacccactcgctccccacggtgctggcgcggcgggagtcgggctggttaaggcgggaggccggcactgccacgggctgtggcgccccctcccgaagacacctcgccggaagtgcggctcccgcctggcaggcgctgagactcctcggctgtagcgcgaaggccccggtccgcgcaacttcccataataacgccgcgaaatgcctccagaaatgcctgtgtggtatggtgtctgagccaatggtcggcattcgtcttccccaagtgcggaaaagag

SEQ ID NO: 734 - DNA, 3348 bp, Homo Sapiens
actacagcctcagtgcatggcggtgggcgcttccagtaactcaggggtgggacttttttcttgctcaggggatgaggccgagcccacaggcttagaaagaaggaacttgagtccgggcacctgtcatcccagcgcttagggaggccgaggcgggtggatcacctgaggtcaggagttcgagaccagcctggccaatatggcgaaacccccgtctctactaaaaatacaaaaattagccgagcatggtggcatgcacttccagctacttggaaggctgaggcgggagaatggcttgaacctgggaggcgagggttgcagtgagctgagatcgcaccactgcactccagcctgggtgacagagcgagacttcgtctcaaaaaaaaagaagaagaaagaaggaagctgaggttcagacaggctaagtccctactgcaggctgcggaatctaaaaaggtaggtgccagggtttgcaacccacacttttattttggtctcaggtagctgatgtcattccagtctatggcaaagaaggtggcaaatccattaacatagatgaagaatttcattttactttttagttttatttatttatttatttttattatgtatcatgcttttaatacaaactttaaaaaatctggaacaatagaaactgtacagatttgatcaatctttttgttttgtttttaaactaaaatctctaaacacaccaatgtcctattccaaaatattgcacaacattctgaatacaaaacccttgattgtattcctccttcactgaagaaaaaacttcatgaccctgctccccgggctcctctccaggcttgcgtcaatgcccccttcccatccctagggagaaaactagagaatctataactcactgcattgagaaaaagacatcattctggactaacagtttccattcttcagaagataatccaccttttgatttgttcctgggaaacagggatagatagaggatggggaaaggggagaaaaggttttatttctcctcttttttttttaaagtttgtttttcctgaaaaaatatgtttctctcatctttttaagaaaaaatcttgaaaagaaaaaaattgtttttacgttagaaatatacatatattatatatacctcttacattttacaaatgtagcaaattattcaatacaaacggacaccaaaaaatgtaaaaaataaaaaaaagttttcctaagaaccaggtaaattagtgcagatttctgtttttgttttcttaaaaaaaataaaattgaagcaaaagtgcctagatttgagacaagacagactgaactgggcccaagagcccagcactggagtcatgctcctgaacacacatttttcttcgtatttcaaaagacacaaaggggttggtctccccccctctccctacatgtgagaaacaagcagacctggtgtgggtgggtgcctgtgtgtgtggatgggaggagggatagaaggggatgtaaggcagcatccaacctttcccagagagaagctatctgctgggcctgtcacctgtgtgggagccgaggatgagggaaagggtggcccagactgggctggcccctgagaagtctaggggaacagatggtgctgggctgagaagccaggacattgcctgccgggggaggtagagctggtgcctactgcagggagaggaggctggcagtgccggcctgggctggacccactgccatagcagttgcctacttggggtccctgggtaggatggagtgggtggggtgccaggggctttggtgctttctggtgatgggaccctgatgccaagtgcccactttgcaaagatgaaaaagttcatgaccctgctcccttggctcctgtccatgcttgcctggcctcctggggttggaggaacaagctctctcctggcagaggcaggagagagttttattttttagaaacagtttcgctttgttgcacaggctggagtgcagtggtacaatcacggctcactgcatcctcgacctccccaactctagtgatcctcccatcttagcctcctgagtagctgagattgcaggcatgtgccaccacactggctaacttttttttaacttttattttttgtagagatgaggtgtcgctatgttgccctggctagtcttgaactccaatccttccacctcggccttaaataattttaatagttgacatgcacatggcatttactattggccggcattattttaaggtgcctgctctgaaggaattctgttagccttcctaaattattcccttggccattggaaacataggcatgagatcatttttagataattggaaaagcagagaaatctgtgaagatagaatgggaaaaaaaatgcatttcactaaaccaacatgccattgattgtgagattccacattactttatgtagccccacggctgcccttaaaccatgacacatgctttatttacagttcatattttacttattcgtagacctcaagaggcattctgtgcttccctcttccttctggaagcttcatgagaagggacattttcctcaaaggatggacaacagaaacaactcaaatattcatttcctttaaatatggtttttaagacaattttctttagaaagccacatttacctgttgggggttgatttatgctcacccccctcccaaatatatgttggaatgctaaccccctattcctcagaatgtgactttatttggagacaggttctttacagaggtaataaagttaaaatgagtaaatagggtgggccataacccaaaatgacagctgtccttataaaaagggtgcatttgcacgcagagacacgcatagagagaacatgatatgtagaggcacagggagaaggccgccatctgcaaaccagggagagaggcctggagcaaattcttcttcatggctcttagaaggaaccatccctgcctacaccctgatttcagatttccagcctccagaagcgtgaggcgataaatgtctgttgctgcagccacaggttggcggtgctttgctgcagtagccttagcacctgatagatggtctctttacatgtcaagcacattgcagcgcacatttgacacacagggagatggaagctcctggaggataagtgttttgtctgtgattttgaaggttgcaagtggaggaactgggattcgaacccctctctgtgtgatgcctatgcctcctctgtgttaacatttatttttacttatttttattttttagtttttgtagagatgagggtctcactatattgcccaggctggtcttgaactcctgggcccaaacgatcctcctgccttggcctcctggtcttgggattaca

SEQ ID NO: 735 - DNA, 12765 bp, Homo Sapiens
ctcttgaatacctcatcaacaccgcaggtgacccggagcccgctgctccgctcggccccgccccgggcagctatttggcacatttcaattagcgtaacgggtgcctggtaaacagccgaggccggctgcgggcacctgcaatccccgacccccgacgccctccccgagaccctggagacgcggctccgcccccaccggtaattaggagattttcaaggcctatgtccccaaagcccagcccagctggagagatcagccctgcggtcctgccgcgcactccaccgccagcctctcgggagtcaagggatccgccttcagggtgaattggggttccaccatgtcaccctcatggagctttcgttagccttgtttgggatacaaaggggtaagtgtcccctcattttagagaaagatcaagagccagtgaacaggatttcccagccagggacatggagcagggcacctgcagatggtccacgtgctcttggctgatggcagcccacctccgggaggggcctgtgcacctttctcccaggaggagggaaggacccaatcattatccagagtcaacggtcctccccatgctttccggctgtaccctcatcctcaggacgaacctccgcacctcctcccatcatctcaggccccatctgcaaagttgggatcagagagaggcccagactgcgctggacaactgagccagttttcatttcaaatcgaagtttaaaagatgccacttttaattatgcttgagtgcagtgtaccctgaggccttttgtggtaaatggctctcaataatcccagtttattcattaattattattaattattttcttaagtagtggcaaggggacgcagggccccgctcagaccacaagtcgcacatcgactgtcaaatcctcgatgagcaggctctgaagagttgcctgtgccggctgcaatctggctcgcctgggcccgggctggggtgccaggagcactctggactgaggcggggcttccagagcgtggggcagggctgggggaaaggagggcctggaggagccacaggccacaccggacaaaaacaccttccaccagggtggcacttcaccttcgggaagctccttcactggataatgaagacttttgtcttcagcaaagcgaggaagaaaagaattaccattaccaccagccaaggcacctgacacatgtggtcagtggtgaactggtaaactcgttctccagaaacaaaacaatcatctcaatcatctaacatttctttcctcttttttttttttttttttgatacaggatcttactctgtcacccaggctggagtgcagtggcgcaatcttggctcactgcagcctcaaccttccaggctcaagtgatcttcccacctcagcctcttaagtacctgggactacaggcgcacaccaccatacctgcctaatttttgtattttttgtagagatggggtttcgccatgttgcccaagctggtctcaaactcctgagctcaagtgatcctcccacctcggtcttgaggcttgagccactgcacctggcctaccatttcattatttatgattctataatattccactgtaggggcatacaggtcccttaacttctcagttccttactactgggccatttcccacttttcattattctaaacaaatttgatgaacaggcttttgcataggtatctacccataccctcattcacttacctaggtgacatttctaaaggtgaaattaactgatcaaaggacgtgtgtttttaaggctttgatgcacattacttaactttaactaaactcaggaaaaacggtgataaattataccccaaggccagcacttgggaagctgagatgggtggatcacttgaggtcaggagttggagaccagcctggccaacatggtaaaaccccatctccactaaaaatacaaaaattaatgggtgtgttggcatgtgtctgtaatcccagctactagggaggctgaggcaagggaatcgcttgaacccagaaggcggaggctgcagtgagccaagatcacagcactgcattccatcctgggcaatagagtgagactcggtctcaaaaaaaaaaaaaaaaaaatacacacacacacacacacacaccccaaggatagatatttataggggatcacactgatctttatatacgaggtctagaacaaggcaaaatgcaaataagaaaaagtcctgaattctagtacttgccagtttccatggtgtaatactcccatcctggccagtatggagatactaacaatttaacaactggcttgcaaaattcctgaaaatctaacaaccgtctctgggagctcatgggagctgaccctggcaccttagtgtgtgtgatgagatttcctccttctctgaaaggaggtcatggtaatttcatctgtcaacttgactgggccatggggtgctaaggtgctggtcaaacattctgggtgtttctctgagagtgtttctggatgagattaacatttgaaggcttggtgcagtggctcatgcctgtaatcccagcactttgggaggccaaggcggccagatcgcttgagctgaggagttcgagaccagcctgggcaacacgacaaaccccatctctactaaaaatacaacaattagctgggcgtggaggcgcatacctgtagtcccagctacctgggaggctgaggtgggaggatcacttgagcctaggaagttgaggctgcagtaagccgtgctcacaccagtgcactccagcctgggcaacagagtgagaccctgtctcaaaaaaaaaaaaaaagaagcgaaagagggaggcaggagagtcagcatcagaggaatgagatacaggaaggagtcgactggtcattgctggctctaaagatgcaggaaggggtcgagaaccagggagtgcaggcagcctctagaaaacagaagaggaagaaaatggattctcccacagagcctccaggaggcaagcaggcagccctgccgacacattgattttagcccagtgagggccgttccggacttctgatgttcaggactaagatatattgtgttattttatgccactaaatttgtggccatttgtttccaagacggtggtattgtccccatttaaccaggtgatggaacaaaatttcagagacataaactctgtgggtcacagctagtgatgggggcccaaaacagggtttgaccccagggctgtctgactccatggcccacgttctttgttgtatcccagaagagaagccactgtttacacgaaagcacctctgggaaggttaacaacttcgtcctgtgtcaggcacgggaactgcgtagcctttcttcatgaaacaccagaaaataaaagaaaccggccggacacggtggctctgtcaccctaggactttgggaggccaaggcgggcagatcagttgaggtcaggagtgtgagatcagcatggacaacatggcaaaaccctgtctctactaaaaatacaaaaaaaaaaaaatagccaggagtggtggtgggtgcctgtaaccccagctacgcgacaggctgaggcaggagaattgcttgaacccaggaggtggaggttgcagtgatccaggatcgcgccactgccctccagcctgggtgacagagcacaagactcagtcaagagaagagaagaaaagcggaggggaggagagggggagaagaagagaaaggaaagggaagaagagaaaggaaggaaaggaaaggaaaggaacaaccacaagcatccacatccagcttaaggcagagatgagtttgcaggaaggaggggaagcccaagggccggagtgaaccaggagctgaaaaccagacggtggctgcgtgagtgtggccagcgcaggccgaggcttcctggtcctggggtccagggcttggactctgactcctccacggagatgagaggtgtggcctgggggatggacatgcagaatcgagacccctgcataaagccaggccccttcagttctgcggtctccgtggaaggacagagcaaaaacacccatccccagcacagggagattgggagagggtctgtcactatgggagaaggaagatcagagatattggcagagcggtctccagaactgattaaaatcaggcaccagcagattcaggaagcccacttgagtcctcagcaggccccagccctggacacaggggctcaggacacagccactactagacaggagactgtaccctccgggcctagtgccttaccaagcactgctcctgggagaatgtttgctgaacggatggtgatggggagagggaaaagagaggggaaagtgagggtgtctaagtccagcttgagacaaggccgggggattcatagtctccacccaccctctgccttcagaggtccaaggatggggtgggcaccagcatggggctgggggagccatgggggccaggggtatctgctgtgggctcaaggagccctcccagggctcagaccccagcctgaaactctcccagcactccaaaagccaaatcccacccagctctgggctgcttcatggggccccagactggagaagacaccccacgaagggtctctaaggaagaggcgctggtggtcaggcctgggcagctgtgggagctgagagtttaatggggagaacgtgctctgttggcttcacgctccaacatcagggggaaccagctgcaccgtttccccagaatcacggtctcttgagcccaatattcaaatatatgcagacgtcggagcctggactatttttagctgagactcagagggagatgatctcaggctgactcggagagtggcccagtcccagaggagcgcagaatcaacctgaaaagtcaggcttggggaccacccccttctcctgctgtaagcgcctggattctgcaccccaggtgccctgaaggtctgtgttgtgggtgtttatttggggcggagggactggtctgcatccctggggagctgtgttctctttccttcgatgccttttttcagcaaacactttgcttttctgcgaaaagacaaagcgggctgcatgctggagccagcggcctggctagggggccgtttacctcccgactcgggatgcgtggctcagcctcttattatcttgaaaggcagcagaagtctgaccccttctgtgtgagcttcccatggctgttatagtcacttaccaccggctgtggcttaaaaccgcgggagcgtatttcctcacagttctagaggccagaagtccagcatcagggtgccagcagggccgtattccctctgaaggcgccagagaagggtccatctttgccctcccagcttccggcggtcaccagcaggccttagtgtttgctggcgcagctgcatggctctgatctctgcctctgtcttcacagggatttcttccctgtgtgtccccgggtcctcttctgataaggacaccagtcattggacttaaggcctctgctaatccagtctggcctcatctcaaattgaagaacatctgcacacaccctatttccaagtaagatcctattcacaggcaccaggggtgccttcaatgcatcttttggggggaacacaattcaacccacagcatcttctgtgttgttctgcccaaggacagccaccccccagcagccgcggtgagaagttcccccaggtttggggtttccaatcttgggtggcggcaggctgggagccagggaccgcttgagccttactgtgctctcctgctaggaggggcggcagctccttgcccctggagacagcgcggctccccagagcagctgagtgtcttgcagtcatcaacagccacctcatctcagaggcagcacctggaatcttacctgcctcacctcctttagtcctcaaaacacctgtgtcccaggattatgtcccttattctacagaggaggaagctgaagtgcaaactaagaggaagttccgaagcagcaggttggggtgccaggtgccagcctggtgaggagctcggggctctcgcgaggaccgtgacggggctttcaccccatcttcccttctgagtcgggcttgttgggatggggtggtggggtctgcacctgcacagccaaggaggagcagggcagcctcaccctagcacagtcctgaaaagagggccccgccccctttaagggaatacgtgattcccttttagagagtgctaggccgatacttggaggagccagtgtggtcgggcagaaaggggtggacaaacctaaaccctacggacctcttttttgagaccccaaactgcctgggctcttgcctcccagaagtcagatcttccccaggggagggtgtgggaaggtggggttagggaacatacagggtctttgggagccttctaagtcagccaaggcagctggggcagctgcagggccagagcacagggaaggcaggtccccaggtctagctgctcggcctccagccccgccaggcccagctaagagggtgctttggctgccaagagaagaacccagggtggggactgcctcctggacctccacaggcagctggcctcctacagtcctgctgggacctgggaccccgtcctctctgctgcccttcagcttccctggctgtgagggacagaacttgttaccagcctcccactcatgttatttctcctgcccttgaacttcaggactgtcttggagccagccgaggcctgtttgcatcctttgcccccaggtccagctggatcccccaccttttcctccactggattcagcctagtgggccctgggctgcaagagaagttgcttcagcccaggggctggggctggaggccaaggcttcaaatgaggcctccccaagttggtactcaacctcctctccctccttggagggcaaagccatgagggctgcagagaggagctagccaggtatgatgggtaagtgcagtggttcacagtagaaccacactagacacatagaggagtgctttatgaaatgctgatgcccagctgggtgcggtggctcacgcctgtaatcccagcacttggggaggccgaggtgggaggatcacttgagcctaggagtttaagacaagtctgggcaacatagtgagacgcccccccacccccatctctataaaaaaaattagccaggtttggtgacgcatgcctgtggtcccagctactcaggaagctgaggtgggaagattgcttgagcccagaagtttgagggctccagcctgggtgacagagtgagaccctgactctaaaaataggaaattttttttttttgagatggagcctcaacctccacctcctgggctcaagcgattctcctgcctcagcctgccgagtagctgggattataggcgcgcaccaccatgcccagctaatttttgtatttttagtacagacggggtttcaccatgttggccaggctggtctcgaacccctgatttcaaatgatctgcctacgtcggcctcccaaagttctgggattacaggcatgagccgccctgcctagatattttggtttttggtttaattggctcaggtgagtccatgggctgaggggcttcatcacacctgtttcctcacctgtgagtggggaggggtggtcacctggcagggcggtggtgaggccggcccgtgcctgcccttccctccactgttcagagttgggccagggctgaaggaggcgtggccagcttcagaggaaggtgtgggagccgcagctctgcctggcactgacatctgggctgcaaattctttctaattctcaacttctcccccactactgccagccagccccttcagcttcatttaaaagttcagacaggattcaaaagtaggttgatatataaagacctattaaaactcaatactaagaaaacaactcaattaaaaaatgggcaaaagacctgaacagacacttcgccaaagacgatacacagatggcaaatatatatgtcacgtcatatgtcatcagggaaatgcaaattaaaacagcaatgagataccactgcacatctatcagaatggcccaaatccaaaacactgacaaccccaaatgctggtgaggctgtggagcaacaggaattctcattcagggctggtaatacaaaatgctatagccacttgggaagacagcttggcagtttcttacaaagctaaacatacttttaccatacgatccagcaatcgtgttccttggcatttacccgaattagttgttggaaattgtgtccaggagcttctggacagctgaacatgtggaggttcctgggaggtggccgtccagggagggcacggaagttccgtgtcctccgcccccttcatacctcaccctacgcatctcttcatctctactctttgtaaaatcctttacaataaaccggtaaacctaagtatggccatgtgactaagctctggccaatggagcacaatcagaagcagcatgagctgactccccctctcctttttctctttcattggatggaatgaggccttagaggggacccatcttggaccggatgaggacaacagtccagaaatgctggaagaccaagctgcatctttggcagattatattttccaaagatagaggcaacactatatcccattccacgagcacttcttctgctgtgactttgacacccctcccattgaggggtggcatctatgtcccctcctcatgagctgcagcaggaggagctttgtgactctcttgaccaatagagtatgccagcattgacagcatgtggcttccaaggctagttcaaaaaaatgcctttcacttccaccttattctcctgggatgttcactcttggaacccagccaccatgctgcacggaagcacaagagtccttggaaaggcctacatggatgggaaccatggcccccagcccaaatcccctgctgagctccccagccgacagcaccaacttgccagccacatgagtgagctgtcctggaagtgattctccagccttggggcaagccacctcagctgatgccatgtgaagcagagacaaattacctccaccaggccctgcccaaattgcagatctgtgagcaaaacaaatgactgtgactgttataagcagaaaagaaaatagaaaagaaaatggattccactcaaaaacttggaagtgaacatttatagcagctttattcagaactgccaaaacttggaggcaaccaagatgtccttcagtaggtgaatttgtaaacaaactgtgatccatccagacaatggaatattattcagtgctaaatggaaatgaggcaccgggccacgagaagatgcagaggaatgttagatgcatgttacgaggtactagggggaaaggagccaatctgagaaggctacaaactgtagggctccaactacctgatgatctggaaaaggtgagactacggagatggtcggaagatcatggttttccagggttaggaggaggcagagatgtacaggggtagcacagaggatttttagggcaatggaaccactctgtatggtgccataatagtggatacatctcattaaagatttgtcaaaacacgtagaatacacggcaccaggagtgagccctaatgtgaactgtgtttggttgatgatacgtcagtgtaggctcatagattggaacacatggaccactctggtaggggatgtggatggtgggggtggcctgtgtatgtgggggaggtggcatatgggaaatctactttccacccaactttgctgtgaacataaaactgctcaaaaaaatagtctttttttttttttttggagacagggcctcactctcactcaggctagagggcggtggtgcggcatgatcacagctcactgcagcctggacctcccgggctcaagtgatcaagcgatcctcccacctcagtctcccaagtagctgagaccaccggcacttgccacactagctaatttttaaataatttttgtaggccgggcgccctgggtcgtgcctgtaatcctagcactgggaggccgaggtgggtggatcacctaaggtcaggagtttgaaaccagtctggttaacatggcgaaaccctgtctctactaaaaatacaaaaattagctgggcgtggtagcaggtgcctgtaatcccagtaatcccagctactcgggaggctgaggcaggagaattgcttgaacctgggaggcgggggttgcagtgagccaagatcacaccactgtactccagcctggatgacagactccatctcaaaaaaataaaaataataacaatttttgtagagatgggttcttgccatgttgcttgaactcctgggcttaagtgatccttctacctcagattcttccaccttggcctccaaaaacgctgagacaacaggcgtgaaccaccgcacctggccttttttttcttttttcccctaactaggctcagttcctaaaagaaggccttggtcaggtttctgagccctacccccctcctgctggacaagatcatggaaaatgcctggctcagctattcttttctcagcctcttttaagcagcatagcagagagggacagaggtagagacagagagggactgagatctgggctcttcctccagctgtacgatatggaccaggcccctgttctcttcgggcctccatctgtaaaatgaggggacaggaggaattctgatggcctgtggctttgatctctgtgagcagatttggttgtatgaggtctctcccctggcattacatgctggaacagaagaaaatggccatagtcactgttaattaaaaactggtaccaagttattggtactctcacgtttgaaatacctactagtacctgcttggtctagaccagctgttctcaaagtatgggccctggccccctgtagtagtagcagcagcacccagaggttttttctgtttttgtttttgtttagagagatgaggtctgtgttacccaggctggtctctaactcaagcatcggcctcccaagtgctgggattacaggtgtgagccaccatgcctggcctttttctttctttttcttttttctttttttttttttttgagacaaggtcttgctctttgcccaagctacagtgcagtggcacaatcatggttcactgcagcctcaaactcctaggctcaaaccatcctcccacctcagcctcccgagtagctgggaacacaggcgcatgccacaaaccttggcctttttttttttttttttgtagaaacgaggtctcattacgttgcccaagctcgtctcagactcctgggctcaagcaagcctcccgcccacctggagcttattaaagactcaaatcccagggcccaaccccagatctgctgaatcagaaactccgcaggtgggggccagcaacatgtgtttcagtaagctcaggaatcaggtgattctgatgcatgccaaaattttagaaccactggcctggaacagggtgtgtgaagcttggcgctgctgatgctccaggccagatcatcctacgtggtatggctgtcctgtgcactggaggatgctgccagcatccttggactctaccccactggaggccaatagcatgccacccctgtctcaagtcacaacaatccaaaacagtgccagctgtcctccagggaacaaaactgccccagtggagaacccttggtgggaaggaaggccctgattgtgcagtgactcaaatacaggatcacataaaacctggagcgaaggcctggcgcagtggctcatgcctgtaatcccagcacttttggtggccgaggtgagtggatcacctgacgtccggagtttgagaccagcctggctaacatggtgaaaccccgtctctactaaaaatacaaaaagtagccgggtgtggtggcacacgcctgtagtcccagctactcgggagcctgaggcaggagaatcgcttgaacccagtaggcagaggttacagtgagccgagattgtgctactgcactccagcctgggtgacaaagcgagactccgtctcaaaaaaaaaaaaaaaaaaaagcctggagcgaagacgtgcatgcagggtcaccatgccaggctgtcactctatccagccatttgctcctcaccatgacttgaaaatgatccccattttatagcaaatcccacctccctgcttacaagctgtgtgacctcgggcaagttacttgaactctctgtgcctctcgctgtaaaatggaaatattaacataatagtacttacctgctagggtagctgagtgcttgaaatgacaactcaagcatggaacaaactctcagcccagtgcccgaggaggtaaacaccggctcattttctcattatgtggctcaggctcttagcaaaatggatttgtgttctctgacctcgtgcggccactgtcacagccagctggaggtaggcagaggccagcctgaggtgaacatgactgagttcaccactgcttgtcagggtgcctgcagtcacggctctggggcagccaggagatgaccctgggtcactgccaccagcagggacttcctttgggcggcttggagcagacagcacccagctctgcagacctgagcaccccatgtgccccaagtgacatggagcagaacccggggaccccggctgtctgccctccaccctgggcgagctccggatgccgcaggaaaagacgagaatccagcacagttcctcttctgcacctcacatcccaataaaatatttattatttcaagaaataaatctttaaaaaaaagagagaaaaagagtgtctctattgctttccc

SEQ ID NO: 736 - DNA, 2468 bp, Homo Sapiens
ttttatcttggtagcaaggtagcaagacttttccaatgcaggaagcttcagtgctttcatttatattctgatgtaagttatcttattgcagaccggtaacaaacactgtcttcacagccatttgagccttaggtatgaatggagcagctttgggtggagggatatctccatgactgggtgggaaaaggtccagaaagacaacattggagtcaccaaatactaactgttcactaggcttggctgttataaaagctgccaaaattcatgcttatggtttgactggatttcttttctctgcttagtatgcccttcagtagaagtgccaaaaaaaaaaaaaaaaagacaaacccagttatatagcccaaagaagaggattaagttagttatctgcagcctctggattgactgtgaagtctgtttgaaaatgggagtgttggccagtaaaatgtttccctaaaaaactcgaagctgaggccgggcgcagtgtctcacgcctgtaatcccagcactttgggaggctgaagcgggtggatcatgaggtcaggagatcgagaccatcctggctaacacagtgaaaccccgtctctactaaaaatacaaagaattagctgggcgtggtggcaggcgcctgtagtcccagctactcgggaggctgaggcaggagaatgccgtgaacccggcaggcggagcttgcagtgagcccagatagcgccactgcactccagcctgggtaacagagcaagactccgtctcaaaaaaaaagaaaaaacaaaacttgaagctgagtgtttctggggactctcatgagcatttttgaccatcaatttagaagaaatattctgatattactattgcattaccattattttatctagattaaattgcttcatttcttaaatggttcagtctaaatgggaagacttgataataaacaaataataactaaaaggattagaaagattctatgattctagaattctttcaagtacacagttattttagagatccacttccagtatttattcacttcattcaacaaatattaagtgcacacctcctatgtgccacacaatgtaccagggctacatggtatacaatgatcaataggagacatggtcccttatggtgtttgtaatgtagtgggggagatataagcaattaaatccaagtcaatgtatgaataaatatataacaatgaatcgtgaacctcatacgaaatgaaaaggcaaatagttaataattgtcagacataaatttcagttcagttgaattcagcaaatggtttttgagcatctattttgtgccaggcactgtgcttagtattaaggatacagagatgcataggagaacattcttgtcctcagatccacttggcactatacctgagtaacacctacgcctctcctcaactcccatttgattttgttggttgatttgtgtaggtttggctatttcacctgctgttcattccacactcttagtgtgtaacagtgaggtagggctttctggtacctgtttgtctgcagatgtagaatcaactcttgtgtttgtgaatttgactcagagaaaatatttaaatgatttgacctttgagatgcccagctgagctgctgagcggacacagactcaacagaactaagaattgttgaacatctatcataaaattataggcttagattcaaagtgatcacaggatatgctcatttcttcccttcccttcccttccctccctcccttccttccttccttccctttcttccttccttcctttctctcttttctctttttctctttctctctatttttctctctttccttcctttctttccttccttttctttctttttttttttagctttgctttgctttcttctttctcagggtctccctatgttgcccaggctagactcaaacctctgggctcaagcaatgcccctgtctcagcctcttaagtagctgggactacaggcatgcaccaccatgcccagtttgctcatttatttattgtatctgggagtcttccacatgctaggcactgttctaggcacggggtaatagcagtgaacaaaacagacacacaccccctcccctcatgcaacttgcacctcacccaacgtttaacatatcctgacagtcggtcattcctttcaacttaaacatcttcactatcagagaactcatctccttatggggagttgtctcatttttaaacagtttgaaatattggaaagctctttattatactgatcccaaatccttttccctgtagcttttacctgctagtctgactaaggttctatatttgaaccagtttggaaatagctaatccttctttctgggaacccttcaaatatttgaaaaaaatacttgtgtttcttttaaggctccccattttgttagctgatatagagaaatatgtgtagatacacgagtacttggatatcatctaataaagcaattgcacctcg

SEQ ID NO: 737 - DNA, 2470 bp, Homo Sapiens
ttttatcttggtagcaaggtagcaagacttttccaatgcaggaagcttcagtgctttcatttatattctgatgtaagttatcttattgcagaccggtaacaaacactgtcttcacagccatttgagccttaggtatgaatggagcagctttgggtggagggatatctccatgactgggtgggaaaaggtccagaaagacaacattggagtcaccaaatactaactgttcactaggcttggctgttataaaagctgccaaaattcatgcttatggtttgactggatttcttttctctgcttagtatgcccttcagtagaagtgccaaaaaaaaaaaaaaaaagacaaacccagttatatagcccaaagaagaggattaagttagttatctgcagcctctggattgactgtgaagtctgtttgaaaatgggagtgttggccagtaaaatgtttccctaaaaaactcgaagctgaggccgggcgcagtgtctcacgcctgtaatcccagcactttgggaggctgaagcgggtggatcatgaggtcaggagatcgagaccatcctggctaacacagtgaaaccccgtctctactaaaaatacaaagaattagctgggcgtggtggcaggcgcctgtagtcccagctactcgggaggctgaggcaggagaatgccgtgaacccggcaggcggagcttgcagtgagcccagatagcgccactgcactccagcctgggtaacagagcaagactccgtctcaaaaaaaaagaaaaaacaaaacttgaagctgagtgtttctggggactctcatgagcatttttgaccatcaatttagaagaaatattctgatattactattgcattaccattattttatctagattaaattgcttcatttcttaaatggttcagtctaaatgggaagacttgataataaacaaataataactaaaaggattagaaagattctatgattctagaattctttcaagtacacagttattttagagatccacttccagtatttattcacttcattcaacaaatattaagtgcacacctcctatgtgccacacaatgtaccagggctacatggtatacaatgatcaataggagacatggtcccttatggtgtttgtaatgtagtgggggagatataagcaattaaatccaagtcaatgtatgaataaatatataacaatgaatcgtgaacctcatacgaaatgaaaaggcaaatagttaataattgtcagacataaatttcagttcagttgaattcagcaaatggtttttgagcatctattttgtgccaggcactgtgcttagtattaaggatacagagatgcataggagaacattcttgtcctcagatccacttggcactatacctgagtaacacctacgcctctcctcaactcccatttgattttgttggttgatttgtgtaggtttggctatttcacctgctgttcattccacactcttagtgtgtaacagtgaggtagggctttctggtacctgtttgtctgcagatgtagaatcaactcttgtgtttgtgaatttgactcagagaaaatatttaaatgatttgacctttgagatgcccagctgagctgctgagcggacacagactcaacagaactaagaattgttgaacatctatcataaaattataggcttagattcaaagtgatcacaggatatgctcatttcttcccttcccttcccttccctccctcccttccttccttccttccctttcttccttccttcctttctctcttttctctttttctctttctctctatttttctctctttccttcctttctttccttccttttctttctttttttttttagctttgctttgctttcttctttctcagggtctccctatgttgcccaggctagactcaaacctctgggctcaagcaatgcccctgtctcagcctcttaagtagctgggactacaggcatgcaccaccatgcccagtttgctcatttatttattgtatctgggagtcttccacatgctaggcactgttctaggcacggggtaatagcagtgaacaaaacagacacacaccccctcccctcatgcaacttgcacctcacccaacgtttaacatatcctgacagtcggtcattcctttcaacttaaacatcttcactatcagagaactcatctccttatggggagttgtctcatttttaaacagtttgaaatattggaaagctctttattatactgatcccaaatccttttccctgtagcttttacctgctagtctgactaaggttctatatttgaaccagtttggaaatagctaatccttctttctgggaacccttcaaatatttgaaaaaaatacttgtgtttcttttaaggctccccattttgttagctgatatagagaaatatgtgtagatacacgagtacttggatatcatctaataaagcaattgcacctcgaa

SEQ ID NO: 738 - DNA, 9223 bp, Homo Sapiens
agggcgcgccgcgtcccgtccggtcccgtcccgttccgtcccgtcgggtcccagccccgccaactctcaccctgcccggcccttccagcggatccacttgcagcccccgacccctgacttggtccccgaggtcggggctcggtgggaaggaaagcgaggggcttcccggaaagaaagggaggaggaggcaggaggaggcagacgccgagagaggagaaaaggaggccagaggcagagggaaaaggaggagggcaagagaatcctagagcgggaagagcgtgggctctgcgggacgtgggcgagaggttaccagggaaagaatggacattgacggcagagagcaagtttagcctggagaggaggaattgagtgagcaaagggggtagtctggggtgcgatgcacagaaaggcccgtccagggtaaccttcacgtctccgtatccgttgctgtcgactttccagagcctttgttcccagtgacgtccctattgcaatggagggacacacttcactttccccagccccccacctcgagaatttctctcaccctcccaccctgcggggccgcagagcttgctcctcacggcaggagttggagccctgacgcttgccttcacctagtttttgtttggtttggtttggcgttgatgggacaaagtcagccaaactactttgccatcagcagagaaggaaagctttgaggctctgcttggcaatgtatacaagacaccctccagagggatggcagctgtagtaacgtacaggaaaggggtcctgatccagaccccatgaaagtgttcttggatctcacgcaagaaagaatttagagcaaatccacagtgcaaagcaaaagtaagtttattaagtaaagtggtgaaagaacagctactccatagacagagtagtacttcccgaaagtaaaaggaggaacacgtccaccctaggtataatgcttttgtgtgtgtgtgtgtgtgtgtatgtgtatatatatgataaaacaatatcatggtgagatgtgctctgctacaagggtttgtgataaaggattaattttcttaattacatttcacaagaataaatattattatctttaaagcaaaattaggaatgcttttgttctcaagataccaggatattaggacactcccaagtctgggtctgttgaataaacattatcaatctgttcccttaactgcaaacatctagaggctagaaatacctttctttctgggatgcagcccagcaagtcccagcctcattttccctgccctcactcaagatggagtcgctctagtttgaactcctctgacattaagaggtggatttatagatttactaggatgttaatgaagcttaatctccaggacttgtcacttgcactagcccattctaagacttgttgtgttcttggggtaaccacggaagaagcactgaccctagccatgcacaggcagcatgaagtacaaagtattgcccaggctgggagtcaccctctataatctggccagtggtacagggactgcagtaggactagtaggctgtcaacaatacctccatatcagctgagctccaacacacaacctgagcctcaggactcaatctttgaccttaagagaaaggaacaaggacatgcctccctgcctgtaggccgctatgaccaaggattaaagataattttttcttcctctcactcctcttctaaggtactgcccagtaggaacaggaggcagcaaagacctaacaaaagtggaccatatacatagtagcagccatcggtgtccataagccgtgatatcaaagagctggagttttcccacttcttttccgagcactgcctgaaccagaaactcagatgtgacattaccagtaatgagtggtgaagcttcaagaaagctttctgaactttccttttccatccattgtgctagagagaaaactgaattatattttcaatctctctagagaaaatgttacaaaatttttcatatgaggagataatcaaagtgtacaacccaaaaatgtagaaaacaattgttacagaggtgaaaggcagttaattaataacttatttttctggattttgtgatgtttgtgctattcatgtgctttttaaaaaacgttgtattttgcgatttcctcattttcatagctaattttgcattcataatttcatgttctttttcttaaacaaggcctacccatctagctctggtctgtccaacacaagctgatctctggctcccatttgggctgttacgtattgaaggctaacctttctgggacagacgcagaaggcacatctcatctttatgaggtccaagttaattaaatcaattgatcataaatgtaaaggtttatatctgaactctcaagtctctttcattgatctgtgccaattcctgtgccaatatcacactttctcaattcctgtggctttatagtaaattttgaaatcaaatgtgtaagtccatcagtgtcagtctttttattcagaattattttggctactctatgtcttctgcatttccccataaattctagaatcagcaagtcaatttctataaaaattcctattgggattttgatagagattgaatggaatttgtagatccatttggagatatctgccatcttgaccatatttagctttcaatcaataaatacaaaatacatctccaggtatttagatatcttttgatatctctcagcaatattttatagttttcagtgtacaggccttacccttcttttgtaaaatttatttctaaaagcattatacttttttgatgctgtgaatcaataatttttttcttaattttatttgtagaatattcataagaataaaattttcttaattttatttgtagaatgttcattgctggtatacagaaatataactgtttttgcataccgatcttgtatcctacaactttgtaaaactcagttaatctatttgcttttttgtagacttctgattctctacataaatagtcatgtcatctgcaagtaatgagttttacttcatttcccatccagatacctttcgttttcttaccttattgcaatggctataatctcaatgacaatgttaaataaaaatagtaagaatgaatatccttttcctattctcaacctcagaagcaaagcactctgtttttcaccattatagatgatgttagctttgagttttttgaagataccctttatcaatcaagctaaagaaatttcttttctttctagtttgttgagagtttttatcatgaatgaggattggattttgtcaaaaacatttctaaatcatgtgggtttttgttttattgtattaacatattacattaatcactttcagatattaaatcaaccttgcattctaacatgtgtttttttctttttcctttttttggaggcagagtctcactttgtcacccatcctggagtacagtggtgcaatttcagctcactgcaatctccgcctcctgggttcaagcaattctcccgcctcagcctcctgagtagctgggattacaggcgtgctccaccatgcttggctaatttttgtatttttagtagagatgaggtttcaccattttggcctggctggtcttgaattcctgacctcaagtgatccacccacctcagcctcccaaagtgctaggattacaggcataagccaccacatccagctcctaacatgtgtttttaatggctatacctagtctttcctcatttttatcctactataactaatttttatgagcaaatacagagctacatcaactggggatcctccaaaattgacagtaagaaacatgctgttgcatttgcaggcatgcccagggtccagataagtatgcataaatattgtgttgccatagtgattaagggcattcttcccaagatgatttgacaacagcaaatcttttataagtaccttctctagaagtatttggcaatgatcctaccacttctctgaatattcagtagaagtacagatgaagtaggatggtctagtaattaaaagtatgatctctgcagacaggcaggctccccagttcaaattctggctctagcatctacttgctgtgtgactgtgggtaagttaaactctttgagccttagatttctcatctgtaaaatccctctttggtaaaatgggataataaaagctaccccaaagggttaatgggaagattgccagtaaatgttaagtagaacatacagttcagtacctggcatgcagagctcaacaaacagtagaaattacgactaagacagcttcaacaatcccctcagcttgactaaacttcagacaggtttctttgtgagcataggccccttttcttagatcatttactttagaaaacttgcaattataatttctttctctatccctttgtgaagtaaatcttctacaacccaggagcatctttctccaaagcctaagaaccatgccttagaaatgtaatcaccaagaaaaattgcacctttatttctttgtatctgtgggaaaggagaagcctaacttcagtaggtgccaattagcaaacacagatagcctgatcccatttaccgatctcacctctagtgtctttcagtacttactaactcacctcaatgcttaaaattctcctgtctgtttcagtgtgattgagttcaatttctcctccattgtgatagtcttgatctcttttgcaattgtcttgaataaagtcttccttgcctaacttgtccagtgtaacttttcttacattataatggttattatacggagaaagaagcatgggttctcctggttgtttcagctgtataactttagtcaatatccactggagagaatttcaataaaagaaaactatttctttatgggttaaaagggatgggcatggggggcaaaataagaagcactgtggttcaattacagcgttctcatttcttctgaaatcctctagttgagtattgtaatttaaatggaacaacttatctccctaaaagactgattttgaaagactatttccctttccctgttaactgctcccaacccaacagccatcatcatttttaaaggaattctaagggcaaagaaactaagaatctaagagaatgtaatacaattgatgacccaaagaaaagcagcacatattaaattgtgacttaaatgctattcaaaacataaaatcgtgccattgtagtatgtgtttgcctgtgtgtctgtgcctttatttctcaatgatgaattatatttcaatgaaaaagaataatgccttccaagtaatagtatcgttatataagagacaattatgccactaaatttagataatttagaaatagtcttaaggagagaaacaaaaattaaaaagtattgaaatacaaagtaaggaactgagattattgtttttctcaatgaagataatatttacttttgctttaagatctagatatgacaaatgttttctggttaacaatttatccaaaaagaaaaaagaatgtcaaccttttttttttctctattccagagagctccagaaggtttttagatttaaaaaagaaaacaaaaaacaataataatactcaaatgtcatattggaagccttaggcaagagctgttggtcttttaatttgctcttaatactatgatcaaataaaaagaaggaaaattttacaaatcattaacagcttcgaggatgagggaagaacagattttcaagcattcttctttatttagtcagaaatgactggctcaacctcagcctacttctctgaggcacattcctaccaactcttgcatattaaattttgccagagcaatgggcctgacatggccttttgaatcacagtgaatcacagtgacccttatccaactgaatgtctcctccaatcatgtttaatgtacatcaagcattctacagtgccaagatgaagacctgcattgtttttttaaaacccacattaccttgtcattgtgtaagagaaagatatatttaggattgaagggtgcttcttattagacccattcaggaagaaagtaagtctagaggagccaagctcaaaacatactcttcaccatacacaatcaaattcctctcagaaataatgttcttcttctccatctatattttggaaaattacatgaaaatcagtagatacttgtaatgcaatcagtgctgaattattactcaacaagctgagtcttcgagggcaccagcaaaacagcaggaatgactaagaaaagtttaactttgatgaatttatgtagcgtcttgaaataaaatgtaaaaatgaagccattttcatttcagtattcagagttttataacattttgaaaaagtaaattttcttttgaagattttataaattacacatggggttgttattacaatctcttcagtgttcaaggtttctaaaattctcaattcagccctggatacaaaaactctaaacacagagggttaaggtattaaagatgaaagctagtacccttacaactatttatattgcaaaagctttgccctcctgcaagaacatgcagtttcccaaacagtaacctctctttacaaggttatgcttattagctgggattcgaagctcaatagcaacactgttcatccatggttcaattcagattgtaatttctttttaaactacctgacccttataatcatatggtgagttggtctgatcattcatcttctcgaggccaagtacttggtctgaacacagagtcacttgtgtttctgaagcctctctgcatcaagatgattggggtgaaaaactgtcaattgaaaaaagtttgaaagaaaccttttatacaatgttttcattgtcttgttctttttctggaaccacaatttctgattgggaaaacaaaagtcttcctagatacaagaatgaggttttaagagataatctttgtttctaattaagtgtggaagctatcaactatcgcattgtccccaatgtcagaatgtgctgaataagattttgctttttctcagggcccagcatttattaagcactcagcaaatgcttactaaatgaatgaatgactctacccaagcttgtgtctttgtctcgaagctgtatcttccatcacagtattaaaatgttttttatgaacatgagcatctggctgcacatacagagcagcacattccacacactgccctaattggatcaccaattggaggaaagtaagtcacaagctgattgcctagagtgggtttttccccatctctgaaccaatctctgaggcaaaaagaatgctattaggctgactgatttatgtaaagcagtgcctatcatttctgcagttaggatggagtcaattccatccaaagccaatagaagagagacagtactctaaaagaaggcctaggagccatgaataactgccgagggtaccatagacactgggttggacaagcaagaaatagtgacgatgtgacttctatttttatgatggctcagcggaaaattagtaaatacaaccagtgtgttagaaataattccgtatctcctaagatacattggttaaaaagatactaataagtttttgtgcgtgtaacatttgacaccaggcttttaagtaaaacaccctaagatggaacttactgtgtagtggaaagagttagactcactagacattgattagctgactgacatagagcgtttcttatcagtcaacaaaactatttccagagaggcttgaaataaaacagttgactttatgtagattatggttaatatcttttgcagattttctaagaaatctttccctatcagaggtccccaaaacattcctttatcattttccttctaaatcttttatacatgcttaagaaatatgcacatgctctaaattgggggaacatgatcctttatgtattaattgaatcaactttggttaccatgttgttctatttacttttttgctgctcgagctaaaaattgagtgacttcaaatacaacataatagtttttttttccgttttgccctctacatttttactttaataactttgtttagaactgttatacctacttcagttgaaatttttattatttttgagagtctccttatccttattaatgcttttcactttaatatttgtaaggctaatactgatacagctatcctaaccaggtatatttgcttgttttattttccctaattctactttttgtctttctctgtccttgtactgtcttttgtaaactgtatatattgaacaaggtagacttttttttttattaatctggtgagataggcaatttatatttattgtaaccatttattatatactatgccatttctttgctttttctatgctttttcttccttcttgcatttttgtggtctatcaaagttgggatttctaaagtgtttttcccttatttcagaatgtttcctctctactggtttgaaagttatattgtattgctattctttaaaggttatctgaaaattttctgttaagtacttagattaacaacatctaaagtcattcattatcttaacttccatcctaaagagtatcaggatcttggagcactcacactaacttctaagtgctcccggacactttccccacatatacatttcctgagttatgtaaaatgttgctagtattttaattacgctcttttttactccacagagtaaatacttcttaatatagacagtatttatttacatttcccatgattactgattttttagctcaccataccttcttgcatctcagactttcctcctagtcattttgctgtactctaaaattcatctttattcttaagtgaaagtcccttgtttgtaaattctcattttgagaaaaaagtgtttttaatatacccttgattttgaaagataatttcactgggcactcattctattgagttattctctcagtaccttaatgatgttattccactgtcttttgccttccagttttggcactgaaaagtctactgttggccaggtgcagtggctcatgcctctaatcccagcattttgggaggccaaggcaggtagatcacctgaagtcaggagttcgagaacagcctggccaacatggcaaaatcacgtctttactaaaaatacaaaaaaattagccaggttgtggtggcgcacacctgtactcccagctactcgggaggctgaggcaggagaatcaattgaacccgggaaatggaggttgcagtgagcagaaatcacaccactgcact

SEQ ID NO: 739 - DNA, 152544 bp, Homo Sapiens
agtccgccattgcaaacacgaagctcttccagaaacgccctcacagacaccccggaagtcacgtacccactctgtaggtgccccggggcacaggcaagcggacgagccagttatccctcagagctcctgctgcctcgcccgctttctctcggaaacgtgaagtgtggcctcagctgaaagtgaggtgggcctcattcaatcagttgaattcttcaagagagaaaaactgaagtcccttagaaggaaagagttctgccttcagactgtctttgaacttaagactgtagcgtcgactcctgccggaatttccagcctgctggccagctctgcagattcacacttgccagcctccacaatcgcagctgaggcggaggaaccctaagggctcattgagatcatggatttgcccttctatgcattgatggagcacctgctgcccacagcgtctgtatttggtgctgggatgctgagcctccttctttatgaatttttaaaaggacactgagatcttcaaacagaggctgccactctaagcaaacagatcccgagccctggactctgaagcttgggcccagttctccttttctccgggtttcagatcccactgtgaagtgagggggcccttctgattcaggacccggggaagccaggggcatgagcatcggtgcctcttctctatttcaaggacccttctgggtgtaaagttctctgagatgccttacatggattcccaccactgcaagataaccatcgtatgtaaagtgttatgaccagcagagcgtaattgaagtgcattccagagggaaagacagcggctcagatgaggcttcaggcttgaccaaatctgactggctggctgccggagacactgctacccatcggcccttaataaatggcctcatttgatcatcatgtgatcttcagaagctgggcttgattatccttgccaaacaaaatgctgaaaccaaaaatctgaaaggtatttcttgctaagtaagggagagctgtgcttgtagagtgtggtcaccctgaacagcgcaaactgcttgtggagctccaagactggcagacttgggagggggagcatttagggattggatgactttggccgtggactcggggttgggacagtgaggctgccactgaatggctgtcactcagaaatgtagttactgataaaaagttgactcaatttgtcagggcaggcttaaaatcagttttggtagttactttttgtcatggctgaagagcaatcctctgtcttcttgaatttggacctttatttggacttgagtttggaaaaactaagaaatttttgttctcattttcattacatgcttgagaaaactgaggctcagacaggcgagtaagtttcccagggtcacgcatttaccggctggcatattaaagttttgaacaaagtccacgcttttcttacacactattctcattagtattagttttagtagtaatcgtagctgtacttttggttcataggttcatagagagttgttaatcctactcctcactgataatccattctcgccatcatgccctacaagacctctggttgtttaattccatttctccttcatgctggatcccatctcccatcccctctccacccctccgacagagtcactctttctaatgtctttttatctgtacctaaatatttgtgtagctttgaaaaatctaatttgtcaagggttatgtgttcattttacatttccatacatgttattgtgcaatatatagatctcatttgtttcctaatttttttcactcaccactgttgtgaaaacacactgacatttctgtatgaccctcttctgacctttgcttcacagcgtgcatctaccataccttaacctaccctgttcctcttgtcatggacccctggattgcctctggctccccccaacacacaccttactgcaacatccacacactggggtctttatggatttccctgggttttcacttaggagtgggattgctggatcctaggagacacccgttaattctgcttggcacagacagtttgctctgtgtggcaggccatattcccatcagcagtgcgtgaggggttcattctgccacatcctcaccagcatttttatactccttgaaagttttgtcagttagatgaatgggtgcaaaatgtaatcttaacattgatttaacctgcatttctgtgtttgccaaggaagttgtgcgtctcttcattacttagcagccattcaagtttccctttctgtgaagctcttattcatataccttagccaatttgatagtccattgtttttattttgttggatttcactatttccttgcatgttctagatgccaatatcttgttgattttaaaagatgtagtcattctccccccaatctgtcacttgtttactttaatgatgcctttttatctcaaacccaaatttttaatgttgctattgaaagggcaaaagttcccttatccctgtcacagggtgtgtgatgcgggagtggctcacttcctcagcgccccgctgctgagacctttaggggagcatgcagatgggccggttgtgtggctccgaccccacggcagcgtctaggggtgaatgtttacagctgctgaagccacagtgggcgtgtgttacaggatgctcttttagttcagccatccgtaggtggcttgtgttagctcaattagacacccttccttatcacaaggacacagggatttctgtatcccggggtttcttgccttggtgtactggaagaatcggatcagttgtgggcttggagaataagtgtaagtttgtttttttgttattttattattattattattattttgagatggagtctcgctctgttgcccaggctggagtccaatggcacaatctcggctcactgcaacctctgtcgcccgggttcaagcatttctcctgcctcagcttcctgagtagctgggactacaggtgcccgccactgtgcccagctaatttttgtatttttagtagagacagggtttcaccttgctggccaggctggtcttgaactcctgacctcattatccacctgtctcagcctcccaaagtgctgggattacaggcgtgagccaccgtgcctggcctaagtgcaaggttttattgagtggaagttctcagcagatggatggggagccagaagggagatggagtgggaaggtggttttcccttggagtcgggcagctcagtggcccaggctgtcctctgacctccctggttgaactctgtgtcgttctgcaggtcaatggcctgccagcctgcctgtgtctgtcagtgtgctgttctgctggggccctctccacatccagctgctgtgtcgtcttccactgatgcgttcctcttgacatccagccgcatgtgcatgtgtgtccgatggggcctcggggtttttataggcataggatgggggtgtggtgggccagggtggtcttgggaaatgcaacatttgggcgggaaaacagaaatgcctgtcctcacctaggcccatgggcacaggccctgggatgaagccctagccagggaccacaccttcctctacccagcacgtccctgtcccccttccatatcactgtggtaaaatccagtttttttcaccttagattttgtacatttgaggtatgacataaagtgcatattcagttcaagataaaaagttttctccaatagtctcctattagctttatttttatgccttttcatttgagtttttaatcaatctagagatcattttacttaggatgtaaggaagagttccaattttagttttacccatcaggcaagccagtggtacccaaagccatgtattaaaaaagtctattcctgtctcactgatgtgtgtcacttctgtcataaaacagatccttaaacacacatgggtttggtgttgagctttctgttttgttccacttatgaatttaatatttctgtaccaaaactgcacttttttttaagtagtattttgtggaattttttcatatcttgtaggtcaggtcccttttattctctttttctgaaattgtttattttttaaagaattttattttttcatgtaaatgtcagaataagattgttgaagtcttcaaaaatcgctcctaaaattttttttttttaatcagaatctcatttaagtatggcttttgtggagaactgccatttcttcaaatgttaaactagtccattatgggatatggtatattttctctttattctaatctttctttatatcctttaatgaattttaaaactttctctataaagaatcatgaattctttgttagatttattcttagatatatttaagtttttcttgttattgtaaatgttatattgttttattattatatgttttagttagaaattaccagtgtgaggaaacatcatggtatggttgaaatcacacctcttaatttttgtagaactcttaattccaatattgcgtgcattgattctgatgcattttctatttaggtgatcatgccatctgcaaataaggatagccttgacttgtcttaatatattcttctacctcttgttgatctttctcttgatgagtccattggacagctttaccagtagcaataagattgcgtttttcttgtttccagtcttaaaggagccatgcctcaagtccatcctctgaatatggtattcgtcaaagacaagcatagttatttatcagataaagaacattctcctttagttacagtattctgggaatactgtatgtaataataataatgtaaataattttatttaaaaacaagttggatatttacaagtgcatttttttttgcttctactgacctagtcaatattttttctttcttcatcttagtatcttaaagtggtgaattaaattcataggctttctgatgttaaaactttttttcattcctttgatgaactctatttataatgatattattattattttcagacaacattaaagtcaattagcaaatatgtaagtaagacttcataagtgaaaagagcctatactttgcattttgaagtttttttttttttttttttttttaaaccagctttggaatcaagcaaacaattttataattaacagaaggtctctgtctctgtctgtctctctctctttctctctcattgtttggaacaacttgtgatttgtgtaagacatagattctttcttgtttaaaagtttgatgtaacttttttgtggaatgttcttggcctgattttttattgcctttttttttccctcttgggggaggctttaattaccattatgaattttaaatgaaaatctatttatccttgctccaatttggaatatcatacttttccaacagtgtgtccatgttgccttgtgttttcaaattgatgtctttataaaaaagattttacattgtttttgcagttatttcctcttttggattctgttttgtaaatttgcatcttccccttattgtattgactagatttgccagagctttttgtatattgtattaatattttaaagaaattgcttttggttttgttaatcttccctatttcattgatttatgttcttatctattttattttcttcttgtttgtcccttttgggttgcttctgtttcttgtttgttttctgcttggattgaatacttagctcattttttcttactttctgataaatacatttaaacatatggagctatcactacagtgtggctccattattttgtaattctcttatgttttactttgtatcttaaagtccttttagcagaatgacattttagtttttgaacatatggtatattatttatttttaatcatttttgttactggtttctaatttcactgctttgtgctcagggaacatactaagctgggtggattgtttgggctcattgtagcttccaacctcgtccatcatccgtggttgtgaaagcttcgctccacacacacatatattttgctctgggatttttattaatcttgtcaatcaaattttgtatgcatttatgcttttttgttttgatttttttttttgtccctctaatctaccagtctctaatagggctttgtgaaaatcttgggcaataaattttgttgtctctatgttctcttgtaatgctgtcagttgttattttatatattgtgatgagctattttaaagggcttatttattcataactactatcttcttgatctagcacactgttttggcagtatataacatcgctttttggcatcataatgtttttcatcttaaaacccatttagcccaatactaaaaagtcttaccttgtatttgaaaaaaattcttattgaaacaacctttggaaactacacacatactttccttttaattatttcatgtattaatttatgtaagttttcatatccatttttacttctcattatgaatcaataaattggttttctgaatttaactcttggactagagattctgctctttgtgtgccgagaattagtttgcagagacccaggtctgcagccatcatgaggactcaacttcgccacacctcacggaagagccccctgtcttctccccagtgctgtgtgatgcagattccttttacagcctgcctgcctgcctccctccctccctctctctttccctttttccttccttccttctttgaatgttacttttttccttctctgaattgtaatacagacatatggtaaatggcataaacatggcacacgttgataagtaaggaaaaggagactcccctgtaagtgctcatgacctcaacaccaggtcatgaaatggaatattaccagcagcctggggttccctgtgtgcccccagctgtctgcagtcatttctgtctcacttgcctctaggtaacaactattgtcaccttagactcattttcttgcgtttctttatggttttagctttggacattcagttctgcctgtgctgtttcatgcaatgaaatcataggtgagtctcacatgagtggaattgtatctgtcttgtttcactcaacattatgttttgatgttttggggtttcatccatatttttggatgcacctgtactttactcatttttgcacagtctgggagtttgttgtatggctatacaaccatttaattttccactgttcagtcgatggacactggagttggtttctagtttggggcaattacaggccaggttgctaggaagggtttcacacgtgtgtcctagtgggtgtgccagtgagtttgcctagagtttgtacttagtcatgaattgctgggtaggagctattacctgcaacttgactagataatatcaaatatgtccaaagttgacattccaatgagatctccagggtttgtgagctgttattgttccgcgaccacactgatattcatatttccagttgtttactaaagggctaataagttataaatacattcatttgcttttcagtctagtgggcacgtgttgccatgactttattttgccttcccctgattagtttgttagtcatttttatcctctctttctaagtatctgttcctatatttttgtctaccttttggggttgcttgtctttttattgatttgtgtgagttaaaaaaaaaaatgcggccgggcgcggtggctcacgcctataatcccagcactttgggaggcgaaggtgggtggatcacgaggtcaggagatcgagaccatcctggctaacacggtgaaaccccgtctctactaaatatacaaaaaaaaaaaaaaactagccgggcgtggtggtgggcacctgtggtcccagctactcgggaggctgaggcaggagaatggtgtgaacctgggaggcggagcttgcagtgagctgagatcacgccactgcactccagcctgggcgacagagcaagactccatctcaaaaaaaaaaaaagcagccgggcgcagtggctcacacctgtaatcccggcactttgggaggtcaaggtgggcggatcatgaggtcaggagattgaaagactgtcctggctaacacagtgaaaccccatctctactaaaaatacaaaaaattagccgggcgtggtggtgggtgcttgtaatcccagctactcgggaggctgaggcaggagcgtgaacccgggaggcagaacttgcagtgagccgagatagcgccactgcactccagcctgggcgacagagcgagactccgtctcaaaaacaaaacaaaacaaaacaaaacaaaaaaatgcttgtcttggtgcagtggctcatgcctgtaatcccagtactttgggaggccaaggagggaggctcacttgagtccaggagttcaagaccagcctgggcaatgtagtgacaccccgtctctactaaaaataaacaaaattagccgggtgtgatggtgtgcacctgtagtcccagctactcaggaggctgaggtaggaggactgcttgaacctgggaggttgaggctgcagtgagctgtgatcatgccactgcactctagcttggcagacagagcaaggccctgcctcaaaacaacaacaaaaacaaaaacccatatatatatgctttggagatgagctctgttttttgattataagtgcaggaaataccttctcctgctccgtgtcttgtttctcactcttgcctaatgtcttttgatgaccaaaagctcctaatttcagtgcagtcaaattcatccactttttttatgtctgagaaaatcttatcttaccctagtattaaataatatgttagcttgatataacaatctgggcacaattcttttcttaatatttaaaaattattgttatgctattgcttggcttccattgttgacaattgtgataccaactcgattcttatttatatttattgctgtttttttcctgataacttttagattttttccttatttctcatgttttaaaaatttcttttacctttatctagttttgcttttttctttctttttttggaccctttgagtcttttaaattcaaggtcttgcatttcctttatttcttgctaattgttggtcatcaatttttaaggcatcctctaatctctgttcatttctctgcccttctggcaattctgttgcatgcacttggcacttccctcctccagcgtccctccttgcattttctgtctctccatttccccttcatgcttcctggcgctagcccgctagcccggtcttgctctttcacatactgatatgtcctcagttgtatccattctgttactcaactcatccactcggttttaaataccaactagtatgtctttcaaatgtatcatctccagtgtagtcttctttataacttacttcagctccatgtcttcgtcttttcttttctcttttataacatctttcatttctactttgatatagttttgtttaaaacatgatgatagcccctaaatgccatgattttgcattgtgagtgagctaagaatccctgaggacattaagcattgtggccagggatgcttccctggggatgtgatggctgcttggcctggcttttggctttccttctgggttgtgcatggaggagagatgcctcaggaaggagtctccagtgctagtctatgtaactctcccttgcactgctttttttttttttacacagcatttagctcttgttgcccaggtgggagtgcaatggcgccatctcagctcaccgcaacctccacctctcgggttcaagtaattcttctgcctcagcctcctgagtagctgggactacaggcacatgccaccacgcctggctaattttgtatttttactagagacggggtttctccatgttggtcaggctggtctcaaactcccgacctcaggtgatccacctgcctcggcctcccaaagtgctgggatcataggcatgagccactgcgtccagcctgcactgctttttaaaaaagtttttcatcttactcttagtgttaatcatctcatcttccagatctgggggtggtggggcagaggagaaggaccctggggttggcaggtccatcagatctggggttcactcctggggtctccatggggcctgcaatgaatagcactcttcttttccctgcccgtggcccccaggcctagacatgtgagaaagggtaaagatggagaccaaaactttgccttcatgttagaggcttatttagaggccagagctctaaagagacctgcaagctgaacccatgagaagggggtggaccttctcccttgcggcctccaggggccagccctgtcccagggaggaggggcacagctgagcccggcaggcccagctactttccagcgcagagtgagtggaaggtaggagaggctgggagtgtgggaactgggacggggaatgcattcagctcttcagcgtgctcccgtgcacatctggctgaaagcagcccccatgtcaccgggacccagcctctgctgagatgatagcagctgcatttctctctcgtaggcctttgtctggcattggctgactcagcacaacataggaagaaagaggaagaaagggtgctcccctctctgctcgcttaccccgctgaaaaccctcacttttctccactgtgggcagttgtattttccaccctaggaagcagacaccttttgccacctcagggcccctcagggcctgtgtgcggtcacccagcatagcccccacctctctctggctgctatggtgcttacagggcttggctcagggaaggttgtcggcagtcctgggccactttgccatgtgttggaaatcagaaccttccatgttcctttcatagctggagctgattttcccagtggcgtgcacagctcccggcctgggctgtgtcgtcttggggaggtggaatttgctacctctaaggtggagcagtagttagtgttcctggaacaatcgtagaagtaagcaggccagaggtgaatgaaacgtggggacattagcacagggggctggggcacactgcatgggtgggaaggggtgtcccttacatcaggggcatggactgtctagagagacaccatttgtccttcaactccaggtggtgtttcaaatcctgctggtgtccagaggcctggactctgtccccatcctataaggatttctgtgactgctgccgtgggactggcatcacattctcattgaggggacatgctttccttggttctaatcctgagtctaagaatgtgaggtttgcctaggcagtgtcactgtcctaatcagcaacaattgtctcttaggcaatgtcatcatcctgaccagaaacaattgtcccttaggcaatgccattgtcctcaccacaacaattgccccttggagtggtcccctgattggcttttgttcctcctgaggcctggacaccacataatttagcggactgagaacctaattaataatcatgtgctccgatgtccaccaacatcaatcgtttggaaaatctggagtaattaggaaatgctgctgaactagagaaactgttcccataaaatgtcaggtactttatttcctggaggagtgaatatcttactgactaggtcttatgtgtaaaatgcagtattctgagttaccaagttgtactgttgaaattcctttaagttggatggtggcatggaagtttctggaagctgaattctgaatagttttaatctttctttgagccttggtttcctcatctgtaaagggcataatagctttgtaaactgaactaacaggatggaatcaaaggacagcaatttttcttatagcattgcacaaacgttagcttggcctcccaaagaagcttaattttaatttaatttcaggaagaaacaaaaatgtgtgaagatgttaaaaaaattttcgctagtcatcattcagcttcagtgtctctatcatttgttttttttttcttttttttttttaagtatactttaagttttagggtacatgtgcacattgtgcaggttagttacatatgtatacatgtgccatgctggtgcgctgcacccactaactcgtcatctagccttaggtatatctcccaatatcatttgtatcagtatagctcaactgaagcgcagggaacgttctctgagccaggctggggcttctggcgggaaccggcgttccctaggaggagcccctggtgcttatgcggtggagggtggagtcaggtctgaggagccaagggctgtttggcggtgagacaaggagaagcagcagggggtttagtgtccaggccttggggagctgggagtcccctgcagtgggaagaggatgcaggggtgaggcccgtgggacacgtgggagccaagtacaatcacaggcaaaagctgggtctccaccaggccagcaagcatgaggtcacaggtccagtcacccacccaggtttgcaccttgggacaaggcctccgaccagtgtgcggtgggtagggggtctcctttgtgagtaacgggatgggaagagaagcgagggtggagaagccaccagaggtgttgacgtggaggctaggaatgggttctgttggtcttcccagcatgggtgtggccggcgggaactggaggagtgggcacaggggtgggactgaaggcaggtgtgctggtggaacgggccctgccaccaggggccaggaggggacttgtgattgggggtgtgtggaggtgagtgtggtgtgtgggggcagcgaggtaggtgggagaagaaaggtggattcttggcctcagactcactaactatcaggactcccagccaggctggaccacaaggtccgaaagtggccccgactggagtagacgtgcttggaggcttctgggcaggtgcagccacgatgacagccggcatcaaggcccttcctctgcaggccccaggtgcaggccctggtggtttgggttcagggtttatgggtgatgggcgcccagcccagtcaggttcagcggggagaaatccaaagccattctgaggggcaggctccaggccggtgcgaaacagtggggaatggcttcccgagaagccactggagctgcgcctcttgccctctgtccggtcctcctccacactccagcagaggggggtcttccagggtcctttcctcctgtggcctgggcgtgcccgtgtgcagaaggaggaaggcgaagccgtccggcatctcggaaatggagcctccagggtctgcgtcactcggaaaggcgcgggctttcccaggccagagtctttcagtcccaaaaggctttgtccacctcctccctgagtcattgcggctttgtgtgggtccaggggcagagaccagcaggaaggacgctgctcctgcctgcgtgagaagcccgtggtgcacaaacgcctctcactcctctcagtgatggaaatcaccatcagataaacaccctggcctcccattttgccttatctgccccacccccacccccccctacaggcacacacatccaagctgtttatcactgcacttttacttacagtagcccaaggcttcccatgtctagaagacagaatctctagcctggcactttgtactctgccctctgatgacctcttcaatccgaatctcctgccagcctcccgctctgtgctccagaaccccgagctgcacacaagtgtctctggacgccatgcccttgcctacttctgtgtctttgtccatgctattctctcagctggcacttcctctccggctgtgcacaccgggcaaactcctattcataccacaaaacccagctctaatactccctgctcaagggtcttcttggacccagagaggcagaattcataactccctgccctggatccctggagaaagctttgctttcccctgttgccctgtggattgtaatcaatccccactctgagtgggtggacagaagcctttcctgagaagcaggctggccgtcctggggtcctgggcttgatgtacctcccgtgcagtgcctggctagagaggaggcacagcctgcagagcatctgttctggactgaaccccggagccatcagcaagtttcgggcaagtgttgggggcttggaagaaggacgattcattctgagattgaacctgacatttatttttctcccacatacacccagccttgactttgcagagagttaaagcaaatagtaatccaggacagatttgttacatatttatttatttcccttgaaatctctacgactgcaaagaaggtgtttattttaaaatttaaattgtagctagcagagtgttgcagtgactcacttaatcacctcctccacctgaccaactccaccaaaatccctgctgcagcttcccattcaaacacccccttcacaattgtgatttttctccgccaggtgactgacagatggcctggctgttttggatgccactgccactgccaaatcactgattttgaggaattaaatcacaaaaacttacctcaaatgcaaaaaatgaaaaggaactccttcctcatttcctgcctggtgtggacacagtgtgctgtctacacgaggccttgttacaaatctgcaccccgctgcagttccattgtgcctgcagtagagaaattccagagcctggggacctgggctcaggcccttgctctcatgaccaggcagtggcagcggctcttcccactaagctgcccggaaggagctccagggactcttggaaaatgtcactgacttctcctaagactagtatcacttctccaagtacccctagtttccctccttccagcccatccttcatataattacccaatataattgtgcacacctggcaaactcctatttatactacaaaacccaacttcaacactctctcctcaggagtcttcttggactcaaaccatctgaaaggcaagcctggtggagtccacttgctggacagccggaagcagctccttttgcttttggtgggaagctcagacttcctgacaaggtccatgtgacccctcctggcctgattcctgcccctgctctccctgcccagcctcctccctcccaccctgtccccgtgtccctccagatggaactatttggtgcatctctaatcatctgtggtgatggaatggtatttttccatccatcacagatggtattttgaaaattacagcaaaaagaagttactcaaaaactgaaagcaaacagcatacaaaatatagactccacttttttttttggagacagagtctcgctctatcccccagctggagtgcagtggaacgatctcagctcactgcaacctctgcttgttgggttcaagtgattctcctgcctcagcctcccaagtagctgggattacaggcacgcacctccatgcctgactaatttttgtatttttagtagagagagggtttcgccatgttggtcaggctggtctcaaactcccgacctcaggtgatcctcccaccttggcctcccaaagtgctgggattataggcatgagccaccatgctcggcccagactccactttttatcattaatttcaacagacataaaattactctgtcaattttctataaacatttctaaacactcaatttttgtttccatctcatcgaggactgcaacaaaggctggattggcataggtccacagaccacactgggagaagctctgatcgagagttcctggaggagccggtgtgctctcttgccctaggattgctcatgctgtagcctctgccagggacccctccacccgtcgtgggcaaccgaactctcactccccttccagactcggtttcggagcctcccctcctccaaacatcttcctggaccttgtccaagtcgggtgccttcttccctgtctgtttcactgttgctggcctctacccagcacctcatcctgcctgtgggatagcgtaggtgctcggcagtgtatgtcttgagtgactagacctgtagtaaatgcaggaatgtgaagatgctgctttataccagtgcttctccaagtgcgggccacagatctccatgtgagtccgaccactttgggttccacactcactcgcgagggaattctttcatggcgtgatctagggaagaacacacttggctccagagaatctagagatgatttacaaagacatgtggtgcggtttgcttgcaggccaggaactgatgtcttgctttctgtgtccatttgttgattctaacgagaaacgttaatgagatatccctcagcagatggtaggtatggtggcatcaacacagttttacactgaaatccttaggctcaaaaggataaggcagaggcagaggagataggaaaaggatgcagatggaacttccagagatgaggccgggcgcgggggctcacgccagtaatctcagtcttttgggaggctgaggccggcggatcatgaggtcaggagaccgagaccatcctggctgacacagtgaaaccccatctctactaaaaaatacaaaaaattagctgagcgtggtggtggacacctgtggtcccagctacttgggaggctgaggcaggagaatcgcttgaacctgtgagcggaggttgcagtgagcagagatggcgccactgcactgcagcctgggcaacaagcaagactccgccaaaaaataaaaataaaaataaaaaaggctaacaaaattggtaagacctcagcaagactgataataaagaacacacacacgcacacacgcacgcacacacacacacacacacacatagagtgaggtaagggaacggaaagctgctaatacacaatatcagaatgaaagagaggatattactaagggatgcacagatgttaaatggatattgctaaaatcttgatgttggtaatttttacaacttagatttaatggataaatttcttttaaaaaataacttaccaaaacaagaagaaatacaaaatctgaagagccctaaagctatgaatacattgaattgataattaaataccttttttacaaaaaagctctaggcccaggtagcttaaatgatgaatttaacatcaaactaagaagtattaccaatcctatacactctatttcaaaaatgaaggaaaaggaaatattcacttttaaatcatttcataccagtgtaactcggatactaaaacctaacaaaaatattacaagaaataaaattatagcccaataattctcatcaacagaaacacaaaactcctaagcaggacattagcacatagaatacagtgataaatacaagcacactatgcgttactaaatggggtttattctggaaatgcaatgtttgtttaacattctaaaatcagttagtataattcatcactgtagggccccccggttccccgctctttctttctgtgtcctgaccaaaagtcatggagtgcattgaccactctgtgacccagccaggtgcaggttttccccagcagacttgaacccaaaccaggcccttgaacattcctgggcactgataaaggtatttaggttattgcccaaaacgatgaaagaaactggccgtggccctgagtcaaattccttaagccctcatgaaaaccccatgccttgtccccctcgctgaggacatacttaggtagaacacctcttttctctcactgcctgtctctaggagtgctgcagccctccgcagttaagttccccattgctgcagccctctacaggtaagttcccctaatcaatgctttgggctgatcacccaggcattctgcgcttctttctttggaaccccaactggtctcatccccaactggggctcagtttggagatgcctttgtgggaactcccctaagttgggatgtcttcagctgtgggttcagcaggatgagacaacatattaataataaaagacatacatgaaaaacctgcagctaacatctgacaaccaagataagcgactgaggcataagtctcagtcatcaaggatttttaaggcagctttagggcatgtctgggaaaaatactagccacagacacacctgtggctgttttttctgaagaagttttcaggaggattagtaggaatacttttccttgtagtgggggaaggcctccaggaagaggggcatgtaggtcttaaggggaatggctttttttcctatgagactttagtaaatgcccagtaaatctacatttcacgtaagataagatgaatgtttgaagagaaaaaaggaggaaagagagtcagttatacatatgtctctgggtaggtggaggaaatgagtcttgtctttgctctgcatctgggaagataagcttgtaatcagcattatcagtgtggaatcaaacagatttagtctgaggagctagacttaggttgtagacctaaactcacaattagcatgtccttgtttatgggaggcaggcaaagaacttactggtgaatgatatgtaggggcagcttttccagatgcctgcagccttttaccttttcctgggggtgtggcagatgcgtgttgctagtgacagctcttcatctggaagagggggttgcatgaggcagcctcggtgctaaagtttggggtcttgagatttttcatctttctttacacatcatctaacggtgaaatattgagtgcttttaccataagatcaggagcaaggcaaagagtctgcttttgatcccttctgtataacattatagtgaaagctctagctagggttagcatgcaagaaaaacatacgtggtaaaaataaatatttgaaagtaaaaagtaaaactgtccatgtcaacagatatgtatgcattattgcttacatagaaatttcttaagcaatataaaacagcaataaaaaaggagcagattaataagtaaatttaaaattgtcacataaaacaaatcaatataaagtttgtttcctattagcagcaaacaattggaaatcacatttaaaaataatttaatttatgaaaataaaataaggataactttaaaaattacacatgacgtttttatttgaaaaatgtaagtctattaacataccatataagtttataaagtaactttataaagttgaaaaagagttacataaatggagagatataccatgttcatagatttggggaatcaatattatcaatgtcaattctctccaaactgatacatatattaaatacaattttattcaaagttaaaactcattttttgttagtaataatttgatactaaaattcatattagtatgcaaattacataaatcaatggaaaataatacagagtccagatcaactcgtacaatataaaattaattaatttttgacaaagatgtcaaggtaattcaatggagaaaaaaagtatgtttaaacaaatagtaatctgacaattaaatatcaatttaggaaaaaaatcaacccttattttacaccattcactgaaattgagactatagtcttacatgtaaaatctataactgcaaaggttttagaagaaaaccaaggaatctaattgcaattttggaatagggaaatgtttcttagcaggatacaaaaagcaataaccataaaagaaaataaatggacaatttgagcttcctcaaaagtaaaagcttcttttcatcaaaagatactattaagaaaatggaaaggcaagccacagactcaggtaaaatattgccaatacaatatggcaatacagtacaaacatttgtcccaagacaaatgacttgttttagagattacatgggaatagcccataagtcagttacaggtccagcaaccatagaataaatgataaatgatttaaatagctacttcatgaaagatttgtgggcaataagcacaagaaaggggttaagaacttcagtaattaaagaaatacaagttaaaaccacaatcaatactacctctcatccagagagatgattatattaaagattaatggcatcaaatattggtaagaatgtagattaatgagaatctccatatgttgctggtggaagagaaaaaagtatatgattttggataggtattgatcagtttcctataaattttaatgtatacctatcctatgatctggtaattcctgctccaagaggaataaaaacatactttctcagaaaatttgtaaatgaatgccatactagctttatttatagtggctccaaattgtaaacaaatttaaatgttcatcaactggagatgaacttatagtttgtagaatattaatacaatagtatactactcaggaataaaaataataatttttttttattggaataaggtggataaatcttaaaaacattatgatatgtgaaagaagccaacccacagagcacatactctgtgattacatttatacagagttcaagaatgggcaaagcaaatcagtgttgctggagatgtaaatgatgattgcctatggaggtagggagtgtaaaccaaaaatgaaattccaagccccccaacagactaaatggaccccctcttggccaaggagattacaaagaaacctgaaatccagttcaggctaagatggcaaggagcaggggtaggacatacctcattataccctctcccttttttttttttgagacagagtcttgctctgtcacccatgcatgacaatggcatgatctcggctcactacaaccttcatctcttgggttcaagtgattcttctgcctcagcctcctgagtagctgggattacaggtgcccgccaccatgcctggctaatgtttgtatttttattagagacagggttttgccatgttggccaggctagtcttgaactcctgacctcaggtgatctgcccacattggccttccaaagtgctgagattacaggcatgagccatcacacccccctctcccttttgaccttgagacagaactgaccagcattgacattaaaatcaagattctaagactgacaatacagactctttgtagtagtaagataccaactccaacctgactctggtaagtaccacatgacagataacaggtcctaaaggaaataaaagtattttatcccaaaatatatttctgtgacatattttgaaatggccctgcaaagctgtctcttgtggggaaaatctacattctttagagaatctgcttccctttccatgttttctcctaatccaggagagatttaaatcagagtctgatacttttaagttctgataagagatatctactatctattctctctgaagcctgccacccagagccttcatctacataacaagaactttggcttccacaacccctcttatcttaaccctcaaatttctttctgctgactccaacactttagggaagcttaactttttcaaccaattgccagttaggacatttttgaattcacctatgacctggaagccccttaatttgagatgtgctgtctttctgggtcagacgaatgtaaaccttacatgtagtgattatgtttttgcctgtaacttgtctccctaaaatgtataaaattaagatataacccagacaccttggtacacgttatcaggacctgctgaggctgtgtcataagtcgtagtccttacatttgcctcagaatattttatagagttttacagaattaggcttttttttttttttttccaacagaaagtgactggaggggtgctttctgaatgatgtaactttctgaatgataaaaaggttctaattcttgataggtgtgtatatgtaaaagtttatcgaatggtacagtcaagatctgtgcatttcattgcatgtaaattttccctcagaaatttgaaaaaagaaatgtggatagtctgatataatttatccatgccaagcctacttttttttttcaatttttattataaattttcctttgaaaccatggccaaccacaaaccaccaacctgtccccactctcaatagaaatctcaatatttcaaacagcaaaatagagtgagaggacttggccctcttctatcctcccatcacctccctctggtgattatttgtggtgggaggagaactgctctgttctcccaaaccaccaatgcactcactctgcttccacctatgctgccttccctcattgctccaggaacccgtggaagaagtccaaaaataaatatcctgtttttctcaatgttttaggtagaatcagtggtttctcacttgaaagtgatccaatgtctttgaaagaagctttctttaaaatgcaaatgccattattttctccacagtgaaggaaagaccctggctttcctccccagctccaagtgggctgttctgattgcttccgggtcctgtcctcatggggagcagcaccacgggagactctgcctctgctgagttttctaacattagtgtcgggaaacaagaatctgccactgatgctccttttgtaaaggtataaacatgtatataaaggaacaccccagcacacccttcttgtccttgtcctctttttcttcctctgcttcttcatcctcattttgtctcttctctatgcttgctgcttttctcctttaatttttcttttgtcttcctctgtttccccccgccccacccccactcactgctgctgttttacacttacttggctatctgtggaatttgtttccagaaatattggaaatcaacatgcctatgggatagaacagggctggattacagagtagagtcgacaactttacctcttctagccagaatgaataaacatctgtttaaacagaagtctaggaaccatgaagaactggaggaggttacccaagagctaagaaacaattgggtggagtttggaaaggcagggatttgatagagtgcacaaaagctccagaggaatggaaatcaaatgcaagaagattttggttcaagataagaaaaaatgtaccaaaaggaagacttatacattcataaaatacctgtcagttccctattagcagaagtttttacatttagaattgattggaaattttagaataacaaacatttttaacagcacataagttacacagggaaaatctgaattcaaatgcctcaaagcaggtgcaattttatttatttatttatttatttatttatttatttatttatttatttattttttactgtcatctgctggaaatgtaagtccacaaccaccaagaatactaagatattttccaaagtgacattataaatcagtaaatggttatggaaaaatatcctttggccacgttgctctgagtttagaaacaataataacggtcataatgataacaacaaactttctaagttcactgtgtggtataaaaatacaatggcggccaggtgtggtggctctatgtctgtaatcccagcactttgggaggctgaggtgggtggatcacaaggtcaggagtttgagaccagtctgccaatatggtgaaaccccgtccctactaaaaatacaaaaattagccaggtgtggtggcgcgtgcctgtagtcccagctactggggaggctggggcaggagaattgcttgaacctgagaggcagaggttgcagtaagctgagatcatgccactgcactccagcctgggtgacacagcgagattccgtctcaaaaaaaaaaaaaaatacaatggttttgtttttttaaaacaagatatcacagtatacaacctataaaatgtggcaatttaaaatgtttaatggaaaatggtgtatgtaggcaacttatatgttgctattcaacatttttctgaatgtcctgcccaatgcaatcagacaagaaaaaaaatatataataaggaagaaacaaattgtcttttctttttttgaaggtgatatgtttgtctaattcaaagggaaagaaaataaaaataacaacacatctgacattcatgtccataagaaaagagatcagtaagagggctggataaatggtgaatatttttttaaaacatttccttatacacgagtcacaagtttcttccttaaattctagactcctgtgcaggtacaatgcctgtttaatagcactacttatttcgtaaattattctctctttcttccattccacagatgtttatgtaacccctattatgtgccaggtcttctttgactcactagggattgagtatgacacagataaaaagaaaatcctgcctgcatggaccttcccctccagtggagaaccaaccggactattaaaaatgatatatttttggttaaaatcatgtgtggtatattaggtagtgatgcctgctaaggaaaaaataaagtaaggaaggcagggtgcagtggctcatgcttgtaatcccagcactttgggaggccaaggcaggcagataacaaggtcaggagttcaagaccagcttggccaatatggtgaaaccccatctctactaaaaatacaaaaattagccaggcatggtggcccgtgcctgtagtcccagctacttgggaggctgaggcaggagaatcactttatcccagggaggcggagcttgcagtgagccgagatcacaccactgcactccagcctgggtggacagagcaatactctgtctcaaaaaaaaaaaattaaataaaataaagtaaggaaaacagagagaattgatagaaagagggttatgcttttagatgggatgcctgagaaggtctaggggagagggcatagaggtgtgaaatgcagaagagcattctggatagaagatacaaagaccccgaggcagcagacttcatggcatgctccagtggccttgagggccagtgatatggtttggctgtgtccccacccaaatctcatcttgaattgtagctcccacaattcccatgtgttgtgggagggacctggtgggaggtaattgaatcacaggggtgggtctttcccatgctgctctcataatggtgaataaatctcaggagatttgatggttttgtaaagggaagtttccctgcacaagttctcttctcttgcctgatgccatgtgagatgtgccttttaccttccaccatgattgtgaggtctccccagccacgtggaactgtgagtctattaaacctctttcataaattgcccagtctgaggtatgtctttatcagcagctggacaaatacagccagtgtacctggagtagagcaagagaagagaagaggggtaggagaggaggtcattcaggaatctgggtcactgtgaggatgttgcctttgtcatgagagagatgggatgccactggaagactctgagtcgaggagtgacctgatttctacttgacattcaagacagacttcttgactgcccttcacccacactccaaaacttgctcctttcccggtatttccaggtaacaagtgggttctcttctctcttcgctggtcactccggccatgatccttggagcctttctcacacctctcctcttctgtgacaacacaccaaatccatcatcagatcctgttggccttacctttaatacatagctcatcttctcaagattccatgctggtctaagatataatccactctctcctgggctagggcaagagcctcctgcctcatctccctgttttcattctcaccccctatgctctgtatttcatagtgaagtcacaatgattcttaagaatataaaaatcaaggcatgtcttttgcatgctcagaattctccaaacccttcccatcacatctagaaaaaaacatcagagtccttgctaggtgtgtacagggatccagggtcttgcccattgcctttctgatctcagctctttctattcctgcccagttgggatccagggtcttgcccattgcctttctgatctcagctctttctattcctgcccagttgggatccagggtcttgcccattgcctttctgatctcagctctttctattcctgcccagttgggatctagggtcttgcccattgcctttctgatctcagctctttctattcctgcccagttgggatccagggtcttgcccattgcctttctgatctcagctctttctattcctgcccagttgggatccagggtcttgcccattgcctttctgatctcagctctttctattcctgcccagttgggatccagggtcttgcccattgcctttctgatctcagctctttctgttcctgcccagttgggatccagggtcttgcccattgcctttctgatctcagctctttctattcctgcccagttgggatctagggtcttgcccattgcctctctgacctcagctctttctattcctgcccagtttgctttcacttctgaatccctgaccaacttgcagtttctcaaagaccccaacacattccctctttaaaaccatttcacgtttttttctttgtcaagaagagttcttcttcctgagtcaccagctcatgtactttctgtctctgctcgaatttcacctccttagagaagatagcccctgtgttcctattaaatggtcttcccttatcatcctatttcaagtgggcacatgctccatcatgtaatctatagaatcaatgaactgaccctaaagaatctggccgggcacggtggctcacgcctgtaatcccggcactttgggaggctgaggcgggaggatcacctgaggtcgggagttcgagaccagcctgacctacctggagaaaccccgtctttactaaaaatacaaaattagccagatgtggtggctcatgcctataatcccagctatttgggaggctgaggcaggagaattgctggaacccgggaggcggaggttgtggtgagctgagatcgcaccattgcactccagcctgggcaacaagagcaaaactccatctcaaaaaaagaaaagaattcggtgaaatttttgtgccacttgacaaactaattttaaagtttgtgtggaagaaaatttgcaaaaagaagaatatataaaataattttttttgttttgaaaaagcaaaacaagggaagagttgtccacaagatatgaaattgtagtatggtgttgaagtaattaaatcagcatgctgttggtgctaaaacaaataataaattgaataaatgagggggaaaacacattgatgtaaacataagatttcagtttatagtaagtgtttaagagaggcatttcaaattcatgatgaaatagactgttaagtaagtgatattggaacaaatatctaaccatataagaaaggctaatatcgtaataggtgacattgaacagtaaatgctaaatattaaatcataaactattagaagaaaatatgaatttatgataatcacttggtatctaaaatcttttccaaaacaaggtggagaatttggaagccatgaggaaataagaaatacagagatatttgacctaattgaaacaaaaataaagtactttgataataaaacacaacataaacaaaatttaaagaaggtttcaaactgtgagaaaatgattattccatgcgatgtaaaaagcacagtaccttttaactaataaggaataggcctccccccttgggaatgcacaaagcctttggccaggtaattttctctcgaagaaatagaaaacaatcatgaataacataaaagatcactattatgaatagccatggacatgagaattaatatacaaatgaaatattttagctcaacaactctgcaattttttattgacaatatcaagcatcagtgaacttgtaggtaaataagtttgttcaatataactgcagatgattccgtgtaatagagagagaagcctctcctactttcactccttgacccccagacccacgttttctggctaaaggcagagaaagccccacacagtagtctctgattccaagcatctaatgcaccctgtaagacttaacccatcctttgggggtattctgtccttctgtgctgtcattgagtcttcagagtgcttgttcacctcatgaataggccatctgcttctgggtgatggggtatgcggtgagatcagctaattccctgggtaggagctctttgctgtcctcctttgctgtggaatgagttccctggccagaggctgcactgacaggagggctgtgttggtggagaatgcattctgcgagcccaggatgttggtgatggtggaggcatcacagggtgggaaggcgcagccgtagccaccacaggtgtttctttctgtgaggatgcatctctgtcttgtccgtgatggaagaagtccagtgtcatcaacctgcctccagatggccagctgctccccgcggggaatggtgccacatgggggctcaatgttggtctctgctgctggcagattgggcacccagaagtgacgtgagccaggccagacttgatgagggaagtccatgccaagtgcaggcacagcctccatccctgccaccatggccacggtgtttaggagcccattggacgatgacagggatgactggggaaggtggcagccttgtatccacagaatatgttatcttgtccacctgagtattaagaatttcttccaggtggttgttttttgggggcattcattcacatgggacacacatattttcacagtctgtttccattctgagaggtctatccacaaacctcttcatagccagcaatcttccagtcttgctctttccaaaccattagcaaatgcacacacatcagtgtgggtctgtgcttctagccagctctcactctaaacctaaatactgctcggagctctgctcactgaaataattttccttccccactgtgctccagggtcaccctgagtcgggcaattgtgctccagctgtccactttcaggggtagcaggagatcatgcagctccatcagtatgttcagctgaagttggttcttcctcagttggtgtaagagacaccttgagaagccgtaggcatggctcctggggtcgggggaggcagtgcctggtgagttggagacacctgctcaccttacatgtaccttacagacatgcctggacgccgtctctcatgcaccatttccatttgacaatacattgctgctgcccacacccaatctaccctgggtctcaggggatgaaaaggggtcttctgggtagacagatgtggtgagggaactccaagttggagcacagtcacgttgcaaaaggacaggggtgtgggggcctggtttcgcgtaagacctggctgcaaagttggacaatgaagactgggagccagatgggcctgttaaaatccatccaggctgtggcaccatcatctggacagttaggtatgagggggatttgcagggggtgcggctgggttcaaatcaattcggttcaaatcaattcggacctcttggccagcccttcagtttgacagctggggacaagggacactaaactggagtttgcctgtggtcctgcctgggagcacagggatagcctaggtggagacaggcagggaagcctgtggccacctggacctcttgctcaccatctctgttctcagtagctccgtctcagaaatgagaggtagcgtccaccccatcagctgacccccagcccccactgcagtcatttgaaaccaggtactacaggtgggccaggaggtcagcttttgaggttttgtgagaaaaacattcatacctgctactccctcatggcaccagagaaagtggaatattccatttgtacccaataaaaatacaccagcgttctcatcctaacacaccccgctgaacactctccctggagagcgagatgagcaacctgctggcctggtttgctgagcaggacggtgctgggtacatgcatgaaggtgcaggactaaggatgacacacccccgggcgcttccaaccacttggcagtttgcctcatataggatcccagtctcgtctcagaataagagtgatttcactgaaatttgcttggcttatcctccagtcaggccccagcagcagcagggaggtgctgagccatgctctccttctcccgggctctgtcctggcagctacatcacaactccaaggagagatggctgagtccctttccctgctggagttagggtggtctctgacctctgccttttaattctgggtgagtcaggaggataaattgaggggtaaatctctgtgtaatatgagctcaatttattgctggtatgagtcacacttaggttgcatttaggaaaaaaaaagtaactggagagtgaaaattgaattagatttctagaaattcaggtaaaacaagagaacaaggatgcaaggaggttgggtccgtgagtggcgctgagcagggcaggcgaggctctggcctgtggtcagggaggccctggggaccacgcacaaacttcgagcaagagcgtcaggaagcaagtcaggcagtgtgggcaggatggatctggagaacctggggcgctttaatttcacccctcagctcctaaatgcagcctcaccagagaggggagaaggaaagtttccagatcatctgctgtgttccagtccccttggtagatatttccatatttgataggtcatcgatatggtttggctctgtgtccccacccaaatctcatcttgaactgtaatccccatgtgtcaaggcaggaacctgatgggaggtgattgggttatggggatggtttcccatgctattcttgtgatagtgagtctcaaaagatctgattgttttaagagcggcagtttttcctcattctcaaacaccctccctcccgcagccttgcgagggaggtgcctgcttcccctttgccttccaccatgattgtaagttccctgaggcctcccagccatgcctcttgttaagcctgtggaactgtgagtcgattaaacctctttcctttatgattacccagtcttaagtcttaggtagtattctttatagcagtgtgagaacagacaaatacaatcatccttgccacagtgtctcagttgcttcaatttaggtattattcatttctctttggagtaaactgagggaaagagaggaagtaacttatctgtggacacaccagtttcaggtgaaggggccaagatgacatccaggtgtgtttggctccaaaaatatctctctgcacagctccaggtggcgccttctccctctctctctttctctctttctttctttgtctctccagtattccccaaacatttgtatggacctggaactctcattagtctttttccatctagacctcagggtgacttctccctggacatacctcttccttctctactccttctccaaaatccatcacttggcttaagttggcagaagacacgttcctcctcctccgtgtggtcggtgtgctagaaatacaagcttcctacagttccctctaaatgaatctctccttttaatctcttacatggcccatcatcctgagttctctagcctggagatggataatggatgcaggtgtgttgagaaccgcttctcagcacgttttcatggttggctggtacctctgaatgcaaggtggaggacgtaacactctgagttcttggccgccattctgggagaggacccgtcccattttagtatgggttacacgcacatttgtaccaagttcccactagagcaaactcctccatgctggaggatggtgttacttcatgttggtttttattctgtgtcccttgttcacacagtggggcattccagacagggaggcctcgatctgagtggctggagggttgggttgttctgagcacaatcttgtaggcaggagggggcctgatgcttctgacttctgagcccttgttttcagagagcacaggtagtattgttcagcgtcccagtgtgaaaagtatttttaaatgtactgggtgaggagtacaattgttattcagacacagtctattttcccccttgaaagactgcctctgaacactgagttattttcctgctctttttcagtaaatcaaaggtttcgccatcatgtaaacccttgggcgacagagtctacctgtctccccctgatattgttctatgagatttcgatgctatcttcattgccagcagccctgacaaagatgcactgcagacggatagcctctcaggtgagattagattgaaccctccttatctcttcattgtggtttcatcactttcaggagatgctctgttgtgagaccttgctttgttgttgctgttcttaaagggaacactccctttgttaggaaaatctgacagctggaagccgtgagttcttggccccttgccctgaagcaagagtgaccaggcctctctcctgagggaaggccttcccaggtggggacataggccctaaagtgagaactgaagcattgtccactccctctttgatgccacatgcatggacggttcagtgaatgtcgtgggaactcagctgtgcccacccctgctttgttaccccggcactttgggaaacagcagagtccagcagaaaccactgaagttttgggctcggagggattccagttcaagccccggcttcaccacctacaaggttcaattttggtctaggaatggaacttctctgagtcttagttgctgtcatcaatattattttactgtcatcattatttatagtaaaataataacctctcagactcgataagtctatttgcgtgcctgacacagtgttatgaggttattatgccttatttaatgccaccatcccaggtgggtaaattagtatcattccatttcatagttggagcagctgaggctcagggagattaataatttgtccaagaccccacagctaacaagtggtggttctggaaggaaaccagggtggctgctccaaagctgccatcagcctgggcatctgccaaggtgccgtctctactggggcagccgccacctcccagcacctggagaaaatgtagcaggctagtgagtggggtgggaggtgggcccgtgtggctcactccatgcatgaaaaacccgtaagtgacaaatgcgtacgaagcagcgcttctcagccagctggccgtcactgtctgcagattgcctggcattcgccttctcagaagaatgagtctcagacctcagggttctgaggttctgtgttgatgtggtggctcagctttgcttgggaggtttcagaggctttctgtgagctgggcattgcacacttggcgcctgtttatgtatttaacacttgtggaaatcctttgaggattgaggtcgctggtcctcccttctgagtgtgacctttggggtgaatttgctccagctgttttcaaccttgttacaaagccctgcagggagaggctgagttcagtcagtcccggagggaggggagctgggggcatcagggatgggcctggcagagcagtgggtgtggaggggcaggtccgggggaagccagtgtggggcaggaggctgggcacctcagggctcctcagcttcctccccacccagctccgggggatgcctccgtggcagaactcctgggtatgctcaggacctgctggagtccagagaggccggggtggttttccagtctgcaaagcccatcctgaggtggagactgatgcttgagattctccacagctgaccttctccaaggtggctggggccattgagcccctggcagggcactgggggcctctatgggctgaccagctctgcacccacctcgctccacccctcagctgtgccttatcaggacaaactgctgctagctcccgagatgtccttggatctgtggccttctcgccccacactccctattctggctgtgtggaaccctctccccatcattcctcactgggtctgttcctcctcctccaagtcgctcatggaacaattatctacggaatgctcactcatgctggtcatcagggtgcagtagcagtaacgcaagcagctgcctccagagcccaaatcctccaaagctcctcacccagcccagtgcctcctggctgcaggtagggccagggccagctcatgtccgtaccccacagcgagccttgcttggagcctgacaaaccctccatgaaggtctttgagttgaatggggctagtccttagcaggcaaccccctgctccttgagagccacaccattctctaagctcactctctgcagccaagctctgccgaagggctagaaggatggccaggacccatcccagatacccaagtgatccaacaaggctcctgtgggaagtggggctgggccaggggatgcttttgcaactgcaaactcaatgtgcagctatgtcttggcaactcctgcctgatgctgcagagccccggcatctcacctgcccctgcccagtctctactttcttcccacatggacctctgtgtgtggcatgtatatgtgagtccagacacaagcgcgctctctcacagcacctgtgctgggcaggtagcaaaacctccgaggaatgcgcaaatgccttttttcagctcctgctctgctgactacgattcaatatccatgtccaaatagagcaatgcagttttcccttccttccagccctcctctgaagaagaaagctctttttcctcttcctccctcctcaccattgcttccctcctacgtttaataagctagtgggttacttactgcaaccaccttttgtttcctaaccagaatcaattttctttgcttttctctgttcccattaattgtgattcataggaacttaaaaggctctcatagcagcatttatatttggaagctgtaaatctcagaaagtaactttctcttgggatacatagacacacacacatcctccctgacctgcgaacagcactttagagattacaaagccttttcacagtgactgccacatttgagtgtcccctggccccaggaggggtcagggcagctattcttctcattttctaaataagaagagagacctcttgtatgtggtggcacaagctggggcgtgagcctttcaactccctgctttcctccttctgcccagaaacccggccgagaattagcagcggggtagagggcttccagctgaagatgggatccaacttcctccctacttagttccttgagcgcagccaggagcctctgggaatatcacacaggtgaccatttcagcagcagagctaggactctgttgaatggacttgaggaaatggctcctgctctgagaatttgcagatgtaacatgaccatcaacctgcccagcccaacatgactggacgcacgccacatccctgaggtggtcaaactccttcaaggactatcacagccttttgtggaaacaggattggagaggtcaagtcttttctctgaggtcacactacagctgcatctcagctcagccttagggcctgggcctgtcctgctctggggcccttgcccttgaagtgcagcttggtaaccagtagcacagggctctcctccagctgtcccctcctgctctggtctgagctggtctttttctaccacgtggaaattctggcttgcagattccttcctgcagcagtcctctgctcggagccctcagccactctgctgctctcacaaagaccctctgggcagccctgagagatggcaacccctccagaggaccttccctctcccactggactctggtcatcactggcatgtgcgttattcattgtcaggcctgtattcacccccactgtctgtgctgtgagctccagatggcagggcctgagcccatcgctacccctctacctttatagggctgtttcatatacgaatgagttaatatatgtgtatcagtcagggttctccagaaaaacctcttgctctatctatgtagtgagaggtctatctacatatagagagaaatttattttaagaaattggcttggctgggcatggcggctcatgcctctaatcccagcacttttggaggccaaagcaggtggattgcttgagctcaggagttccagacaagcctggccaacacagcaaaaccctgtctctacaaaaaacacaaaagaataaccgggcaggtggcacacacctgtagtcccagctacttaggaggctgaagtgggagaatcacctgagctcagaagcttgaagctgcactgggccatggtcatgctactgggtggcagagtgagatcctgtctcaaaaaaaaaaaaattagctgacaggattgtggggtggcaagtttagaatctgttgggcaggctggaaatttgaagaagagttgatgttagggtgttgagtttgaaatctgcaggctgaaaactcaggcaggcttcctatattgcagtcttgaagcagaatttccctttcttcaggaaatctcagtctttgcttttaactccaactgattggatgaggcccacctatacgatggacagtaatcacgttactcaaaagctactgatttaagcactcagcacatctgagaagtgcctttaccataacaccaggactggtatttgaccaaagaactgggcaccgtggcccagcaaagtgcacacataaaactttccgtagaatagtgtgtggtgaataggacacattcaataattgtagcaattattagctatctgcaagtgaatactcagtttctactgaatcacttaatagatttaatactttttaaagagttcaaagaattattttttgacatggagaacctgatacaaacttcccaccatgttgcatggcatttcagaacattcgaagacttggtgaaccacagggttccatctgggtaaagaactcattaaggtccccctggttttaatttctatgatgtcgttattttattagtcttcttaggcaaaacaaaaaatgttgtttgcctttttgtaataaagtaacacctagaaagccatgagattatgagcatatttgaggatttctatttggaatcattttatattcatggactttaattggaaagcgtgcagttacctggctggaggtttatctcagccggcttgatacattctctgtgattatgagtgaggaagctgcctggagaaagcctatttttacataatgcagtttttcatggtgtttttgttttcacaaagataaaataattgtggtgaagtggacagagagactcctgcctttttatttttctttttcaggcttgttgtagtagactcttaaaaatgtcaaaacaaatcaccaattttggtatgtttattatactttttctcatctttattgagagaaaacacttttttttaacctgaagaattacatgggtaaatttccacaacagatgtttactaagaaagtatggtgctgacatattctagaataatggcttttactagatgagtggttgatggcacttggagttggcatggtgaaaatgggcctttctaaccagtcagatggtcctccaaaatgcacagaggcaatttgggaattatttaatattgttggaaccattgtacacttagaataaacaaatgcttgcttaaattagacaaattttatttttttaccagtcatttgtggaaatttcataaatacatttcacacatctgggtaacttcctcattccaattatattccttagctcaacgtgaagcctttgcatgactcaaactcctttgaaatggacagaaatgcatcattactctttggaaactttagtagtccctaggacttgtacagaaacgagcaaattctggatctgtttcagtcacaacgctaaagagtgaaataaaacagtgaggaattctggtggggcttgaacaaaagaagtctgaaatttctaaacactatacttggattcaatagttgaatttttatgctgtgcacattgtacattttgtaaatatgtctttaatatgatttactgaaacacagcctaacaactgcagaggatacaggggactggacatactgagcaagtgctgtgctttttctcatttgttaattttagtatgtgctattatgtgtacatttatgagaaatctcaaatcacttttttttttgagataagagtctcactctgtcacaaggttggaatgcagtggcatgatctcggctcactgcaacctccgcctcccaggttcaagtgattttcctgccttagcctcctgagtagctgggactacaggcacgcaccaccatgtccagctcatttttgtatttttagtaaagacagggtttcaccacattggccagtatggtctcaatatcttgacctcatgatccacctgcctcggcctcccaaagtgctgggattacaggcgtgaaccactgcgcctggcctctcaaaacacttttataaagggttgatgctgcctaaaaaatacaaacacaagatacacacaaacacacacacgcacttctatagacagtcttaatgtgaatgccaggagaaataaaatgatccaacacaaaatatgtttcatgttttgcacacattagatgcccaataatcattatcaatcacagaaaaactgaagataccagttgaatatttgagaattgaaggatttctctgtgtggtaaaatgaggcatatgttatttctcgtgtcttttcatccgaggtgtattagcgttctccagagggacaggactaataagatagatgtgtatatgaaggggactttattaaggggcattgactaacaccatcataaggtgaagttccacaataggccatctgcttggctgaggagcaaggaagccagttcaagtcccggaacctcaaaagtagggaattcgacagtgcagccttcaatctgtagccaaaggcctgagagcccctggcaaaccactgctgtaggtgtaagagtccaaaagctgaagaacttggagtctgatgttccagggcaggaagcatccagcatgggagaaagatgaaggccggaagattcagccagtctagtccttccatgttcctctgcctgcttttatcgtagccgcgctggcagctgagtagatggtgcccactcacattgagggtgggtctgcctctcccagtccactgactcaaatgttaatctaacacccccacagacacacccaggaacaacactttccatccttcaatcaagttgatgctcagtattagccatcagaagtccaccccttgtcaccttgaacccatacacagctcctgaaatcatacataatcttcaaataaagacaataataaattcataattacagctaacattatacagctatcctttgtacaacggaaacatactaattcttaacctaagtgctattacataaagttaacgacacttaaatgctgatatgaagtcagtaaatcttatgtgataaaggaaaaaataaaaacatattttcttagtataagtgtatacacgaacaaatacgttcttaaaataaggaagaaatactcatgataattacagttgtcgtttctgcagctggtcatgtggtattaatgactgcttttttctactacccattctgtattccctttgccttcagcaagcacttcagcaggtcgtgtttttttttcttttaacctggtggagtgatgcaaaccttcattgcttctgcgccatttgccatcctgcctggattgggttgttgtagtttcctgttgaccttaatcacagggcatggggaagggaaggaagcattttcttagatacctggaggagacagcaggcgttgtaagattaaaactgtgatattgggactgtctcaccatcatcatctttgcttctctatgggatcaagcccaattctttgactcctccttttgctggggacagggactccgacagcactggggtagcatggtacagctcacgagcagggaaaaacacacctgtttctccagtgtgtcatgagactagaggaggcttcctgtgagctgctttggtcacgtgtctaggaggaatatggtgttatgacggccagcatgggtcccctgcatgcttctatggaccattgagtagggaggtgacacagtgaaattcacagtcctggcagaggcactgttaccagaaaagggatcggatcccaaccctaagagagggttcttggatcttgcacacaaaggaattcaaggtgagttgtggagtacagtgagaagagatggtttattaaaaactattccattacagaggaggtcatccatggaaagaaagaagaggaatgcaccatctttgtctgaaggtttccttatgtaggagtcttgtctatgtaaagactaaactaagctgtcctatatgtggatgggcaggcagcatgacaaaatttagtagtttattaatgtaaagaaaactatccttgacattctagtgtgtaagtacatcaaagtgttaccgtaattatcttgaaagcgtatatcgttatgggtattgggacatctgggttttctgttgttggaggggtttgtccttgtaggcattagcaagctgcttccttagctgtaaacatctaaggaccatgggtggtgactgaccaggaatgtgccttggcgagtttcaagatggaaggccaggtgcggtggctcacacctgcaatcccagcactttgggaagccaaggcaggtggatcacctgaggtcaggagttcaagaccagcctggccaacgtggtgaaaccccgtctcttctaacaataccaaaattagccgaatgtggtggcgggtgcctgtaatcccagctacctgggaggctgaggtaggagaatagcttgaacccgggaggcggaggttgcagtgagccgagatcatgctattgcactccagtctgggcaacaggagcaaaactccatctcaaaaaaaaacaaaaaaaaaaaagggtacaagatggagctgaacttaaaatggtgtcactctgactctcctgggctcctgcttccataacagcaccaaagcagagaatcaggggcaggaggcttttcggcaaatcaaaccacagatatccccttccctagcacctctgcaggccgcagcagctgctctgtggagagaagtgagttgagcactgaggatctgcaggtaaggagctgaagacacttccctgccattcggggttttgcgtcctataagaagagatagacataaagagttaaacagtgggtttgaggctattttgtttgtttgcttttttgagacagagtcttactctgtcgcccaggctggagtgcagttgtgtgatcttggctcactgcaacctctgcctcccggattcaagtgattcaggcacgacccaccatgcctggctaaattttttttttttttgtatctttagtagagacagagtttcaccatgttggctaggctggtctagaactcctgtcttcacgtgacccgcctgcctcggcctcccgaagtgctgggattatagtcttgagacaatatgtcggcccaaaggctattttaaaagactccatgagcaaaaagacgcaaggaagagaaaccgggtgagctgggaggtttgctcaaagagcaatgtgactccttggcacctgcagggtgaatggaggtttgagaggtgaagaaaataggtacattgttcagggtggggatgctgtgctgtggtgacaagtaataaactcttagatgcttggcacaaaaaagaatggatccgcttatatcatacctctaagtagtttgtgggtaaaggcagtggacagtcctctatgcagctattcagggactggggctccttctgtcctcctgggatggagctagtctcaacacacagcctccagggttgccatggaaggggcagagggaggaggatggacgtggagctttgttgtaaggcaggccatgaaagactcatattatttctgtcctgttggtcaaaggtgatcacaaggccccacttggatgccctgagtgtgaaatgtgttcttcctgtggacccagtggcggggacggtagaatttagacatgtgctgagcacttggcattaggtctgaaaaagtcaggaagagcatttcaagcataggaacaaatgaggcaaagactcagaggcacaaaagagccagatgtgtaggtggaaccctgctgtgctgatgtggcagatggtaattgttgaatgagaaaaaaggaagacggactggaggaggaggagggtgcaggaaggtaacagaccctgcgggcttttcctctaggcagtaagtagttggcaacggaagtgttggagcagaggaaggagtggcttgttttgatctaaggatgagaattctggcggcaaggtatgaaggagaaggttggaagtggcgagctttttaggagcctaacacagaagttcttgtaaaggaaaagggtgtctggatttggggtataaatccagggaccatggggtgaacatgagcagatggctgtgaaaactttcagttcgggagacaaattggatgctggaatgttccaggaaagggtcactgtggagttacagaagaatggataaaataatgtgccctagtccttcatccccaagaagtaccaagaaaaaaaaatagcaggaagatactcagaggtgatgctgattagcggctatagccattgacccaagatgaaaggacgagtttgatcttctcaggttgctggtatcttggcgctcctgcatccgcttctaactcgcggagatagttcatcatttcccacggcttaaagtacagtcttcatactgccgactcctgaatgtctgtgtttggctcaggtctctcccatgagctccaaacaggtgtttgcagctgcctagtagaaaattccacttggatgcctcccaagtagcatcaactcaatctgtcacaaacttatctcagagactttccttttaaacccaggctcaccttcctggagaaatatcccccccgcttcccagttgcttatgccaaaaactggagagcgtttttcatacgaacctccccttaaagctcatattcaattactcaacacgatcaatatttccttcccaaatcttttcttccacggttcttctctccatcaccactgccaacaccttactctaagccaccctgactcctcactgcagcaaccaactctcgggccacttcacctctgggtctccttaaggtattttctataatacagccaggaagatctttttaaaaatggaattcaacaattcaaatcatgctattcttgtcttataatcccttaagagcttccctttattcctcagttaaatctcagatttgtagcctgccctggaatgtcctgtctgacctggccacgctaaattttcctccatttcgctccatgatttcctctggatgcggcgccagcaattagctgaccttccttcctttcccaaatgggccaggtccttccagccttatatccctcgcataggccagttcaaccgatggcttggaacactcttcacctcccacccagggctccctggcagcgtcgccaccttcagagggctgtctctgactgtccagaccaagacaacacctggaatgctcttccttccttagcatgtcctacttaaggacaactgcaattaaaagtacaggtcaaagttgtgagggaagtctttctgttgagggtcaatgcagtaaggacagggattagaaataagttttgctgtcattaaactctctatttgaaaactatgattgcacataaacgtgtttagtaaatgtttgcattttatattttcggacttaaagcaggactatatagaggtatcatcttggttagaaaattggttccatgaacttcccagtatacccaagaccgtatttcaaaattggaatcttcagcacatcatgagttttcagcctttggggctcaagggaggcagcagagccagggcatgagaacctggagtcaggccagatggcctcattccaaatccctgctctgccaactgtgtgacctgaagaaaatgtcttaacctctctgtgcctcatttattttgtatgtaaattgggggaataatagtatttataccataggttggctgcaagaaggaaataaaataattgatgtaaaatatttagaactgtacttgacatatactaattggttattctgcgttgttagtgttgtaataacgattagaactagtaatcttctattattgtaatcctcattttggctatgttatttaacaccatatatatgtcatcaagatacataaataacaaaacatgaggcagaaggaggttgcatgcaattaaagggctacaagggtctaacattttcttggagctgttaaggtattaatttaaatttgactctaagaagtaaataatgaaattaaattaaaagtatagggaaaaagctagagaggggaaagaagaatgatgaaatatatttaattcaaaagacgtcaagagactagttaaaaaggaaatagaatgtgtggaaaaaataaaaaaaaagtagacacaaaatcaaacatgtcagcaattacttttaatgtagaagaactaaaagcagcaatcaaaatgccaacattatcaggctggataaaaaccaaaacaaagtaaaacctaaatgtataatctttacaaaaaaacacacattaaatatgaaacgttaaaggtaaaatgatggggtaagttacctctctcacaatagtaactgagaaagctggtagagcagaacacagacgaagtagggtttagggcaagaacatttattaggaatacaaagggattgtttccataatggtgaaagagttaacccacaaggctgtggtaaaaatattcaattgctagtgtctaataatatagtttcgcaaaaataaagcaacattcaccaataaaaggatcaaatacataaggcagaagtcatagtggaagatttaacatagttatttcaataatgaataaataagtgaacaaataagaatacagaggatttcaacaaggtcaacacatttggcctgagtgggatacacagaaggctgcctgtagcaatgacgtactcacagttttcgagtgtacccggctcgtctacaaacactgacttcagctgggacagaaagcaagtccagaatttctcaaagaattgacataattttgagtatggacaggaaggtgaccaggaaatgctaaatatttgggatgtaagcaatgcacttctaaatagccatgaataaaagaaaaacatgacattgacaatgaaacagaaatatgttgaattaaatagtaatacaaatacaaggtacaaatgcgtggaatgcagctaattctgtgcttagaaagagacgtatgcccatccatctggatccatatctagatacatgcctatatctagatatttatgcttagatattcatgtctatatttagctatagaaatagatacttgaaacaactgtttagacgtctaaatagagatatatatatgtagatacagaagatttgaatatgattaacaaacaatctaaatgacacatagagaacactccatacaaaaaaagaccagaattcagttttgcatttacctacatacctatctagtcatctgaatatgaatatttaaaaatcaaaggaaaagaacaacaaattaataccaaataaagtaggaaggagcaactaacaataagaagataaaagttatgaaattaaaatttaaaaatacaaatatgcaaagaaaatcaatgaaagcaaagctaatatccccaaaataagataatcattaaactcttagcaaaactaaagaataaaggtgagaaggcacaaattgctaattttggaaaagaaaaaggtataatcactgtagatccaatagatatcaaaaaggcacagggaaaattataaacaactttttaaaattgatatgaaaatttagatgaaacaaacacttctacaaaacataaaacttactaaaactgactacaaagaaatagaatattttaatatttatgtatctattaaattatttaaactaatttttttaagacaaagtttttttttgttcttgtttcccaggctggagtgcagtggcgtgatcttggctcactgcagcctctgcctcccccactcaagcaattctcctgcctccgcctcctgagtagctgggattacaggcacctgccaccatgcctggctaattttttttttttttgtatttttagtagatacggggttttaccatgttggccaggctggtctcgaactcctggccttaggtgatccacctgcctcggcctcccaaagtgctgagattacaggcatgagcctccacacccagcctatttaagctattttttttcaaatctctatgaactcaaagttttacttataaaatggaccaaatataaggaagaaataacagaaaacttttgcaacatcatcttgggaacataagaaaacaccatcaaactagttaataaggtcaacataaacatgtttccaaaacctgacaagagctttacaagaatgggaaattacaggcaaatttctcaaacttagatgaaaaattttaagcaaaatattagtaacccaaatatagcaaaatctaaatagtacaatataacatgaagttggatttttccatcagtgcaaccttggtttgctattcagaagtcaactaatgtagttcaccacagtgatagaataaagagaatatcatgtttgatcatcttgatcgatgcagtgaaaacattggataaattctatactcactaaaagtatgaagtagaaagctatggttcaaagaaaacatttgaaagcaaatacattgactccacctaaagtgtacaccaatacttctgcttcctgtggatggaatatcaagcattagacctaatttctcactataaaagtaagtagaaatttgaaaacttaacatttgaaacaactctttccaaatattgaacaacaggcagcccaggactgtgattccaaagataagagaagtaaaggcttgtctcgcatgtgccatatttcttcccgaagacaatttctgctatgtggatgtcgtaatgagaaatgcaaaagagtctgggagtgtcagaattaagtcagtaaaaggctgaggcatctaaactttgcagagaagtgctatagaaaaaagcagaaaaagtgcccaggagtctatatgggagtcaccgtgggtcttggctgagtatcagtcatgcatgcatagagtgcaacttcatagagccaggcaaaggatccccgaggacctattagtttaacatttctgagaacccacatccgagaggaagatattcaagttccaaccagctagaagggagggcctcagaggttacctggggtagtcagtggaaggctctgtggagctacaccttagcagtcaggtggaactatccccatactgaaggttcctctccaccttccccagcaaagcctaaaatggaaccggaatggatcagactggatagcagataacttgattttctgcaaagtagagtaggcccaacattctcggaaggaaaacaacacacacatcaccatgtcaggcattcaaccaaacgactaaacatcccccaaagccagaaaatgtgacacgcaatcaaggaaagagtcaataaatcaatcccaggcactacaaaagtgattgaaaagttgaaaagaagcacattaaaacacctaccataaacatacccagttatttttaaaaaagggatatataaaaatgaaacaaatcttctaaacattaaacatgtatctgatatgagtctttcagtggatcggattaacaatgggtttgagactacagtagaaaatatcagtgaacttgaagacagacatagaatgtatgcaaaatggagtaatgagaggaaaaaaagaaagaaaatgagcctaattgagctaggggcaatattaagccatttaacctacgcaaatttgtactggagaaggggcagaagttcaaaaataaatttgaggtaaaaagggccaaaaattggttaagtttgatgaaaatgataaactttcagatgaaagaaggtcaatggaccccacacatgaaaaatacaagtgtgcatgcatacacacatacacaccaagacatatcataataaaactgttgaaaaaaacagttataatgagaaatagcttaaaagcaatgacacaaaaggccaataaaatatagagcaataaagataagaaaatcacagatttctcatgaaactgcaagctagaagacaatggaacaacagatttaatatgcaggaagaacaatgtaatctagaatacaatctacatgcagtgaaaatgccctttaaaatgaaggcaaaacaaagactttgtccaagaaagaaaagccgaaagcattaataatctccagcagacccacactaccagcattttattgaaagttctttagaaggaaggaaactgatactagaatttgacacaaagaaataaagagcaacaaaatggtaaatgtgccctaaatttgaagtattttttcattgtattaaattttattaacaagattattggctttttttttctttttttcttttttgagatggagtcttgctctgttgcccaggctggagtgcaatggcgtgatctcggctcactacaacctccacctcccgggttcaagtgagtctcctgcctcagcctcccgagtagctgagattacaggtgcgcaccaccttgcccaactaatttttgtatttttagtagagacggggtttcaccaggttgtccaggctggtcttgaactcctgacctcaggtattccacctgcgtctgcctccgaaagtgctgggattataggcatgaaccactgtgcccggctgattattggctttttaaagcaaaaatgtggggtttgtaacatatggaagtaaaatgtatgacagaaatagcataaggtggtgtcttcgtaagtatgtttacataaatgtgcaagtattcattaaagggcatattttgatcatgacttttctgtatgctgtacataaaaaactttgcctaaaaccaaaaagaaaaggatactgcagtagattgtcttactatttaacaatatgcatcctaacgttctcacctctctgggaggaatttactttatcgatatattcatggtggatttggccatatgatttcctttggcaagtggaatgtgagaaaacatgacaatatgccagctccaaacagtggctttataatgtaattcaagctcattccacatctcttgagctcctctctctaccatgagagcagcaatatacaggttaaaccttccgtctgcaccctggactctagggaagacctgaaactgacaccaacctagagatgatcagtcagagcatatgcacaggcccaagagtgaaaaatgattatagttttaagtcattgagcttttgcaattgttcattatgaagtattgttgaagaaaaagctgactgatacagaatttagaataaagaagtggagtgctcttgtaacagaaacctaaaatacactgtttcttggtattgttttgcagacagggcagcaggtagcatgggaaccataaaatgaatctgaaaaattacaacctatattgtgcagtagtaaaatatttggcaaagtactagcctgtagtaatttataaggaaaaaaaaatgaggctaggggctgtggctcacgcctgtaatcccagcactttgagaggccgaggtgggtggatcatgagctcaagagatcgagaccatcccggctaacatggtgaaaccctgtctctactaaaaatacaaaaaattagccgggcatggtggcgggcgcctgtagtcccagctattggggaggctgaggcaggagaattgcttgaacccaggaggcggagcttgcagtgagccgagatggcgccactgcactccagcctgggcgacagagtgagactccatctcaaaaagaaaaaaaaaagaaaaaaagagagaaaaaaaaacctaatgaatttgtgactctgggcaaagatatttcaggaccgaccatactagtgccagttaagcattattagttgcatttcacagggctctactaggaagtcataagttaagaaaacaactggccattttacaagcagaaaagaaagagaatagagaaatctgagatgttcttggacttggcaagtttagagaatgggtttgtttctaaacacatcaggagtggtcagtcattaaggccacgaatctcctatcttgttaagatacttgattgggtaaaagtggttcctggtgagtcctttcagttagaataaatgtctcaagagtgtggttcctgagatgccagataagttcaaagtacctcctgtaagatttgaggtgtaaaatgacctttgagacccacatttctaaaggcagaaaggaggagaatgctgtttagccaaccccagggcatagtttccaaagccttcttcagggatagttttcaaacgccttcttcagacatggcctagaaagataaggataacagggctgggcacagtggctcacgcctgtaatcccagcattttgggaggccgaggcgggaggatcacgaggtcaggagattgagatcatcctggctaacgtggtgaaaccctgtctctactaaaaatacaaaaaattagccgggcgtggtggcgggcacctgtagtcccaactactcaggaggctgaggcaggagaatggggtgaacccgggaggtggagtttgcagtgagctgagatcacgtcactgcactccagcctgggcaacagagcaagactctgtctcaaaaaaaaaaaaaaaaatagaaaaagaaaaaaaaaaaagaaagataagggtaacagaaggaactctttgaaggagaagccaagagcgatggagaacaatggaatagaacctcagcctaacccaccaacattctttacctgacaatagggaactgtggaacaccagccacctggatttcggaattgctatgggccagtgactgcagggtcctccctattcttccccattccaatagaaatgttcaaggcagttgtcctgctctatgccaccattatttttcagctctgtgagaggaacatatctttgaaaaaaattcctaggtctccagaccaagagaagtcccactgagacctgatgaaaaaattgtaacatttgagctttcaattgccgcacctggattggatgattcttttgaagtgttagggagaaaggaaaatgcatacttgtgactgttcagaaaatatgcactctcttttcccagcactctgctccactcccctgccccagaagggtgtactttcctgcatcattgatattggacttggtaatttgatttattttggccagtagaatgtggggaaatatgacagcatggcagttccaaaacaaggttctaagagactttacaagtctccagtatatattttgtattctaccatacaccgcaagaatatcacagcacagaccgtgtctgattcttcagcttgagtcctagaatcaaaagccacgtggagcttgcctgaacttcacctctgcctggagctgagaagttcatgtgaaataaatgtttgttgtttcaagctactgagattcaggagggtcagttgttaagcaacattactgcaagaaaatctgagtagttcttccttatctatgggaatatgttgcaagactcccagtggatgcctgaaactgcagataatacagactctacatatactatgtttttttcctatacatgtatgcttatgataaagtttaatttatagattaggcacaataagaaattaacaataaaatagatcagttatagtgatctactgtaatgaaagttgtatgaatgtggtctctctcgaaatctcttactgtactacaccctctttttcttgtgatgaggtgagatataaaatgcctgtgtggttagagaaagcgagtgaatgatgaaggcattgtgacaccgtgttaggctactgttgaccttctgatgtcgggaggatcatctgcttcaggtgatcctggatcattgagccgagacaatatccatggttggatggtagcagcagacaatgtcaatgactgactggtgggtagcatgaacaagctggacagaggggtaattcacgtcccaggaggcataaagtgggacagtgcgagattccaccacgctactcagaacagtgcacaatttaaaacttacgaagtgtttatttctgaaattttccatgtgatatttttgggccatggtaactgaactgtggataaggggtgactgcaatagtacaggtaaacaacaaatggtgctgatgagaatagctagtcgaaagaaataatcctggctcaacactgtgcagcaaaacatacacacgtgttaaaaatggagcatgtttaaagcaaacagaaatgcgagtaaaatatggatgcaaataaccagctgatatcagagtataaaaggcatttgaaaggaataaattatttcaagaaatcaaggagaaaattaaaataggttagcctcaaaatatttaaccttctgaataattgaaaaatattaatgaaattaaaattcacaaatcatggaaatgtttctgaaataagtatcatctaacccatgctttagggaacatgagaacggaagaggtaaaatcactttcaggtctgtatgcagagggtaggtagaacctaaaactgaggtccatgctctgtcagcagacatcaggataattattaatagaagcaaaacacctagtacctagagactagtcctcatccctgtggctcacgacaaaggttcctttaggttcctgatgtactaggcactcaactgtctttttgacagggaaccagagttatcatatattaaattccacatatgcaattgactgcccagcacaaattacacctttcagaaatgtcattctgttgaatagtgaaaagctattcccagggtggaaaacattgagatttgttattacagacagggattggaaaacaaaatattgtgaaattaagtgtgtcagattgtttaagcacaacaaagatgataccagaaatctcattcattgtcattcaaatctccattttcaatggagtctagagaagagcaaatagctaggtacaaactccagttaccccagactgaactaaataacatatcctgaacaatgagcccatgggaggtatttgtgaaatacttgagaacctttcttattgtgtttggtaactttgaaaagcagatgatacagcaagcaccactttactttctctacattaacttagagattttctcccatgggcttgaagaatgagaccctctgtgcaatctggccagggccctggaaattagcatctactgtagatgacccatgggccaaggcacgtgggagcccataggatggagggaaatgagaaggtgaggcagagattctgcctcctggtgttcatgccgttgtataatcccttcctcttcaatgaggcaaatacaatgtaccagcaaatagaatatggcaaaagccatggagtgtccctcccaccattctaacatgggtatgcaaatctccgtcttatccttagaccacacgctttctttgctggctagatgaccttagcaaccttaccggggaaacccatgtggcaaggagctgcaggtggtttctaggagctgcaggtggtctctaggagctgcaggtggtctctataggagctgcaggtggtctctaggagctgtgggtattcttgaggagctgcaggtggtttctaggagctgcaggtggtctctaggagctgtgggtatccttgagaagctgtaggtggtctttaggagctgcaggtggtttctagcagctgcggtggcctctgggagctgtgggtggctccaggagctgcaggtggtctctaggagctgcttgggggcctccaggagttgcggggggcctccaggagttgcaggtggcctccagcttacagcaagcaagaagtcagactgcagtcctacagtcacaagaaacggatcctgccagtgttctgagggaggttgaaagcagattcttcactatcccggcctccaggtaagccccagctctgactgatacattggttggttgcagagttatgagaccctaagcagtcatggcccagttcagccactcccggactcctgacccagggaacctgtcagatggtgagtgtgtgctgttgaacccatcaaggtcgtggtggtgacgatgtagcagcagatggttaatacaaaagggaagagaagcaggagacccggcaagaaaggaaagggtggggcagggcagaccaatctccttttttgcattaaaattaaaaggcctgtgacttaattttactgtgagtgagatgaggattttgagcagaggagtgatacgatctgatctctatgtattaagaaacactgtggctctgtgacagggacctggctgagttactggggaaagaaatgctgggattctggatctactgtgaagggagggtgaagggtatttggatgatgccttggttgtgggatgtgaataataggaaagttgcagttgactccaggtttttcagtgtgagccactggatgaatggatgggttgccttctactgctgtggtgaggcggttttgagggatgggagctgacagccctatgtggggcataaatggccatcccagtggagatgacagccaggcagacccactgtcaggactctgcagttccaaggggaggtctgggctgcagacgctctggggttcccgaagtagaaacgtcgcataaaggcaaggtacagtcagtacttggggaagtgtagctatgagcatgcaagttgatcctgagctccttggaggacggtggaacatgctgacaccacaaacagagttgaaaaataggggtctcatgtgcatcccttttgtcctgcttggtttcggtgtgggtggaagtgtgctctccatggaccgcaatccttgaaaattctggcttcagttttgctcaccagatatcacccctctcctcaccatgcctgtcttcccaggagcactatttcaatgagaagctgggagctcagaagctgagcgggggatgtatcactcttaggtgaaagaagggggaagaaaaaccagaaaaggtcctctttgccccaagtgctttgcatgcattaaatctaaggagacaggtgtctttaaatctggattcttaaatcaatcacttgctgccaacatgcttccgtgttcaaagtcagttaccatgcgatgcttctgaaaatagacctgtgctgaccaatcatgactcttatataagatttagtactgacttaagcctgcaccagccaggaatgtgatgtgacaagctggatgggagcaactcctggtgatggatttccagccaaatgagaggtgactctctgggtacacggagagcacacctcagcaggcagggcctggctctggggagagttggtggcatggatgcacagagcttcatggggctctcatgagtcctcctgagcaggcaccaggaagcctgttagtcgcctcacagcttcgatgtgggctgtggccagtcagaagcaaggccagcagcaatgaaccaggagagagcagaaagcccctaccggagtccagcttggtgggtccattggccccaacaaatggctctccccagccacatcctgtccaggactatgccagggtcgtaggttgattccctccttcagggccatgggaacatggacaggatcaggaaggaagttagtcccatgctccttgctgaccagaggaagagacatagaacattctccaacccaaatgtgggaggaagcctgagtggggcaccctcacagcctctgcaggtagcaccttggccaacctccttctgcagagacttccctgtccttgtgccaggcttgacactgaccaaggcaggtggggcagaaccaccccaggccatgctgcaaaattctacaccaaacgtcccagtcctgttgggtcagccagccctgagttcttagccccgaccactgcacctcccccgcagtgcccctcaggtcctctgccagcaggtgccagcaggatgtctcaagtgcagctcagatcactgtgctctgcctaatatccccacttctcctgtgttgggtcctgaatgccttgccttctccttgggcagaacactgatccattcctgctcaccttggaggcctcaacatgcacagcttcaacttcaacatcttcattttcatcttcttcttcttcatctttatcttcatcttcattttcatctttattttcatcttcttcatcttcatcttaatcatcttcttcttcttcatcttcatcttcattttcatcaccttcatcatcttcatggtccacatccagccacctggtttaccagagagtgtccccgaatgagtcctgccctctcctgctttctgtaattactgaatgaccccaagtgggttggttgatgtctctgggcctgagttacctctttttactgccgggatgattgatagtgtgtaacttccagggttgttttatgatatgaattagaaataatgactgtagggctgggtgcggtggctcacgcctgtaatcccagcgctttgggaggccaaggcgggcagatcaactgaggtcaggagttcgagaccagcctgaccaacatggagaaaccttgtctctactaaaaatacaaaaaaattagccaggcgtggtggtgcatgcctgtaatcccagctactcgggaggctgaggcaggagaatcgcttgaacctgggaggcagaggttgtgatgagccaagatcgtgccattgcactccagcctgggcaacaggagcaaaactcagtctcaaaaaaaaaaaaaaaaaaaaagaaataacgactgtaaatactgcttagcctagtgcttggcgtacagtaggaactcaatgaaagggggtcattactattggctgctcagcccccctctctgctgtatgtggctgcctctttatttgtactttagtacttggcttagagaaatcctcctgcagggaggcttctctgatttcatgagactgaggtgggcttctcccatggcctcccacagcctttgcgcctctctcttgtgcagtccaggtgacatggtgtcgtgattgttcactaatggatcagtcttctcaccacagggggctggagggcaggggccattacttttaagactctgtgcaacacgctgatcagtcacaaaatgcatgtttgttgaatgaatgaaagaaatacagccagctgtccctgctcgatgagttgctccttggttgacctttcccctatgacacgacctctgaggatttatgccgatctccagacgtacaggatggttcacctggtttctgctgtagcaaacatgctgctagctggagtttgtttacggagagactgtcttagaaggggagtctctgagtggacacagctgaattgtggacctcatttgggtgtttccttcattcattcatcgatcctctacagaacataaaatttgagtcagtgtggtgcccagcacaaagtgagtattcaacgggttttgactcggtccaattcattcctgcttttataattttcttttttttgaaggtggagaggcgggaaggtccccagtgtgttcatgggaacgcagggcatgcctcactgcctttggacttgccgctccctgggttgggagggagacctctctgacagatgcccaccttatgttctcagcgacatttccctcaccattccctctaccccttttttttaaaaaaaaaaagagacataactcatatactgtaaaattcaccatgttacggtgcagagttgggtgggtttcagcggatccacagggcagtgcagctgtcacttctctctatgtctggaacattcccatcaccccagaaaggaaccctgttctcttaagcagcgtctacccattttcccctcccccataatcctggcaaccacaaatccactttcggtctccatggatttgcctctcgttgacatttcacataagcgggatcattctataagtgagcttttgtgtctggcttcttccactcagcatcgtgttctcaaggttcatcagtttggaccaggtgtcagtgcttccttcctttttctggctgagcaatattccgttgtgatttaagggaacatgaatacacagcattttctttatttactcctccattgatggacattgggttgctcccactttttggctcttatgaataatgctgttatccctatttgtattcacatttttatatgaacacaggtgtcagtatctctgtgcacattgtagtgtgacatctggtaacttcgtgtttgacatttccatgaagtctccaccaaggctgcaccatttttccattcccaccaacagggcgggagagctcccgtgtcttcacatttttgtcaatggctactattttctggatttatgtatttacttattaattgtagtcctcctaacaggcatgaagtggtgtctcattgtggttttgatgtccactccatcttaacgggtaaacttgctctaactccttacccaaatctctaaaccatttgtcaccctctggatttgttcatctgtccatccatccatctgcacacacatacacactgtatacacatacacactgcacacacatactgtatacacatgcacactgtgccacatacacactgtacacacatacacactgtatacacatacatactgtatacacatacacactgtacacacatatacatagtatatacatacacactgtacacacatacacactgtacacacatacacgctgcaacacgtactgtatacacatacacaatgcatacacacatacagtgtatacacatacacactgcacacatatatatactgtatacacacactgcacacacatacacaccgcacacacacactgcacacacatacatgccacacacacactgtacacatatacacaccgtatctgtgtgcatcaggatacatcaggaatgcatttctctggcccctcctctccactcaggcccctctgcaccttgaccatcccatgccacatttttccactttgcattccacattccagcccatcagaaccaccaacaattccacacttatgccccattgaagtctgaagatgcccaccctgtgcttggctcatcattaccccccaccagcctgcaaagctcctgcttctccttgaagaaacatctgctctggccatgccttgacaaagtggggacctgaccaccaaggagggaggggaggaaggaggacagcatttatccatcatctgtgtctggccccatcccagggggatggagtgcgggcagggttgcagtaggaaccctgatcacaccttggtcttcaggctcttgtgggtgaaagaggctggcacgtacccactgaatccaggcaggtgttcgggagtgggcaggtacactcagcctgaaatgatgggtgtattttgcagaaaccaaaagggatccctgttgggaaaagcctgaggaaggtcgggagaggcatggggcgagctgcagatggttggaggctcttggggagaagttgtgggctggtcaggtttgggagggcaggacatgaggttggaagacacgtgtctttgatctcccaaatgtgtgttctgagctcaggccccacgcacatggcttcccagttgacacattcctatttcaacatgaatattttaataaggcagaaactttcatttttctctctttttaaaatcaaatccatttcttgtgatttattgatttttttttaaagtaaatcaattttttcgttttcacaacttattaccagatagtggggtctggaacataccgagcaagaattctgttaaaagtatttaaaagtattttcaaatcaaatcgataaaactacatggatatgttttttaatattacaaagaacaaatgtggaaaagttaatcaaaacatgctatttgacaccaacacgtagaacagcacagctttgatttgaacagatgttctaaaccatgaggactgtgcaagagaaacttaagaaaaataagcataagcctctctgatacaaaaacaagcagactcggttctgggtctgggtaagttgggttaaacacactctccaaatggctacacctagaaaagctggacagaatacatggaacaactatttaaagaccctggaaagcgaacagcagcaggaggaaagaactcccaaatccaacattccaccagattaatgcagtttactctgtcccctacctgatctcttcaagtctgaactcaatgccctagaaacccagaaatggacaccaaggtgcaggtagagagaattccaggaaaaactctttctttatggcccaagtagcaggaaaacaaactcccatcagaaatccccattttcctttttttttttttttgatggtgtctcactctgttgccaggctggagtgcagtggtgcgatctcggctcactgcagtcctcaactccctggttcaagtgattctcctgcctcaccctccccagcagctgggattacaggcatgaaccactacgcccagctaatttttgtatttttagtagagatgaggtttcaccatgttggccaggatggtctcgatctcctcacctcatgatctgcctgccttggcctcccaaagtgctgggattacaggcgtgagccatcatggcaagcctagaaatccccattttcttttcaatgttttccttctgttctctctcaccacaaccccttaagcaatcacgtggagatggtggcagcagagagtgatacgcgcccacaggtgcagggcagtcatcctctccgtcctgcagacctggtgttccaggaggcgaggctgcacctcacacatcctcccctgggtgcttctgagctgcatgaccatggacgaagggatgactgcagaagtgctccacagaacagggtaactcacatcccaaatttccagccagaggaacttgggaaaggctgtttgcagactcccgggctcacggttcccctgtacacacaaagctgtgcacacatgggtgttgcctcatggagcatttcaaacgtcatgaaggttaaactgacggagcactcacagaccgagtcctaggttggcctctggatggccacttgtgggacagatctggacagaaatgcaaagcttggaaagtggagctaaccataaaaccacagccagtccagagaaggcacgttggaacttgtggcctgggtgtgagcaggttagctgcctgcagaaacaaacactgggcattgctcattctccctgcctcataacataccatccagaatgcccaggatacaatccagaattacttggcatgtgaggaataaggaatatcccaattctcatgggaaaagatggtcaacagacaatgatactaagatgacacagctgttgcaattatctgacaaagacattaaaacggtgattattaaaacattccagccaggttcattggctcacacctgtaatcccagcactttgggaggctgaaacacgtgtacagttttgagctaaggagtttgagaccagcctgggccacatggtgaaaccccatctctactgaaaatacaaaaattagccaggtgtggtggcatgtgcctgtagttccagctacttgggaggctgaggttggaggatcccttgagcccaggaaacagaggttgcagttagccgagatcacacaactgcatgccagtctgggtgacagagtgagaccctgtctcaataataacattccaaaaagtcattgcaaacacattcaaaatcaatcaaaagttagaaaaggaaaatttaagtcctgaaaaaagcgtgcatgcatgaacgtgcacacgtgcacacacacatactcacacagaaacctcatggataggctcaatagcagactggagatgagagagaaaagagttagcaaactcaaagacagaccaaaagaaattatccaatctgaaaaacaaaaagttggaaaaaaaaaatagactaagcctcagggacctgtcagagaacaataaaaggtctagtattttttcactggaatcaaattgaggtgagagtgtgatgctaaagaaataaataaatacataaaaatttcaagaaaatttgctgaaaactctttacattttggaaattacctaagccaccagaatcaagaaggtcagcaaaccccagagacaataagcccaaagaaatctatgcacagacacatcataatcaatctgctgaacactagacacacacaaagttttgaaagcagcaggaaaaaaaaaaaagatgcattccctaaagggagaaagcaattcaaatggctgtgactttcttatctgaaaccgtgggggtcagacggaagtggcacggcgtttttaaagttctgaaagacaataattgccaccccagcagtatatatccagagaaaataccttcaggaataaagatgaaataaagacattctcaactgaaggaaaacaaagagaattcattacagctgaactgctctaagagaattcctaaaggaagatctccagacagagaggaaaggatagaaggaatcttggaacatcggaaaggaatgaaatgacaggagtgataaatatgtgagtaaatgtaacaaattattattctctgctttgaattctttaaaatatgtatgaagattgagagcaaaaaattgtaccattgtctgatgatgttttcagtgtatgaacacaatgtatgtaatgcataaggcaatgatcacatagagagagagagggtctgcaggtccccatggaggaaagttttctgttttgttgttgtttatttattttattttatttatttatttattttgagagggagtctcactctgtcacccaggctggagtgcagtggcgcagtctcggctcactgcaagctccgcctcctgggctcatgccattctcctgcctcagcctcccaagtagcggggactacagacgcccgccaccacacctggctaattttttgtttatttagtagagacggggtttcaccacgttagccaggatggtctcgatctactgatctcgtgatctgcctgcctcagcctcccaaagtgctgggattacaggcgtgagccaccacgcccagcctattttatttttatttttaatttttagggtacatagtaggtgtatgtatttatggggcacacgagatattttggtacaggcatgcgatgtgtaataattacatcatggaaaattgggtatcaattccctaagcatttatcctttgtgttacaaacaatccaattatattcttttagttattttaaaatgtacagtgaaattattattgatgatagtccccctatttgttgtcatataacatggaatttagaagtaagcaatccggccctaggatgagggccctgtggtggtgtcaggatccggtctccttcccacttcctgccatgccctcctttaccagtggttttcaggttatggttccacggtggctgcccacctctgctcactgcatctgcatcccaggcaagacaacaggagcactcaacacaaatgtgcacggccatgggaacaggccagccacatattcctcttcaaaaggccctcccagaactactaggcagcattttctccttcctatattgaccggactttgtgatacaagagagaaaagaatttagcgaagtatatttacacactgaacaaaatcagggtcatattagcaaggaagaaaagaaaaatagacataaggtaggcaagccatagtatctttgacaacagttattaaatattgtatgcaaattttatatattatataatacacatatatgtatttatgtatgtgtatgtagatagcatggccattctatgtgaagtgacattttctaagtagactgcaaagagttaagtatgatcattgcaaaccttagaacaatcagtgtttaaaaaattaatctctataaagagatgtagtaagaaacacaatagatgatgctacatatgttcaaataacccaaaaagatggcagggaaggggaaacagaagaatgtcaaatggatggaacaaacagaaaacaaatagcaaaatagtagaactgaacccaaatatatcaatcattatagtaaatgacaatggtctacacacactcttaaaagacagaagttgtcagaatgcataaaacaacaagcattattcatatgctgctcataagaaactcactgcaaatataatggtgcaggtatattaaaaggaaaaagatttaaaaagattatctatatgaacactaatcaaaaaagccaggttggtgatattgatatcagacaaaatggacttgaaagcaaatatatttaccagggataaagtaaaacattacataatgatagaagagtcaattcatcaagaagacataacaataccaaatgtgtatgcatctaacaaaagagcttcaaaatatatgaagcaaaaactgaagaaactgaaaggagaaatagataaatctcccatgacagttgggaacttcagcactcctttattagtaagatatagaactggcaaagagaatctgcaaagatagggaagggaacaacaccatcaaccctctgcatctaattgacgtttacagaacactctacttaataaaaacagagctcacatactttcaagtctgcatggggcattcaccaagaaagatcatggaaatcataccaagtatgttttctgatcataatggaattaaaacagaaatcaactacataaagataacagaaaaatctccaaatacttggaaattaaacgacaccttttagatgatcattgggtcaaagagaaagtcttaagggaaattagaaaatactttgaacaataaaaatacagcatgccaaaatttgtgggacgtaaataaatcagcgctttaaaaaattaaggcactaaactcttctatgacaaaagaaagattgcaagtgaataatcgtcttcaccttaagaaactacaaaaaataaagagcagaatatgcacaaagcaagcagaagaaagacgagctgaaatcagtcaaattgaaaatagtaaaacaatacaaaatattaagaaataaaagctgactccttgttaagatcaataaaattagcaaacctctagcgtggctgacaaggaaatatagaatagaagctagaactaccaatatcagaaataaaagagactttttttagtgcatcttgcaaacatcaaatggataaggaaggtatacttcaaacaactctccacatacaaattcaacaacttacatgaaatggactaaggccttgaaaaccacaaactgccaaaactcccccaagatgaactagatagcctgcatagccctattagtaaaattggatctgtagttaatctttgagaaagaaatctccagccaggagcggtggctcatgcctgtaatcccagcactttgggaggctgaggcgggcggatcatgaggtcaggagatcaagaccatcctggctaacatggtgaaaccctgtctctactaaaaatacaaaaaattagccgggcatggtggtgggtgcctgtggtcccagctactagggaggctgaggcaggagaatggcgtgaacccgggaggcggagcttgccgtgagccgagattgtgccactgcactccagcctgggtgacagagtgagactccgtctcaaaaaaaaaaaaaaaaaaagaaatctccaagccaaggtggtttactgtcaaactctaccaaatatttagaaagaaatagcaccagttatatacaatttcttgaaaaaaaggaaatgttttctaccttatttgatgagataagcattaccctgttgtctaagccaaataaagataatacacaaaaagaaaactacagactaatattgttcatgaacacatataaaaatatccttacaaaactattagtaaatttaatctggtgatgtatagtaagatgaatacaagaccatcaacttgggcttcttctaggcattccaaaccaggtcaacattcaaaaatcaatcaatataatcaactgtattaactgtctcagaagtaatatcacatgatcatatctattggtacagaaaaggcatttgataaaacttagaatccactcacaataaaaactcaaagcaacctaggaataaaagaaaaattactcatcttgctaaagggcatttacaaaaacttatagctaacattttacttaatagtgaaagatgtaatttcccccgaaaatcataaaaaaaggctagagaatccccttttacccattctattcagcattataatgaaagtcctagcctgtataatagggcaggaaaaaaataaaagcatgcagtttaagaggaaaagataaaactgttctattcatagacaacatgactgtatacagaatcccaagagtagccaaaaaatcttctagaactaaaaggcaagtttagcaaggttaaacaaggtcaacacacacacacacacagacatttccatgcattagcgattgataaactgaaaaccaaaatttttaaaaatgccattttaaataggtcgaaaagtgaaatatataagcataaatatagcaaaacatgtacagaatttgaatgctgaaatagaaacaacactgatgagagctttcaaagaagacataaatcagtgaagagcctactgtactcaagattccaacactgtgaaaatgctgactattcctaaattgatgtacagattcaaaataattccaatcaaaatcccagcatgatttttttagacaaagacaaggtgattccaaaatttatatgaaatgtcaaatgaatttgaatagataaactattttttgaaaaataaaacggggaattaaattccttgatttaagacttactcttgagctgctgtaatcaagccagtgtggtgttggcaaagggttagatccacagatacgtggaaggccatatagagtccaaaaatggacctacacaaatacagacatttgcctttgttataatggtgcaaaaacaagtcaatggaaaaagcacagattttcaacaaatggtgttggggcaattggtcccttatatgccaaaaataagaacctcagcctaagactcgtaccatattcaaaaattaactcaggatgtattatggatctacatataacatgcaaacactggaaaacctttaaaagaaatcacaggaggaaatatttgggatcagggagttgaggaaagcattattagatgtgacttaacatcaaaagcataattcatacaagaaagcaataatgtattggactttatcaaaattagagcttttgctgcaaaagacattgttaagagaatgcaaaggtgactgttatgggttgaattgtatcctcccaaaattcccatgttgaagtcctaaccccagtacctcagaatgtgaccttatttggagatagagtctttgcagaggtgatcaagttaaagtgaggtcattagggtgagtcctactctaatctgactcgtgtccttataaagaaaggaaactataacaaagacacacacagatagaagaccacaggaggacacaggaggaagacagcatctcatctacatgtgaagaagcaaggcctccggagaaaccaatcctgcagagtcaccttgatctcagacttctggtttccaaaaaaagtatgagtgtattagtccattctcacactgctgtaaagaactacctgagaccaggtaatttataaagaatagagatttaattggatcacgattccacaggctgtacagaaagcatggctggggaggtctcaggaaacttacaatcatggcagaagatgaaggggaagtaggcatgtcttcatgtggccacagaaagaggaggatggtgaagggggaggtgctacacattttttttaaaaactggaccttgtcagaactcacatcacgagaacagcaagggggaaatccacccccatgatccaatcacctcctaccagacccctcctccaacattggggatcacaattcaacatgagatttggatggaaacacagagccaaaccgtatcagtgagatagtaaattccctttgtttaagctccccagcgtgtgggacttttttagggcagccacagcaaaccaatacagcaacttgcagactgggctaaaacatttgcaaaccacatatccaacaaaatacttggatacagaatatgtttttaaaagtcttaaaacttagcagtaagaaaataaatgcaccaattaagaaataaacaaaagacttaattacacgaaaaagcttttgcacagcaaaagaaacaatcaacagagtgaacaaacaactagcagagtggaagaagatatttgcaaactatccatccaacagggactaatatccggaatttacaaacaactcagacaactcaacaacaacaacaacaaaaccccaaacaatctcattgaaaagtgggcaaaggatgtgaatagatatttttcaaagaagatatgaagacatacaaatggccaagaagcatgcggaacaatgctcaacatcactaatcatcaaagaagtgcaaatttaaaccataatgaggttccatcttaaaccagccagaatggctattattaaaaagacaaaaagatcacagatgttgatacagagaaaagggaacacttatacactggtgatgggactgtaagttagtgcaacctttatagaaagcagtatggaaatttctcaacaaaaactaccatttgatcctgcagttccactactgggtgtacacccaaagttaaagaaattgtgataccagaaagatacctgcattcatgttgaccgcagcagtattcacaatagcaaagacaaggaaccaacctaagtatccacgaagggatgtttgagtagggaaaatgtgatctctatatacaatggaatactattcggccatgaaaagaatgaaatcatatcttttagcaacagggatggaactggaggccattattttgagtgaaacagctcagaaaacagaaagacaaataccacacgttctcactgataagtgggagttaaatcatatgtacacagggacgtgaagagtggaatgaaagataacagagacccagggtggggagtgggatggagacaggacaagaaattacttagtgggtacaatgtacattattcagctgatggatatgttaaagccctcacttcaccacaatgcaatatatccatgtaacaaaattacacttgtatcccataaatttacacaaaacagaaataggcaaaagatggaaaaagacattttaccaaacgatcacaaggaagggaaatcatcacataaaaatattttccctcatttgccgttgatgaagtgcaaaataaaaccataatgagatgccgttgcacatcaattacaatggccaaaatgaaattactgagaatgccaagtgctagcaagactagaaagactggatctctcatttcctgctggtgggaatgcaacaggatgcagccactctgagacatagtttggcagcttcttcatgattaagcagacaccgtatggctgagatcctgctcccggggaaagtaaacttgtgtgcacacatgtaagaaaatttcatagcaattttattaatgatcaccccaaattggagctaatccaaatgcccttcagcaggtgaatggataaacaaactgtgatccatccatacaaaagaatgttactcagcaacaaaaggaaatgaactattgataatatgcaacaatttggatgaatttcaaaggcattatgtggaaagaaggaagtcaatctccaaactttatactctgattctgtatgaaattcaaaaagctttctgagcttgacctccttccttctgcataatgtctttgaaattcatccaaattgttcttctatcaataggagggcgtgttttagagtgatggagctgttctgaatcttaatggttacagtgttaaaattcatagaactgcacatcaaaaaagttatttgtacggtgggacgatttttaaaaaataatataaagaaccatcagactcttccagtcttgctgaggactggtggggttgtgatattgaagctgtgtgcatcagagccctacggaaggccagagaaagagtggcgtcaccgtgtggccgtgcctgaattgcccagtggtgcagagcatgaggccacagatcaggccaagccgtcctcccagagactcacttctcagcaggtgagcatcaggctgttgttgaccggctgagccaggccctcctcgcctgtcacctgaactgttcatcctgttatggcccctctgcctgactgccttcattctctctccctccaacccgtctttttccctgcagccaatgtggtttttcttaactgtgcatccagcccaccacacctcaactttaaatactccaggagcttcttttctaaagaatggttcaaactccatttgcttactgtgcaaaacacttagagcccaggctgcattcccgcagctgcctacaaacctcatcccttcacggatctgctgtgtgactctgggcaagccaccaagccatgcccactctgctggtacttgtcgccctggtatggaaaatggggtgactataacagccatatcccagagttagcatagggaggaagtcacagtgacatcgaaagggctcaccaaaggctccttgctactgtttttattcggggctaatcccataactgttgttattacaaacagatacagacatccagtgcccactccgccacggtcaccacgaacgtggaatccgggttttattctgactctaccatactattacttagaaccctttctttacaaaaaggaaattgcgtttaaattgcttaaacaacaataacaatgaaacatattggctcatgtaactgaagagtccaaagaatgatttggcttcaggcatggtttgatccagaatctctaaagacatgaccaggactcttgttttttctctccctccattggtccagcttttctttggctgccttttcaaaacatctctctctgcattggagccagatggtcaccagcagctcccaagtccactggaccagctgtggacagggacaccctctcccagtagtctgtctggacagttgcaggaaacgccctgctcaggtcacaggcccatccctgaccccagatactttctcaagaatgtggagttcttgtccacaagctgattgtccaggctgaggtcatgtggctgcctctgtggcctgatgtctgaatgggggtgaggagaggggttgggtcagcatcatctagatggcatggaacaggcaggactgggggtcttcatcatgggcccccacactgtgggctctaggggtttcattgttgagagggaagtatggaccactggacagaccagtgaccacagtgtctgtggctgtgtgtcctgggacagtttgtaaactttggtggcctcatttgtgacacgggatgacagcagtccccgcccaggtctgctggagctctgagaggataagggtacccacagcactttgcaagtgcctgtcattagtgagaactctgaaactgtgccttccacagctacattgtgttattgttttgtgtggttgctttcgtattgcctagcaaatgacctagtcatgctaagaactaaattgatattagttcccttcactttgcagtcccacggacatttcaatcaccttataactcagcgtgtttgcaaattctatcccttctgcttgggaagctcctgttccaaccacaaataacaccccatcgtttagtagtaacagcattttaaacagcatttgtgtggctcttgcagctttttatgctctcttcatgccccctcatggaagcttcgcacacactcttggttctgtcgcatggttcccttttgacatcggtggcatcagaggtccacggaggagccacaggactgcctgtcggtctagcattaccttgtgcggcttaccttgtctgttttggctcccaaggctccagagggcagggcccagggctcaaccctcacatgtctcaagagctcagtacacggcggagattcccgggaaatgctgcagtgaactggattgtgaggcaatgcacagaacacagcactgcgtggcacctagcagttatgacgtttatcatcccgggtttctaccagtgccaggagagtcctgggaaatgagagtccactgagaggtcatgggatggaaggaactcacagacttggggcacagatggcttctctgtgcctgtgtcacccccgcctgcagatcccatgtccatcctggtgcccgagagtccccatcctgcatgcatggctttgaacctgctctgggctaggaatgtcaggcagtgcgtctgagcttcagcctctccatccataaaacaggaataacattactgcctatcaggatttcatgaggattaaataaggctgaatgagaaagaggcatataaacttgatttttacatgccttggaatataaatgcttcttaaaaatttcagtgatgccttttacaattctgaaaagttagtataaaaagtttgcctgccctgcctttctcctgagactgcatgtgaaaatcaaatacaacaacgaaagaaaaaaatgaagtgaatgtatcataccagctcagccagcgtgttttgatggcttgaactgaagacataccgagatgtcacaactgatgctgagctgtgtcccccaagccaagccattctctaccttgcaaccagaaactcacaaacacaagtctgaccatctcccctctttgcttgaactcttgggtggtcccgcttggccatggtgctcaatgccatcctggcttcaggatgatgcatgccacattttctgagatctggtcccagatactgcttctaccttggaatgtttttcttctcagaagaaacaaggatactaaaagaagcaagtaaaagcattgccctatgacggctgacaagaatagacagaaggacagaaggtgcatttcattcaatcacccagagaaaactgtgctcctggagacagaggtaacacccccagcttagcacaagacacagggcagtcagtggcgaatcctgccctggtaaggtctccaggcacccgaggcctggaggtttgtaacaagaaaaggagccaagttccctgtccccaggaaggagctggactcagatgaatagtgtgagggggataaagaaaaagtgtgctctcctcccgccgagaggcttcaagagcccctgcagattcggagtgataaggagcttagaccagcaactgctgtttgatgaagttgccatctgtgggatttgctgactttgagcaggactcagggatatctctgtgttacagcctggtcaggactgtgcagacgcgctttatctgatcctcggggaaatcattttctgagtaagctaagctatgatggcttctagagactctgccagctcccccagtggaaaggtcaatgaatcttccaccaagaaaaaataatcgtgggagggactctgcacattaaacaccacttctgagttccaaagaatgttcacaaaatagcatggcaaaaatggaaagaggtgaagcaggtgaagtttggggttcctctggggagacatttctggaccgtgcaagcttttgagggttgagattgggccttctcatggcttcatcctgtgacagtgtccagcacctggtgatgatggtttcgtggtggtggtaggcactcaagctgtgtcaccaggcaccattgtttggcgaatttgccatcatccaaggtatggccatagccacctgggcccagatgctgtcttttgtctggggctcagacttgatcagacacaggtgggaagctcatgagagacaagcacataatgaaaatgtcagtgtgctggttttcaacatcacagggtggaaggaggagcctcctggccattccctactgagatgggtgttgtttagaaactgacatttgattccctgctaccatcacaccattgttgagagcactcactctttctaaagccttggtgagagcctcctcgttcccagacctgcctcaccttgctcaccctcacaccatcctccatcctctgtcgggccagcgagcctgttccgtgtgggacgcaaccccctgacgatggcggtgtcttacctcctcaccatctgcacgctcttctagctctgcactgcacctggagcgatggggccgaacatgacctattagcaagactcccccttgccccatagaaagatgagatcagcctccttgtcatgaggttagggccaggacaccacacacgtgggttgggttccacaacatggagtccaaaatgatagaaatttcacgacattgcaaactccttagtattctggctatgcagtgatgggggcagctggaattctgaccccaggcaccagcccctcagtggctctgcccaatgctggccggcctcagtttgccacaggagcccgaggcctctctgtggcaccaagaacagctgggtcactgtgcatgtggtcagaatgccacgtggtttatggcctcaatttaaatgattacaagtattaattaatggatggttggaggatggaggatggacaggactacccaatatttactgagcacctgctttgtgccaggcaccctgaagccctgatgggcactgcacttgctcctccaagcacctctctttccatctcctaagtggccgagcagccacagccattattgccccgtgccagattcagtatgcggaggatcaatgcggcagcagagcgtccatgctctgagtggcgcgggctttgggtgatggcatttccccagctgtgttccctggcagagactgtggtgatatttctggctttgttgctatgtcaacccccgatcttgttcttgcctcctgtcttgcgtcaggctggaggcagcctctcccgagctctccctgtccctggtgtgcacgggaggctgcaggctgtgagcagccatgccgatgagcctcacatcacacagtgaacttccccttgcttggatgtctgaccaccaccatgaggggcctactcttaggctccaggggcaggctgggcacccccactgagttctcacctgaggggagagacctggacattagtggggtgaagaacgcgatgagggtcctgagacagaggcctgcttgaagagtaggatagtgtctcccgcgtcacaggtgacagcaactcattgttgaatgagcagtagctgagcgagtggacagatgcatgatgacatgtaacgatctggacttgttcaacgtaggaatggggccaggaaccataacaccacggcagcacaattgcatagtacagcaatagcatctaacatgaattgggtacttactgtgtaccaggcaccattcctagcatgacgtgcaggaaggtgtccagtcctacagcagatgtaatgcaggtgtatcactgccgtggtgccgtgcaccggggacagcacacagggaagctggggtcacggagactacattgagatttacccacctcaccgtgtccaaagagggtggggaccactttctatgcggaagaactatcagcttcataaatggttccctgtcactggagcaattgggagctggtccgtggtatgggcaggaaaccatggatgtgcgcggtcaatggctacagggacggagggcaagggtgggcaggctgagtcatcaggaggtgaagtggcagcgcatgaggactgtgtggacaacagggtggaggtggaggagacccccatgcctgggggagaaggatcgtgtggggagctgctgtaacatgctcagggagcacagagggtatgcactcctgagccacgaggaaggtggttccaattctcacaaaacctccagagcaggagaggagaagcttgccaggggcagtgtggagtggggaatggggagtgccttggaagaagcctgaagaacatccctgctcaggagggagaaccacggggagtggagatgacagaggacgagaggccatggctgcagagggtcttcctcgggctgactcaggtgcatgctgggaattgcatcagggaggtctctgtgggcttcggtgacagctgtgcacgacgatgggggaacttggtggtgaacgcaggtaattacgtctggaagtttagtgtgaagacaaggaaggaaacttgattgatgcaggaaggggtcatggtttgcaaggtgctctcttgcctgcggtgccccatggttgagtggagcaccttctgtgcagggtgacagggctgggaggggacaggggaagagtgtgtggggtgaggcggcttctgggctcctgatcagtctctggggtggctgtcttcgtggatttcctttgaggtgtggggcccaagctgatcctggcctcactattggaatgagggtctcagggtgggtgtggtaccatgtaaaggtgccagcaagtcctcacaggtagggatggcctggctcctgacaggtagacccctgaggtgcaggaagcctcttctttgagaccagcaggctggtctccccaaggaggtctgaggagcagccatgtcagacccggctctgttccgagcctgcagccagagggcaggtcccacgttccaggccttcttccctcctggcccctgtcctcagtgttgctcgagccctgagtgtgccaggtgctcactcaggggggccttggagcaccggggggccatcccctccacagggaggagggagatgggcttttctcccaggaaacgtttttttttttgagatggagttttgctcttactgcctaggctggagtgcaatggtgcgatctcggctcaccgcaacctccacatcccaggttcaaatgattctcctgcctcagcctcccaagtagctggcattacaggcatgcgccatcatgcccggctaattttgtattttttttagtagagacggggtttcaccatgttggtcaggctggtcttgagttcctgacctcaggtgatccgcccgcctcggcctcccaaagtgctaggattacaggcatcagccaccacgcccggcctctcccaggaaacattttaaaatgtactttactgataccgctaatgtctgttttattttaaaatagagaaaaaaaggaagaaaccaccccctgccttgaatagttacacctgcacttgccgtccactgtgactctctgtgaggtttatttttgtgacattttcctatgaagtaagtggagaagatggcacttcctgggtaggcaggcacctggcaggacagcagggggtgcccaggtgcacagaggctgcccagggaacgcggtttcccccacaaccagctccgccttcccacagccacccctggctggagtacaagttactggggctcagttcttaggattcctacaaagcccaatttgggtcacctgacttgttaagtcaggtgaaggtgacttacctgaggggcctgcaggatgtggggtcaggctctggcactgggtgctctctgtcctcctcaaacgctctctatgctcactggccttcagggttcttgggggctcctgtttgctcttcgggcgttggcatcctccagtggactccagggaagttaaataaatgccaagaggattcacgtggcagggccctggaggtggagaggaaggagcacaggagacaccaggtgctcactgtccagcggggatgcaggcatgaacatggcagaggcaggcagcacccctcagagcgctgagctgtcgggaagcccccggccctggtcactccccacgcctgcccagagaggccgcgccagatccattaaaagtgtttcagcagcttcagaggcccccatttgtactgcccattctggagacaacagcgccctctgcagtgccctccttcagccttggggcatgtgaaggagcattggggctggcagacagcctccgtgggctgggagagaggtggacccccgggtgagaggatgcaggggattgttgtgctctgcagttttggggcaggtgtagcctgacctcaggctcttagagggaggagtccagggccaataacctgaccctgtgaagtgggggctatgtgaccctcacagagcctctgccctgtgggctccaaactgaaagctttctaggctgagtccagaagatattctctgtggtccccatgtggagctgggggctcgttgctcaccaggagagggacgctgggtgctggggctggggggccctcctgggatagcagcaggttcatatcttgctctggacaccagatactcacctgctcatcctctacaatgcacctctgcatgccaggaagcccacagcgtgcagatgagaagaccagggctgaggttggctctgtttcccaagcagatggtggaaggcagatctgaacccaagttctgtgtgattcccaaagcagaaggacagacagctgcccccctgaatggcactgatgctgccaggggacaggagcgactcctgcagccacctttcctgagcactgaggctgaatgtgggaagcaggggagggtgccaggccccaggagaccctgaaagctggcaggaaaagcaaagcagcagtgcagggaaagcctcttgggggcactgtcctggggggaaggagagcacagaaggtgggtcctgagcttctaccattccagggcttcctgaggaggccctgcttctccttaatgaatgaacatagctgctattccaatcttctggcattcctcaccatatcagttccccctctggttgctgccttcatagcctgaggagcccctcttgctaagggtaaacccaccaggaggtaacgggaagaatgggaggacttccaccaaggtcagcttgccaagtgatgctgctctagccacagggccccttggctctgacacaggacagcatgaccattgtgcagcaaggtgacactggtgagtcctgcaccagggagagcctgtcactggcagtgccagaggcttaggatctaacagttccagtgtaactgagaggtcctagagtgcgaatgagggaggttcccacactgcgcaggttggagagatgctgcgttaccgacgctgaagtggttgatgccaggggcagggccattgctattctaggatggttcaatccccaaacctcatcctaccacatctcctcctgaatggcttcttgatgtcccttgaatgtcactttgctgtggcttgtgctccatggagaagcagccagtcattgatctgttggacgtctgtgactcttcctaattgagtgtcctcgcccgagttcttaccctgccctgtagagccacagagcagtttgtttctgaggacagcgcttcccatgtgggaagagagtggattggtgcatccaggcttgttctccaggggtgtcctgtgacatgtgtctgggttattgcttgtattagtcagcttgggaggctgtaacaaagcaccacagaccgcgcagcttaaacaacagacatgcattttttcactgttttggaggctggaagtccaagatcaaggcattggcagggctggtttctcctgggacctctctctctttggcttgtagatgcaatcttttccctgtgttctcacacagtcatcattctgtatatgtctgtgtcctaatttcatcttatgggacaccagccatgttggattagggtctatccatatgattttatttaatgcactcacctctttaaagacaccctttctaaatgcagccacactaggagttagagcttccacatatggatttttcagaaggctcgatttagtccctaacacccctgccttggcatcctgtggtcattcacctcccaaacttttgcctctcctccctcctgacttccctatagccattgggatccatcctaggatggggtttgaaggcaaacatatagccctggcacagaccaatggggcgagagtcatatctcctttcttttcctgtcttttcaccatagaaaacctacctaaacttaagtatttgtttcaagatcaagatctcctgttgggatgcctgtgggaagcattgctcagaggctgttctccaaccttgtaccctaaatccctcaatagggtacaagaagcaggaagtggaggcctgggagccaggcagaagctgggaggatgcagacacatctctgaaagagggggcctgctgggttttaatctttaatttgctttattggtgggcttcaggcatctaatgagatacatgagctttctcacacaagaggataattttagttttgaccacaggagagaaaaacacatccctgggcttgagacagacagtatttttatggtattttttaatgcttttgagtattaaacttttatgggtgtttttaaaaattcaggaaggaacttccaaactctcatgcatcccgtggcctttgattgtcagaggtgcagcacgacggcgtggtagagggggtgggtgtggacgttagcagcccggattcagatccagacagacccctggctgcgactccaattccacatcagtaaaatggggtaatggggtttgtggggctctctgaggactgtgtgtcacgcccattctggagacaacagcaccctctgcagagccctccttcagccttggggcaggtgaaggagcatcagggccagcagacagcctccctggaccgggagagaggtgcacccccgggcgagaggatgcaagggactgttgtgctctgcagtttgggggcaggtgtagcctgacctcaggctcttaaagggaggagtccggggccagtgacctgaccctgtgaggtgggggctcacactgcaaaagtggcctggcttagcactgcactgaaagggctcagcagatgtccccatggattgatcattaggtcaatggatgtaaaacatttctgctcaaatcaaaccactaaaacggcttgattttttttcactcaacaacagctgtttcagctccagctgtggctgaaaggggccaaggtacatctcaggccattgcttcagagggtgcaagccccaagccttggcagcttagacatggtattcagcctgcaggtacacagaagtcaagaattgaggttggagaacctccacctagatttctgaggatgtacagaaatgcctggatgtccaggcagaaaattgctgcaggaacagtgccctcatggagaaccgctgctagggtggtacataagggaaatgtggagttggagcccccacatagagtccccactgtggcattgcctagtggagctgtgagaagagggccaccgtactccagaccaaagaacggtagatccactgacagcttgcaccacgcacctggaaaagccacagacactcaatgccagccatgaaagcaatgatggtgatgaaatgagagagctgctctcacagaagcaggaaaaccatggcagagcgaagggactgggaacacagatgccaggagacagggacaagtctttccagacaaggggcacctgcatttcactctcacactcctttaatgaacaaagcgaattcctcccataagggaagcatgcgctgacccctgccctttgagaggcggggaggctgggaaaggcaacaagacaccagagagcaaaagcagtgcagcacgggggtgcacagccagccaggcactggagctgggcagggccgggtggagaagacctgcagttggttgagaaatcaggagtgtctcagtggagtgactagtgtgtggagcctacctggcatatttaggagctgaacttcaccactggggcagggactggctgggtgaataaaggccaggggagaccccagggtaagatggggaggctggtacaaccctaaagggtcccctgggctgagttaggtggtccagaccaggtacttgagtcaccaggagctgcagagctctctaaagaggtcatggtacctttgggaagatgacttcaggaccaaagcagtccaccaaacagagcagtcatgtcctctgcccctaaaaatgccataaaaatgacagaaaaaggtagaataagtgtataaccagcaagagataccatgaaagagacaaagaggctgcaggatttctcaggaggaggggtaggatcagacgggtggagaaaccaaagcgaaccacacacaaaaaacagcaggaaaagctactgcaaagatgaggccaaaccctgtgcccaacaggcaggcagagacggggcatgggcgcagtcctcagggcaactgaacaagtgggcacaggaagaactggcttctgaacaaaaggaagggccggaggctgcacggcgctgcagcagagtctgtgtattctggagtctgcctccatgggcctgaatttgttctataaaacggagatcgtgaggatgtcacttttcagcttcagccagtgcagtttttatcatgatgtcgtgatgcacactgcgtgggggaggggcagggggctactggtaacccaagagtgaagctgaacaggaaggcggagcagaaccagctgcagtgttctagtgttcaagagaacagtagggaaattatagttgacgataatttattgtctatttcaaaatagccagaagaaaagaattgtgctgctcccaacacaaagaaaagatgaatgtttgaggaggtggatatcccagttaccatgactggatcgttacacactgtatatgtgtatcaaaatatcatatggcctcagaatatgtacagctatgatatatcaattagaaatacaaaacaagagaatggaatggaaggagacatggaagggaggggccctctgctgtcttcaagaaagctgccaacctgggggtattcaggataaattcacaggttacaacctgagaagtaaaaagaaaaagaaaaaaaacataaggaataaaaattatcagagttcttggaaatttttaaaatacctgagatatgtctgagtagcagaatggccaaacactgaatcattcgtctagatgcctgggttgtggagttttaccagaagagagtgagacagaggaggaaagagattagaagaaaggaaatgctcacagatggaaagaagaatgtttccccgaattgaggaaagtcgtgcatttttagattaaaaagagtctattttgggacaaaagagattaagaaaaaaatgcaagcacttagatacattctaaataaagaacttcaaaagttaagaaactatccccaaatcttttatagcgtgacaccaccaaaaagagattcctagtatggaacaagcttcttactggtgacaaatttctaatagccacatcacaccttcagagaaaatgacttccaagatctgaaaatattttgagtctgtaattctatgcccagacaaactattattcaaatcgaggagcaaaataaccaattttcatgcataaaaaacctcagaaaatcaatttacagtctatgggctcttttgaaaaataacttgaatatacatctaaacaaaacagtagtaaacaaacaaaaatcatgagcccaataagaataaggaccatgggatgaagaagaatgacaagaaaagaaacagcagaatgttgtagttaattgtaaattgatttctaggtaaaatatataaaactaggaacatatttttatactaaaaagtaggatcttaacatggcagtggtgagaattgggcaggaaaggagcgaggagaaagtgaaagtatgctaaatgtctaattttctccagtagaaggaaaactatttattatgacttttagaaaaatgttaggctgaatatatgtgctaaaaaaatacgatggtttctgaccagctattgatcaattggatgtctacatcaaaaaaaaaaaaaaaaaaaaaaaaaaaaaaaaaaaaaggattttaagaactactttgtaccatactcaaaaaacaatttgttagacttgggatctaaatttcaaagttaaaaatatatatcttttagaattagcatggtaaaatatcttcataaactttgagtagacagagttaagggtaatcattacgatcatatatagagaatttaaagaggcacatttaaaacaaaatgatataaacagaagatatttcaatggaaaaatatatccaggaaaatatatgcatatgttttaaaatataaagcaggtgtgttaatattaatgtcacacaaggaagacttcaaggcaaagatcataaaacaccagtttagcagtaatgttttatttctttcattaaaaatagaaagttgaaaagtatcataagcattcaactcagtcagttagcagaacaaacattagtctgaacacacacatacgcacacaccccaaaacaaacagaacaaaatttagaaaaatggaagttgtgaaattaaaagcagaaattaataaaatatgaaaaataacagagaaagcccagaaagctaaaagaagcttatttgaaataattgatgaaatagatatcactctgtggaaagccgtgaatccaaatggggagagataacaaatacaacctgtaagaatgaaccctctcataggtactgtggactttcaaaatagaagagaatactgccttagagtctattttgtgcctatggatttaatatctatgatgaaatggaaattttatagaaaactataaaataccaaaatttactagaggaaaaacaaaatttcaggatagacctgtaactattttataaattgtagcattactcaaaaatcttttaattccctttctccccagcaccaaacaccaacaaggcaccgcaaaggggattttgagggtaaatttctcaaaaccctaaagggacaaataattccttttcaacacagagggaaataatatcagaaagcttttcaggcctttctagaagatgatgtccttgacaccaaaactggacaaggataatacaaaaaataaaatgctacattgatttctgttgtgaaagttgatgcaaacatggtaaaaatataataaattgaattcaggactatgtaaaatttatatacatgtgtatgaatatatataattatatatatgaatatataattatatatattagtatttattccaagtttattttatgcaatgagtttataacattaggaaaaatccattaatataattgatcatattaagaaattaagaagaaaaaatacttatcatcacaattgacaaaagaagcatttaataaaagatgtaactccatagtatttaaagtgactaattcaaccaaccaatgcataatatcaatatcttaatattttagcagattgggaatatgacataaggaccctgaatacaaaaaagtgtttgtaaccacccagatatcatgtcaatggtgaaactccaggtcagttgttttcaaaggcagaggcaagataaaagattttctctcaacactctcttgaagaaagagggtagggtggatggtttatgaatcccagagaggaggaaaccaatttgctattatttgcagattatatgaatgtttatatagagtaggtttacatagaaaaggaaagttcactgagatttctaggtacaagatctagcaacatgcacaaaccaatattgtttatgtataacagcttcaaacaattagaaattgtagtaaccattatgaaagtgatgaaaattgtattgcttagtattctaccaaaattattaagtaattttttttttttttttgagacggagtcttgcactgtcgcccaggctggagtgcagtggcgccatctcagctcactgcaagctctacctcccgggttcacgccattctcctgcctcagcctccagagtagctgggactacaggtgcccaccaccacgcccggctaattttttgtatttttagtagagacagggtttcaccgtgttagccaggatggtcttgatctcctgatcttgtgatccgcccgcctcgacctcccaaagtgctgggattacaggcgtgagccaccgcgcccagccttaagtaatttttaaagaaaataatgaacttccattgagaaacttagaggagaacttaaagaaattacagacatacactctgttttcccaatgttttaacgatgagaattctccccaagtggaaatatcaactcaattatatgtggttgagagatatgctgtacatacaccgtaggattctatagtgtatatggaataggatgtgttctcatttatttttatggctgcgagtagtccatggcatagtataaatacgatggtgtatattctatatacatcatggaatactctgcagccataaaaaggaatgagatcatgtcctttgcagggatatggatggagctggaggccattatccttagcaaactaatgcaagaacagaaaaccaaatgccaaatgttttcacttataagtggtagctaaataatgagaatacatggacacaaacaggggaacaacagacactgggccctacttgtggatggagggtcgggggagggagaggagcacaaaaataactattgggtgctaggcttactacctggatgacgaaagaatctgtacaacaaaccccatgacaggagttcacccatataacaaacctgcacatgtacccctgaacctaaaatacaagttaaagaataaaaaccaaaaaaacaaaattgtaacagaatttttcacatcagaggacaagttgattctagtatctgaacagactaaatgactagaaaaagccaggtcaaaattaaaaaaataagcataaaaaggaaggagatttgtcctactaaaataaatatttccttacaagtttcaggaaataaacagcatggtatcattgctggtgtggacaacggatccactgatgccgtcatcaaagacgcatcaaacacgcaaagcaacaccacacaccagaggcctgctattagcaactggctttccctatagaacaaaaagaaattattctggcaggaaaagctgctctgaaatgccatgaagtgataaatagccgttatttatcctgcgtgttggggccactgatgtgttttgctgcaggtgcattagatgcggacggaggggagtttgcctgatgcagttgaggaccttgcggggcgattgcacctgtttccttttgcagaagactgactctgagatgcatctggtccaggtgttcaggtgggaggttgtggatggatgtgcacgagggccttaggtgccaggagaatgaatgctgatgcttgcagttgtgcatcttgagaaggggccgtggccagctcacttttcgtgtttctgttctgaaaaaccagccttgagaaaatactttgcctctatgacatcagaccactgccgcagagcttggggattcttgaagcagagatgcaaaatatgtttcaaaatatccagagagggacctgctggagtgccctgctgctctggatggtgtcctttccgcaggctgagatctgtggcctgaagcaccttgtcctgagagaggagtggctcctctggctcccccggttctgtggcttaagtctgcggggtcccaagcgggtgcccatctcggagaggtcggcattgcatctttgcagatggaaggaagccccctggagtggcaagtcgggccgagcatctgggtggatgctttctctagggctctgggattggaaatggacccgtccaatgtcggtgctgtgtccccttgcccatctccccatcagcacctgtgttgtgcctgcctggctcccacctcctgctcccagtccacacctttcccttcctccctcccttcacaccttggctgttcccaaggctttcccacttgctccttccttatggtgaaattcacagttgtcatccttgctcagagttcctcagagccactagcccaggtccagtcactggtttcagccacctttgcagaaatcaggagacatgtctcactaacaactccgagaaagtcgaactcgtctgggcgtggtggctcacgcctgtaatcccagcactttgggaggccaaggcaggcggatcacctgaggtcgggagttcaagaccagcctggtcaacatggagaaaccccgtctctactaaaaatacaaaattagctgggtgtggtggcgcatgcctgtaatctcagctactcaggaggctgaggcaggagaattgcttgaacccgggaggcggaggttgtggtgagccaagattgtgccattgtactccagcctgggccacaagagcaaaactctgtctcaaaaaaaaaaagaaaagaaagaaaaaaaattgaactctcaatccctagatgtaaaatcaacctcgtgttcttgatttcaccagtaattcataaccacaactgttgtgtcttgaacacttactatgcttggcatacttataatttttatttcactttatcctcaaatttaagatgaagtttctcctactgactccattaaatgcatgccaggatcaaggattctagagctgtagggacttgtccaagtcacacgttgtggacagcaaagccagtgtgtgagtcagagcctgagcctggaagccagaaactctaggctgaggagtctctctgtcacccgtgcctgcccaggtggcaggatcctgcttgtgacctctcaccctgagctgcagaccttctgtttcgtgatccgcgtgcctggactatcactgccggtcatcacggcaggtgttccatgctgcccatgcctggccggcctcagtccctgccggggaggtcactgagtgtccattgcatcctgggggtacatggactccctgccatggtctttctcgtctgcctgttcttgagtcttctgagcttgtaggtggggggcgtgtggagtagagctgcaacagcagcctttgtagaatgctcactgcacaccaggcatggttctgggaggcccatttccatccatttgatgagtttgtttctgcaatagtgccaagcacagtagaaggcaaatactcagtggctcatgaagacatctagaagtatttctgttgcttccaaacacaaagtatcctctgagctatgcacagtggtgggtggtgccattcacggaccctgtgttctctctgagcagagcttcctctgtggaggaggtgataatggggtcacataaattccttcacaggtgacaagagccagcaaggctctccatgtgaagcccgtgaggacacgggatccctgaggccaaggccaagtctgatgtccctgaggccgggccgatggtgggcatgtgtgctgaataaataaagagtgctgctaagtgctaagatgagggcatgagaagggcttccccttagctagagtctgagggccagtgaggactcacaggtgacccctcctggcgatcaggccttgtgtcccatgccgctctcttccatagggtgacagcttcaacagcgtctccattccccctgggcctgtctcctgtgagcctcctggctcacagctcctggttggctccctaccccctcccaggcagcacagtccagctgtggacagtccagtacagtccagcgtcaccacatggacactgagggtggtgtccctggacccaatgtctgggcagtgataggatgcagaccacaccaagagaagcccggggtcccaccagctgaggggtggttaatgggggtccactccacagctgcagcctggagacccccacttgccagcctggtgctgtcagcagttctgggacaggtccactgtggatagacagggaaggagagagggctcaggtgccctctgcagagcattcagggtaagcgaggtcttgagggactggccaactttggagatgggataacgagggatggacgcttctcccagcaggggagcatggccgccatggccccttctttgctggaagggcctgatttactttggatttcacccttctgtgcatccaggaagggccgcgcccagtcttgggaactgaggggtcagagcagttatgcccagtgttcatggggacacagggcatggtcccacgtgggcaactgcaggcagaggctgatggtgtaatggcgtgtgtgggaggatgcacctctctctgtgttggggctcacatgtttccttggactccagcactgctgaggccacccggggaccatccagaaagatgaatagacactctcaggcccttgatggctctgttgtgtggcccaggtaacccatcctccctctgggctttcctccagtttggctgaggtgggggtggggctggacagaggggagctgctgggacttggggccatcagtgccaggccaaggggagcagcctcatgaagaaagcaccagaaagcaggagttgggcacataggcagcgtgtcccacctgcaggagaggcctagagaggtggtcagagctgggggccagcttgccgcactgacccaaggctcagctatcaggaatcaggagggaagcagtcctttccactcactggccacactttctgtaattccagctgtgaatggttggggcctgggcttagtctaggccaccaggaagaatatgacgtggtacctgagggcctgcctgcaggatgccttttggttcacgagaaaaaatgatggggtctaagccaatgagagcatgtacctatgtgttgtgagttgatgttccagccacagagctaggaaggagttggattaagtccctggagcaggaatggcttcctagaggaggccagtatagcagtgggagaacccagtggtacattttctcattgttaagggtgaagggtacatcggaggagagacctctccataaaaatatccatgcagcaaaaagtggtccaaagcacctgctctctgtttaggcaagcatacctgaaagaggtggcacagtcctctcagggcagtggagggatgggggctcccccagcaagaggatctggcaagatacacagctctggtgacccatgggcagctgctagggagccttctctccaccctgaaaatagcttctggctgctgggtgaactatggagagaaagcgttttattatttttcctagccctgtaatgcattgcttcactgtcagcttagcagggagaggagagcagccaggatcacattgacctcagctcccaggatgcaggatactaaatcaatcaaactagattaaaagctttggacatatcttgaactcagggttgggaggcaaccctttcttcttattccagctgcttcccgggaggatgcccagcatgcggggatctgcaagggctcagtgctttgaattatttaaagatggagcagggctgggatatgggaaagtatcctgacttagagctgcagtgcgttctgccacagagagccatggggatgccctgctgatggtgaagacaaagtgcaggcggaagacaaagtccaggcagacttggttgtcaccatagtggatttcccagtttaagagactctattctgcagccaaggggctgctgccttttgtatccacccctcctccccaaaccaagaccaagaaatactccttctacctggtctttgaggcagccctgcccctttagaggagacggaagattggtcagaagctgtgggttcaaatcccagccccactcctgaagctgggcaacaccgggaagctgattgaactctctgggatctccctccactgtgaatgatgttcattcttaccagctttatgggtccaagtcattccaggcactatcctgggctttatcctcccacttgtgaataaagcacattcattgagcgcctgctatcttacaggtttacatcaggaaaacaaaacagatgacatccatgggctctcaaggaaattgcaatataatgacaaatttctctcaactgtttggcttctctggaggaaatacgcaggatatgcagtaagaagtgagatgggatcgtcaggtaaggctgcctggaggaggtggcatggaagccaaggctgtagagcaagttgactaggcattgcacagggggaactgcatccttggtagagggaaaggaatgtgtaagccttgaggtaggcaccagctctctggttagaggaagagacggtaggccctctccagggcagcttgagcttagggaaggaagataagtatcatgacaagaggacggatgggcctagatctcacaggatttgtgggtcaggcttggattggcttattctagggctaatgcaaagccagggctgaggtttccggtggtgatgacctgcactgtgatgggaccttttggctgcttctggtgcaggcaattgtcagccttcacctttgccccatcagctttgccagaagtttggccaacttccctgaaaggccttttctaaccatctcagttaaattgcagtctgcatttcataatcataaagaggtcaattatctaagaagacagagcaatacttaatgtgcatgcacctaacaacaaagcatcataacacgtgaggccaaaaacgatagacccgtgaagagatgcatccactactgtagtaggagacttaaaatccctcagtcagcacaggacagatgtagcaggcagaaaatcagtaaggatgtggttgaactcaatggtaccatcaatcaagtggatataatcaataccaatagatgacttcatttaacaataacagagtacatatccttctcaagatcacatggaacattcaccaaaatggatgaaagtctcggccataaaacacatttaacacatttaaaagaatagaaatcatacagtgtgtgcctttaggccacagtgcaattaaactggaaatcaataacagaaagctggaaaattccaaagtacttgcagattaaacaacacacttgtaaataacacatgggtcaaagaagaaatctcaagaggaattttaaacatatttggaactgaataaaaatgaaaagataacatcacaatttgtgagatgcagcaaaagaaatatttagaggaaaatttatagctttgaatgtatacattagaaaagatgaaaaatctaaaatcaatcaccttagatgtatatattagattggatgtaatttccaaagcataggaaaataaataaaaattggaacaaaaataaataaaattgaaaatcagaaatggacaaaaccaaaagctggcttttgaaaagatcaacaaaattgataagcctctagccaagctaactaaaaaaagagagaacacaaattactttaatgagaaatgaaagagggaacatcactaccgatcttatgaacattaacaggatagtaaaggaaactatgaacaactgtatgcctccaaatttaataacatagattaaatggaccaattccttaaaagacacaatctggcaaaattcacgcaagaagaaatagacaatctgaaagccatctatctatcaacaaaattgaatcaataattaataaccttcaaaaagagaaagcactaggcccagatgggtttattggtgaaatctaccaaatatttaaggaaaacattacaccaaatatctacaattccttacagagaatagaagcagagggaattcttcctctcattctattaggtcagtcttaccttaatacccaaaccagacaaagatattttttaaaaaaagacaacagaccaatatctctcatgagtatagattcaaaactcctcaatcaaatattagcaaattgagtcatgaatagaaaaatacataaaaataattatatattgtgaccaaataagacttatattaggtatgcaaggctggttgaacatttgaaaatcaattaatataatcaatcataatggtaggccaaagaaggaaaatcaagtgatcacatgaaaaattgcagaagtacttgatattgtaaaactcaacacccattcattataaaaactcctagcaaacttagggcagagagtaatttcctcaaatggataaagaacatctgcaacatacctacagctaatatgatatttcataggtgagaaactggaagattttctgctaagacaagaaacaaggaaaagatgttccctcaccactgctttcaacattataccagaatttctagctattgtgataagacaataaaataaaataaaacgtatatggattggaaaggaagaaataaaactgtctttattcacaattgacataaacatctatgtagaaatccaaaagaatgcactgaaatacaaaccctgaaattaataagcaattatagcaaggttgttggttatacagttaatataaaatgtttgcgacttttctatttatcagcaaagaacaaatggaatatgaaataaaaacaaaacaccatttacattagccttccccaaatgaattacttatacatacatcaaacgaaatatgtacaaaatgtacatgagaaaaattataaaactgtgataaaataaagaaataactacatggggaactattcaatgtttattattaggaagacttgatattatcaagacatcagttcttctcaactcgatcttctcaatgcaatctcaatcaaaataccagcagcttattttgtaggtatcagcaaagtgattctcaggtttatttggagaggcaaaatacccagaggagccagctcaatattgaaaaagaacagagttggaggattgactctacccgacttcaagacttactattaagcatagtaatcaagacagtatggtactggtgaaagaacaggcaaataaaccaacagaacagggtagaaagcccagaaaaagacccaaataaatatagtcaactgatctttaagaaaggattaagggcaatacagtggacccaaaatagccttttcaacaaatggctctacaacacttggacatccacatgtaacaaaatgaatttagacacagactttacacccagcctaaaaattaactcaacatgtattatacatttacatttaggctaatatgatactaaatgttgagaaactataagtgtaaatataaaatgtaaaatgaaaatctagaaaaatcccagaagataagagaaaatccagatgaccttgggtgtggtgatgactttttagacacaacagaaaaaacatgatccatgaaaaaagtaattgatacgttggacttcattaaaattaaaaactctctctatgccctcttccttggtggactcaccctgagcttctgtcttagtccctggctcctggttgggccccatggccctgcctgagtccttgtgctgtgggaggctgcactctgccagggtgggggccgcacacccctctggctggcccctgcttctcatcctccccatccctggccaactgtagcttctggagacagcatggctgcctgcgcagtcatcagctacacagatcctcagctgaacactaggacttcacgcggcagtccagcttttccctactgctggctctctcctgattggcaatgcccgactgctggaccggaggtgctgggtcccaggcatgagttaaaccatgtgccctttgggttcctcagactgttccaggcaggggcatgggccttaccctcctccctgtctcccaagtctcctgcccccttgcctggcacacacaatgccaccctttcctgcccctgccctgccttgtctgcaccttctctgggttgcagcagcagagagacctgtgcacctgcccctccaggtatggggcctcccagctcaacatgtagccctttccttggaaacccaactaactggtgagtgcacgtcctcaactccccaggcaccctccctctggcctgcagacacaattgttcttgccacatcagatcccagcgggctccttggtgctcagtgctgcggctgccacggggctgtgcatgccctgcctggccctcctcttaggaagacaaagagaactgcaggcttgggagagccttttacatgactcggtgggttcttcctgtttcccttcacaactaaagccataggattgaatgtttctcaagaaaagagcgtaaatcagggtgtacaattgctgaattgcctgtttccaagtggaagggatagagccgtgggtgctaagagacgagaactttatcctagtcttacctccctggagtgacctcggcaagggaattagctcctaactgtggtttcctgagggtggaagcacagcgtggctcgttgttgctaagtgcttttcctgtggtaacgagtgtggtcattgtgatttattggcgtggctgagtgttggctctgactttgtcttccctgtgctagtcatctggggacagaggcccgtttggccactggggggtctttgtggagacggcccaccagcatcccgggacagaggctgctctggcccccctgaacgcgtgtttcccacgctgtcctgcaggtgggtaggtctgcggcttccacgcgctcccaagctccagcatggtctctggcacagagcagggccctgaagctttgggatcgttcagctattccatcctaatcctagaggcagcatgtcctggaggaaataaatcaggctcaggacaagagcctctgagctcaaagtcctgccctaccatttccaagcctctaccttgatcctgtttaatttaatttaatttaattaattaacttatttatttatttatttattttgtgacagagtctgactctgttgcccaggctggagtgcagtggtgtgatcttggctcactgcagcctctgcctcctgggctcaagcgatcctcccacctcagcctcgtgagtagctggcagtacgggtgcacaccaccacgcctggctttttgtatttttagtagagacagggtttcgccatgttggccaggctggtcttgaattcctgtcctcaagtgatccacccgcctcggcctcccaaagtgatgagatcacaggcatgagccactgtgcctgaccctcctttagttatgttttttaatgtataaaatcaggatgatcataattctgggtagagttgtaaccacacccaagtttggccactcaccactcaaaagccaaacatgggagactgggttgtgggaggaaaagcagttttgtttggaaagccagcaaacctgagaagatggtgaactagtattctagagaaacatcttcaattgttcaggctggctggaggatttttctggaagggagatgtggggaagaagagaggggtggtatcaagaggtgaccaaggaccacagagatctggtgccagcgaggggccgaggaggatgggaacttctttgtccttgcgtcaagatgcttctgtgaatcttaaacaaaacatagttagttgtttatagactttccctttacttagttttgaaaactacacgattgtggtttttgcattattatctcagtgctctaaaattatcctatcctatcctacgtgcaaaaatgagtaaagaccccttcaacaaaaattgagtgagtgctgtgagttcttttgctgtttcactgttgcagaatgactggatattacagatgtttgcaaaatgccttgaacatattagaagttccctaaaaagccgtccttattattgttgtttgtttggcactttctggctgagttttatttcaacaaatttctaatggcaaactatttttatgttcaaacactgaaagcacaatgtaacaaaacggcgatgttctatagactttggtgtgtacgtgcagcgactggagacaatagatatattttcttgcttttaaaaggagttgtgtgctttaattaagaaaaagagaaagttttctcttagcatattaattatctcgcttgtcatatcaggtatttgttccggatgacaggtcataattagtgcacagaacagactgaaactcccaacgagaagacaggtgtcttggggagctgggactgatggcgttctctggcgtttcaccaggcgcgggaagggcatgcctggaagcagggtctctttggggtcagatgtagggaagaaaaagcaattcatcactgcctctctgagggcccctaagatactgtgccttttccttaaccctccctgggacagttactctttcacacagctttgaggccatgcaacagataagaacggtagaaaaagtcagcactttggttccattcccagatctgccaatgacgatgccagtgaccttgggcaagttactcaggagctctgtgtctctcctgccacagtgcggtggattgaccgggatgggggcacagggtgccaggcacagtgtcggctgcacggtaggaacttcataatcataagcccagctttcttccccacttaccacattcaatcagagttagctattttattaattcacccacacaaagattcagaagtcccacactggatgccttttctgtgctgggcatcagggcagagccgtgaatgtaacctaccccctgccctggagagatctgtgtgcggacagacattggaggagtagggaaaatgctctggcccactgagctccgtcattttcctcctggcaggtattttccatgctgtctcatagatggatggggctgagcatctgacttgtggccaagagccatgagcaacggtggggttcaccgcttccagacctgcctcctacaaggcctttttatctccctgccccttttctttctccatttgccagctggatgcagagggcaaagtggagttccctgaggcccagggaggatgtgaagccaccagaacaaagaggcctgagtccctgagtgaccatgtggagcagagcactctcccagttcttgcccgctgtattagcttgttctcgcattctatagaggaatactcaaggctgggtaatttataaagaaaagaggtttaattggctcacagttctgcaggctgtacaggcatggctccagcatctgcccctggtagggcctttggaagcttccaatcatggtggaagatgaagggggagccagtgcatcacatggaaacagctgaagcaaaagagagggtggaggaggtcccagactcttttaaacaaccagatctcatgtgaactaactgagcaaggactcatcaccaagggttggtactaagccattcataagagatccacccccatgattcaggccctacctctaatactgggaatcacatttcaatgtgagatttggaggggacaaatatccaaaccatatccctagcttaggtgactggttgttgcatggagccgctgagatatgggagttgtgtattgcagccattacatgctctggtgggggccagccagtggggtgcctgggtgggcctggaagtgagatgccagcccctcctcctggtgcaagagcggctgagaaaagccctcatccttgcctccagtcgacatgcacagtgccatgtggtgagggcccagtgatgggatgaaggaaggagccagggagagcccattccccgagaaggctgggccttcctctttgctgttgtggacgctcgcatcagaaacccatacagtctttgagagtgggacactccatcttcttggtgcctgtgtcccctggattagcacaggcctgtcccaggtaggccctccatgtgctagagttgagcacagcagcttctggaaggtgggaaagaaactggtagagaccaaaatggtacaaaagttccttctttcccacacacaggactcactcccagcacctgagaagggaagtgggcgattacctgagtgagatgttcccatctcaacactgtcatcatttaaagactgttgtttgatcttatcatcacaactggtacattacagcacttataggcacttacattagacaaatgttaaatacattatcgagtttaaaatgttattatggtaatagggtgcctgatttcactgcagttcatctgaaaaggtttcagtgcttgagaatatttctatttcaaggttaattaatagataatcatgctgatttgcctcagagggatctccttcgcacacccgggccactgtgagtgtcaatttttattatctgtaaaccttgttgccgacacacccttcccctgggtcctcctgccccaacacattcaagcaaagcgactcagtgctcacaaggagttttgacaagacatgggttccaacacattttattctgttcacaatgtagaaaaaccactgcttcagaacacatgttttaaatattaaagtgctgaaggatacattcaaaaagtacaagaacacataacataatcatctcctcaaggtaatattagcactcaacggccaaaaattgcagcaaagagaaatggttgcatccttggagctacgtcatcctggttgcccaaggtctgttagagcaaaggtccctttctctgcagggcaggtctttcttctgaatcacagaatgttggttctgccattttgaccaatagattagtaaccagttaaacccagactgaaacaatgagctgctagagtttaatttttcctggtaggaattcaatgtagggcactcatcggagaaaaagtcaattaccctctggcatccgctgcttggttacagcagtcactgcctatccatggactaattcaaccagtaaaacatttaatgaccatctacttaaggcagatgcttgcacaaagatcaatcagacccagacccagacccaaacccagagctccatgcctggagccatcggaacctgcacaaagacggtgcggcttttggagggaatctcttctaatccccaaattgatgacctctggaagaatgtgagggaactccgcgatctctgctctgtaagaacatgggcctctgtgccttggttcctggctggtgcctgcctcagacttgctgcctgggttcccccgtgtccccactgctgcctctgcatctcactggcatttctcaagggcccaccctggcccaggcctcttctaggagctttccacgcactctctgattcctcctccccacagagtgctgctgggtgctgagtggatggatggaggttgctgtcacgaggaagtgaagcagcatatggaggaaatttgcagtaccgcacccctcctaggcatccccaggcctgtaacatcactttcctcctctcctctcttcctctccgcacccctcctaggtatccccaggcccataacatcactctcctcctctcctctcttcctctccgcacccctcctagacgtctccaggcccgtaacatcactctcctcctctcctctcttcctctccgcacccctcctaggtgtccccaggcccgtaacatccctctcctctcttcctctccgcaagcacactttacagcttcctttgcagaatgtcgggggagtcaattttagctgtgaggtgttgaaaggccttcctgaaagaggttgttggaggaggagaaggaggaggaggaagagggagacacctgaaaaggaaggggaggaggaggaggaggaggaggagagttggagcaccccaaaggatgggggtggggggcatttgcatggtagggatactccagaatcagcatgtgcaaaggctctcgagggggtgggggtaggtggagtggttcaggcaggaacattctggagtccttggtagatgggcatactgtggttgagggagtaggttggctggatgggtctctgcacagaatatgtagagcagctgcctgattctttgaggtttattattccgaggggcaaagaagcaattgcgtctctcttaccatgcgctgcctttgaacattgctgctgctttagcataacattagattaaatgtgctctttgtctgtctttaaaataaactccctgaaggattaggttgtgattttgttcccaagttaactctcatttatctgaaatcctgtctgtggtagctcagaaatctgggtccattccttcactgacatttcctgtttgtcagcctggcctagcgtaggggaagagttgttaatgcccatccatcccatccagtggccgtcagaataccagagcagggcttacgagcctgtgtcagggcctctgaaggatttagacacaccttgggctgtggcctggagcagtcaaagtgcagggcgggagccctccccacaatccttgcgttctctcaccccctaaatctgtgcccattggaggctggacacagtcctggtgcaggaggcacagtggtgaagatcagcaagccagtgaggtgcctgggtgggcctggaaattagatgccagcccctcttcctggtgcaagaggggctgaaaaaagcccccatccctgcatccggccagcctccaagagccacatcgcctgagctgtgcagcattgacatctttccagagttaacacagataccctgcccagtggggcgtgtgtgagaaacaacgttgagggaatgcacaccctggagcaagggacaggggtcactggaaaggcccctccacacattgcttccaccgcaggggcctccttgcgggcagaggctgcacgggatgcatctttgtccccagatcccacagataaggacgttggtgtctgccctaatggagagttttgctgctctgtgagaggcacacagagcttcaggccctgctcaggcttggtactggctgcggaagcagggggttcaggctgcaggattctcctgagcggcagatgtcctcgtgctttgctttctctcttagccactggggtcacaatgcaatgtaatcagtggtccacactgaccaacaacagggcttcctctgagcagctcctggacagagcaggtccttggtactggtctgaggctctgggtctgatggtcagatctacccccgtattgcaatctgggacacatatttccccaggaagctgtcgggagtgcagaccagcctgatgctgagggtgcagccctgaggttgctggggtctgctttagcccccgatcccatgacctgcacctctgccctgcccactgtccggctgcctctcagcttccaagggaggcctctgggaaccacccaggcttcctgtacggtactttcctttggagcctggatcagtcaggctgagcctggctgtgctgtagaaacaaacaaaccccactttaaagatttctcactcagttaagtccactgcgggtctgcagctccccaggcagctcccttccacttggtgactcagggatccaggaggcctctctgaggatcctcatcttgctgggagagaactctggacactcacctttctccactgccaccggcaactgggaagtctttccatgaagcccaggaaggagcgtaaaattggatgagatactgtagcaatctccatgcaacatccaagctcttccaggagagaaggacaggctgagaggctgggcagacccggactctattcctgccccagcaccctcaggagtgtgtgccgctgggtgggtccccttctgtgcagagcagcaattctcctgagccaaaaagatgtcaggatcaaagttcagctgttcctgaacttgccagcccctgctcacaaaggctgcagagccagaacagagacgaagaagctcctgatgcctgtgcctctgtttaggtggtgtgtgtgtggggtgtatgtgtgtggtgtgtacgtatgtgtgtgtggtgtgtgtgtggtttaggtggtgtgtttgggggggagtgtgtgtgtgtggtgtgtatgtatgtgtgtgctgtggtgtgtggtttaggtggtgtgtggggtgtgtgtgtgtgtggtgtgtacgtgtgtgtggggtgtgtgtgtggtgtgtatgtgtgtttatgtgtgtgtggtgtggtgtgtgtggtttaggtggtgcacgtgtgtgtgtgaggtgtgtgtgtggtgtgtgtgtgttgtgtgtgtgtggtgtgtatgtgtgtggtgtgtgtgtgtgtggtgtgtatgtatgtgtgtgtgtgtggtgtgtgtgtggtgtgtatgtatgtgtgtggtgtgttgtgtgtttatatgcctgtgttaaggttaccggaagtaatgcagcatatctctttagtttcaaattctagataaataacaaatactggttttctagtgtgtgctatggaatatttgaatgcatttatactaaaaatatgaggattgtttatgctgtacttttacttgctaactctgacaagtcgtgtgtgtgtacctgtgcacaacatttcagctaatcttcaaaacaactcgataaagtaggtactattgttctacccattttatagatgacgaaactaaggcacccagagatgaactcacccgggaccaacagcctagatctggtggagccagaaggcccctcacacagcctggccgcagaggctgagccctcagtgggcgccgggaccttctggcagaggctgagagtgttggggaatttcagatccatcctggagggagcctgactgggctttagtggggtggctgccggttggggttctgaagggacgggggacccttgctccacagccaggggcttctgttccacggggcttttccaaagcctccttggccctcctgcttcccttttccctcctccactccccacggtgtggccaagcgggtgaggaagctgagccacaggaattcagactttcccacggtgcccccttaggcggttcctgagtccggggtcccatctgtaaaaccctagcattccctctcctgggagggctcctttcgagaactgaatgctgtcataattgtgtttgtgcagccccgtacagaagcccagattttggcctctccatggcccacacacccccttttgccctaggagtgggccgcggtgacacctgccggctctcccttcacagaccctgccccatccatcctcagtcccatctaccccggccccagaggggtccctcgcccctcagcatcagctggacctcctccagcctccctccaaggcaccatttctggttcccacagtgggaccagggatctctttttccttctctcactggctctggtaacatctcactgagaccccagcgggagttgcagcttcctgatctggaatgatgtgtgtgtgtctgtcaccaggggggccgagctcagatgggcagggatcatgatggctgatgcgtcctggcggctcccagcaccctgcctgcttctgtgtgtgctgagtgttgactggcatgaatccttacggatggtttccatatgcaaatcatgcaaaaacccaacatccccagccccctgtcaaacccaactttcccctgaaatagctgcctctaattgcccttaacacacagcagtgtggctgaacgatgttccgtagctgtgggcattccgaaggaaaatgtgtccttatccccagttataaggggtgttgtgggccaaattacgtaccccaaaaagtcttgtccaaatgctaacccgcagcttctgtgaatatgaccttatttggacatggggtctttgcaggtgtgattaaattaagaatatggagatgagatcatccttaggatttaagttcaaatcctcaaatcagatgacaaatttaatttaatttaatttaatttatttattttgagatggagtcttgctctgtcaccaggctggagtgcagtggcacgatctcagctcactgcaacctccgcctcctgggttcaatcaattctcttgcctcagcctcctgagtggctgggactgcaggtgcagactaccacgcccggctaatttttgtatttttagtagagatgggtttcaccatgttggccaggctggtctcgatctcctgacctcatgatctgcccaccttggcctctcaaagtgctggaattacagtgtgagccaccgcacccagcgtggatgacaaatttttataagagaacagggaatactcaaacacacagaggagaagaccacgtgtccttgaagacagagattggagggatgtggccacaggccaaggatcacctggagccaggaggagctgggagaggcaggaaggatcctcctttgagcttttgaaagaagcgaggcctgtcaactccttgattccagacttctggcgtccagcactgtgagagattgaaccatgagtttgtggcaattagttgtggcatcgcctggaaactgataggaagaatacaaactcttcagagagagggaaaaagtgcatggcattagctgggttttcattgtctgctcatggactcagatttattgaacatctatttgtattagttccaagaaatagaaatactaagaatacaaagcccgtgctctgagaaatacatcaggagaaatttagtacatcaaagacagctactagctccagggacacaggtgccaggcagggcttcgatctgggtcttcactaatgcccttgtctacaggcaatcccaaggcacaagtcatctacccatgagcaaactgagccgcagagcattacacactggtggtaatttaaagaaagagtgtttatgcttaacccaagaggacctcttcagttaggtggtacttgacttaactcttttttattttttattttttttttcttttgagacggagtttcgctcttgttgcccaggctggagtgcaatggtgcgatctcggctcactgcaacctctgcctcccaggttcaagcgattctcctgcctcagcctcctgagtagctgggattacaggcatgtgccaccacacctggctaatgttttgtacttttagtagagacagggtttctccatgttggtcaggctggtctccaactcctgacctcaggtgatctgcccacctcagcctcccaaagtgctgggattacaggcgtgaaacaccgtgcctggccgacttaaatcttaacaaatggatggaaggcagccatacacaatgttggggacaggccacctggttctgggggcaggaggagcaggcagggggcctgggtgcaggtggtctgcgaggaggcagcatacagagtgttgtatgtgtcggggagctgagggggagaggccacagacatgggtacagaccaggagattcaggacagatgctgtgatgagatgggatttcttcctacagaagtcgggagagcctctgaagggttccaagtcgacagaaggactgggtttgagagagagcatgcctgaaggggagaatgcagggagaagggaggccaggaagaggctcttctccacgtgggatggtgagggccggtctagcagcacgaggtgagtgatggagggcagctctaggaggtcaggctgcgtgagggacacaggtggcccaatggatccccgagaagccacatcagctgtcaggagctttgtggacgaggtagaatgctttctgaatcctgagcactgtgcaggacatgggtcctttgtcaactaccatcgaagaataagtggtaattttcggagatgcaaaatgttgggtgcagaatgcgagtccccctcccctgcgggccgtgggctgcttggctgcggggtgagggtggtgggagtgagaacagtgctccctgttttgtgcacattgctactcactgtcgagttcagcatgagtgtggggaacagcccagccagggatttgtctcggggacacagaatgatggggtgcgcagggaagagggtgccgggccacaccctgttttctagcggacggtcgctgtggggtgatgactgcaggccccggtgcaaccttcccttttaaatcatctgaggcggcagaagcatcagctccacagccacgctgccctcttctgttctctccttagaggggagaaggattcatgtctgacttttgaacccgtgtcacctgctcccatttcgccttgccacagagtgcagcaccaggataggagtgataaagtggtggaaggtgccgctccgacttgggacctgccacatcccacatggattctttccctacagaaattcatcgccaggaaaaatgacctggtcaaagtaggatctgggcattcagggcaccttggacataatggtaccctaatattcatttgaatactgtgaaactgccaatattcaaccattgttatctgctaacatggcaatttctgcggccgagtctgtaccagccagtaaggcttgtgtctcatgttcacctcaaacaagctagaaaagagagaacataggaggttcaggcaagaaaagatgcctggtgtaagactatgcgtgtgtgtgcatgtgtgtgcatgcatgaatgtgtgtatgtatgtgtccatgcaagatcatgtgtgtgtgcatgcaacagtgtgtgtatgcatgtgtgcatgcatgagtgtgtgtgcatgcatgactgtgtgcatgcatgactgtgcatgcatgattgtgtgtgtgcatgcatggttgtgtgtacgtgtgtgcatgaatgtgtgtgtgttcatgcatgattgtgtgtatgcatgcatgattgtatgtgtgcatgcatggttgtgtgtgaatgcatgattgtgcatgtgcatgcatgattgtgtgtgtgcatgcatgattatgtgtgtgcatgcatgtgtgtgcatgcatggttgtgtgtatgtgtgtgcatgaatgtgtgtgcatgtgtgtgcatgcatgattgcatgcatgattatgtgtgtgcatgcatgactgtgtatgtgtgcatacatgattgtgtgcatgtgtgcatctgcatgtgaacagggcagggtgtgtaactttcccaagtccctttgagagggcaacacacacagctacactctcagggaatggaggaggcagcaagagggagctagtgtgaagccacttgccttggagcctggacggtgggtccagtatgagctgccctgggcacaggggagttggcttagcactaaagtcgggagctgccagcactggatttgccctagcatgggtcattttctgatgcactatgtacctgcatgttgtatctgctgtttccttgctaactcacccctgttgctaactcacctctctgggatatgagtgcaaggacatttttccatccaggccactgatgtagccccacacctagaacagcccccgaaggacgaaagctctctggaagtattcatggagtggccgatggaactaagggtgtgggcatttgagtgtagctgatttggggagtgctatttatatcacatgtgcttgacattcattctttgctatttttttctcatggaataaaacagtgtctggcacatagtaggtgctggggaaatcgttgttgattgaatacatgaaataataagaaggaatagatatcagattgttttgtttctaagattgagttgccatattaaaaaaataacaatacagggtgtacagttaactttgaattccagataaacacataactttttagtataaatatgtcccaagtaacatgtgggatgcactcatactggaaaattaatctgaaatttaaatttagctgacgatcctgtattttatctggcaattctactctaagaccatgtgaagtatataaattcattgttatttcaggaaagggagctgaaaagcttggacaacatgcctagaatcacagagccagcaagaggctggtccgctgactgatgcccctccccgtgcctcctgcctttaaaagggggcccagggacaggctcccgcacatccctacatttcccaggcaggagactcaggggcagagaggcgggaggctcgctcagaactcagcgccaggttaaagcagttctgggttggaccctgtgctcctgcccctgcccagtgggctggcattcttgccactaccctgaaccttcatatattctttgcccgatttattgaatctctgaggcgctattgcgggaaaacgccaccccacacctctgtctggtttcctggacgttgcctgaaggccagggttcctgctggccgtctgaccttttctcttgttctcttggcggcctttttacagaagatacctttacagccagctacctgggaatcgctgtgcacttttgggccacatctgctggggacaggctgcaagctgagcaaaacctgcttgtttgcttgagctgctccagataatctaatgaaagaaacagggctgattaatcccagatactctactggcgtttaatcccagtgaatgttagacaacaatctcattatgtgcttatgtcttcaacatgacaggcaaggaatgaaattaagccataaaatcaattatttctgcagaaattggcatataagacaaaacatcatcaggaggcgaaagcagtgatgattaggccttcatttcccccgtgctgattgtggagctggcaccacactcgcgatgctccccaaaccatcccgttgcaaggctgggtcctgggcacaaaatggggatttgagaaatgtccttcacagataacgctctcttcttgccacttcctctccctttctctctccttctctctccctctcttcctatctctgtgtctctgcctctctatctctttctgaatcctggtggacattgtgagctgttgcggctgcgtttggggagtcttatgacccacggtgggtctcctgtcctactgcgtggcatgccgggtcccaagggtttgcagagggactgaggagagcgtgactacataattgtacaataaaattgttatagacaccgaggagtagtgaaagtaaaacagaacaaaacattgactcagaagtcagaagacgggtgacaaagctgtgtcacctcccacctcttgagttcttggaaacttttctgccagaggctcagttttcatgtccgcacaaagtggagattgtgggaggtagtttttcaggcctggtgtgacattcctttagaacggatgctggggccgtgtgctgggcaaacctctacacagtaattaggtagccagtgagcacggctgcgagggcgtttgtcatcccaacagcccatattctcagaaataatcacccagaggagcctcggtacagagacggatagggcaggaaccaccagctcctgacctcaaacggaggtgtacagacattcatcagaggtggcagccagctcctgctgcctcatggtgcttccaaggttgaaaaaataaccttccaacacctcctgccctgacacagggttacttctggtagaggtggggagaggaatcgatggagtgagaagcatcctatgacctctatatgacctctattactgggattgttgacaagaaaaattctttaattttttacttctgtaattcacaagcaaatataagtatcgagaacaaggctatttgtagttgtggtttcaagaatccacgccagtgctgtgagtgacctgcgggtgggaagatctttgtgctgggtatgaaaccacaatgacgaccacaaaggaaagatggcatctactgatgttagaggcacttgcttttattctcattagcatttgcccaacaagaactattcaatccttttgacagaagaagcaactgaggctccagaaggcacagtgacttttccaagtcacacagctaaggatagaggcgccaggaagctggcccaggatgagagatggagagctgagattttttcctttcaggtaccactgcacacacccatgaggagagtacatctcacccatcaggcctgggagggtacgtacaaggcaggacgggcctgagagagttccccagcagcccctccctgttgcctagatctaggttatatcagtcctggacgagggcaaacaagaaggactttaacacaagacacccagatctgatgccccctgtttccttgccaggcaggcagctggtggtgaggaagggttgccggtcatccctgggaacttcacccaacagtcaggatggtcagggttggatcgtcttccctcacttaagccccgccaccttctttctcctgcgaggggctcggccccctgccccactggagctcccctatcgccacagtattgggaagttgccattgattaagattgtacggtttgtgcagatggacaaggagtcaccattgactgcaaaagcagatacagcagcagggcccttggtgtgctcttcttctaaacatatgacgccttcatcttccagccagcaccgggaaagccatcttttttccttgggtctggattgaggccaggctgccctgccctctcaatcctgcagagtgatggaagcatgtctgcagagggctgtgttccacctgcccctcacccaccaagagcctacagaaagctggcggtgactggggagcagtggaggatccaaagctcagcaagaagtccaggctggatgcctgcaaaggcagagtctccattgtccactcacaaccacggcctcacgcatgatgggccctgccacatgcctaccgaatccctgtcctcaaagggaagcactttggggtgcagggaaaaccaagtgaacacaaaccatctgcagaaggtaccagagcagcctgatgggaggacagagaaggcacaggcgggggctctgggacagcaaggggacggcccctggagagagctgcaccacaaggctaagggcagaaagtgcaggcacatgggggacagcatgatctatttatcgattcatttaaacatttattgagtgcctactgtttgttagggacggtgctatagccactggaggaagagaaatgaaggagtctattggggaaaaagaaaaagaattaaccgcacttaattatcctgcaatgatcattacagtgagagaaaggtttgcacaaaatgttctggtaatccaggggaggaagagattgaatccagggggaaagacaggatagtagataagagtctaggacctggactggaggggcacatttcaaatcccagctctgtcactcaatagctgtgtgatgctgtgtaacttgtgtaggctctctggcctctgcttcctcatctttaaaatagggataataaaaattatacctggtgtgcagtatggtgtctataggtaataacactgtatcctatacttgaaattggctaagagtaaatcttaagtgttctcacagaacaaaagaagaaaatggtaacaatgtacggtgatggctatgctaattagctaggtgatagtaatcatttcacaatgtatcaggcatcaagttatacactttattatttatttatttatgagacggaatctcgctctgtctcacctaggctggagtgcagtggcatgatctcggcttactgcagcctccatctcctgggttcaagcgattctcctgtctcagcctcccaagtagctgggactacaggtgtgtgccaccacacccagctaattttgtatttttagtagagatggggtttcaccatgttggccaggctggtctcaaactcctctccttaggtgatccatccgcctcggcttcccaaagtggtgggattacaggcatgagccaccgcacccagcctgtacactttaaatacgtacaattctaatagtcaattacaccccaataaagctgaaaataagaaataataatcatacctgcttcattaaggttattgtagtggggtgttggtgttaaccagctctcttgaaaaaaaaagatatgcatatacatctatataagcttattataaattttactataaaataatttcaatccaattcagaaataaagttgcccacatcattgactaatggctgtggttccaacaggaatgttggcagttggcaagattgcctcagtctcccaggtgatcccagcaggaggtgctcttagcagatttctgcattaaagtagacaattactgtggaagatgttaagctgtgcccatgattgcctcagcggtgtacatgacctctgacatgaccttccccagtcctgggcttccactgggttctgaattttctcggacttgagtaaattaaaccctctttctaaagcaatgggctcagcctttagggatgcatttctctcatcttgtttcctcctcttctctggtggaaatcttgtaacagttaatttgatctgcttcttaggctgattctgcctacctcaccaactgcagaaccaacactgagagctgaatcattaaacttttcccttcttttgggtccaagctcaagagttgagtttctctactgttcattcttcttccattatatggcccttgctggcacctcacggtgcctaacttgagaccatctgaacatttattaagtggttttcatttatgtatgtatttattttatttttttgagacagagtctggctctgtcacccaggctggagtgcagtggcatgctcttgactcactgcaacctctgcctcccaggttcaagcaattatcctgcctcagcctcccgagtcgctgggattacaagcgcctgccaccacgcccggctaatttttgtatttttatagacacggggtttcaccatgttggccaggctggtctcgaactcctgacctcaggtgatcctgcctgcctcagcttcccaaagtgctgggattacaggcatgagccaccacaccgggctgagtgtttttctttgttggacaacctgcacatgttttctcagcctcagataacctcaggggacatgggctgtctttagactgatttcacatagttaatattactcagtggtaatttaaatctttatttttcatgaaaacaaattctttatttttcatgaaaacaaatgcagatatgaaatggagtggaatgttcaggaatttaaggtaaataatatcattaagagctcccatgccctaagaggctcctttaggttgtgtggcttagatcatctcccccatattacacatttacttttcttctgatagaagtagttttaggaaaacatctgaagcagtgatagagaacaagcctagcagacagaactatggagcatgaaactgcagaggcagggagaaccaggttgccaaagaggcagagaagtatcctcaaatggcaccgaagatactcatcagggaaaggtagtgcctagtccacttctgttgctataatataataccacaaaacgggtaatttataaataagtttatgtagctcacagttctagaggctgggaagtccaagagcatggtgctggcatcttgcaaggaccttcctgctacagtatgacatggcatgaggctcacaatgtgagaaagcaagaggatgagtgtcagctcaagtctcttcctcttcttataaagccaccaggtccatgatggggacaccaccttgatgaccttatctaattctagttgcttcccaaaggccccacctctaatcaatgtatgatttagggattaattttctaacacatgaaatttgggggagacattcaagccataacagggagactcatgggagccctgggctggggtgtggcctggcttggtcagggctgagcttctggaaatggcagacaaggtcgcagacagtgttgacatgcaaagggctttgctgccccaccattcacagttctgctaccatgagcgtggggctgtttttgattatcaggtactctttatttatttattttttctgagacagagtctcgctctgttgcccaggctggagtgcagtggcacaatctcggctcactgcaagctccgcctccctcctgggttcacgccattctcctgcctcagcctcctgagtagctgggactacaggtgcctgccaccacgtccagctaatattttgtattttttagtagagacggggtttcaccgtgttagccagatggtctcgatctcctgacctggtgatctgcctgccttggcctcccaaagtgctgggattacaggtgtgagccactgcctcaggtactctttccttcagaaacaggctctcttttgttgcacacatttttctcatcacagagtaaagtaaatcaggaagctctcggaagaaaagagatgcccactgtagacaagctgagcagcatttagtcttcagagccaagagaataaactgttagtcaatgatttaattcaactgccttgaatcctaaacagtgttgatgaggttacattactattttggattcaggcagaaggggccatacatggaaattaagaggggaaaaccaatattgagtcaaaatgctaggctcacttaggaaacaattaaataatatctagagggaattgaatattaaagtcaaatgcattctaatgggctaagtggccttttgagcttgctctctcctcaaatcatatattcatatatttccaagtcttgcaagctctgaggcattcacactagggacagcgcatggtatttgcagaatattaagggcatgatgatgtttctcaatagttcacaaataattcaggagttgagctgcttaaatgggagctgtcgtgctgcaatgtggaatgcggtctctgtgtggtatgctggtctgcaggcttttgctgaatgcaatgccaaagcatcaaaatctagaacagggcaggagccttgccaggaactgcttcaaggcaggagcagactgaaactggaagaaggttgcagacacatcttttgaggtgcagaaagctggggacaggactggaggggcaaaagcatttcctagcaatccacaaagctggcagattggttgaaaatcaggaaaagagattcctatgatttggaaagttgatatctgggccccaaggcacaaggagagtcctggaatctcactggtgctcagatcacaggacatgctaaaggagaggtcctgatctcaccctcaaaatgttccagtcaaatgatgaactcaatctaaagcccaggcccaactcaactactgagtggatggattctccccacaccaactccccacaccatggtcgggcaggagcagggtatgctttcttctggagctaaacgttatttactttggtctacttttttttttttttaaacaaacagtctccagaataaaataaatttgacacgacacatgaagaagaaataagaaaaggagacccacggttatgaggaaaaatggccatgaaatgtctagagagggcctggatggtggcatcatctaataaataaggccctttaatatgcctatggcagctatgttaaaggacctcgtagagaggtagaaacaagctggaaatttcaccagatagatggaaactatagaaacatccaaatggaaatgacagaaatgaaaactgagatccagaatgaagattaattaaatggggtcaccagcagattgagcacagctggacattgcctggtgtggccccaggccattcttcacttgtcaattctccttggactcctgggatggttggagcgtgtcccgtacatggcaaatggataagcaacagaggacaatggacaacgcttgctgtctgatattgtctggccccatgtccctacccaaatctcatctcgaattgtaatcctcataattcccacgtgtcgagggagggaccgggtaggaggtgatttgatcatggggctggttttctgcatgctgttctcgtgatagtgagtgagttctcatgagatcagttggctttatgtttgaagttactccttcacatgcccttctctctcctgctgccttgtgaagaaggtgcttgcttccccttcgtcttctgccatgattgtaagtttcctgaggcctccctagccatgtgaaactgtgagtcaattaaacctctttcctttataaattgcccagtcttgggtatttctttatagaagcatgaaaatggactaatacattgtctcatagagtgttgagtatgtgtgggtcccctgtctcattctcacgtgtcatttccaaaacagatcatgagccgaaccaaacatgatggcatggtgaaatatactcctccccttcgagtaggaggaattacaaggttatgtagcaaatggcatgaattaaaatcctgttaaggagggattgaagaattagtgaagaattaggaatgataatctaggctaaaccccaaagaaggcaggccagtgaatgaacctgagtgttgtaagaccttgtgttgttcaggaggtggtaaaactactaatgtaaggttggtagtaatataccaattgtttctattataatatatattttagtcactaaaataataataaatagatatgtaacaaactaatagcaaagaaaatggaataataaaacatactgaaataaaattgtggggtggagggaggggggagggatagcattaggagatatacctaatgctaaatgaccagttaatgggtgcagcacacaaacatggcacatgtatacatatgtaacaaacctgcacgttgtgcacatgtaccctaaaacttaaagtatgataataataaaataaaaaagtagcaaaaaataaaataaaatgaaataaaataaaccaagaagagaaggaaaaaggaaaaagccaggaacagatagaaagcaaaagattagactatagatttaaaccaactacgtagtaattactaggttgaagcatatgaaattatctcttttttgtttaaaaaatctaatattgcagttccacatggttcaatctaatgcactaaatgaaaattaactacatactccaaataagaagcaaagatgatcacataggattcagaaatctcagataacaacaacagtagcaagtagcagaaattaaactgaaatggagcaaagaaaggtgaaggtaaaacgataccaaaagtacccccatgccatcactaactgaagaaaagcttccacagtttaactaatatcagacactgcggactgcaggtggtgagcgatgttagaggaagagaggcatttcataaccacccaaaggccaattcaacaggtagataaaacaattatcaataacagagcaatccacttcatataatatcaaagtatgtgaaccaaaaagttacagaactaagagacagactcatccacaagcgcagactctcaggggccgctgacccagcgttcctacttctggatctgtgctcaacagaagtgtgaatacatgcacagcagaaggagaaaagaagctttcattgtaaaagcctagaattcagaatgtacccaatgtccactaacagtagactggatacatgaactgtggcatattcatatcatacaatattatatacgatacaacaaaatatacagcaacacaaagaacaagatatggctaaacacaacaaacaaatggaccttacaaatacaaagttgtgtatgcaccatatcatttacggaaagttcaatggtattaaccctgagagagtcatgaggaaggcttatggaaggacagtaacatttaattttttatcatctgactcgacacatttccctttataaaaaaccagtgagctataaacttgatttgtacagcttacttcatttatgttctgattcaattaaaaagcctacaaagaagttccatcaggatttttgaataaccatatcagacaggtgatctgactgccagaagaaagtggatggcgtgaagttaaggtcttattcacatgagcccatcctggatttcagcttccatagcaagcatgctcttcaaaggaattaaatgcaaaccagcgaggatgttttacaataccaagggtggaaatccaacccaactccccttttgtaaaacaaagcagtcactgggatcgatcatacactcagcattcaggagtatctggaacccagaacgtcagcaccataggaatgccttctctccctcacccgtcatatctggaacccagaacgtcagcaccaccgtgatgccttctctccctcacccgttccaggtctcatcaacagacccaggtggtaacagcgctcccagctcctctcttctctcagtagggattactcttcctcacccgatgacatcaggcttatcaagacttgtctggcccatggaatgtggcagcactgactcccttggcctttgacaggagccttaggaggcactgactgggcctgcctcattctccatcgtcctggctcatgggtccttcagacagagactcttctttctgctagaatcccaggatgaggaagcacccggagcagcgaccctgcagctgatctgtaacataagaaacaaaggtttcctatctcaagccattgacacttggagattgtttgttaatgcaattaaaaattagcctgtttttggccagatgtggtggctcactcctgtaattttagcactccgggaggctgaggtgagcagatcacttgaggtcaggagttcaagacaagcctggccaacatggtgaaatcctgtctttactaaaaataccaaaattagccggaaatctcttgaacccaagaggcagagattgcagtgagctgagatcatgccactgcactccagcctgggcaacagagcaagactccatctcaaaaaaataaataaataaaaataaaatagtctgttctttttgcttaggattgtcttggctatatgggctcttttttgcttccatatgaaatttaaagtattctaattctgtgaagaatgtcaatggtagtttgatgggaatagcattgaatctataaattactttgcgcagtaggccattttcatgatattgattcttcccatccatgaggatggaatgtttttccatttgtttgtgtcctctcttatttccttgagcagtggtttgtagttccccttgaagaggtccttcacatctcttgtaagttggatgcctagatattttattccctttgtagcaattgcgaatgggagttcactcatgattatgctctctgtttgtctgttgttgatgtataggaatgtttgtgattttcgcacattggttttgtaccctgagactttcctgaagttgcagggaacaacacacaccagggcctatcggagggtggggagcaaggggagggagagcattagggcaaatatctaacgcatgtggggcttaaaacctcaatgacgggttcaaaggtgcagcaaaccaccatggcacatgtatacctatataaaactgcatgttctgcacatgtatcctggaacttaaagtaaaacttaaaaaaaattagcctgaacactgcatgttctcacttacagctgggagctggacagtgagaacacatggacataggaaggggaacaaaactcactggggcctgttggggaggggcttggtggggagaacatcagggaaaagagctaatgcatgctgggcttaatacctaggtgatgggttgacgggtgcagcaaaccaccatggcacacgtttacctgtgtaacaaaactgcagatcccgcatatgtatcctaggacttaaaaaataataataggccaggcgccgtggctcatgtctgtaattccagcactttgggaggccaaggcaggtggatcacaaggtcaggagatcaacaccatcctggctaacacggtgaaaccccgtctttactgaaaatacaaaaaaattagccaagcgtggtggcgggtgcctgtggtcccagttacttgggaggctgaggcaggagaatggtgtgaacccgggaggtggagcttgcagtgagccgagatcccgccactgcactccagcctgggcaacagagcaagactctgtctcaaaaaaataaaattaaattaaataaaattaaagaaaattagcctgaactgattgatacaacttgtaccacatacagagacatgaagcctggagactctgggattacatcctaataactctgcggcccggtgaaataggcctacctgccctgtaaagtttataccatcccgggtctgtaagggctcatgtgtccacttccagaacaaacctctggcaaggatggatttctgtaattactctgggttagtagtgtgacaatcttgaggtcagagggagcagtcttctctgtaaattcacagtttgaacaaagccttctgaaagagatcattgttttgctttgcatgtacaaacaataaatgtacactgtagttatcacatggagttatgtaacctatttggtggttatttattttgtgaaataccaaccaatgggacaagatccctgggcatggtcagggaaaagaacccagacatctcataacctaagggatttcaaacactcataacacttctcactgtgagttaggctggttctgaggagttttctcattccacgatgtgctgcatagcatgtggaccagccaactgatctttgcctgtagtatatacattttttgagacagggtctcgctctgttgcccaggttggagttgcagtggtgccatctcagctcactgcaacctccagctcctgggcttgagtgatcctcccacctcagcctctcaagtagctgggactataaatgcacacagccactcctggctctgtttttttgttttattttattttttagagacagggcttactatgttgctcagtctggtcttgaactcctgggctaaagctatcctcccacctcagctttccaaagtgctgggattacagtcatgagccaccgtgcccagcctggctatactattgacctcaggactgccaccatccatggctactgaagagttggataatttcgtctacaaaattgaatacatgtttgtccttgaacccagttgtctttattgtttatcaatgaatgctcccaggacaaaccctgctttccaaaactgaaatctgagattcactctacccctcttgctaccagagcccattgcattagttctctgttgctgcttttacaaattaccccaaatttagtggagcaaaacaacacaaatttattagcttatagctctacagtcagaggtctgatagagtctgaagcatcatcagggctgcctgcctctctggagacattgagggaagtctgtttccttgctgtttcccgtcttagaggctgtccacattccttggcttgcagcatccacctctatctccaaagccagcaagacaggttgaatctttttcaccgtgctttacggtgaccttgcttctgttgtcctttctctctcggactttctcctctgccactctcctcttttgagacccctggattatgttgcctccacctccagggaatccaggataatctgcctatttcagtcagttgattagcagccttaattcctgcaacctcgattcccgtttgccctgttatgaaaccgacccgtttgcagcttccaaggagtagggcgtcggcctcctttgggcgttattctgctgaacacaccaagtgaacaccaacacctgccgacccatcttcttaacatcctgggtcctgcaggggttcccactcacagctccagttccattctccaccctccctactttgagctgtatgtttagggaacctcatttccaggtctgcctgggtcatggctccttttagtctcagcagatcctggtttggataattaattagatggttactctatcctgctgcacgtgcctggccacttaatagttccccagccatggggagccgcctcacatctacggcctttctactgttctgcccttccaggagatctctgcattccaacccacatccatgtggaaatataacttatctttcaagggtaaactgctgtgtcccatcttttgtgaaattgtcctgttctgtggaggtttatctgatcatatctgctcttatgctgagcttgcatctcacatggctctgatacacagtgtcgagtacaatggaactgtgtttgttatttctcctctcctgacgccgaacttcttgaaggcagaggtagctcaggtctccaggcacaaatcaaagagccctgcatgagtcaaatctcagtaagcaatggatggagttgaactaacttggcgtccaccctcttttataaaaaatgaaaacccttagagagacccagtctcctccctccattgcacataaaaatcagttaagtccgggcgcagtggctcacgcctataatcccagcactttgggagactgaggcaggttgatcacgaggtcaggaattcgagaccagcttgaccaacgtggtgaaaccctgtccctactaaaaatacaaaattagccaggcgtggtggcatatgcctgtaatcccagctactcaggaggctgaggcaggagaattgcttgaatctggaaggtggcagttgcagtgagccaagatcgtgccactgcactccagcctgggagacagagcgagactctgtctcaaaataataataataataatgttactgtacagagatatcactaagtacttattagggtctttttaagttttattcattaaaaactataagctgttaagtttagaagaattatatatatcttaaaaatcactgttatgtcaacccaaaggaattgattgacctaggcaatgatcatcaatggatacattcattagatgaatgatgggtggagaatttgacaatggacaaattaaattgctaccacctatattccctgattgtccctcaggataggacaaccataaagtgtgtccccagtgtgaaaagtactctttagtatcatatttaaagtattcatatttaaagtactctttagtatcatatttaaagtattcatatttaaagtactctttagtatcatatttaaagtattcatatttaaagtactctttagtatcatatttaaagtattttaaagatgctaaagtatcatatttaaactattcttgctcaaaacattacatcttaaactactcaaggttctaccttccatttacaaaaacatggggaatagaagatgaactcaaatgacaccacaaggaacaaccagacaaatcatctacggctggaatgtacaggacaagtaatataatgttgggaaaaaagttaatgcacaaaacaaaagggggccagggacttctgagcaataaagagacttaagagactccacttgaatcaatgtgtctaccttgttggattctgattcaaactgaccgactggataaagatgttcatgagtgggcagagaggcatgactatgggctgggcatggggtacatgtaagaatttattgttcattgtgccagatgtaataatggcattttggttatagataaaaacttctattttttagagctatacactgaagtctttaggagtgaaatgatacaatatctgacattcatcaaaaacagatgcaaaatgttataaatgaatagatgaagcagttatgaaagataaaacctctctacctttaagcacgtttgaaattttgcacaaaccccttttttaaaaatagaaatcattgattgtatgtctaaaatgattaagttagtgaataaaatagttttctcccaactatgcagcaaatattttcaccagtaaatggggaagtcagacctgagaatcggggaaggctgtttgagctaactctgtcatgatacataatcacctagtgccgtccttattttacacttgacaggttatgtggccaagcagctttcgtgagttgctgtaaactctgtttctggtctttccaagcagcaggccagcttccctttcccctctaccctccacagtgcctcccacagtcttcttcacacaatagatattcagcacttacccttcgagtgaatgaggggatggatggctgggtctttgcacacttgcgataccatagcttatgaatgaatggatgaggctaataaaaaagaccatgttttgcactgaaattgcttcatggtccttctgggtccagagactctttatctatagacattgtgtctataaatccatatctaccaggccaggctcttgagtgaatgacttaccaacatcccactgctgccccaaggattctgaaagacgaagagaccattcaaaatcaaagggaagattatttccccactgagagctgcatacactgaaaggtagggagctgagggtgaaaaaactcactactactagatctggtgtagttcaagttcatgaatctcagcactgatctctcagcctgtttcttgcataaataaaacagaggcactggtttgcatgagaatctcataatgcgctatgaaatccatgccagagtcaggcatctaatttaagaattatttctcgattttgtgtctcacatcctgcttctgcctctttctgctgattggattcttcccttccctttccctaacaagcttgtctccccctctccctgcacctcctcctctgatctttccctcctgccttcacctcttcctctctccctaataaagtgaccctggcctggctagatatctgtgagttggcagagaggtcaagacaggtcatatgccaaatgccctctccaccagatctggggcaggtgggttgggtttagaaacacaaggaagagatgtgggctcagcttgggttgggtctccagaagtctgggtgctggcacaggctctgtgactgacaaggaacaaagcacaatctgttgtttctgagccttgtctccgcctgaggacctcatgctggtcaaccgtgtttctctctctttccaccgattctggagacaaggctcacagctgagtagagaggaagcagagcagtagcaagggtgctgctgatgctgctcagataccttgcctggttctgacaagcggtttccactccccacccagttctacacgtgtccctgcactggggaaggctctctctggggtcacggtgggtgggggacagcacagccagagtccctgtattccgaggacttgggttcttacgaagggagacggataataaacacattagataagtacatgaacaagtggatgtccagcacttactgcgctttgggaaagatgaagatgaagtaatgcctcagagaatgttcctgggggtagagaaggaggagatgctgagaaaagctccaagtctccgggagaaggtgacagctggccgtggcctcaacgaggagcggccgcatggagatccaggagaaaacgtcccaaacgaaagaacaagcggttggtgccctggatcaagagtgagtctgtgggctccagggccaaagatgtggccagcgtgggtgtgcattgtgggtgaggggagatacagaggaggatggagccagctggggtcaggcctggattcatgggctactatagcttttattctgagtgaggaggttttacgattaaggtgttgtgacctggagagccttatgctgcttccaaaactcccgggctggtgtagaaaagcagaagaggaatcaggtggctagagaggggctgtcctgccaatgtgggcacaggggatgctggcttggaggagggccacagctgtgaaggtggatagcggtgacgggctgtgccaaggttttgtacatgagctgcaaagaaaaacaccattcagagaccactgacttctggtctgaacatcaggtgctggtctatagttttccaaaacagagaaaactagaggagccacggatgtacaggataaagtcaacggctctgcttttccaggaaagactgtgacacatggaaaacatccaggtagaagtgtcgtggggtagctggatgcacaagagtctgaagctcaaagccagggctcgggctgcagatagaaacttgagagttctcagcacgtagacgttctctagagctgggactaggcaggtcacccaaggaggacacacagctagggacaaaggagggatgaaggaggggcttgaagtggtttccctggagctgagattgcagagaggagacggggcccacagaagagatgaggagggcttgttccagacaacatggtgcctctttatcaagcacagccatgaatcctggaattcatgtcagagggagccactgcagaacttggaaaagtggcaagaggaaggcgaactgtctggaaaccaaacccgagtgtcggaggaagagcagagtggaagggtgccttctgcccccaacccaacagaagcaagggatctggcctttcccatcccccaggttggcaatggaagccagccttggtggactcattcctgtcctagacccaagcggagtccctcctatagtaacaggtgaacccagacccgccaccaggtggatcagttgggagctttgccaaaagtaagtggcctgcggagactccttccctatcaggcctgagaccccccctccccaacctagagatgcaggcatagctgggacagtggcaagagggacagccaaaaggaatggtgaagcctgggaatcacctctgccctgcaagcctgagactcctctccccacacggacagtggggacccggggggtggtcccagtggggtggggagatcccaccacaatgactatccagccaaggaagcctgagactctcctccctcatggagagatgcggatgacctggtctgcagaagctcctcctgccctgaggtcgctcccacagggacccacggaagctcctccagcaccagatacaccaagcagctcaaacaatagcacaaagactctgaaaattaaactgtcattagaaccccagcccacaaaagtaggcaagagggaaactaaaagaatttgtggcttgcagatttacttttaaagattggataaagaaaactctttcaacagaaaagaaataaaaaatgaagaaatcatgaaacatcagaaaggaagaaaacaggagcatgggtaggtatcatgagcacactattcccttcctcctgaatggtctaaatcacacacgatgattgaaataaaaatcacgttaccatctgatactcaagacgatatttaaaactggtgagggcaaaggtgcctgaatggaagtaaggtgttcacacctcacatgaagacacactgatactcatagagaaaaaatgcaaagcaattggaaggctgggcttttcaacaaatggtgctggagcaattgttcatccttaggaaaattaaatgaaccccccaaactaaacttcacgccttatacaaaaatgaactggaaatgattcatgaacttaactgtaaatgagaaatctgtacaacttttagaagaaacaatttaaaaatattaggaatcttatgctaaaaaagaattcttcaacaacagcaaaacaatccatgaaagaaaaaatgtttaactgaacactttgggtcaaaatgatgattcttttttttttttttttttactctgaaaaaaagccatgtgaagaggataaaaagacaagttacaaacagggagaaaatatttgcaaatcacatatctgacaaaagattagtatctagagtttataaagaattcttaaaattcaacagtgaaaaaacaacctgattataaaatgggcaaaaggcatttggagacaatttcatgtagagtatgtacagatggcaagtaagcacatggaaaatgttgagcgtcattagccattggaaaaatagaaattaaaactacaatgggatatcgctgcatctctactaaagtggctgaaataaaaaaatagtgatgatcctaaatgctggcaaagatacagagaagccaaatcactcagacatcacgggtggaaatgcaatacagccactccggaaaacaaccgggcagtttcttacaaaacattcagttgcattcttgggtatttactctaggaaatcttatattcacatacaaacctcgacatgaatgttcatagaggctttatttgtaataaccacaaaccagaaacatcccacgtgccctcagtggttaaacaaagtgtacctaatgccatggaaaccacttagcaataagaaaggaattcttgtggtgatagactcgttctgtgtctagactgtcctggtgcatatgtgaacccagcatgtggcaaaaatgtgcagaactaaatacacacacacacacacacacacacgagcaagtagaactggaaatctgaataagatctatgggttgatcagtcaataccctggttgtgatgttgcactagttttgcaacatattttctttggtggaaactgggtaaagggtacacaggatctctctgtattatgttttacaactgcatgtaaatctgcaattcaataagaatttttaaaattttttttatttttgagacggagtctcgctctgttgcccaggctggagtgcagtggcgccatctcagctcactgcatcctctgtctcctgggttcaagtgattctcctgcctcagcctaccaagtagctgggattacaggcatgcaccaccatgcccagctaatttttctatttttagtggagatggggtttcaccatgttggccaggctggtctcgatcttctgacctcaggtgatccacccgcatcccaatgtgctcggattacagctgtgagccaccactcccgacccaagaatatttctaaaaatgaaaagagagaagagcggagatacaggactccagttgagtagagtgacacagaagaaacaagatgagaacaaatttacatgtagaaacactcatcaggtatgttctcagtgcttcctgtaactcgctgaaacttcacaggatcccatgagatgagaaatgctattttatttggcagaggatgaccctaaaatgtagagagattaaataatgttcccacagtcacacagttgataagccctgctttcatgggcagcacagcgtagttgtggaaggaaacattaaatagtccaccaagtgacgtgtaaatggtaagtgcaagacagtaagattcctgagggcaggaactcagtgcatttgttcgctgttgtatactgagcacttaagaaaaggcctggcatggggcaggtgccaggaaaagaagcaggagccagcaatctatggggaacaggctatcagttgaggagcggagtcaggcatgttttggcaaatgacatttaagcagacattggagtgatgagtagcagttggctagatcagatcctcattccaaacattccaatgggattctatctcccttggaatgaatccaaggtccttatcctacaaggcttctgggacctggctcctggccatctctctgccctcatctcctcctgccttcttctcttcctgtaggctcccttccttgaacatcccaagcccacgcccatctcaggacatgtgcaccagctgttcctgtagcctgaaatctcctccctcaaacacacaggactcaactcactcccacagctccctgctcaagtgtcgccttaagagaggccatccccacccacccacataaaatcatgtcccacctgtgtcgttccacttccctgaccctgccttattttccactgtgcttcttcccaccatctggaagatatgtttgctctctgcctcctgacgccgaaaaagttgtgtacacagggacatttctctttggtttgtctaatgctgcatcttcattccccagaagggggacaggggtgtgtgtgtgtgtgtaatggttgaagagaagtggaaactgggcatcagtgcatggatgtgcactgactctgtggctctgccactgcacggggaaatgtggttggtgaggtgaggcagtgaggagatgaacccatgccagtcacagtgtgaactgagagcccacatttcatgaaagcagggacctggggaaagagaaactacttcccatggccaagggagatgccaggatcagagtctttgtgaagacaaaatggaagtcttcctggagaaatcaaaacctaggcctgcgcctcccctgtgtgaatctgttgcccccttgtggctggggattacctaagccaaagaaattttcttctaggttcatgtgaccccgagattggctgggagaagtaaatgtagagcagagctagaagagaaaagccttaatcaaattattgcatattctcactgaagatgagctcataatcccaaattacaaaacatacgatgagtgagagaaaacagacagtgtgagcagccaggtttgatcaatctgaactagagtataaagaagtataattacacaaattaagggcataaaagtataaagtaggaaacagtaagtagaattgcaatagggccaaatagaacttctagaggtaaaaattacacacatacagaatctaaggcccttggtcatgttgaacagcagattagatatagctgaaaggaaagaattaataaggtgaaagataaaaccaaggaaattaaccaggatgcagcacagagagataaagcttttgcctgcaaatgtctttattttgtcctcactgttgaattatcgtttagatagctggaaagagacttgtatgtttactgttatcttcccttggcacattcaatatattatagactttattccattattgtatgaccttcatttacttatcatttacgaacatttgttgtaaacctacagtaattaggagagtatgatatcaatgcagggatagacgaatgggtaaatggaacaaggaaggagcccagaagtagatccacgtatacattggtataaaacagagtcagccttacaattcagtaggcaaagagtgagctattcgctagtgttgggacgtaggttttccatatgaaataaaaatacaatagagctataacccacatcacacatacactccaggttgattaaagaactgaacaactaaagcagaaccctaaacctttcaaaactcaatagaatatctgtgtggcctctggttagaaaataatatcttaaataagacacatgatgtgcatatgcgataaagaaaaattaaagtatcaaaacttgcatccagacatctaaatctcaaaaacataatatggatcaggaacatgaatttcaaagtatacataaaatacaacataagatataaatgacttttaaaatttaaaaacatgtggagcaacgaaatctgtaggttctggataaacatacatgtaagaatgttacacgcccacaaaattaacaatgctgaattcaggataccggttgctgcttctggaactggggcacagaggcaggttttgggctagaaacaagtgaatgaggtacttcaaccctaacccttaacgttttatttttaaaagaaagtcatccaaaccaaatacagcaaaatactgtgttttgagaaattcaagtggcaggtatgaaattattcatgattccctatatggctgcctgaaatattacacagaaataaaggaagaaaatgttaaatatgtacataagggtgctggaattattaactgcggatctgaaggtacctggaatcaccctggtgtgactattccttattgtttctctcctctagagagtctctaaatgagttgacctttttttttaattagtcaacttcaaggtgacaatctgttgctttcaaccaagcgagtgctgactgatggagaatcctgctgctgcatcctgcacaggcgctcctggcacagtaaatcaccgacctgatttctgggcaaaactcagcacattggactccttgtcttactggatcgtggacattctcaacaacccctgcgagccaggggatcacgcggaatctcagcagttctctgggatccactgctccttcctcactctcatccaaggggctttgccagcactgagcaagtgacacccaggtcgccgcatggccgctcctccccctccgctcctgcctctaatctcctcctgcggaacgggtgggagctctgggcacttacacttatttatggtcatgtactgctggaacttaatgatacataaatctcaaattatgaagtcacagctctccatattcctggctcaaaatgatcctcaggataaaattaccagggaagcaaacaggagggcaccgtctagtgttgaggattgctctggatagctgggggaaacaagtctttcccaggaagcacatgattcaaatgccagaggatttgctcattcttgaataaatgaatgaatgtgtgaaagaagacatctgcaaaaatacatgttcttattattcatgtttacagaagaaggaggctcagagacacaatgttgacagggccgaggcctggcactacagaattactgacggacagatcaatcacttctctctgaggatacagcctggggagcattaggatcagcttactcagggcacctcaccctttcttgctaccagctctagagtcttgtagatgatcttgagaatctccctagggtttcttgcccccacctaatttccctaaacccttcctcctcctgacttccttttcttctccatcaagtcctcagcctaggttcatttttcctctatagacgctggtttctccttgctctgacctcgtggcatttcctttgcctttccttcctcgtcctggctgagatccagctttgtgtccttcatcctttctcccctgcccctttctgcctccccagcttctcacggtggacagagacattccgagatcctttgctcggttttctctttcaggctggagtgcagcaggctgggcatggctgccttccttcctcacatccccatgctctggaaagccctcagaggacctgggtctcacctccacagtcccgtggctccctgcccctgcaggctggactcgcccctgggcttggaccacctccagccagactccagtggtgtgatagagagggctcaggatagggggttctgcgaactgactcatcacccccaagcaagtgataacctcactaaggctcagtcctaataatcctgctatattaacaacctctatacttttgaaactgacccctagtcccataaacagttttttgtttttgttttgataaacatagaaatggatgcttctggtcttaaagcttgaaacttgtatttgttttatgagttcctttttcaggaaagggcccccaggcctctcaaaagcatcaaagaactgaaactcactagatcatctcatccagacagtgagatgtcagacccttcattcaccctgattgcttccttacccctctgagctcctcttttcccatacattgttacatttcttccctgctatataaacccctaattttagctggtcattgagatggatttgagaatctcctgggctgcagcaccaataaagctttcttccttggtgatactctttgtctcagggactggctttctgtgcagtgagcagcaggacccagaaggaacccatgatgttttggtaacacctgttgtcgacttgtctctaaagtgtcatgtagtgagaccccgtctcagaaatacactagggactcagagtgttgccatgtcctcggtagcttttgggattagtcttcatttcattcacatattaaaggctgtggtttttgtgttattgccttgacagccagtgcctggttcccttccctgagtctttttcctgtctgggtttcctcttcctcacccttctgttgtagaactcacctttgcctttaccctgttaaagaaaaccagagctgggcagtagttaaaagcggcaaaatatattttactcacgacaattgcagcaggggaaagagactttggcatagaactggctcaagtccaaacatagcatgacaaccggggattcacagccagggaggagggtggggtcaggggatgggaagtcactgagaagacatcagggtgagggggagtctggctaaatggacctaataggattcttgctgaagacagaccaaggtgaccgacatcacctgggggatggtggagaacaggaatttggtcagatattggaggtgatcagttatggagctggggatttttggctaaaccgacttgacggagttttgctaaaactgagcgatgcaaagatgagcagagacaccctcaagggtggccgagtctagaagaggctcagaggagcctgacagcaggcagcccctttctctgttctagaattgagagccctttctctcctttgcaaccgacatgccacatctttgtgtcccagggccccaagggaccagcctgtggcctcgggctgtctgaggacctccccacccaggcttctgtgagttttctgtgacttcccttcctggcgtttctctcctcggcctcagcgctgcagcagacatggttcttgggtccagtcacattagtgatgaatgaccctctccagcctccactgcctggcgaggtggagcccatgatcaaagttgccctgaaggtggagccctgcagcggcagctgggcgaggcccggggcatgtgctcaggaactgcatcaggaggggcctcttctttctccccgccttctgtgccaccagctctgtccctctatggggcagccgactcacacccatagagtgggctaggcatgtctttgccagtgccatgagctccctgccccttctgcatgagactctgtggggtgcaggcagcagctcagtcatcctctctacagatgaagagaaacccgggatgccccatggccacacaccacaccagaggcccagcaggaaaaaactgggcctcctgattcctgcctttcttcattccatcacacgcaaactgctggagcgtggtgctcaggaagagccatcgggtccctgagctggtccatgtcactccaaagtgaggggctcctgcaaacatggcgtgtaaggagcgggtgtttaaaaaatgggcacttgcaatgaatttggggtcagctctacttgcagtcccagtcagaactatccctccctacctgccagccaccaccccacaccccaccacccaacagcccaccatacatactcctgagacagacattttaatatattttttctactctctaccttggctcctggtctctggacgctccagggctctcccagcatagcgccagggccttctttaattaggagcggcttctctgtggttctataaaggtccagcagcccaggggtttatataagatcaggaatggccatcagtgatgttgatttcaagaacattggggctactgtgagacagaccgaggagctcagcatcactggcatacacattggtcacaggcacatacaacaggccacaggtacacacaccaggctaccagcacacatgccaagacacaagcaggaatggtcaggaggggttgagccccaggacgagctggataggttcttcctttccccaaaagaacagataaaagtagcaggacttgtgctccaggatctgactctggtcaccgcaggcctttgctcctacctccagcctccaaggcaggggccagtcaccagcaaacccattattttcaagagcatgtgaatgcatcttccagcttcaaattcttaataatcatttagactatggaaggtgacattggtattcccattgtacagatgaggaagctgacagctcaggaaggccagtgattgacatgaatttacacagccctcctgtagggccaggtttcgggccctctcctgtctgttccagtgtcctcttttaattctctcctttgcagagaacctaccacaatccctgcccagggaaatccgctgccggccacattgaggcacccctggaggaggacggggaggcagggagaagcagagtctcagccccggccacactgctgtctgaggcacccctggaggagtacagggaggcagggagaagcagagtctcagtccccagtaccccaagtgaggaccagggtgtggagaccagcagctcccctgggatcaaaggcatgtcctattcctgggggccgtgcagagccctgacgacgtgcatgagtaaaggctcacagtgcctcatccgcctgaaggatgctctggggagacagcagctcatctccaagtgggtcagagcaagttctggagacttcctctctctcttttgctctcaaacaggcagcacataaattgagctcccggtgacctccaggagagagagatcaccagggagagaattgctggtgcacccgcgggttgctggcagtgagaagcacggagcgcggcagggagagggaccggcatgaggactccttggagcccttaagaaaggtgctgcttcctttacctttcaagttcataaagttttgttcttctaagttgtgagagaaaggaatttgtgatttatttgagaaggttttctgaaaaatctttttcacagttagccaagagctgacctgttgggaagatagatgaacagctcgagtcataaagattcctaagtgacgtttctgtgcaggttattttcaggggggtcattgccacggaattgcaactgcagacccgtacttggcacctggctctgttaggaaagaaaaacaggtgtggaagatccagcccaggggccatgtgcaatgaagattttcatttctcccggtccctgggagatagacacattcatctgacctctcaaactcataactggccccaacctcctgtgcaggagggacagggcataaggccaacgttagaagactaagcacagtcagcacagtcctcctctaccgaggctgggcagctaggatggaccccacatccctcagatctgtggttcagatccttggtcccccagatgctccccaagggccgggctccgagtctggtattttccttctgagatctgggcacaaccactcaggccagaagggtgctatgggacttacagggggtggggaggaagctaaggaattgaatctcacccgctttcttactgcacttatgttccacatctgaagatgggcgtgtgctgactacgttgccttgttcgtagtggattcatttgctctaaggtgtcactgattgtcattgattacttatgtaccataagacaggaaaaatgaaattgtcaacgtggatcaaagcaaatgacctaggcaaatctcaatcattttaggtttatttgccaaaattaaggacgcgcatccaagagacagatgtatgcctttctctgaagatgattttgagggctttaatatttaaaggggaaagggcaggatactgaaaaatacataatttcatgtgccgggagggtaggagaaacagccattcatgcctttgtctgcgtcaggcaatctgcatttttacataaggtaatgtagacaagagggcagaggaagcaatgaaatatgcatttgtctcaggtgagcagggggatgactctgagttctggcctgtgttcctgtgtctgggaagataagcgatcaatttacgttgcaggatgcacttcagcagaactgttttagggtgatgatcttgggggccaccaggaatttccttctgggcaaaatgtgagggaggtatgtagcttttcatctttgtagccgtctttttcaggagtaaagatgggagacaggtttgtgtggtccagttcccagctcgacttttccctttggctgagtgagttcggggtccccagatctattttcctttcacgcccaattaaatttatctatgcattgctctcccataacttggaattagtatattagtatatatcacatactttaaacctatatcacttttgtgggtacataaggaaaacagaagtggaataaatttggtaatgtatttgtgttcatttcttatcaatgtggtaacaaattgtcactaatttcgtgacttaacacaacacacatttattattaggttggtgcaaaagtaattgcagtttctgccattaaaagggcaacaaccacaattgtgtttgcaccaccatagtatcttgtggttctgtatgtcagacttctgacatgggcatcaccggatgacagtcttggtgtcacagggctgattccttctggaggctccaggggaaatccatttccttgccttcttcagcttctaggctgcctgtgttcctcggctgaaggatccttgcttccctttcaaagccaacagacacctaccatcttgaaatctctctgacctgaactcttctgcctcccttttctacttttaaagagcctttgattacaccggccccacctggatcatccaggccactctccctatgctaaggtcaactgaggagcaaccttaattccttctgcaaccttaatgcctccttgctgtgtaacagcattcacagcttctgggattaggtcatggacattttcaggggccattattctgcctaccaatcgtagtatccttaaaactttaaacaagtatttacaacccaacactctgaaacttttttgattaggaattgcctatatttctgtttttcacaatcatcctctgccctccagagcatctgggcagcattcatgaagggagtgccccacgtgaagatccaggatttatttcccagtcactgcacctgttctgcaagctttggcatgcatgcctagacaatgaccattacataaagaccactgtgtggttaacagacatggcaaggacatccagatttcagaggttttaaaatgtggaagaagatgtatcatggaattgatgaaatatggcattctttaatattacagacaatgagtatcagaaagcatttgatacttgatagcatttgatacttaatcagttgtaatatcagcttatacttaaaattatctgtaagtaatatatgtaagtaagctttatgatggacaggaaacataattttctttatggttcaaagctgtatctgaagttcctggaagaatatcaggaacaaagtaggtgttcaggaagtatgtgttgaatgaatgagacatattaattaagtgaatgggctaatggatgaaggaataaatgaatccattcagtgaaatctattattattttattcagataagagttattgagagccattaagtgtattaaattatagaatgctgcatgttgtctgtgtaaaggatgccctttgagagatagttatctcctcttcttgcctcccattcattcagcaggacagagtgacccagaagagcagagaggccagtggttcctagcccctcgcacacagcatgtgctcattgaaaactgtgagtgaatggagagtggatggagccatggacacttggacagatggatggatggttgcacagatggatggttggttgtcagcataaagaaatgcctgttaacggggcctctgatgcttttggttatcctccagtaggaaggattatggatgatccgttttacttgccttgaactctgggtggcttagcacacattcttggaaacaaagacccatggataccctcatgagatgacccagaaagtcaggactttccagagggagaaggctgaagaaacactgagccataaagctcagaagatcccaggctgcaaagccatcgactatctgaaggaggccggccccctttactgcaggcactgctggctctgagtgtgtctgtgcctgctggctgattccctgtgtgtcagacccgggacacatcacctcggggtgagaatgtgtaacatcttcgtgtgtgggtgtagcagctgcagtgggaacatgtctgaatgactttgcacagttctggatggcaaataaatgtttaaataggtgcatcctaggaggtacacttcagatcagctctcacagtctaagcatcacttcctcatgcaaagcactctctgctgggctttgacctcttgagctccttccctgttatgtaatagtatctaccaaccaaatgaaaactgggggtgccccctaaggctccagcctgtgaaggtggagagcctcctgcagagtcacatgtctgcaaccttgttaggttgtgactctggcgattccatgaggggtgagagttatggctggtaacttagtaatttgcatgcagggagaagcacccaagatctgttgattactcggcccattctttctgacccagtcaaagacgagcccttcctggaagaagccacgtgggccccggggagggaattgtgttagtaaatttaccggctcatcctcttccacatccatgactctgtgggcagagagaaaactcagagtcccaaaaaggtgccagcagatcaaagggaggtgtagacttaatttcaggataacatatttatacaacatcttttatttttagaatttcatattggggtctaaaacctcgaactccagtggaagaaaccacttgcatttccaagggggtgaccctcgaagttctttttccaggggaaagacatttaatttcatcttgtcttcccatatttgttcctgttagattacattaaacgagttatttttaatcattgttcataaatcacagcaagggtacgccctgaggcacaaaacatttgcataaaaatattaattgccactatctctcctttggggttcgtgggaaattaatgtgcaggcagccagtggcaggcacgagggcggatagaggacaggatgaaggaaatggcctccctcaggctttatgtcctcccctgagaagtctccatcagttcacaatgtgccactcagaacttcaggattctcctcagatgtctcctcctacatggagcctgcctggatttctcctgtgtcacctgtgcgccatgactgaacccctcttaggaaacttgaacatccttccgatttcacacatctgcggacgtgtccccacgtggactgggaggccgctgcctgtggttcctgccagagcacagagtgaccagcagaagaatgaggtggggctgccctctgtctcctgcacaggcttcccccacagtctgtgcttcctgaatacaggcgcacatgatgttctctctgaatttacccttttaattaaaaacaggagtcattagaccatgagctgagcccaagtccccgattccaaaacagaaagcagactgttgtgttctgcttctataaaccaccattgcagcctgcatctctcccactgcattgctcaccaagagcaaggcacgcattaggaagcatggcaacgtgtctacccaggccaggaattctgtaaaccagagccttaatctccaaagcaggcctcacagcaggaggtgagcagtgggcaagtgaagcttcatctgtgttcatggctgctcctctccccatcactcacattaccgccagagctccaccttctcttaggttagtggcggcattggattctcagaggagcgtggatcctattgtgaactgcacatgccagagatctaggctgcatgctctttatgagactctaatgcctgatgatccttcactgtctccaatcacccccagatgggaccagctagttgcaggaaaacaagctcagggctccctctgattctacatgatggtgacttgtataattatttcattacatattacaatataataataatagaaataaaatgcataataaatgtaatgtgcctgaatcatcccaaaaccaccccccctcaccctagtccaaggaaaaaaaaatggttggggactgctgctgcagaccatgtgtccactcaggagtgcagatccagaagagaagggaagggagaaggcaggtggggtttggacggctgtgctggtttatccactctccattgccccatgcccgtggtataaatacccctgctgtggctgaacttgggtgaccatcagggtatcattggccttgtcatcggctctcctgagctcctacacgtgggcttccatgcaccacccggatgagtactggcttcttgtttcttttagttttctttgcttatttatgtgtttttgcaagaggagaggcatagccctgaagtgacatctgttgtgctgcaatcgagattccagtgccaagttaaagacaacttccaaatataagggttgttacatatttagttcagggctagcacaacagcacggcagtttgacccacattacagaaacttttttgtatgtaagtgaaaggtattattgacagtaagtttataagtgactagaagggctttggctagagaagattcacagtattgccatgagatcttgtgaaggaaacagagagtgactgaatttggctgacatcatgaaggtctaaggcagcagataagctgccttcttctgcttccattttgttattttatttgtccattcatttattgattcatgggttgttgtgttcctaccatctaccagtcacggtattaaatctaccagtcatggtattaaatctaccagtcatggtattaaatgctgtgacttggaggtgaaaaccgaggcacaatgatcccttctgccattaagcttgtcatcctggagcttggtctcaccacccaggaacctcctacaatgaaattcccacatttagagcgcctgagttaatggtatgattgtgtgtgcatgtcagtgtggggggggggtaccatgacaactaatgaatcttagaatcactttactggctccatcataaattatcctaaactttctttgttcatattcatattacaaagttagactatgctgcctggcgttggaatctgataaaaatctgattttatgtcagcaaccagcaatcttccccggtggtagattgtccaagctggcctttggtttcttgtgcagtccagactgagaagaaagtcttggcatttctgagactgtagggggttgtttcagcccatctgagcatggtgcacaaaggcggaagcaggctggtcctcaaaggactactctgagaaggagaaagcaaaggctatgggctaaatgtcagggtcagaggaatggctccagccctgcagaaaaaattatgtgtctctagcaacaaccgaaaggaaacaggaaaggaaagaaaaatccctgaacacactccagtctcagagtgggacagggctgagctccactgggcagttccaggtgggggggtgggaacatgatcctgttcctggaaaagttccaacaagacagcaggctatagccagccagctgccttgggcacaacacagagcttcctaaagacctcaggaggtaggaaaatcctagatgctgagagactcactcaggagggggctgagtggacagaggtggatttgaaatctgagaccctggtatcattccaaggcctctggccctcagcctcaagaggaacagagcttactcttccctgataatgtatggacaggaagctgctaatcccctgttcagtgagccacccttctgcccatgggctgaggcagcaactttgtctctagatcaccaggcagggctcccttagatgaagactgaccacagcctgaagccatggccccaattgcgtgggctctgaatgatgttgttcctcagacagatattttaggtagactgagacagcaacttagtgtatttaaaagaaaacaggcttgaaaacggagggggctccgttcaagtcctggctaaaccttgccaactctctgaccttagagaaccaactactatttctgcatgtggacgtcttcattggtagcatagagatgccctgatctctcctgaagggctgaggcagaaatgggaggccaggtatgcctgtatctcaggcacttcacagacagttgaaattaacacatgcaggctagttggctgaatggaacacaaaactcaggccgttttctctggtcttttgatccaaacactttcatatctgaaatacccaaaggaaatgaatattttgcaagcataggagcaataggggggtcaggagttgcctttgaatgctctggaaaagcaaaagcttcctttcctctctttgcttggctgaggagcccagatcaaaggtccccactctccccacagtgctgttctctggggacatcattaccatggacccagccatttgttggtttcagtgcggtggtgtttacacagaacgactttactggctatccctcctcttgtcccaggaaatgtcttttgttttatcaggcagagcaacaaaatcatatgatgaaataatcatcaggataattaacccctttcatcaagagagctaagaacacacatttaaggaccacatattaatagcaataatatttagaactggaaaaaatgattttattgctgcagaaagacctgaggagtaggttggcccctctaattgatgctgagtgtgaatctgcgagttgggcagcacacaaacgttaattagtttgtgctcgggcacacaccagctccagtacactcaagtttcatcccaaattgctgctaccatttcccactttcttcctggtagacattattacatttgtgatgattcaaatagattttctgcaggcattaaatttttagtaaacagacccaaattaacagctatttatgacattttactctagggatcaaatcaaaagcactcatttcatatataaatatctcttcttctctgcttttaatgaacgggtatttttgttgctgctgttgttgttgaaggcaaaattagacacatgcctcacccctccaggctgcctaatcatacgtgctccgtccctccaattgagagaacgttattacctttaggagtgaagacagaagcatgttaattttccataattcagtgaaacaaagcatagatctgaaatctccctctgtggaactcctttctcatctacagtaatgggctgccttttaatgaaaacaattcagcctgttctaatgtcaccatcagggcaacacggacttcactggatcctgatttgggaagacggtcttttcattattcttggtgttgtgcaggcaataaaggaactcgagtgtctatgagtgaccttgctggtggcaacgttgtgtttagtgctaatgaggatggcttcacggtgcaaggatgaaagggctggtggaggggttttggcagccgcgagcatccgtccgcttcccgcactgatgggaggtgctcacagcttatttactgcgtgcaaagatgaaatactgtcatacctgggcaaagctaactgtctgttggcatagagaccaaattttggactccagtaaattttgcagaatcacagatgacaggtcaaactgtgttttttcccctttaatggggagaaattacaagttttcattcacatttcacgaatggacaggcaaatgggcaaggtgtcattgataccatgttgattgagaaatgtcttctagatgaagatggcaaatttaacacactcacttagctctttctcttctcaaaccctcattacaattacgacagaaggatttttcaaaaggcctaagcccacatgacaaagggaacagatgaagacgacacaattttgaaaacgggaaagaaaaggctcagtgaaagtgacttagtacacagtatcttggtttggggcctcatcaaggtgaggcttcaagtacaactagcttattcaaaaggtgaagagaactcccacagggatgcgggaaagtgagacggggaaaggaagtcaccaggaatgggcgcatcttcaagccagttaccaccaggggcaacttgaacccgacctgctggggagagtctggaagccagggtagaacacctaccttccttcattagtagggtgcaagaaaattctgagggaacctttcagaaactaacagtacaaagaaatggagaatagcagaggaataagaagaaggagaaggaggagaggaagaggaagaggaagaagaagaaggaagaaggaagaagaaggaagaagaaggaagaaggagaagaagaaggtctgtccaggacttcacatatcgtcatggttaagcttcaaaaggagagactatccatgtggaagggaggggaaaatagcaaagaaataatttaagaacatttcccagtactgaggtcataagtttccaaattgagttttctcttaacccccacttttcccaccaactactacatttatttttactctgttttgcaacaaagattattatctgtgacctgtctctcattcttttctaaactgacatcaatgaggcatccagtcaccagtaactttcatattgctagaccagcagtcagttctcaggtgccgtgtggtttgctctcacagcagagcttgtatgtgctgtttgcatggcttcccaacctcgccccctcttgctcattttgtcttctccttcccgcctcactgattgctctttctcagcctcctgttctggcacctcctattctctttgagctttaattgttggagtgccccaatattggatgttctgcatgaggtccaaactcaccgtctccatggctctcattcagggcaagatcttgaagcccatccctattttaaggactctatgtctgcagattagaactttcctcctaatcccagactaatctatctagctgtacttgtcacattctctggatgtctgtcatctcagactcaaaatgtacaaaattagatgcctcaccatccccccaaattccacttcacccacagccttcctcatctcagcaatgctacgtctactccttttagttgctcaagccgaacattttgcaatcatcttaagctcctctttttcttttttctttccacctccaatataacaggaaatcccactggctctgccttcaggatgtatttagaatgtaaccagttctctccttcactgctgctgctgtactgagagcatccactttgtctctcgtcggcactgctacgggtcttcccaacaggccttcctgcttctaccctcacacaggctgtccttaactccggagtgacagtaagactgtaaagctgtgttaactcattgtcactactctgctaagaggcctgcttgggtccctctataactcggaagaaaagtcagagcaccccatccccactcctagaagctgataagggcctcatgatctctctgtctcatcatctaccactctccctagctgtcagtctacccctgccactctaattccctgatgtttcttcaacattgccaggaacctgcttacctcagagcctgctgcggactgagttgtcttctccaaaatccatttgtggaggccctcatccccagtgggagagtatttggagatgaagcatttggaggtgattaagcttagatgagctcagagtggagcctcaggatggcatcgatgccctggtaaagagggacactgagacctggccctcccttgctctccaccgtgtgaggacacaatgagatggtggccacctacaagccaggaactgaaccctacggggccttgacactggccgttccagcctccagaatggctaggaataaatgtctgctctttaagtcactgggcggtggagctttgttatggcagcaccaggggctggttgagagcctttgcatggctcttgttccacctggaatgagatttctaactcttggctacctcacccccttacctcattgtttcatgttgcaaccacccacccactccccatgtctctggcattctcatttattttttctttgatttcatagaacacatcacaaagccatttgctcatgcatgatgtttattgtctattttctatctccctgctagagggtaagatgctcaagaacactgctctgtctgcctccctggacccagaaaatgcttggcgtgtggtagaacttagatatatttgtgttgaataaattaattgaaggggtttgcagactattcagtacaatcgattataaaaacccgaaccagccccatcattgctaaactttaatgaggcaagtaggatatcatttttagtgggaaaaatcaggttcattcaaagtgttggggaatccagtgctatcaaacttctcaacagcaaccttgaaagctaggagatagataatgccttcaaatttctagaggaaaatatctctcacgtagcattttcttttctttctttctttcttttttttttttgatggagtctcgctctgtcacccaggctggagtgtagtggtgggatctcggctcactgcaagctctgcctcccaggttcaccccattctcctgcctcagcctccagagtagctgggaccacaggcacccaccactacgcatggctaattttttgtatttttagtagagatgggatttcaccatgttagccaggatggtctcgatctcctgacctcgtgatccgccctcctcggcctcccaaagtgctgggattacaggcgtgagccaccgcacctggcctcacatagcattttctactcagcccaactttcattcacataggagggaagaataaaggcattttcttacatgcagactctaagcagatattactcatttgccttttttggggacagtcctgtagcatgtgattcaacaaaacacatccataaaccaagtagctccaagaaacagtgactacacccaggaaggaaaggaagaggctgtccaggatggtgatgatgaacatccaagaaagcaattatcagacaaagggacatacattgacaggggcgtgtgcatcggcaggggagttgcaggatataccagtcctaagcacattaaaatctcaaaaaaaaaaaaaatatatttcaacaagatgattatccctgaagaaaacaaagttcattaaaggagatgtaattatagtgcattaaacgttctagccaagagcactatttacataatgatgatgatataaatatgtaatcatcatccaccacaactatgttggggaaaggtgaagccagtgtgagtgtgtgaatgcctgtgagagaatgtgagtgaatgtgtgtgtgctagtgtgtcaagtgtgtgccattgtgtatgagtgtgtgtgaatgtgtgtgagagtgtgtgtatgggagtgtgcatgtgatgagccacatccataagctgaatcatcttcaaaagatgagacctaaacctaacaattcaagtaacaggatgaaagtatgtgacttgaaaatatggagttaaatatcaaaaaaaggtccttgcatctgggaagcaagaatcaaaggtggatgagaaggggcacaaactgctgttttaaattttaagcactgtagcatccttgtttttaaacaaccatttacatgtatacgtgtgtgtgtgtgtgtgtgtgtgtgtgtgtgtgtgtgtgtgtatcttagacaaaattaagactttttttctgctttgtttccccccccccagcttttctcaagagatccacaatccggagggaagacccacaggcttcccagcattcacacagcatcattccctttgcctccagtccctcctgatagtgcatgaccccactggccgtccggatggataggcctgggactctgttattccaaacccacccaacctcacacatcctttccctacatctctgcatgtctcattctttcttgtctttcaaattcagggcacacctccgtctgctccctcatagaaaggccatctctctctctgtctcttaacctctctctctctctcaacctctctctctctttctctctctgtcttccttaaactgttattgtgcttgctccatgtcttctatggtctttgccattttctaattgcagttataaccatttgtggctgtgtcttattcactcctcgttaagttcttcaaagtcagtttgaaattctagaatatactacatggaggaacactattctattagtactttttaagacccactcttttttaatgtctcttttttaaaacttttattctcattataatatatccttatctctgttttgtttgggattattcttctgtacctcttataactacttaactgggcacttagatcattagtgtataggctccttatttccagattgtaggtttgaagcttaaatttttctctcaaaactgctttttctagattatgttaatatttggtgtagtatttttatcatttactttgaaatgttttaatttccctgatgagttcttattgacttgtagctattattaatacacatattttaaaatgtgtgaatattgttacaaacttaaaatattaatgtgctttgaaaaatgatcctcgtgatagcatctcactgcgatttcccagacctagcacatggcctaccttggtctatgccccacatgagtttgttttctctaataagtgggtacattgatctggtaaatgaatcacactttaattgcatttttatatatatatatttttattatactttaagttctagggtacattatttcaacagttgatactttctttatttggtttgttgacaatcgagagaagaatgttaaaaactcacactttgattatatatatattaatttctccctgtagttttgaaattttttgctctatcaattttaggtgtgttttattaagtgcaaatgagcttagaaatgtgatatcattatcataagtaataacttcaatcattttgtataaattgttatccttgacaattattttgactcaatatagacatactttctgcatttttgtagagctatctcctcttctttttggttcctattgcctgctgtgttttttcccatctgttttgttaatagttatctaaagctgcataacagatatcctaaaattatgtggctttagaacaacctaccccttgttgtcctacagtttctttgggttaggaatctgggagtggcttagttgggtacctctggttagcagtgtcttacgaggctgaactgaaagtagtggatgtggctgtggtctcatctgaaggcatgactgaaggaggacttggttccaaactcactcacctggttgctgaaagaactcagcatcttacaagctgctcactagggacttctctcagatcattgacccatgggattcttttcagaacagcttataaaatggcatctggcttcaatcagatgaacactgaggaagcagagagtgagcaagctgggaacctaatctcagaagcagcatccctccaactttgctgtattctgtgcactaaaatcaagtctctaggaccagcccacaaacaaggagaggagagtgtgaagattgtggggaccattggaagtcccctgagatgttgcctacacacagtctcttcactctcaaactttccatctctgtatatttttggcaggtctcttatattcatatccaaactatgacatctgtctgttaaccttttctttttttttttttgagatagggtctcactctgccaccaaggctagagcacagtagtgcaatcatgagtcactgcagcctccacctcctgctcaagcaattctcccacctcagtctcacaaaatattgggattacaggcatgagccactgtgcccagcctctattaacttttgagttttatgatttttcatttattttcattactgaaaactttgaatttttaccttattctatatacaaatatataaaataatatttataaataacacac

SEQ ID NO: 740 - DNA, 2585 bp, Homo Sapiens
agctgacacagatggtgggaggtgctcgtgcctctcacggtgatcagaaacatcaccgttgcaggtgacgccacttcacttaacactgggtgtgggcggattcatccgctctgaaaattacgtctttggtggacatcagcgtggacttgggttgtcttttcactttcttgctaatgtccttggatgatccacaacttttccaaagcaggccaagctataaataaagggtggactgaccttgtcaactgttaaattggagccgtggtgcgttgcctagaacattgcggatgaccccgagcagcacagcagatcaacggctgagaaagagctcattcagctcatctaactaggatgctgtcctgccagagccctgggggttctcgtctcctggggcaaaagcagcatgcaacccttatgaacccatcttggaaggcattcggggagcccaagacaagaccattgggagcctcagggtcacttgtgggggtctctgtgctggacggctgtacctctcatgaaatggacaactgaccataagaaggaggttagcctttgtggcttgggcatccagcctttcagagatatgaaaccacacacgtcttcagagtgaacagctgctcaccccgatgtgctcaaggggtgcaggatgtggacacatcctactgaatgagccagacaacgtaactggatctgtccagaacaccacgatgggtgacattgccatctgcagcagtgctgtacttcctcccgccaatttgtaaagtgcagacaggatgctggatcaactggctgctgctgaggccagtgacctctagggcgtattcccacgttcctttgcagtagctgctcacctttgtaagcatgtgagttattcgtgctgtctgttgtgatcctaaggaatccaatggtcaggaccagaacttctgaagtacagcccagcattgccgtctggcatccccagaaagcagattttgagattggcatgatggccgttaagcagggcgttctctctggagcaatgtctagccggggtcggagtggggagagagagaggggggctgctgagaatatcacagagagatggcagcctttctgcagcataggcctaagtgcacactcacctggctatcactgagaggactctctgttcaacagggccactcagggcttcccctgcatggagatctgagtgtccagggaggggacgtggtgagcatttctctggtcaaagtgtgcaaagcaaaatctgccccattcctgccaaagtggttgacatggaggaaaggggagtgccagttctgtaggctgaggtggtggctgttagaactgctcctaggctagttggtgttctggaaggttcccctctatgtgagatgaaagagcatatctttaagagctgcaactttgaagctctaatatagaatgcttttggtggcaagcattacttcggaaagggcttgaagacccctgaagatccttggtggcctaggcagttcctttattgccagggctgtgcaggactaagcttcaacagcgccaccatgtgacaagaagcaattgcagtggtgcattgagggttttcttttgcactgagaactcaagtcccactttcacccttggacctggtaaatctttggggttcatggacaattctgaggaggagatacttaagagagtgatgttagaatttgatgttttggtttattgtatcagaaaataaaagaaattggatttatagctcagtttgtggttcatatcaatttaaatagctttgaaatgctgataggaccatcacggttttttggttgctgaaatcccataactaaagcaatgcctcaataagcttttaatccacagcccccatgcccaggtctataacaaagtttttatatgcctatggggaaaaacaattatgaggcaaacatttataaagttaaatttattacgtttctactcctattttttattctgctggtgtattgttatatattttcctacatatttaaacattttcttcctcttataaaatgttagtgattttaaatgatggtgtgtccggaattggttccttctggtgggttcagtcttgctgacttcaagaatgaagccacagatgctcacagtgagtgttacagctcttaaagatggtgtgtccaaagtttgttccctcagatgttcagatgtctccagagtttcttccttctggtgggttcgtggtcttgctgacttcaggagtgaagccgcagacctttgcagtgagtgttacagctcttaaaggtggtgcgtccagagttgtttcttcctcccagtgggattatggtctcgtgcagaccttgcattgagtgttacagctcttaaagggggcacggacctgaccatcctggctaaaatacagtgaaaccccatctccactaaaattacaaatattagcccggagtggtggcaggtgcccatagtcccagctactccggaggctgagacaggagaatagtgtgaacccgggacgcggagcttgtagtgaacagagattgcgtcactgcactccagcctgggcgacagagcgagactccatctcaaaaaacaag

SEQ ID NO: 741 - DNA, 2028 bp, Homo Sapiens
cactcaggaggctgagacaggaggatcgcttgagcctgggagttcaaggttatagtgagctatgatggcaccactgtactccagcctgggcaacagagcaagaccctgtctcaggaaaaaaaaaaaagcagactgtaggccagatatgagaatggacggtttctcaatttttacctctactgagcactgaatgaatgaatagagagtaggacgatgggactgttaatattttcagcatttccctctcattcttttcctctgggagatagtacatacaatggttaagacacaggctatagaatagactgacttgggttcaaattcagctccatgactgactttggagtgtgacctctctgaacctcagtatcttcagctataagacaggagtaattgctacctcactaggccaggtgtggtggctcacacctataatcccagtacttggggaggccgaggcagatggactgcttgagcccaagagttcaaaacaagcctgggcaacaaggcaaaaccctgtccctacaaaaaatacaaaaaaaaattatccaggcatggtggagtgtgactgtagtcccagctacttggggagctgaggtgagaggatcacttgggcctggaaagtcaaggctgcagtgagccctgttcaccattgcactccacccaaaaaaaaagaacaaccttgctgttatgcggattagacaagagacaccatatgatactgggcatatggcaatgctcagtgaatattggacagctaatacaatttgcagagtcactgaggaaaagtatagcttcagagagcttctgtgtccagatttcaacgattttctttcatcattatttcgtggggctcccaggaccatatgtggctcacaaaccacaggctaggatgtgtttaacgttaaaagcaagcagtgtgtttctctgaagtgtggctccaccatggtgttcggttacacccagaggaggaggctggtgggcagtcatagaagtgcatcttccagagcaggaagggatcaacagctcttcctggagacttccattctcctaccccagtttctgagcacagcatgaatctagaggagtttctcttctgcttttcctcctagttttgtttcctctatcccttttccttgctaaagtgtgttggatggtcaggaatgtgggcggagaagagggggagctggagacatctcatcctttcatccagcttgtgtaaaaatgcctcagaactccctcataccacatgcaccataaattataaggtcaagctttgtaagcctgcagccctcttggctttttgcatgttggttagaatgcctaaatagaaagcctctgttaatgttgattgcctcttgtctgttccaggttggcaaggcccccagtggccaaggcatgagcctggatgccctgcaaattgagtacgtgttagggatgggggccattctttatagtttgactctggagagctaggaccacctttcccagcctcaggggtgcacatcctcaggagctgcctacctccagatattgtaagtccatgcagaagaggaagggcccagctggggcacctcttggttgaggaatgagtatgtgacattttcatgtgggcacattttgatactactttaaaaatagaccaagcacagtggctcacacctgtaattccagcacttcgggacgctgagagaggtggatcacctgaggtcaggagttcgagatcagcctggccaacatggagaaaccccgcctctactaaaaatacaaaacattagctgggtgtggtggcacacacctgtaattccagctactcgggaggcagaagcaggagaatcgcttgaatccaggaggcggaggttgcagtaagccgagatcacgccactacactccagcttacactggacatgatgaggaggaggaggatgatggtggtgattatgatagaaatggtgatggtgatgatgacaatggtgatagtagggatggtcttgctctgtcgcaatcaataaatgaatgcataaacac

SEQ ID NO: 742 - DNA, 1571 bp, Homo Sapiens
aaaggaaactgaagaaggtcaatctagaatgatacttgctggatggattgaaaaagtgaagctttagcagcaagtagaaaaactgaagcatcagttgcagtaactcatccattgagtgaaaaggttcttcccatgtccctactctcagaaatgcattctgaaatttcgaagaaacaagacattacacaagtacatggcttcactaccaaggggaagggcaaaagaccatctttgatttaattccaggcttcagtgtctaattctgtggcaaagatagctcatgaattctttgttcctctgccaagcgcaacagggataagtagccttgctctgggaatatgagtttgatgattgggttgcatgaaccctggaagcctggaatattcatctattttcacattcttctgtccctcctgactgcagcactccccaaacctacatggaagagctaaaatcaattctggtaaatctcatcaacttctaggacactgtggtagatttccttcagtttaatctctagcattaactggaagaaacattttcttactcagtcactacatttgtcaagaaataatgctatggttgaacactgcacgaaatgatagagattaacagtagcacaatactagacatttcttttttgctattctacttaatgcctgatgtaacctcatgaggtggatgttgtactcctgactttagagataagaaaactgaacttttgggaggctaaataacttacttacagttacatagtcaagaaatggagatggcaagagttcaggcctaggtttgtctgattgcaaatactacatcctttctattgcttcactttgtttggctttaaagctgttaaatgagaatgaccataataccccagagaacttctgtgaggattaaatggatatgcaaaagctctcgacataatacctggctcaagacatctggggaggcattcaactgggacctgcaggattcgctttcaatgtggctcacccacatggccaggagtgcagaccaggaccagctgtttctctccacatgggtttcttcaaggacttcttgggcttcttcagagcatgccagctggatttcgtgagtaagcatcttaagagacaaaaaatggaggctgccagtttaataaagcctgtgccagaaactggtacagcatcacttcctccatactctttcagtcaagcagtcatagggcccagattcaaggagaaacgcataatccctaccttttgatagaaacaattttcacttgaaaactttgggggtatgttttaaaagtattacatctcccaaacctcctggcagtcaatgccagagccaggatttaactgcaggtttatttgatgacaaagcccattttacaaagactaaaacagacctgaagagaaatatagcaggtttaagtaatttcccatggggaaatgaaaactctgaatccaaagtccttaaattagctactacactatggttcacaagatgaaatgcactggtgcatggcagtgcatttttaaattgtgatgctttctatcaataaactctttgtaagtaaaagtaaa

SEQ ID NO: 743 - DNA, 11863 bp, Homo Sapiens
cactgggttagaggacatggggcagaagacctgagaaggaagagaggacagttctgtgccacactggtcatatttagaagacattttcatattccaaccattgttctgtgtgtgcattttatttctcacgactgtatatgtagttaacaatactattttttagggaggtgggggggtcagccccccgcctggccagccgccccgtccgggagggaggtgggggggtcagccccccgcccggccagccgccccgtctgggaggtgaggggcgcctctgcccggccgcccctactgggaagtgaggagcccctctgccaggccagccgccccgtccgggagggaggtgggggggtcagccccccgcccggccagccgccctgtccgggagggaggtgggggggtcagccctccgcccggccagccgccccgtctgggaggtgaggggcgcctctgcccggccgcccctactgggaagtgaggagcccctctgcccggccagccgccccgtccgggagggaggtgggggggtcggccccccgcccgaccagccgccccatccgggagggaggtgggggggtcagccccccgcccggccagccgccctgtccgggagggaggtgggggtgtcagccccacgcccggccagccgcctcgtccgggagggaggtgggggggtcagccccccgcccggccagccgccccgtccgggagggaggtggggggggtcagcccccctgcccggccagtggccccgtccgggaggtgaggggcgcctctgcccggctgcccctactgggaagtgaggagcccctctgcccggccagccgcccgtccgggagggagagtggggggtcagcccccccccgcccggccagccgccctgtccgggaggtgaggggcgcctctgcccagccaccacccggtctgggaggtgtgcccaacagctcattgagaacgggccaggatgacaatggcggccttgtggaatagaaaggcgggaaaggcggggaaaagattgagaaatcggatggttgccgtgtctgtgtagaaagaagtagacatgggagacttttcattttgttctgcactaagaaaaattcctctgtcttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcgccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaaaaaaaaacaatactattttttgaactatctaccctttctagatgttctgaaatgcctatgttaaaattagagatagtaaaataacacattttgtaaatctttttgttaaaattcatatgtaatgttgttttggttggggggggtggccaaaccacctgttaataatacacattgtgtttgtgcactggttcaggggaggagagaggaaaggaagtgtaagagctctatgccaatgtgcttatagtgaggcaaggttaaccattgtctcatgcctgggcattttgttttacttatctgggtatattgtggatctaaaggacaaatgagtcctgactttacatctagtctttctagatgttaaagaggttgctagtgtatgacaaaagtagttagtaaactaatatattttgtacatttcgttttaagattcccaggaaagacagtcttctgaaaatttgagcattattgcccagtgggttgatggagatgggaaggtgtaggccagaatgttcatacttggaagactcagtcataactgtttttacatgtgttcactttattcaagacttctgtgcatatagtggacgaattaacttcttacctgaaacatcttatctatgtagatgttcagaattgcctgatgtatgttaagtgtagaggtagtaaaatatcaccttgtaaatatctttttgctaaaattcttgggaagtactgtcttttggaagtggaattgtgaagccacctctgtaagcagtatagtactgtctatacttgttcaatggtttagaaatgggagggaagaaattgccaaaggtaatatgctagtgtgttcatacttggacatttcacttgccatttttctgtctgttttgtgcattttgttttgctgtgtatgtagagtacataatggacaaatgagtcctaattttgcaacatttggtctctagatgtttaagaagttgccagtgtatgacaaagtatctagtaaaattagcacattttgcacactttgtattgaaattcataggaaagcttgtcttctgtaaatgatttttgggtatgaatttgttcagccatctctaagcgttacacatgcctgtacctgtccactggattgaagacagagagaagggagtgaggaaggactggttcaaggtcaaaattgtcatatttagaagatacctccgattatagccactgatacatgtgcaattttattttacagtgctatgtacacagtggaaagttatatgaaatatctggtctctctagatagttagaaatgcttgatgtatttaaaagtagaaatagtataataacactttttgtaaatagcttttaaaaactgatgggaaatactgtgtttgcaagtgggattgttaaatcacctctgtgaacagtgttacttgttcattcagttgaggaaggtgagagggaagaaattacaaaagatgttttgctattgtgtactagaaaatttcagtttatccattgccttatatgttaaatgcattgcaagtaactttgctatactacatattgtgttatatactggaaaaatgagtcctaattttaaaatatccactctctagatactaaagaggttgccaatgtatgacaaaaatagtaaagtaacacattttgtacactttgtgttaacgtttataaaaagactatcttctgaaaacgacttttggaagtgaaatgataacatcaaccctaagtgacacatgggcccatatccaccaggttggtggtgcagaggagctggaagaaatgaaggattctagatcagaatattcctatttagaagacagtttaagataaaccatgtgtgtagtttattcaaccctactgatgcaagagaatagggtctggaggcaggaaacataaagcagattcatgcagacttcctagaaataaatgaaatggaaacacatcagctatgacaggacatatactctccaacagagtaaatgactttgtaactttatttcatcctctccatttacatagggcgtacatcaagtaaatgactagggtgtatactaagtaaatgactttgtaactttatttcatcctcttcatttacataaggcatataccaagtaaccaatggaaaccttgagagggtatttaaacccgagaaaattctgtaactgggctcttgagcccctaagcacaggccttctcccaccctgtggagcgtactttcatttcataaatctctgcttttgttgtttcattctttccttgctttgtgtgttttgtccaattcttggttcaatatgcccagaacctggacaccctccactggtaacatattttggcaaggcagccaggaggtaagcccaaagtttgggatttttcatcttttcttttccactccatacaggggaatctctccctctgtctctttttcctttccaactcgggacccttggtgggcagcgcctaaacacggaggcaaccgcaggtttctgggtggggccatcctgaaggacttttttctatcttttctggttgtggtccctgattcctatgtgtggcgcagctcagggcaaacttgcagctcagggtgaacttgcatgtgtttcaggcgacggaaaccctacttgactggctaaggacaaaagaagcctactcagcttccatttcctatcattacagttcatggctatcatgctagtggaacaggaagcatgggataatgtggccttatcaaattataaggatgctaaacgccagtgattacacccaggaaccaaaggacagctcacaattgcctctggagggaaaatatgcaaagcggcactggtgcccacgtaaggtcagagatgcctgacactcttaagactggaccccaaagggggattccccaggggatcctccagacttcaacctctccaaaggggatgcccttggcagcagttctaaggactagtactaagccctccttagaattttctcttgcagttgcaatactgtttggccccaatatggtttggattctggcatttgctgttgaatgggaaagcgggatgcagttgcatgtatccaggctttggtgctgctgttctaagcaggggcaggcctagttattatgtgatgttctcctttggtgctgtttgaccccagtgttctttcgagtctggggaggtttggcctttaaaaatcaaactgccatggaaattgctttacctgaaataatagttcacagccttcattggattgcttattgggtacacaaagtaaaattggcaagcttgtattgctatctcatggttagggttccaaggtaaaagctattgaatcttcatttgtgtgtgtgtatacacatgtctagatgtgtttatttgcacatttgttatatgttgtgttttggcatataagtaaaagagcactcataaattaagtaaataagtcgaagcaattttcaagttcacatgacttaagtataactttcctaaacaggctagttttaaaattattggtgaagtaaaaatagaaatgccttcagaattgtcagcatatatttttgtctgggttttatatttgtctctgctagatattttgaggtgttagggtttggcatagaaggttataaaactataaacccagccaaaacaaaacgatctcgtttgcgtttttttttttttttttttttttttttttgacaaatgagcataatttaatgttagctaaatcttctgggttactggcaaaaatacgtatgtattaactttgaggctcttacttaggtttaagtgcacacctggctattcaaaatgtggttaacagggaaataactgactttaaaagatagtgtctaacatttcggtttacagaggtaatctagataaactgttaaaagtgaaacaattgagtacagtgaatgggacaaatgttttagataagctttttgtgtaaagtcttaaaatcatttttgatgctcatttaagatctgggccatttccaattagaaaggttgtgatatggggaaatatgtttctaaaattgtggaattgttcttaactataaattcccatatctgatagttcaggatttctagctttttagcgtttcactaaagttttaggttactaaggataagaattctagttaacacataattctgtatacaaaacatgccagaaagtttgtgttattagtgagaaaaagaataatttagaagttatctaaaagttagttcaaattacagatttgaaaaggttacttatgaaacaatgtagtaaggaaccagtaagtagaggagaacgatatggaaaaagtttagataataaaatattctttaaaacctgatagagaattggagatatttggctaattaacattttcatagtgaaagctgttagtcttgataaaagtaaaataagcattgtaaagaaatgcatcggcagtttggcaattcctttttactatagttaagcatgaagccggatttggtgtggagccaaatttcacatacatgcttgcattgcttcacactgtttactgttttgtgtggatagtgctggcactggagtacttattggttatgtgcctatagtgtatttcttgattgcacaggatgtatggtgatattggtgaacttaaggatactgaattgtgtatcaggaacaaaatattcattatgtgggttttggggggccctaggtaaacactgtagcctccagggtagattgagaaggaaaaatttagggttgggttcctatttgtttttgcttctaattttcatttgtttgccatttattctcctctggctttgcttgtgtatgcacatataaaatcatatatattttttttaaatttctagtggaaggcttttatttggttctgtgaatagttattttgttccctatgcatttctagcaagtcatcatttgttccatttatctggaattcctaggctacctttgtcaggctggcaggaattgatggagcacaccagctttttaaccttgaactaactcaaattctgtttatgatactttaagtgtgttgagtatattttcataaacagaatttgagtcatatttctctgtctgcccattttctccaaaattcgtaaactatttgtgaatattcttaattcatggcaatgtgtttgtttgcatatagtcaagcagggttcctagggctgctttgggagacagaacccagaaacctggcatactggcaaaagggtaagaatttcttaccagccagactctggtctctgtctctctgtgcaaactgcataaatgaatagtaaaagtcactgtttatctcctctgtaaagttttgattaatataaaaaaagaattctgaggccgatcttaagctgtagtgaatctggtgtgctttgtgtctttctgtattgttttgtcataaagaggggtaccttagaataaaatgtgtgcttaggaccccatagacctgctgttcaagacacaccagcagactggtcagtcatgtctttgggagcttgaccttgtaaccatgtggccatgctttctcttttcacagtggcagcctgggtttagggttcaattcctggcttagggaatgagtcctttatcttctgtctgtgtatttatatgtgttgtgtgtgtactataaaagagcattaattaattagcttaataataataagagcttaaatcaaatattttatcagaaaagtaaaaaatgtaatgccttctatttacttcatgtaacttaagtaatctttgggaaataaagacagttttaaagattattggtaaaataaaaatatcttcaaaatgtaaatatttagtctaaattatgcaggtcagatattagatttgcaaaatgctttaaggtcataaaccgcttctttgacttttaaaaattgctcaatttattttggagcattagattctagataaggcctggggacaaatagaattagccatgtcccctagctatgcaaagaaggttataaagaaaggagattttatataagaaaggatcttatatcgtaaattcgtgtcctaaagtaaaataagcggttgttaaaaaagagggatgtttaggacaagttagaaagtcaaagcatgtcgtagatggtctgtgtaagtcatgaaataatttacaaaagagaatttatgcaagaaatatacaatttaacggtgattagacctcctaaatgcttcataaaatgccactatgactcttaactctacaacttgcctgctttacagctcggtaaggcctgagacacgtggagtcagatgctggagtcagaccttaagtgtacttctctctgggtcctagactccacaactaatatataattaaaatccttaacttaccaaagttttcaccaaaagtaaaactcgctaagagttaacattgtaacatgtaagtgagactactgaagcaacagttttacatgcaagttacgtaagaaaagtgaatgcattttcagtgaaagattataacaaggcatgggaatgtagatttttttttctgtctaaagggttaaaggattgttttaagttaggataaagctaaaagtttgaatgagttgtggaagatttataaaaattaatattgtaaaaaattatgtgtgtgaacatattgactaaatttaaaggggtattttctggtttttccataaattgaacatcaaaataaaagcacaaacagggttttcttaaagcaccgatctgctctttaacaaacatttgtaaaggattataaaaggtttatgagaatctcaccttatggtcaaacggattaagattggaaagatatgtctacaaggttttcttaaaaattggggttgacattaatagcacactaatgcaagggtgaaatttggctttctctcttgaacaagattttcatgcagtattaaaagataatgaaagatctttgtttgccttttgaataaactacccccccaccaaaaaaaaggaagggaaagacaagagacagattgtttgtaaagtaagtcttccatctatcaacatggaaaggtttttgccttttaaaacatttttgagtcatcattttgctaaatgaatgactatggtaacctggaattccatttcataatgtcaagtgttttaaatctttaacatatttaataggcttcccaaaatcaaatttcagcttcaaaattgtcttttctaacctctaactttgagatgctgcagagggcccctgaagcatccaaaagagaggtaaacagaattatttgacatgtttaattacatgggaagcattgtcaaaaagaaaaaaatttaatcttcttcaggttatattttagtgaataatattaatatatgttccaaaattgtatgagatttctaaaattccaatatgtctgagtatatgctatcaatcataattatgattattatgttattgtagaccacagaaataaccaaatttccttgtcaattgtgtttttaactataactatttaaagtcatttccacagttaattgcttaatgctgatgcagtttctgaaaacttcacaagcatgcaaagtcctagaatatggtgtcttttaggagattcatgaaagattggaaaggaccctaaaaagcactcttgaatacaggtttctaataagtttagaattatatcatttgaactgggtaagaattcctggaactttaatgaaaagactgactgagttctaaaactgctaacccaagtagaacaaaaattaattaaataccaagaaaatactttgccagattttcatgctaaatcagctgatactgaaactgtttagatataaaatttgaataaactccatcatttaaatcaaattacctatgataacccatcagttatcagtgttatgcacctaatttggggaaacaactggtattcaagaggatatgagtctaatgttaattaagcatgaactcatggagaaccaggatggccaccttgtccttcctaagtcgttaaagcttttgttagtaaaatttctgcattacatgactcgtcacggaaaagataaaatgatccaaattgaatatattgatgtggtgacttataaattgctaaaatagtttataaccaatgtttggtcccatattcctgggaaaacaatcaaagcttcaggtacatccagtcacctgataggccatttaaacattttatagagggattttattcaattgttattttcagtgcatgttttctggttgtataaaagctttcccatgcaagagggctgatgttataacactaagttattatgccaccaagtattttcacaaggtaaagaaagctttttatggttcactgaggacaatcaactccttcacaacctagaaactgaagattgtatcttctgaaaacattggataaagactgtccttgccatccacactacagcaaaacttctggactttgaactttgggttcatgatctcacaactgagaagagtccctccacactcttggaactgtacacccattggaacccttaaggtaaagctaaccagggaagtttctctcccgaagaagatggcatccttgatgtgaacagcttttcccaagatcatgaatcaagacttctctattatcatgagactcttatctttgaatattttttccttgcttttgcctctatgaagaatagaagtggaaaaaggatctgttgtgtacaattatgggttatacttttatttgtgaagaattttgcagccagctttaggtcctttttccatgatttggaataaaagaggcaaatgtatccctcataataggctccatagcagtttactgtaaaggctatggttacataatagactaaattatcttaagaaagttatgctaaataatagagttggctaaacagaagagtatctgtgcagctgctggcactcatggcctatggagaaaacatcaggtattatagagattcagttgtagcaaattaatgaagagactgcttagttaagtgagtagactctttagctcattgtttaatctatttgagtttaggaggtttggtttatggtgaccctggataaggagcatacttactctcaactcttggtattatcctcctgatagtcataataatagtctccctggtgtgctgtattctctcaacggttttaaatgtttgcatgctgccacctctagaatgtcaaatggcctctcttcaactggaatgacaagagctgaaagaaattgcagccatgaggacactgtaacctacgaatgatgtgctgagtccaaaagcccaaagtgttggtaactgagagtggtgctaagtaaggccctaagttttggtcacactctcacttaagtgagaacctgaccaaaaaagtggaatttttttttttttttttttttttgagatggagtctcactctgtcacccgggctggagtgcagtggcacgatctcggctcactgcaagctccacttcccgggttcacgccatttttctgtctcagcctcccgagtagctgggactacaggcacctgccaccacgcccggctaatttttttgtatttttagtggagacggggtttcaccatgttagccaggatggtctcgatctcctaacctcatgatctgcccacctcggcctcccaaagtgctgggataacaggcgtgagccactgcacctggccaaaaaggggaattttttttaaacaaaattatgggaggtcatttttttgtactgagcccatgcgccaggccccaacagaccaaactaaaccaaaacggagtcacgtatgccaagaccttaaggaaacacatagatcctagaacagaccacaggccaggttttgtttttctcctacaaatctctataacaaacattcctgacagcatagatatccaccccctgagttcccattaaatcttttaaccaaattaatttcctctcgccaaaagaccatcaagcttcagatgatcatgcaacaaaagtttcatccagttccaccacccctggccatcaaggagctaccctgccttcactagaaagagcagagcaggacttctgtgatcctcaataggtagggactaggcctcaagccaacatgaagcagttacaaaagaaagaccatcggcccctccacctcccataaagatttatggggatcccatctctggagggaaatgaggcagaagaatagggtctgtaggcaaggaatataaggcagatgcatgctcacttcctagaactaaatcaaatggaaacacttcagctatgatgggaaatgtcttctgtatttacatagggcatacactgagtaaccaatggaaacctctagagggtatttaaaccccagaaaattctgtaaccgggctattgagcccctatgctcaagccctctgccaccctgtggagtgtacttttgttttcaataaacctctgcttttgttgcttc

SEQ ID NO: 744 - DNA, 3893 bp, Homo Sapiens
cttggaagcagtgggaccgtctggtggtagatgcttcacttcttcatttatgactccacattcgtggaagagagcaaagaacaaacctatttctgaaatgtttctggcttccatatgcctctggcttttaggaaagcacaagtggcctgcttggggtccctcctggcttgctggacttcccgtcactttttgcctgtcgtcttccatggttcctgcatggatcttgttgcctcaggaccaagctgcctttgcttttccacaatgtccatgactatgtggggaaggaaatggaccctcatgctgacagcgcatgtccacgttactagtttcctttagaaaaccatctccaatgggccaggcacggtggctcatgactgtaatcccagcactttgggaggccaaggctggcagatcacaaggtcatgaaatcgagaccagcctgaccaacatggtgaaaccccatctctactaataatacaagaattagctgggcatggtggcacgcacctgtaatcccagctactcaggaggctgaggcaggagaattgcttgaacccgggaggtggaggttgcagtgagccgagattgcgccactgcactccagcctggttagggagcgagactggtctcagaaaaaaaaaaaaaaaagaaagaaaaccatctccaaccttaactccaggggcgccattcataccctgttctatagaacctgcccaaggtgtgctcctgaagaaagggaaggtgctgacctaatggctccgagaacagtatttttgataaagtgcagtctctcagcaagtgtcctcaaagtgctggccttgctcatgcagtagagctgggaaagcttatttgggacttgggtaccacataagaaataaagagggaatgtcatactagcaggacttttgacaaaaaaagcctggtatgagaggccctgacactaatatgattcctattctcactcaagttaatagatcatttaaccaatagcaaaaagaaccggaagtgtcctcccaaagagtacactatggaaagggtggggggatggagtacctttacagtggagaaaagtacccttacaccacctctgcaggggatctaggtcaacatcagcagttacaagttacattgacagcatgtggccttgatatgatgtgatgagaatggctcttcacccctgtggtcttcctccacaaaacccatagccccagttaaatcatgaaaaaagcatcagacagaccccaattgtgaccagcactcctcaaaattatcagggtcctcaaaaaaaggaaagtctgagaaactgtcacagtcaagaggagcctcaggagacaatgaaaactaagtgtcatgtggaagtttgaacagaatcctggaacagaaaatggacatcaggtaaaaactaagaaaatctagatagtgtggacttcagtgaataacaatgtgttgatattgattcattaattgtgacaaatccactacgctaattgccttagtctgttcaggctgcaataacaaaataccatggactgagtggcttatacacaacagaaatttatttctcacagttctggatgctgggaagtctaagaccaaggcactgccagatttggtgtctggtgaaggtccatctcctggtccaaacatggctccttctcactgtgtcttcccatggtggaagggacaagaatttctaattccactcatgagtgctctgatcccaagacctaatcacctaccaaagcccccaccttctgatagcattaccttggggcttaggatttgaacatatgaactggggaggactctggggaaacacatttaaaccacagcactaatgtaggatgttaataataaaggaaactgggtgtggggtttatggaaactctcttaacttggtatgaggtatatgcaaactctctttaatatcttcagaattttcctgtaaactttaactttaatctgaacttctaaaaattatagttatacacgcatacacagagagagagagagagagagcgagagagagagagagagagagagagaagttatacatagccttcgtgttgcaggtctagcctacacttctagccttattccccctgtttaaaccttataagtcagccaatataatgaaatttccttaaggtcaagatgctactatgtttattctccaaaaaatttgaaaaataaatgagttttcttaatttcttagaagactcaataaagttgagatcataaagtgtaagttaaggaagaattctacctgaagagactcatgaaacaaaaatgatggtgaggaaagggagtgctgtttcattgactagaaaagaattagcaaattaatcagcacattgccttttaaatgttccacttcaagagatgcacacattttcaggcccaatggtatcgtcacttccaataaagctttattggtggtatctggagaacgctatcctattatatccttggctaagctcacatatgagagactctttaaaggaacaatgcaatagtcttgatattcattgcagacactggttcttgcctactcaataattattccctcaccttcctgacaaagaacccgacttgttcaggtatctcacaatgtgctcaggaaaggtgggctcttccccaggtccatgtggttaaccagaactgctctaaaacatcgtgagaatcccattcacctttgccagtgattggtttaagggtagggagattacccaattctgaacaatgatataggagaagaaagaaatttactaggggattgatgggaacaggttattttgttcactatacagggacacatagtgagaggtgacaatgtgctagcagccctcactcactctcagcacctcctcaagtgtgggcgtgtggcgtgggactggcaggcagctctgcccatggccccgatgtgggatccactaggcgaagccagctgggctcctgagtcaggtggggacttggagaacttttatgtctagctaaaggtttgtaaatgcaccaattagcactttgtgtctagctcaaggtttgtaaatgcaccaatcagcaccctgtgtctagctcaaggtttgtaaatgcaccaatcagtgctctgtgtctagctaatctagtggggacttggagaacttttacatctagctagaggattgtaaatacaccaatcagcactctgtgtctagttcagggattgtaaatgcaccaatcagcaccctgtcaaaacagaccaatcagctctctgtaaaacggaccaatcagttctctgtaaaatgggccaatcagcaggatgtgggtggggtcagataaaggaataaaagcaggctgcccaagccagcagtggcaacccgctggggtgcccttccacactgtagaagctctgttctttcgctctttgcaataaatcttgctgctgctaactctttgggtccacactgcctttatgagctgtaacactcaccgcgaaggtctgcaacttcactcctgaagccagcgagaccacgaacccaccagaaggaagaaactcagaacacatctgaacatcagaaggaacaagcgctggacccaccacctttaagaactgtaacactccccacgagagtccacagcttcattcttgaagtcagtgagaccaagaacccaccaattccggacgctttttggcgacccagatgggactatcgcctatcaccaagtcgtgagaccattgcctatcactgagtggtgagactgtcacctatcgccaagcagtgagtaccatcagaccccttttgcttgctattctgtcgtatttttccttagaatttgggggctaaataccgggcacctgtcggccagttaaaagcgactagcatggccgctggactaaagaaacgggtgtcaag

SEQ ID NO: 745 - DNA, 1999 bp, Homo Sapiens
ccaggcatggtggcacgtgcctgtagtcccagctacccaggaggctgaggcaggaggatggcttgaacccgggaggcggaggttggagtgagccgagattgcacgactgcactccagcctgggcgacagagcgagcctccatctcaaaaaaaataacaattaaaagaatgaaaaaataaaataaaataaataaagggggaactaaagatacaaggggataaggaaagatggaagctgctgctttatggagacaaggtggagggacatcaccatgagaagctatagaggataagcagttgaagctttgcacaaaatgtagatgacaaagatgggtagctctggatggttattttctgcttgtttgttttgcacctgcttaaaaaaaaacacctgatttttttttttctgtattgccaccttccttctttcattaagaagctgctgttatggctccaaataggaccttgtgccatgaagtgcaatctgcactaacacatctacaaatgcatgtcaatcacacctaaagtagaaaaagaaagctcttgtggaattattctaaagtctaatggatttttcttccccactcttaaggggcatctcagcaacaagttgttatggaactgtggcaacatcttaatattcccattctcaaaatagttcagaaaaagtgcatgaaaattgggggaactacttagtaagcacttcaggatagagaatgtagctaaaatgagtaaagtggagaaggagtcaacggcattgtgcacagcattgtattcatagcttgctcccttaaatcgtgtttgggacttggctgctattttggtacagctgctattactcagtgcagaacattaacatatgggggaaattgtatattacacaatgcagcttccacattatgctgacaccattcctctacttgtccatttactttaagagacacttactgatgcaaaggagactgaacagtgaaggatctcactcagaatcctgtccacaatctgtccagtttacaccttaccccaaagaggtaatctcttttgttaattacctgtgtatcttccaattttttcatgataatataataatgactcttcattccctctttttttgacacagaggtagcctgttatacaacgttcttcacctcattctctcacttcacaatatatcttggagatcttaccaaaagcacacagagacctcctgcgttgtgattagattttcattgcataatattccattgttcgtgtgtgtgtgagtgtttagttagtctcaaattgataggtgcatgaatttttccaatcttttgttaaggcaagcagtattgaataaacttgtacataatatttttgcatgtgtataattatatctgtagaatgagtttcaaaaaatgaaattgaaaggtttaaggctgtattcacaaacaattttgaaaggtattgattgcctaattgtcctccaaaaggtttgtcccaaactggactcctataaccaataaatcaaagtgcttgtttctccatagccttgtcaacagagggtgttgccaaacttttaactttttgccaatctgacaggaaagacatgatatctcctgtagtttttcttcttcctctggtaaaagcaaggttaagtgttttttcatgtgtttaataactatttttgtttccttttctgagtttcttcacagttcccgagacagaaaaaaggaaaaaggatttcagcagacagaatttcaacaacaattgtctgttaaaattctttttactttttctttcagagattgctagtctctttcttctcaattttaaggtgcattttaattgctaaagaggtcatttctttggatgtgatatgcatgaaaatatttctataagtttttcatttgtcttttgattttttatgatattttctgctactcggaactgctttttattttatgtagttcagtttattaattttctgtcctatggcttttacgatttggagttacagttag

SEQ ID NO: 746 - DNA, 1440 bp, Homo Sapiens
atggaggaagactcactctacttgggaggtgagtggcagttcaaccacttttcaaaactcacatcttctcagccagatgcagcttttcctgaaatccagcggacttctctccctgagaagtcaccactctcatcggagacccgtgtcgacctctgtgacgatttggctcctgtgacaagacagcttgctcccagggagaagcttcctccgagtagcaggagacctgctgcggtgggagctggtctccagaatatgggaaatacctgccacttgaatgcttccctgcagtgcctgacatacacaccgccccttgccaactacatgctgtcctgggagctctctcaaatgtgtcatcgtcccaagtgctgcatgctctgtattatggaagctcacagcacacgggcacctccaccgtcctggccatgtcatccagccctcacaggcattggctgctgacttccatagaggcaagcaggaagatgcccatgaatttctcatattcactgtggatgccattagaaaggcatgccttcccgggcacaagcagctagatcatcactgcaaggacaccatcctcatccaccaaatatttggagggtactagagatctcaaatcaagtgtctctacttccacggcatttcagacaccttcgacccttacctggatatcgccctggatatccaggcagctcagagtgtcaagcaagcttaggaacagttggtgaagcccgaagaactcaatggagagaatgcctatcattgtggtctttgtctccagaaggcgcctgccgccaagacgttaactttacccacttctgccaaggtcctcatccttgtcttgaagagattctccgatgtcacaggcaacaaacttgccaagaatctgcaatatcctgagtgcgttgacatgcagccatacatgtctcagcagaacacaggacctcttttctatgtcctctatgctgttctcgtcgtcaccgggtggagttgtcacaacggacattacttctcttgtgtcaaactcaagaaggccagtggtataaaatggatgatgccgaggtcactgcctctggtatcacttctcctttgagtcaacaggcctatgtcctcttttacatccagaagaatgaatttggaagacccagttacagggtgtccgcaggcagagaaccaagagctctttgtgctgaagacaattgaattgtggtgaaataatatgtcatgaataaatcttgcagcagatttatttgtctcactttgtaatcagtgaatgagctttaacgaatatcaatgcctagtgcctaccccccagagataagaacttccagtttctcatgtgtaatcatggcatctggattgctcatgattctgaagataattctcctgtcccccaaagtttcagaatcacttcaggtggtagaaagagataacacatcagtc

SEQ ID NO: 747 - DNA, 1595 bp, Homo Sapiens
gcgagcgctccagggcgggcttggaaatggagacaaactcctccgagccgttaaggctcagccggacagggcttaggagtcccgagcccagtcctgttcacccccattttatagaaagggaaactgaggcccagacaggggaaagtcacttgccgaggtgtttgctgcagactgcgttgaccgaacctgctttttcacagcagtcagacagcaagccctcccgtccctccaggaccctagttcctggggaggaaggcgttctcagcgataatgaccagcattaaagtgctccccgttaccggcgtcactgccccagccagtggaggccccggagagggactgaagatgtgtcacctaacttctctgaaccttcctccctcaaggagaactgataatccctaactcacagttctgtgaggattgaatgccttaagcatgcaggttaagtggctactgaaggcagtttttgtggacaggtgatttgggagcctggaggaagggttacgtgcgcgcgcgtgtgtgcgtgtgtgtgtgcgtgtgtgtaagaatctttccgtgagaggacatctgaggtgccttaggagagtaggagtggacaacagcatccaggcagaaggagcagcatcccaaggatagaaggtggagcagcctggccggcagggatctgaagcccagagagaggaagccactggctccaagtcacagagcagaaactggtcccagcgtcagatctgcgatgctgcccaggcatggtggtgaccctctctaaacaagcacactcagaatttccctggctcggctgggcgactcagaagaaaactggccatcagcttctgcctcaagcgggtgctgtggcaaggaagacagagcatgtgtgttgtgaacactcattagaggatcatccctgctgtgccaggtgccatggcgctggatgcagaaagcaggacacatggaaagatggtgtgttcacaaagaatttggaagaaagccagatggtgacaagagtgtgtctctgaatgccccttttgggggtcactaaaaatgccccagggtttttagttagaccaaaaaggaggcttcaaagagatgacttctgagccgggttgtgatacatctaggatgtcaacaggcagagaaagggcagggactgggagtaaggaaagaacatctgttcaaggcaaaacactgattaccaaagtttctatcatccttatgttgacaacggacataattttaaccttttgtataagccagactgtaaaggattattagcagaataaaagcatctattgggcctggtgcagtggctcacgcctgtaatccaagcactttgggaggccgaggcgggcggatcacctgaggttgggagttagagaccagcctgaccaacatggagaaactctgtctctactaaaaataccaaagtagccgagcgtggtggcacatgcctgtaatctcagctgctcgggaggctgaggcaggagaatcgcttgaacccaggtggcggaggttgcggtgagctgagatcgtgccattgcattccagcctgggcaacaagagcacaactctgtctcaaaaaaaaaaaaaaaaaaaaa

SEQ ID NO: 748 - DNA, 2276 bp, Homo Sapiens
tgtgcggacaattttacctgcaaggaagagacccaggacaagcatggaaaagctgtaccgtcttgaacagcaatggccactcagaagctctctgtgctgcaaccgaaggctgggacagttgagagctacagagaaaatgcccaggaaatgtcatactctgggactttagtctgagcctcaggataaaaaataattccatttacgtgtctcagtttattttttagaaatgatctaatatttaatatgtaaacatctccaagaaatggcagctgctgggaaatgaaaattccataatcattactgtcagtatttcaaagtctcttatggaaattgctatattctgtttccatatagtttcacattgtgctaattttgtttattttaatgtgctagaaataactttaaatttgtgtctaaaaaataactaacacggcttccaccctctggaatttatatgcatccaactcccaaagaatatgccttaatttccaactatttaagtcacagagggctaactccagaagatctactgaaaagtattaaatagaagtttcgccacgttgggcaggccagtctcgactcctgacctcaggtgatccacccacttcagcctcccagagtgctgggattacaggtgtgagccaccgggcccggccaagtttaactttttagcatcaggttctttgcagctgctgggccagatataaaatgctagtgaaaacacacatccctttttatctcttaagctattactgtgagtcttatgactacatttgaatcagtgttaccaatcaaacgaagttgaaaaaatcaatttgtgtagatgtgtacatctcactactgtaccttgctgacctccagatattcacgtgcctactgcatattaatctgcatcctggaccatttgcaacaagtagatccccacacatttatgtggggccaattttattcttccggtatttattcttcaaattcaatttgaattcatccttgcaaaaatgtttattgaggccctactgtgtgccagaaggtacatatactacatgttgggaagccacgtttactcatgactcagtcaggacacaagcttcggatatgggctacgcatgtggaaatgcactgcgtttactcatggttccgtttcaaagatagctcccttcacaaattagtttgcacttgccatacctttgtctataaatcatttgtgttgccccaacttctggtctcacagatgcttgcattaaaattgatcattactattgcttttcccataaatatcgttgtttacattttattgccacttgaatttcttctcctaaacatcaagacatctttcgctatccaccacatctacttcttcctttgctatcagaaaacaactggtaaccagttggaaagctgaagcaccactccgagcctggccaacggttctagtccctctcatgtgaatgtgcatgtgtaatgagaggtgacacacacgtgtgtactgtgtatgtgtgtacatatacgtcactaggaatgtcaacatgtcctcgtctttctctaactcctgcagtttctgactccctttcccgtactgcataacacatcatctcaaattcttcatgtgtccctagcgaatgcgatcttgatggtgctttctacctcctgagatacatctcaaagaaaggaaaaagctcattattcccaaggtggagatgaagaataatatgcaagagcctataaagcaggactttgctgaaagacattcgcacccagtaaaatgtggcacatgcaagagcatcagctcagggtctgcctagacacaggccattgagaaagttctgctgtactattccatgtatatgtaaaggtacaaatatctaagaggtctccttgaaagccaaaactggagaccagaaataagccagtaagtagattttaaaagctactctgagttatccatcacatatgtagcctgttttccttacaaaaaccaggccgagcatacaggttgcactgactgtcaaaagaataggtctctcctcctccaaacatttgattattataagtcaaccaaattcaaaagataaaacttccattgcttatatgagaaatctctttctaagacgtattactgtctgatgatttcaatcgtatttcatctctaacctgtacgacatagggcacgttgcctatgtgaaaagagagactgccttcatatcagacagacaagcatttagaatcctctccaatccataagcaacaacagttacccattagggaaaaaaaaagaa

SEQ ID NO: 749 - DNA, 2593 bp, Homo Sapiens
ttaaatggtttgtaaccaatgtttgatttgtcaaatccataattctggtaagacaataaaaacttcaggtgatacatttctagcacctgttggatatttgaacacttacagatggattttcttcagttgccactttccatgcatgttttctgcttgcctaaaagattttccatgcaggaaggctaatgctataacagtagctaaatgcttactagaacatatgttttccttatggggcattcctggagaattttccagtcatagaggtactcatttcactggacaagttgtaaaacagttaagtaaggtattacaaacacaatggtattaagcaaagctaatagaatcaattgtattaccttggtaaaaggtattactgactgatggcaatcagacctacccttagtggaaaatacagattaactccttatgaaatagctactggaaggcctatcctcctaataatagaagctcacatgtctcctgctcttacaaactctgacatgacacagtattgcaaggctttaatgcattatgccaaagtactagagaaagattgcccttgaactccattgaagggatcatcctaagtttttctctgtagcaaaattttagggcctcgagtcttggatccttgagttgtggggcttctctcaactcaaaaaggcacctccagactcttacaggctcactggagacctcaaggtaaaactgaccggagaggtttctcttcagaagcagatggcatcctagatgttgacagctttcccaaaatcacagatcatcaagacttctctcttctgtcactgtaagatctttgtcctctttctccttgtatttgttttctgtttatatgtggcaagataatgtgataactaagatttcataattgatagcttctgcagggaacttaactgaatgctgggcagatcatgttaaatctaaattattatgtgaccttagagattctctggttcaccctgtaacaaatttcactgatattccaagtgtggctatctgttcaaattgctcatctggtcctttatgtagggttaggtttttagatttatgggttcagattccctgtttaaatctaagagtagacaaaatctataatgagggttttgcagtaaaattatgccagaaattgactgagaaaaccaaagtaaagataattcaacagtttgtagacaaattaataacattaatcccttaattgtcagtagcctccaaccatgcaatgattcaataatggagccttagataaatattactagtgcttccctactgatgactcttaatgcataagacatcccacagggatctgtctgttgtgcccctctaggatatatttttatctgtgcaagatttaataacaaccatatgtgtgggcaagttcatgtctcaataattaaaaaataaaaaggaccaatgtggattaaggatcctaataatagtgtcactccataaccaattggaaacttcacattggtctaaacctcgtaatttgtagtatgaaataaagaggaatttgccagaaggtataaatgcctctaaatgggcatcttttggcagaatactcctttcttggtttggtataaatgtaaataaagtttgattagaaatctatgttaaacattagctactatagctgactctactgaaaaggatatagttatccagcaaacttctttaaattttcttgcttgagttgttttagataacataattgctttggactatctgttggctgaatggggggagtgtgtgtgatagctaacacctcctgctgcacttggataaatacatctggtatggcagaaactccgttgcaagaaatcaacaaacaagctacttgattaaaacaagtagattccttttctggttcatttttgatatatttgattttgaccagttcaatctgtgggggcccctgttaaggaatatacttcaatctctcagcattattttctgataaccatcataatagtctccctgaggatatgtgccatatcctctcaggaggtttaaatgttcatatgtagccatccgttgtatgtcaaatggtctcactacagttagaaaaacaaaaatatgaagagaatataaagagtcatccaagtgacttgttgttgtgaagtatgaatctcatactgagaacaaacaaccattgttatggtgacagagggtggcatcaatgcccaaggttttggtcaatctctcaaaatggagaaggagaccaaagaggggaaattgttttaaattaattttggcttaaagctgtttctgtatgtaacaactgcaacctaacttaagagtatattcttgtgataagtagctgagtctcagccaatcatagcagctgagcttcagccaatcatagcagctgagcttcagccaatgaaaggttgccgactgatcagaccacgtccatataaggcaaacgctgagctgtaaccaatcaagctgtttctgttgtcactttatttttctgtctgtaaatatgcctgcccacattgctgggtagaggaggttctaagtgcttcccaattcataaattgttctctgctcaaataaactctgctaaatttaa

SEQ ID NO: 750 - DNA, 1701 bp, Homo Sapiens
cagctgtggtaggctcacatagccagtgtgatcggtttttaagaggcagtgcttttcagcttttctccctgatatatccattttgcttcccagcactttttaggagtagtgagagcacttcctgcccttgttggaagccccagggtggacactcagcacgaaggtctctcccttaactgctgcccttccaagacttgctcccgagatggagtgggcgtggtcttccaggctggcccttccttctcctcaccgccaccttccctgccccagccccagcagccatgggtacatgggtccccagctcacctatggattcccgccagtctgcccagctgcagtactcacgccccatgggggatcttggtctgtttttcttgtgggagcctagtggagagcagacgtggctttttatgtgtcttgttggggaggtgacttgcatggtggggacaaggctgtcgtggcaaccttgggatcgagtttgagactaaaggatgtcatgagatccctggcttctccccatgttgttcccggacaagggcagaagggaggcatggcaagggacctctgctgtccttactcaacagtggtcctcatccctccccacctcccactgcttcctgcaagggcaccagttgtatgagaaagttggcctttggacttaggatttcttattgtagctaagagccatctgaagcagcaggttgcaggacaaatgcttcagtccgccgagagcagtaccgtgtggccaagaggtggactcagagccttccttgagctaaactcggccaaccaaggcacgcagcatgtcccctcaggtctccagtcagtccaggttgaccctcagttctggacgtgtgtatatagctgtatttaatacctcaaggtcattgtggctctggggatgccggggcaggaggacgagggtgcgctgtggacacagcagtccgcggaattccgttctgggaagccaatggtcgccggcaccccttgcttcctccctctgttgtctgcctgtgtgacacacatcaatggcaataacttcttccaactcctcgcagaagtgggagaggccggcagcctgcaccgagaggggctttcctctctcttgctccccgcttcgttctgttttggctgcagagagtggttcatccatactctcattccctcgcctccccttgtggacgggggtcttgccttttcaattcctgtgttttggtgtcttcccttatctgctaccctgaatcacctgtcctggtcttgctgtgtgatgggaacatgcttgtaaactgcgtaacaaatctactttgtgtatgtgtctgtttatgggggtggtttattatttttgctggtccctagaccactttgtatgaccgtttgcagtctgagcaggccaggggctgacagctaatgtcaggaccctcagcggtggagcctgctggggggacccagctgctcttggacaagtggctgagctcctatctggcctcctctttttttttttttcaagtaatttgtgtgtatttctaactgattgtattgaaaaaattcctagtatttcagtaaaaatgcctgttgtgagatgaacctcctgtaacttctatctgttcttttttgaggctcagggagaaactagcatttttttttttccaaactactttttgtcactgtgacagttgtaaataaagtttgaaaatgctttcc

SEQ ID NO: 751 - DNA, 3788 bp, Homo Sapiens
atagttctcctccttctcaaaagcccgtcacctccccacaattacatattgccctagcttctttcctgcctcctccttttccttcctttctcatttcttcctctcttccctcattttcttgcccattcccttccttcttccctcttccctcttcagagtaaaaacaaattcctctttttattctttccacaacttagtcatttgtgtgtgtgtgcgtgtgtggccttggctcttgatagcttcaaaatgtcttcttctcccagtgacttatgaacgtattttcttacacacaggcagtatcctctctatgaattcctttcctttttgttctcctgtaatgtccaacctaaatgccatctctccctttcctacacccagacatctgattctacaccctgactctccatcccacttaccaacccccagtcaatggtttgtgtgtttcttgcttagctatttaagcttaattgtctggtgtgccctaaagctgaaatttctctatttttcatgtctagtaccaggttttagttttagtaggtgtttaataactactaaagtaaatctgaaaaagtaaccaaagctgggaagtcactaaatactcactcagtaatcacagcgaaattgaactctgtagccttgtaaaacacttgtctgcatattaccgtgaaaggaggaaattactgggattaatatttcaaagacaacagtagtcccttagtagggaaaatatatcagatgatagccaggaaaatgcattatataaatcctcattcccagtaaaatgtaattcagccttgaccaaaatatataagtaactcatccttgattataaattcatggttaactgataagaatctgagaggtttctttagatacctcttaaaatatctaaagaattcagcgatgctgagtaggatctagataaaaactatctggcagaaaagctttgtctcacaaggtgttacctacctgcttttaggacagcttggcacatagtaggagatgaagtgcttgatgattgactgaaatgtacaaggagaaatgtacaagactacaccacgggtggcagagatattgaacacagcctgtcaccttgccctgtaagatctctggctgtgtatccactttttgagcaagagacttgagttcagaagacctgaattttaatctctcagctctgctataaatgtgggatcctcagtaagtaattttacttctctggacttggttttatcacctgtaaaatgaaaaccgtgggcttaatagatctctcatataggcttgagttgcttgtatgactgtctgtagttgtttttagaaaagtaatgacaagtacatggaaataaatattcaaatactgtagagggcaggtaataaggaaatgtcatctttcctgtgccctgactcccaggtctttctcccaggtcttagagtaagcccctttggctaattctgtcttattcctctaaataatatgttaagtctctgtttcttcatttgttaatctacacaataccatttgtctttgtattattcaaggtaagaaatttagcatactaccatcaatattttaattttagatatatatttttatgatttacatccatttcttttattacttaaatagaattaaagcactatttcttaacccatcagttttaagtagtattcctgactctctttgctttcttccacttctcctcccccttatatttcctagcttctgtcagttaaatcatcacttttatattgtccaaagttataatatttaaattctcttttataactctggttgtcttaagtgctgtaactataggttaattctgaaaattgaaagtcaatacagtatcattatgtgaatattatttactgcaaaactacgaaatatgcctggacgtgcagatgacaaggtagtcctgtttcaccaaacctgggccacttgaacaagaatgctccaagcattgaagtcacattaattctcttattatactccacaagttgctcaaaatcattctacatttttagctggcttcgtattgtgaatggctttaattttcaaataccctcaaacttgaaatttagattggtagttctcaaacttgactgtacattggaattactgagggagctttaagaaatctaatagttagaggatcccaagtctagggtttctgatttaattgagctggggtgtggcctgagcatctcagtttttaaaattttgcggcttgattccaatgactagcaagagttgaagacctttactgttgaaacccagtcatgtctagtagagtcaaaagtaatgaaatacactgagtctttggacagcaagagcagaaaagtgaaacccgatagcagctgaaggtttatagaatatttatttcttttttggttgcagctatctccttcccaacctaccactgctaagactgtttcataagatgcacttctctacactcagctaatgaggtgtttcaatcagcagttgttctttggatgaggagccgatattgttttaaagcctattattttcttgggtgggtattctggagcatggggagctgaaagtgttgcaaggaaactgctgtgtgaaatttgatcaggtccttggtattcatttttatgtttcaataactgatttattttttcccccttgtacttaagatttaacatgtgttgtatttccagcagttcaaatctaattgtgtcgaatttccaggattggaggaaaagttgctccctttcagccctcctactagaagcactggagctaggctggcgggcattggaccctagtaggtatagcaggctgtgaagagcgactgggtggaagcagccccagaagaacccgtgtgaacatactgtcctttggccgcctggcagttagcctagaagacaaatatgagagaggagactggttagagtaaatgtgaccccaccttgaccctgtctgcctctcatgggaaaccagtcaaaccttcactcagattttcttctttttacagcaatgttgctgaatattgctggggataccatccccttctataaagtatctcccctttttatcccagttttctgagcatttctttggtaagcttgaggtttgtgtcagttactggggaaatctctgttcagtaccaacaatattgcagcaacagtactagaaactaaagttgaaaaatttctcactagtatagtacactataccaaaagaaaaacatgtttattttaaaaacatttccattttctacctatattggtctagaagaatatgtaatttttatttagttattgtagtatcatttgctttcctgtatacattccagttaaagataaattcagaattatgaaacttacgacaatatttgaatgtcactcagtggtaccacttcttccagtcagtgttgctattgtctgttctctccaggacttatttctacattttacatcaatggttctccaactgtgtttcatggtctaccagcatcccttaggaacatgttaaaaatagaaattccctggccttacccctgacctactgaattagaaactcagtgggtgagacccataatctgcatttttaacaagcgcttcaagtgggggtaggggaaatgaaaagaggttggtaatgggtacaaaaatacagttaggcagaaggaataagttctagtgtttgatacaacagtaagatgactatagttaacaatgatttattacatattttaaaatagctggaagagaagatttggaatgttccaaacccaaagaaataataaatatttggagtg

SEQ ID NO: 752 - DNA, 2261 bp, Homo Sapiens
atcagacttagcagcatcttcctgtcccaagagaagaggggatgggaggatggcatggttcagggcttaggggaggataggggagaaaaagtggaagcaaagggagaggcccaggaaggattttgttgcgacatgttacctgggctgcacctgctgtatgcaagagaagaggctgggagtcccctctgcagggtgttcatgccccatctctgtgccacgaggagttgggctgctgaaggtgagtacagggaggttccctgtcatctcaaacctctcaggctccacagtactgtttcaagtatccagagctttcctgcctttgaaaagcaaaaagttgtctcaggagagacagtgtgatttttgcaaggtcatgcagggtcacacaagttaatagcaaaactatagtcagaattcagactttctaacacaagcatatgacatgtatacttgtcccaggactctatgttctatgttttcctcttgtcacatttatggatccagtccaaggcagagagaacatgactctgaggtcaggcagatctgcaagggaatagcagttcttctcaggattgttgaagaaattaaatgagctcgaatatgtgagtgcctagcctagtacctggcatggggggttatgcattcagtgtgttgctctccttcccttccaaggtagcctggctgttatctcctttctggaaactcattgagcatcagagatcttgacctccttgggcacactcctgagtttatttaggcctacatttataggatgtgtcaggagctcaagtactttatgaacagagattaattgctcttatgatttaatgcattggccacccacactggtgagatgctccctgaactatgctatttgagaaacaatgaaggaactttgtgaggctaataagatttgtgctgttaatttaagtcttgaggatgtggactacagagagtataacattttatagaatttgtttaaagctacactctcatctttgccataacctggcctttcataatacattcccgtggccacctagcatcatgggtaaggctctcatcaaatgcttcttggagagcaatgcatcttgcagaacaggaggtgggaaatttccacaagggaatgactatgaatggggtgggagaaagacagggaagcaggggaagatcatttccattatttgttcagtggtgattttgggtgaacatctctctttagtccagaatgggcaggaaaatgatatgaattgtaattgttggcaagtgcgaaataatatatttagtgaggaatgtagtgtgaagcacatgaaactgcactgtcaggaagagaagttgaatctggggtcagaagaactggtttccattcctggttctgcaaactgccatcaaacttgaaggactcattctgaggcagagaatgaataaatcattacctttgtgaagcatcagaatcagcagcactttcctgtcccaggagaagagggaaggggaggatggcacgtttcagggcttaggggaggataggggagaaaaagtgagaagggaggctgacagaagtgttgcagacactgcaacacttgcatacttaacactgtatactaaagtagatgttaacctgcgctgcaatctgtatatgctgattcagctgtaatccagtcgctcacttgttacactcttacattttcaccagtaagtagtccttgtgcctccttgtatgggtggcccagtctctgatactagatcagcagcttcagcttcatgcagagtccttcctttgaaaaaccagcttttgcttgattttattataggatcttggtctcatgttagtgtctctctacctcagtcttcccagaatgtaggaattcttgcccataatattaggccagtacttttgttctaggcttatctcaacagacctgatatccaccttttctcttcctattactcagtaagcatccatctttagattgtgaacatacaagacgctggcctttatagggcctcttatctctgtcacagcatggagttttcatgaaaacaaggggctgagaactctgctggcacatagtaggcactcaggacaggttagctgctttcaatattatttttctgttcgtagatgtcttagcatgattattatttttactgaaacccacccaaattatccatatggaacagtgggctctgacccaggaaaggggggcccaggaattactgtactgcctgttgagcacgtgccttagtgtgtccatctgtctgct

SEQ ID NO: 753 - DNA, 2854 bp, Homo Sapiens
agtttcagtgtcttcctgtggtctgtgaagaagagaaacttaacaacaagaagagggaaagggaaggtcgcctaaggagaagacacaggagtaatgagaagacacaggaggtagagcagcacttgctgactcagaagcattaacatgaaacgctggagtgcagggcacaataatggttgactgcagcctcaacctccagggctcaagggatccttccacctcagcctccccagtagttgggattacacagatatttcaagattcagcatcatttcagaccctgaaaaatccctgaaaattgaattctcaatagataatgcaactccacataatatctggattttgtaaatgcttgctaataaattattttacaacgtgggtgagtttaggtgtgtaggtgatttccacacattgagagccaaaacatcaaattttaatgttggtctggtgaaagagacataatatttgatggttcatgaagaatactacaacataataagcattttagatccagggttatttctttgtatgacttatttccttttatggccatcaatccaaattttaaaaataattttttaatatatttaagatgttgtcatgtgtcctaaaatgacaaaaataaattagacacatgtttaatcatcattccagtttggtttattcactcatattttattgcataaaacaagtcaaattatttagcatgatgtcaaagtcttaagtgtaaacctcttgggggaaacagcaaagaattgggaagaatattacagtctatcatgtgaatttcatcaccacaatcagaaactaacacaaaacccagaagaaaccctaagaaagatacctgtaacctgaagaagatgtagactagatgccaaagacagagaatgatctgaatggaaaattttgcagctaaactattttcccttttttgtatgtatcagggcaaaacagtgcctaattttctcctcattttctatcatgaggcaagaaaacacatctgtcaaatgtggcagggtaacctcagagaaaagctggagacaagctatggtcataaatgtatgctaaatagatggttcaacataagaaaatgtaacaagttaattcaacacattcatagacttgacttcaagagaaaatttaggcagcattgcaatagaagcagaaacacatttgaaaaagtccagtatttatttgttaaaaactcataccaaattgtaaagaacattgatgctatgaagaaactgcatcaactagtgggcaaaataatcagctaggcttcataatggcaggattaaatgcatacctaacactattaaccttaaatgtaaatgggctaattgccccaattaaaagacacagactggcaaattgaataaagaatcaagacccatcagagtgctgtatgcaggagacccatctcatgtgcaaagacacacataggctcaaaataaagggatggaggaatatttaccaagcaaatggaaagccaaaaaaaaaaaaaaaaaaaatgcaggggttgcaatcccagtctctgataaaacagacttcaaaccaacaaagttcaaaagagacaaataagggcattacataatggtaaagagatcaatgcaacaagaagaattaactatccaaaatatatgcacccaatacaagagcacccagattcataaagcaagttcttagaaacctacaaagatacttagactcccacacaataatagtgggagactttaagacaccactgtcaatattagacagatcaacaagtcagaatattaacaaggatatccaggatttgaactcatctctggaacaagtggacctaatagacatctacagatctctccactccaaatcaacagaatatacattcttctcagcaccacactgcacttattctaaagttgaccacatcattggaagtaaaacacttctcagcaaatgcaaaagaacggaaatcataacaaactgtctatcagaccacagtgcaatcaaattagaactcaggattaagaaactcactcaaaattgcacaactacatggaaactgaacaacctgctcctgaatgactactgggaaaataacgaaatgaaggcagaaataaagatgttctttgagaccaacaagaacaaagacacaacgtaccacaatctttgggacacatttaaagcagtatgtagagggaaatttatagtactaaatgcccacaagagaaagcaggaaagatctaaaatcgccaccctaacatcacatttaaaagaactagagaagcaggaacaaacaaattcaaaagctagcagaagtcaagaaataagtaagatcagaacagaactgaaagagagagagacacaaaaaacccttcaaaaactcaatgaatccaggaacaggatttctgaaaagatcaacacaattgatagaccactagccagacttataaagaagaaaagatagaagaatctaatagatggaataaaaaatgataaaggggatatcaacaccaatccaacagaaataaaaactagcatcatagaatactataaacacttctatgcaaataaactagaaaatctagaagaaatggataagttcctggacatatacaccctcccaagactaaaccaggaagaagtcgaatccctgaatagaccagtaacaagttctgaaattgaggcagcaattaatagcctaccaaccaaaaaaaaagtctaggaccagacggattcacagccaaatgctaccagaggtacaaaaacgagctggtaccatttcttctgaaactattctaaacaacagctatccctaactcatttgatgagaccagcatcatcctgataccaaaacctggcagag

SEQ ID NO: 754 - DNA, 5536 bp, Homo Sapiens
cctaagtttagtagaagaaaggagagaaaatatagcctagcttataaatttaaaaaaaaatttatttggtccattttgtgaaaaacataaaaaaagaactgtcacatcttaatttaaaaaatatatgcttagtggtaaggagatatatgtcaacttttaagaggttgaaaaacaaacgcctcccattataagtttatacttcacctcccaccactataacaacccagaatccatgagggcattattacaggtttgttacacaggtatacacgtgccatggttgtttgctgcacccatcaactcaccatctacattaggtatttctcctaacgttatccctctccttgcctcccacctcccgacaggcctatgtccatgtgtactcgatgtttagctcccccttgtaggtgagaacatgtggtatttggttttctgtttcagtgttaattcacttaggataatggcctccaactgcattcatgctgctgcaaaggatgtgactttcttcttattagctgcatatattttgtggtggatttgtaccacatttactttatctagtccaaagttgttgggcacccaggtggattccatgtctttgctattgtgaatagattccttaaggatctagaaccagaaataccatttgacccagcaatcccattactgggtatatacccaaaggatgataaatctttccactctaaagacacatgcacacgtatgtttattgcagtaatacttacaatagcaaagacttggaaccaacccaaatgcccatcagtgatagactggataaagaaaatgcagcacatatacaccatggaatactatgcagctataaaaaagaatgagttgaaggatccagccccaaatgttaatagtgctaatactgaaaaatccacttctaaaacaagtgtcagctgagcgtgatagtgcacacctgtaagcccagcacttcgggaggccagggcaggaggattgggcagtccagagagagagcttctgggggcagctgcgacctcactgggatcaactgggattctggggccagttaagtccgttttccacgttgactcttccagaaccagaaatgtgcacactgaacccactcctgctgaagaagactgctgtgactgatgcagatatgctaacaggcacaggaaaaggatccaggtgactttcttgttaaagaagtgcatgcattttctatccaccgaaacccacacaacgaaatataatacagtttaaatataacaaataacatatgacaagtttaaattttttaaatgtttaagtatacagtagtccccccaccaccttacatgttccaagacccccagtggattcttgaaaccaaggatagtattgaaccttatatacactatgttttttcctgtatatatgataaggtttaatttatgaattaggcacagtatagattaacaacaataaccaataataaaatagaagaaccaagtggcccataaccatatgacaagatgctgtgtcaggagagctcttggctgtaagtaaagagcacctaactaacaatagctcaaactaatttgggtttacattctcacataccaaaaaatcccatgctccaatacggaggagtctcagaaacattattctaagtggaaaaagccaggcacaaaggtcacatattgcataattgcatttatttgaaatatccagaatgggcaaatttgcagagacagaaaatagattggtcgttgccaggggctgggatgaggagggaaaggagagtaattgcttaatggttatgaagttttattttgggatgatgaaaatgttttaaagctggatagaggtgatgggctattactaggtaagtttcagggaagtcaaaagttatacacagattttcaactgcacgagggggttggccctccccctactcccatgttgtccaaaggtcaactgtactataaattcttgttacctatagtcaccctactgtgctctcaaaccctagaacctattccttctaactgtattttgcacccaatgttcccaacacaaacatgataaatgtttgaggtgatgaatatgccaattaccccatgaaatgcaggcaggcttctgatgattgtgaaatggaatcttatgcaaaaaaaaacaaatagcctttccttgcagccagccagtgtttaggcagcacctgccacacacccagcactgggacagcttctttgactgttgagccgcttttcctgtttcttttctctttctttaactcttacacccattattcgaatattctaatcagatctatcaatcaaagcaaatactacttgccaagaattgagctacatgctaaggttacagtggagcaaaaacaacaaagtccctttcttcttgaagcttatagtctattggataaatacatattaaatatttaactgcaaaaacaatgtatttcagccatgaaatcaaaatggatcagaaacataaacattaaagctaaaactaataaaaatctacaggaaaacataaaagcttcacaacactggctttggcaatgatttcttgggtatgacgacaaaagtgcaagtgacagaaggaaaaatagatcacttggacttaaacgagattaaaaactgttgtgcatcaaaggacacggtgaaagggcaacccatggaatgggagaaaaaactgccaaccaaaaatacatagaacacttaaaaatggtttaaataattttatctatattttaccataattatatatacacatgtatatatgtgtatatatagtgtgtatatatacagacatatatacacttgtatatatacaagtgtatatcccaggttggtctcaaacccctggcctcaagccatcccccagccctggcatcccaaaatgctgggattgcaggcctgagccactgtgcccagcctaactcactcttcttgagcaatgtagggaagcaggtagtaaactgaagtgccacatgcttgggccagattccttcttgcctcagggcctttgcacatgctgttctctctctggctgctcttccctacatcccacccccctcacttacccgagaagcttgaagaacggggatcctctcctgtgggcaggggagccccagcttccctcgtgattcccgtcctttcaagttcattatggcagctctgtcaatgagcaccccagggtggtgtggccgcagcaccaggacccgcgctgaaggcccagagacctggcaggccgggaagaaattcctttcctttgggaagaaccaccaacgctcagtccaagctcacacggttatctagtcggcaatgccaaaaaaccacggctacaaatgaactggtgagctggctcctgctctgagactgccagagcttctggtttccactgccttggagactgctgtctgcatttgcttagacaacccttagcgaggccttcatctgctcttggtcgctgtcaaccccccacccgacagccggtgccgtgtagaaacagatcgtccctgtgagacactggagctggaccatcgactccactgcactgcccgagattgaggagccagagaaaggcccggcaagcccaagtcggaactccctccagatgctcccgagccccatggcggcaggcgtttctttgttaggcttttctggggtcatggagattttctcggccctctctgtgagcctctagccttcctccctttcacctcctctctcccactgtatttcccatgtactccagcaacggaacaaaacccaaagcagtgcccttgtattaactggctagctgggctacccctacatagtgaaactaaggttgagattggccagaagccagattaatgaaaaataaaattgtgattcatttccaggcctcttaaacctgaatggtcagattttgtggctgagattgatgagtccaagttgccaatgttggggctatttattgtcaatagtaatttcattaaaaaacactcctgaagggaggtatctgccatggtgtgcgtgggtgtaccgcctcgccaccggcaggcacaactgctctagattaagaagctcaaaatatacgacagagctacagtaaacaaaacagcatggtactggcataaaaagacacatagaccaatggaacagaatagagaacacagaaataaatcgatatacttacagccaactgatttttgacaaaggtgccaagaacacacaacggaaaccaccaaagtgtctagctaccaatgaatgagtaaaggaaatgtggtacatatgcacaacggaatactattcagccattaaaaagaatgtttggttactctaggcacctcatgtaagtagaatcatacaaaatttgtccttttgtgactcgcttatttcactgagcataatgtcctcaaggttcatccatgttgtcgcacgtgtcagagtgtcctttctttttaagactgaataatattccattgtgcagctgaacctcattttgcttatctattcatctgtggatggacgcttgcattgcttccaccttttggctgttgtgaatatgctgccttttagccacttattcagaaaaaaaaaaaaaattaaacacggcacaggccaaataaaagcacatttgcaggtccctgcagccggacagccatgagctttgacctctgcactcattgaatctctctcctgactgacttctatctttctactctctgtaggaaatatcacaaaggtgttaccatatggagaggtgaggaggagtgtgctgcccaaaaagtggtgtttcaggctcttgtataatcacatgaacatctttaataagattctggatacaagaatttaaagtagtaattagtctcaaaaaaaaaaagaaaaaaaaaaccaacatgggcaacagcagtccaggaaaacttcatggaagttgaaagaaagccaccaacccctctccttcctgtggcttttctaactggaactggaactcagaaagtacattaatcaccaatttgggaagctataggaaagtatgttttctaatatacagtgagagaatgtgactgataaaaccaattttcttgagactttctccctggaaagtgaatatatgtattcatagggccttcacaagcacagactaacaagcaaagagctacattcactgggaaggaagactcaaaatttaaaaatagaaaaaaaaatgatggcccagaagagcaagttcagagtgctgttcatgagtgatccgcatgggaccgcgatgcctctgacgtctgccatcctggagagcagcagagcgtcactagcagccaaacaggaagacaagtgtttcacggacataagaaatttaaagtggaagcactttctagagcacacaaaacagcctccctaacacatgagaagtcaccagcaacacagaaatcaccaacaagtaggtcaccacatttttaaagatcataggaaattgttcacgccaacaaatctcagtgaacctcagctctcagccttgaaaacaaggatggctgtactactcacttttttcttcttcttcc

SEQ ID NO: 755 - DNA, 3715 bp, Homo Sapiens
aggcgcgagcttcctgcgcctgctcagcagcctgaggccgcggccgggtgccctcctgccctcctggccatccagggattgggtgtcagtggcctgttgcacattgtcacttctacaagtgactaacaccgtcaggataatctaaaactacgaatactacctgactccacaagggtacggtgtattctccagttttagcatctgccttaaaaattacctcagagttaagcactgctggggacttatttctactcttggcaggaggagaaaaggaaatgacatcagaggtgctttgctaaagatcacaggaactgcagctgtggccttcctatttcgcagttttccccttaaatctttacacagattcccatcagagtacagtaaaacaaaaattaaatagaattcatatatttgaaatccttggcatcaattcactccaggaatccaagacagtactcaactgaaggggaagcaagcacaagggagatttctgggacactgatactgttccgtttcttcatctgaatgctgcttatgggccttgttcaatttgtgaaaattcatgactttgtacatttatgggtttcactttgtagctcaggctggtcttgaactgctgggctcaaactatcgtcctgcctcagtctcctgagtggatgggattataagcacacaccaccgtccctggcataaaatagttttttaattcacaagatttaataggtagattaaaagaagaggtaagacaaaattaaaagaggtaagacaagagaaggaaaagtcagactgacagattataagttcctatggtacacagtccccttagattggaagaaaggagctaagagggtaaggaagcttggttgccagttttttataactggcagcctggtgatattgggtgtggtagctgagatgtcccaattgtagtcacaaggcctaaaaaagcagatctttacaaatgtttaaaaatactagctcaatgtaaataagcatgaatgttcttgacctccttactgtgccctgaatgtgccaaccacactctcattccaccatctttgctcctgcaatgctgtttgcctgcaggccttcctgccaggagcttgctccttctctctgtccactctggatataacagcccttgcccttctccactttacgctctcttccctttctcttcttgtacctttattttcctgcatagcacccatgattatctgatctatttttttccctttttttttcattctggtgcccaggctggagtgcagtggcacaatattggcttactgcagcctcagcttccctggctcaagccatctgcccaccttagcctcccgagtagctgggactgcaggtgcacgccaccatacccgggaaatttttgtactttttttgtagagacagggtcttgctatgttgcccaagctggtcttgaactcctgagctcaagcaatccacacaccttgacctcccaaagtgctgggattacaggcatgagccactgcacccagcctgatctattatttatttaccagtaccttccctactggaatgaaagctccatgagaacagagtctgttttgttcactgctataccccttgtgccaagaacactgtctgacatataacagtaactggaatatttaatgaatgaatgaatgaatctaggtatatgatggtgggatgaggaaataaagagatagaaaatgtcagtactgtataggtttcagggacaatgaattatcaatacaatgatatattgcctgaatttcagcatatcttagtaactgccttaaagttacagaaggactgagataatctgttagaatgtgaacaataagagcacctacctcacagtatccacataaattgtttagtgcagtgcctggcacagagtaaatgctcaacagttgttagttatgattaagtctgaatagtaactcacacactaaagtaaaattgaggatttgaaacagaaatcaggatttccgttcctcctttgttaaaactaggcacagtattcaacagtctaatcaatttctaaaagtaccatttaaaactgaggtatttagtaaatggtttatagactacttagctctgtaactgaaataaattattctccaaacacggctttcctcaatgagcttaatgaatgttttctgtttaccattattgatgcttttacaaatatctcctatgcctccagaatgatctcggtgccagtgagtcactacaatttcctggattgctgtgttaaattcagttagagcctgctttaaacagctgatgtattctggaattgctggttctccagtgtcaatgaggattctcctgaaaattaaatggaagataatcacacaattggaacactgcgttgacattagcattattttgcacacagataatttacattaaagaaactgcaaaaattattttacttttaacatgcacaaaaaccagctacatcacttcagcttaactacagtaatctcaccctaagaaagttttctgagaaaaattagagctaaatataagtctgaacaaggaataatagcagtcatcttgaacatttacatagcaattaaaataaacatggcaccattccaaggactttacatattttaccaattacattcctcgtaacaactgtttaaagtagatattttatcattatatttagaagtaacttgcccaggttactctacagataaatggcagaaacagctttcaaacccaggtattctgatgccagaatatgtgcttttatctatctgcctttgagatctcatatctcagtatatttcaaaagttttatagatatgaaagattttgattcaatggcacccctaaagaaactagtctttggcactagatatacaacttatcactgaagttttatattagcaccctgacacatgaaaatgaaggctttagtgaagcatgggaaaaacatctgagctattttctttctttacttagacaaccccattagctgtattttttgcttgtggttctgaatcttccttatattttgtttgcccttcctcacgattttatgaggtggcctttctctgtgaagttttgctgaactaaagacatgggggtgacatgttcctcaagatccaattcttttttttttgagacagggtcttgctctgtcacccaggctggagtgcagtgttgcgatctcagctcattgcagccttgacctcctgggcacaagcgattctcccacatctacttcctgagtagctgggactacaggtatgtgccaccatgcccggctcatttttgtattttttgtagagatggtgtttcgtcatattgcccaggctggtctcttaactcctggggtcaagcaatcctcccacctcagcctcccaaagtgctgggattacaggcgttgagccaccatgcccagctcaagatccaattcacaaacttcttcactcatactgtttcacagtaacacctcaataattcaggctggctgacagattagccttgatgaaaagtctgagttattcattaattgatcaataactgtttatggattacctaatatgtgctacaaatttgtttcttgcagtaagcaggacacaacaaccctgcttacattcaactgttggtgagaaggggaactgcatatgactggaaataaacaataaaagtaacataccatagaaagcattttgcaaagcattaaaattaa

SEQ ID NO: 756 - DNA, 3011 bp, Homo Sapiens
ggtagcaggcggaagtgcggccctcgaggcggtcgcggcctgtcggggcttggagcgaatggctccaaggccgcaggctgggcctgggccgcagccgtgggaagccgacgatgcctgaggcgctctgtcctcggcccaccctaggaacttgtatgaccgcaggaaaggatcaggagaggccgctgcccgtctcccaccggctctaggctccctcggccgaccgatgtggggaaggggaaggggcccgcgccgaggctctaggggaggctcctaggccgggttctctgacttaaggccctcttggctgtggttttgcgggagtgagttgagggagctgcattcactcaagtccctcacatgcccgagggcccgggaatcgtgaagccgggcctgcggacccggtgggaggaaggagtgcgaagcgcggccgccgtgctcggccggcgccgggctaggtcgggcggtggggaccgcgccggcataggacaacgcggtggagggaagcacctgcccccgcccaccttgactcagggccgccgcgcccctcctgggccatccgcgcgggggtctcaggatggcgaaacccgggacctcgcggccctctagtgctcccctgccagggtgcgacctaggtaccctttatcgagccccactccccaaggcagagagagttcgacgttcccaaggagggagtctccatggaggaattcgtcctgcttcacttccagagttgaaagcccgtcggttctgcaaagaggagcagtcgggcgcgggctagcaagcagctgatgaaaataattgtcctcgcacacacagccctgcgcccaggggcgcgcgcgcgcacacacacacacacacacacacacacacacacacacacaacttgcctcctctagccgcccaaccttaatattccgggcatgcagttttcaacaacttgcctgacacaataacaaagacatttaaatgccaggacgcagacttcactttttaacctgctgagaggagctactttcaaagcttccccaccgcgaataaactgacaaaaaatatggggtgcacttataaattaaacaccttaccctcaaagcaatatacgttaatcaggtttctaaggcaatagccatctctgtcttttcctattcacccaaataatgcccccagaaggaacccctttacacaagagagaactggaaaaaaaatgaattatacccattgctagtaaaaaatcatcttaaatcaatagagcaccacttgaacttgagtttctattgtttcactgaatcatcaatgtttttaattaaacagagctaccctttctgttaaaacattacataaaagggttaggtttctacttttgttgaggcagctggcgtttgttggctgttgtgtttgagcaacagactgttcaatggaagcgagaaatagctcaacgcgctcttaatagacctgtttcaacaatgtatcttgaaaaggaatacattgtgttattgtgttagtttgctacaaacctattaaaagaaaaatagcatccatcaggtctaacaagacgcatttgtattatacgtacttatctgcttcaaatacacttcttggcacaatgtctagaattcaactagatcatcaggagctgggcagaagaacgcataccagttaggtaatgatacacgggctaaaaataataataaaggaaggactaagcagacggtaattgctacttttttgtgtatcatgagaaataacaggcaaccctacttcaattaaaaatatattgcaaaagtgtggactcctacgacaaaaacaatttaaaaaatatttgtagcatgggaatattgatccatatcccatatttggaacgaatctgatacactttcgataggaatttgtttcagagaaggattcagggcagaagcgatgcatttttaaagcagaattaaaacagcgcaaagagcccggctctttagggaaatgcgcgaaacaaacaaatcgaaagcaagcgttccagccaagtggttggggagcaccgttgtctggcactaggaaaggaagtgcttcttgaaagtgttctcttaaaaatgattttccagacttattttattgcattttaatcacaaagtgaaacttaaagcaaagaaacaggacattcccgctaccgaacagaacctatcgtctattgcaggaatgactgctacttggaccacagacctttagaaaaaacagagaggcaaatgattaggctaatttaacgcggagatctgcttagcagaaaagacacccaaagtagcatctgtcagaggaaaacatcttttgcttccacacaaggcactcgatttggtttccaaccttgagtcctcaacattcaactttcaagtgcaacaatgttggaggcacaagagaatagtagattacctacaagtgaacacaattgtacggaaaagagacttacataagttacaatggcaccctatgtgagatatctactttaacaaatatgtagagcaatattttgcccaataaagtcaatcatttgttacatttttgaataagtaaattatcacatgaagatttagaaaaatgttaccctgaaacattaaacgatagttttgccatattacaaaatagctattttaaacttttgtataaggcatttgaagccaaatggctgatatgactgttctcttcagctggaacattttttttcttctcaagaagggtgtgtgtgaatgatgtgtgtgcatactggaggtagttgagaagaatttgattaatacataagacttttcactaatgtctcccctctaatccaaatttactttttaaattaattcacttggatttaaaaacagaaatgagataataaaccacaaattacacattataaaaattagtttctccaatgtatatgatttttggaagagtgcattttcaaggtgagaatttttgatgtgtctgataatctgccagatatgagaggaatgtcacaataaaattggttttgccatgatatgaaa

SEQ ID NO: 757 - DNA, 3010 bp, Homo Sapiens
ggtagcaggcggaagtgcggccctcgaggcggtcgcggcctgtcggggcttggagcgaatggctccaaggccgcaggctgggcctgggccgcagccgtgggaagccgacgatgcctgaggcgctctgtcctcggcccaccctaggaacttgtatgaccgcaggaaaggatcaggagaggccgctgcccgtctcccaccggctctaggctccctcggccgaccgatgtggggaaggggaaggggcccgcgccgaggctctaggggaggctcctaggccgggttctctgacttaaggccctcttggctgtggttttgcgggagtgagttgagggagctgcattcactcaagtccctcacatgcccgagggcccgggaatcgtgaagccgggcctgcggacccggtgggaggaaggagtgcgaagcgcggccgccgtgctcggccggcgccgggctaggtcgggcggtggggaccgcgccggcataggacaacgcggtggagggaagcacctgcccccgcccaccttgactcagggccgccgcgcccctcctgggccatccgcgcgggggtctcaggatggcgaaacccgggacctcgcggccctctagtgctcccctgccagggtgcgacctaggtaccctttatcgagccccactccccaaggcagagagagttcgacgttcccaaggagggagtctccatggaggaattcgtcctgcttcacttccagagttgaaagcccgtcggttctgcaaagaggagcagtcgggcgcgggctagcaagcagctgatgaaaataattgtcctcgcacacacagccctgcgcccaggggcgcgcgcgcgcacacacacacacacacacacacacacacacacacacacaacttgcctcctctagccgcccaaccttaatattccgggcatgcagttttcaacaacttgcctgacacaataacaaagacatttaaatgccaggacgcagacttcactttttaacctgctgagaggagctactttcaaagcttccccaccgcgaataaactgacaaaaaatatggggtgcacttataaattaaacaccttaccctcaaagcaatatacgttaatcaggtttctaaggcaatagccatctctgtcttttcctattcacccaaataatgcccccagaaggaacccctttacacaagagagaactggaaaaaaaatgaattatacccattgctagtaaaaaatcatcttaaatcaatagagcaccacttgaacttgagtttctattgtttcactgaatcatcaatgtttttaattaaacagagctaccctttctgttaaaacattacataaaagggttaggtttctacttttgttgaggcagctggcgtttgttggctgttgtgtttgagcaacagactgttcaatggaagcgagaaatagctcaacgcgctcttaatagacctgtttcaacaatgtatcttgaaaaggaatacattgtgttattgtgttagtttgctacaaacctattaaaagaaaaatagcatccatcaggtctaacaagacgcatttgtattatacgtacttatctgcttcaaatacacttcttggcacaatgtctagaattcaactagatcatcaggagctgggcagaagaacgcataccagttaggtaatgatacacgggctaaaaataataataaaggaaggactaagcagacggtaattgctacttttttgtgtatcatgagaaataacaggcaaccctacttcaattaaaaatatattgcaaaagtgtggactcctacgacaaaaacaatttaaaaaatatttgtagcatgggaatattgatccatatcccatatttggaacgaatctgatacactttcgataggaatttgtttcagagaaggattcagggcagaagcgatgcatttttaaagcagaattaaaacagcgcaaagagcccggctctttagggaaatgcgcgaaacaaacaaatcgaaagcaagcgttccagccaagtggttggggagcaccgttgtctggcactaggaaaggaagtgcttcttgaaagtgttctcttaaaaatgattttccagacttattttattgcattttaatcacaaagtgaaacttaaagcaaagaaacaggacattcccgctaccgaacagaacctatcgtctattgcaggaatgactgctacttggaccacagacctttagaaaaaacagagaggcaaatgattaggctaatttaacgcggagatctgcttagcagaaaagacacccaaagtagcatctgtcagaggaaaacatcttttgcttccacacaaggcactcgatttggtttccaaccttgagtcctcaacattcaactttcaagtgcaacaatgttggaggcacaagagaatagtagattacctacaagtgaacacaattgtacggaaaagagacttacataagttacaatggcaccctatgtgagatatctactttaacaaatatgtagagcaatattttgcccaataaagtcaatcatttgttacatttttgaataagtaaattatcacatgaagatttagaaaaatgttaccctgaaacattaaacgatagttttgccatattacaaaatagctattttaaacttttgtataaggcatttgaagccaaatggctgatatgactgttctcttcagctggaacattttttttcttctcaagaagggtgtgtgtgaatgatgtgtgtgcatactggaggtagttgagaagaatttgattaatacataagacttttcactaatgtctcccctctaatccaaatttactttttaaattaattcacttggatttaaaaacagaaatgagataataaaccacaaattacacattataaaaattagtttctccaatgtatatgatttttggaagagtgcattttcaaggtgagaatttttgatgtgtctgataatctgccagatatgagaggaatgtcacaataaaattggttttgccatgatatgaa

SEQ ID NO: 758 - DNA, 3822 bp, Homo Sapiens
ggaaagccaggcttgcatgaaggaaatgatttcctatgattctgcttactgcttaaaaaaattaatcaagttttctgcctgacaagatccagtatctgccggaggagccccaccttctgctactattatgttcttcagatgagtagaagagagtggggagggagagagcaggaagaagaaaggaagaataatgtcttgaaattgatgatgcatatcataaattattactcaccccatgttcccaccctcgagagacctccaaacaatcaccatgccacagtgaacattcagtaacaaaaattcagccagggttttcaccagcatgaatggcagtgattccaatcaggaaaacagaaagaggagagttcagagccacctagaatggctcttgcaagatacgaaatcaaggcagcagcaacagggctgaacattcctcatccctaactctcccttcaccagtaggaaacccaggataactgcaatcaccgcaggcccatctggcctgaagttctactactagtagccctccatgggaccttcttaaggaagcatgtcaactcaggtaagggatgtaaggggatggatgaccctttgaggccaaagttggagcaaaaaacaccagatgttcctgtgcactgctcctaagagatggttctgaagaccagttcggggagaggtcaaaatactggacagaatctcagcaacatggaacctcaaactaagtgacagtcacagacaactcttccccaaagaaaataagcacagacatggtttgtggtaagcagaattataaagatgaattcccatctccctgtcagattaccagtatggtaaattaccagattacctggttatttattcaaacactaatacagttattgccttgatggaaacatacagatacaattaaaatcccaagtaccaaataaattgaccttaagacaaagactaagtaaatcacatgagccctctacaagcagagagtttttctccagctggtagcagaagccagagatttgaagcataggaagtattcaacacattattgctggcctgaaaatggaaggggccacataacgagggaaaccggtggcctctagaagcagggagcagtcccctgctgacagacagcaagccaagacctcagttctacaattgcaagacactcaattctgctaaggacaaaaatgagcttggaagtgaactctgagcttcaggtgagaacacggccaaacaacaccttgatttcagcttaaacaaagaatgcagccactccatgccagaattctgacctgtagaaatttgagctaataaatagatgttttaatagcttcatcgatacatacttcacttactgtaaaattcattattttaaagtgtacaattcagtggttttcagtatatccacaaaatgcaaccatcaccactatctgatttcaggatttctttttcttttcttttttttttaatcccataaagaaaatccaaaccaattagcagtctttcttccttctccctgctcccagcccgtgaaaaccactaaattactgtctgtttccatggatatgcctattctggatattttatataaaccaaatcatgcaatatgtggccttttgtatttggctgcttgcacttagcataatgttttcaaaatccatccatgttgtagcatttctcagtatttcattccttgtatagctgaataatataccacacaaatatatcacattttgtttgtccattcatcatttaatagatgcttaggtttttccattttttaagtattataaataatatggcttttaatatttgtgtacaagtttttctgtaggcacaggttttcatttctcatggatataaacctagagtgaaattgctgggtcaaatagtggctctatgtttaacaatttgaggaacagccaaactgttttttgaaatggctgcattattttacaattctgtcaacaatgtatgagggttccaatttcctgacgtccttgtcaacacttgttaatgtctgcttttgtattttaggcaccctagtgggtatgtcataatattgcattgtgattttgatttgcatttccctaatggctaatgttgtacatcttttatatgtgcttattggccatttgtttatgttctttagagaaatgttctgttcaaacactttgcccaagttttaactggactaattatctttttattgttgcgctgcaagaattctacatgtattctggagtagttgtttatccgaaatacaatttgcaaatattttctgtcactgtataggttgtctttttactttcttgatagtgttctttgaagcaaaaaagtttttttattttcttgaaccccagttgatctattgtttcttctttttctgcttgtactttcggttttatagctaagaagccattgcttaaatcaagttcacaaagatttacacctctgttttcttctaagagatttacagctttctttttttttttttttttcttttttgctagagaaaggatctcactgttggccaggctgttctcaaactcctgggctcaaatgatcctcttgcctcagcctcccaaagtgctgggattacaggcatgagccaccacgcccatccaagttttacagctttagatgttgcatttagatctttgatccattttgacttaatttttatatatggtgtgagatagaggttcggctttattcttttgcctgtagatatccagttgtttcaagccacagtgagataccacttcacacctactaggatggctacaataaaaaaaagacaataacaaatattgatgagaatttggagaaatttgaatccttcaatttgctaataagatgtaaattagaggaaccactttagaaaacattttggcagctcctcaaaatgggtatatacctgtaattttatgtttaaaacataactgtaattttatgtttaaaattactgtttgactcaacaattccactcctaggtatataccaaagagaaatgtaaacaaaggtttacacagaaacttgtataaaaatgttaatagcagcattatttataatagccaaaaagtggaaacaagctaaatattcttcgactgacgaatggataaagaaaatgtggtatatctatatgatggactatcactctaccattcaaagaaacaaaatactgaatcatgctacagtatggatgaatttaaaaacattatgctaagtgaaagaagccagacacaaaagtccacatattgtgtgattccatttatatgaaatgttcagaaaaggcaaatctatagagacagaaagcaaattcgtgattgcctagcgtggggtgcagaaaaaagtggggattggagggtgataactcaggggtgcagggtttctttggggggtgatgaaaatgttctaaaattaattatggtgattatggttacacagcgttatgaatatactaaagaccattaaattatatacttaaaatgattgtattatgtggtatatgaattataattcaatagaatagtagtaaaaaaacaggtgatggaaagcatttgcctgcagtctatactttttctactcctggtataggagaacaagaacaaagaagtcactcagattgttttaattgcctttgtactaaggagaaaaataagacctatgtcaggcacatgggtagatggttcctcataaaggcttaagacaaaacccaagtaaataaaaatgagtttgtatttttctgatgaacttttttgtatatgttttatgtgaactcatgtgaggcagaggcagagagtcactatacatgatttc

SEQ ID NO: 759 - DNA, 5314 bp, Homo Sapiens
cttttgtgcaggcatctcgctgtctgcgctgggcacggagcggcgcgcgcgcgcccgtctttccctcggcggcccccgcggctcggacccgggccggcagacaggccatccatcatccgccctcctcccgcggagcgccgcagccgccgcggccaatccggcggcaggtggggccgcacctgcgcgacagcccgccgcttccctccgctcccttcgccgcgcctcgcgtgctagcggtgcccttgtgagccactgcgttctccaaggccagaacgggacagatggagaaattgagatgagagctcatccacaagattacccatcaatgagcaccaatagcaaccaaatccactagaagactgggagcttttaagtcaagaaacttacatcagtatcatcattccaagaagcggtatccaagctgttttatcgaaagtgcgcatgggagatggtgctgtgagtggggagtgagtcaaaaactccgctggggtgtacaaaagtctactcaaatgtccacagcatctgtgggggatggagaatagttggaggatctttctccagaatccttctgttctgtagtacaagtattactcattatagactagcacgaaaaatcaagtgaaatgcgaacttaagagtttaaaaagaataaatggtgcttttctggcctattagtaataaattaaataaaaataattttaatttgtaagtaatgaatgctaatctacattgtattaattgggcttaaccagagagtttttgtttacatacattaggcaaacaaacaataggaatgaggatttttaataaagaaggaagccagaaacacacacacacaagcacacacacacacacacacacacacacacacacacacaccaagtaagagaatactaaaagatcagagaaaatgtaattatacttatcaaaatgttttaatgcagtggcctattagtttcagaatataaaatttatttgatttgttgagcaacttggagcttattttttaatcctttcagataataggaacttgaaacatacttggctgtgtataagatatatgtgatattagaaaatcatatatatctgttaatatatattcaaatatattactaagcaaaaatatatttacatgtttatatcaatgatgcaattaataaatgttttcacatcctgtgtctcaatttatccttacataaaacaagtgagttacttattctttaacttctctaggcaaatttcaaatattttctgaatataactacagaatgcttggtttgtgtctctatgaaaggtcttaacacactcctgcaatgaattatatgcatatggctctcccatactgggaatgcctagaggagagaaactgtcttcttaccatatttgtatctatggttcatgcctgctccacatagacccctaggtttcactagagagatctcaagacagtaggtttgaagtaagagaatgggaggatttagaggcatctcgactatactgatatactctgcaatcagcttggcatctgggaaatgttttgctgtctgcttcatctccagtgccttgaacagtacatgtttctctggagcccctgcaaggtttgttgaaggagggcatacatcaggtattccataatttagcaacattccataatgtggctgctagtaaatggttggttcaggatttgaacccaggtcctctgtgtcatgttctaaatgttgggagaataaatccctcccttgtctcagtgaagatttctaagctgccctgggttgttgtgtataggtgtttagcttatgggatgggactggaaggtggtgtagggacacaaaaggaattaaaccatgtaagttcaccttggttggcattttcatttctcctttggatatcaagcctgaacaatgattctcaaagatatgtattaaattcaataaggatttactactactgctcacctattaagtgcgaggaacagttgcacttagtaggaataaagaggtagctggcacaaactattctgcctgttttttgtttttgtttttcgtttgtttgcttgtttgttttttcgacagagtcttgctctgtcgccaggctggagtgcagtggcgcgattttggttcattgcaacctccacttcctgggttcaagagattctcctgcctcagccttccaagcagttgggactacaggcgtgcaccaccatgcccagctagtttttgtatttttagtagagacagggtttcaccatgttggccaggatggtctcaatctcttgacctcaggtgatccgcctgcctcggcctccaaaagtgctggtattacaggcgtgagccaccacgcccggcctattctgcctgtttgttgactgcagtcatagtatgttcttgctcctccctgagctacttttgctttgaataaaaccatggtgtcatggaaagaacaaaaagctccagggtagggcacatgttttcaaacttattacaagagggagcctggatgagagtatcttaatataccttttagagctgatgtgtccttctctccttgagatccaattaaatttactttctgtgagttacatgatagaaagtgttacattgtacattttagcaatttcagcttattcagatcaaacaaaaaaaattagttgatttgactatctacagtttatctctgccaccaaagtaaatagcatggacttgaaggtgccatcccaactattgccctgacattccatcacctgcattttccagaaatcaggtgaacgatatttttcagtcttgctgcatttcacctctggagtgtgtagacccagtcttaatgtgcctaaaccaaatgagatgtgttatcccttccaatggaactaagcactttaagtaactaaggaattggagagagagagagagagagagagagagagagagttttctaaattcagcaagaaaaaataaggtagtcgagttgtgtttcaaaccacttctataattgggagctaaacaaatttgtggagaaagtacttggtcaactgtataatttcttctactattaactatccaaaacaaacaattaattaaaaactaaacacagataatgaagactatctattttctaaaactgtgaactttggaaaggggcgtgctttatggatatctgtaagtccatatttggacaactatcagtttaacttttagtaatctaaaatgctcaacttaaacttcatttcccacttctgccaaaaccagaagaatcaaaaatacagtgaaggggcatgagatttccagctcacatttccaatctccagaggtttgaaaaacttcatctatctatttgaatgccatggttgtgatccaaactgaatttgaactttagatacttaagagtgacccatcactgtttaaaagtccaaagtggccacagagaaccctacggaccattacttcattgtttattcttgtaaattataaatatttttaaaaattccaaattatgaagttcgaaggggatattttatatctctcagccactgtcattttcttcctcccttccttgggtgttggccatgtatctatgagtccagttggtaaaacaatcagtagcattgacaggatgatgtactctggtccgaaactacatttctcagctttttcagttctcaggagacagcggaaaatgtacttagcaaactctattataaaggtccatgttgttccaaatatttagttgtacttaaagtaaaatcatgacttcagatgccaagtgaaataaagcataattttcacactgtatgatggaaagactatttatcatatacatgtctttctcttaggatattattgtgacagtatagcaatataatggtttataattacatatatacacacaatatattttatagtgtaactgcatcattgttctggacaggggtgagatatgaaagtcctaaaagcaaatattgagactattaagttatcagagtctaaactgtgggagtagaagagaaacagaaagaagaaatggaactgtgagatatttcaaagggaaaagacactatatgcatgaagcaaccactattatttattctacaaataagtattcttgccattactttacagataaggaccgtgaggctcaataattagcaaataatggagcatgactcaattctgtaggtatatttgacttaaaaaaatgcatcctactttttcatattcagttcaaaagattaatgatgggacaaagaacaaagaagaatttggtaccaccaactgagggctggtctggtgtggtagttggtagctataataagttagtacaaacatgttctgctcatgctacaagaagccaactggtggagacatcaagaacacagtcagaaataaatatagcaatttaatttaggagagagctgggagctatagattgagcctctacatttaattggtagctaaagtaatgagaactgtatgaaggagaattagagataaaaacttctcaataaaaatagtggtaagaagaagaaatgagaaaacaatcttgaggattgtcaacaccatgaaagtcttagttgtttgattattgttttaatagtagagatggggacattttatgtgtcaaagcagtggtccaaatgagttccgcatctcaagagttttgtagagtgttaatgggtgttactcaaagggaaaaaaaggataaagttataaaccatttaggagaccctaataaaactaaagtgaatgaggttctttactatctttaattggctatatttgtcttacaaatatccaaaatggtgacatggtatatcatagttcctaagattatttgactacagagtccagatttcttggagaatcatctagtggtacaattaattgggagaaaagagccaatgaagagggaaacttggaatgtcagagatggcaggatacccctgatggatcttctgaggggacagcaagggaagaaattaagaaatcagaaagggaggtcttgaggatgagaggtagggccttcagttagaaatcactacatgggccaggaacggtggctcacgcctgtcatcccagcactttaggaggctgaggtgggtggatcacctgaggtcaggagtttgagaccagcctggccaacatgatgagacctcatctctactaaaaatataaaaattagctgggcatggtgtcaggtgcctttaatcccagctacttgggaggctgaggcaagagaattgcttgaacccaggaggtggaggttgcagtgagtcgagattgcaccactgcactccagcctgagcaacaagagagaaacttct

SEQ ID NO: 760 - DNA, 14167 bp, Homo Sapiens
agtgctgctggtgccggagtccggaagctgacggcgttgcctaggctggattgcagcggtgcgatcaggactcattgcatcctcaacctccccgactcaagcagtcctcccacctcagcctcctgagtagcaaggctacaggaaaaacaaataatcctcagcactgaagttcaaagccatggttcctgcgtgttccttaacatgacacaggtgggccttcattgaaaacaccttcagctcctccagctcaattctcatgaaaacaaacagcggtgccctttgcccaaggtggaagaggtggccgtgaaatcctcatcagcttcctgtatattgcagaacctcaatcaggccgtgctgcaggggtgaggacctggtcgtccacctggagctcaccaggggaaataggggcagtgtcccgcaggcagtgaactggcacagcacccctgcccctgaccctcgccattgccattgtgatgggggaggggtcagggcccctctgcacagtccaagccacagcaaaatctgggaagtctcctggtctttgcccaggaaacagccttcctagacaggctctgaattattcacctcttccccttcatattacaactgccactcagacgtgaaggtgcagcacaaagcttcagaaacaatggaagaaactgaaatcaggatcctgactcctgcatgggaaagctatagctgtgtgactttgtgcaaatcacacacctgttctgtgtcttgcgtctgcatctgtgaaatgcaggtgaacctagcacttacctttgagggctccttggagaattaaatgaattaattcatacaaaggacttagagagatgtccggcactgagtaaacactcagtgctagctgttatgatgatgattaaagataatcaaagcttgtgctttttaatagacaattttttttggaacagttctagattcactacaaacttgagaggaaggtacagtgatttttcatagcctccctacctccccccatcatcaacatcccccaccagagtgatatgtttgctacaactgatgaacctacattgacataccatcatcactcaaagttcatagtttacattagggttcactcttggtgctgtgcattctatggatttggacaaatgtataatgccaggtacccacaattatagtatcatacaaaatattttcactgccctgaaaattctccatgcttctcttctttatccctccttccccgtagccgcaagcaactactcatctttacaatctccatagtttcgccttttccagaatgttacatagttggaatcacacagcatgtagcctttcagattagcttctttctcttagtaatatgcacgtatgcctcttccatgtcttttcatggcttgatagctcatttatctttagtactgactaatactctgttgtctggatgtaccacagtttatttattcacatactgaagaacatcttggttgcttccaagttttgccagtcatgaagaaatctgctataaacattgtatgcctgtttttgggtagaaagccttattttttattacattaaacatgtaatatatggagtttacctctgccatttcagagtgcccaacacacagcaggattgttacttggttttcaactcctgactcttttccaaatgtctagtgcagatttctgtgcctaggtgggtaacagtgggaacttctgggacccccagctgttggtctgaccttcattcagtatccttctggtcagtcacatctctcatctttgcatttgactctgctcttaatgccaatgaatctaaaaactcagacatagcttgtccctacatctttagtgagtttgttcatgctttcacaatagtcttgaatttcaggaaaaaaagtatatcattcaatgatggcaacataatgctgcagagtttggttacatagaatattctgatgcatgaaaatgatgtgcaaataaaaaagtgataaagatggtcaaagatatacaggaggcactactgatagaaatgagtttaaatttaggaaaaagggcaaatttacttagggaatagaggtgctagaaatctataatgaaattgccacattactcttgagtatacacagattgaaagactgtgaagtggtgattgcaaatgttcagggttttttaattatactttaagttttagggtacatgtgcacacgtgcaggtttgttacatatgtatacatgtgccatgttggtgtgctgcacccattaactcgtcatttacattaggtatatctcctaattctatccctccccctccccccaccccacaacaggccccagtgtgtgatgttccccttcctgtgtccatgtgtcctcattgttcaattcccatctataagtgagaacatgcagtgttcggttttttgtccttgcgatagtttgctgagaatgatggtttccagtttcatccatgtccctacaaaggacatgaactcatccttttttatggctgcatagtatcccattgtgtatatgtgccacattttcttaatccagtctatcattgttggacatttgggttggttccaagtctttgctattgtgaatagtgccacaataagcatacgtgtgcatgtgtctttatagcagcatgatttataatcctttgggtatatacccagtaatgggatggctgggtcaaatggtatttctagttctagatccctgaggaatcgccacactgacttccacaatggttgaactagtttatagtcccaccaacagtgtaaaagtgttcctatttctccacatcctctccagcacctgttgttccctgactttttaatgatcaccattctaactggtgtgagatggtatctcaatgtggctttgatttgcatttctctgatggccagtgatgatgagcatgttttcatgtcttttggctgcatagatgtcttcttttgtgaagggtctgttcatatcctacacccacttgttgatggggttgtttgtttttttcttataaatttgtttgagttctttgtagattctggatattagccctttgtcagatgagtagattgcacaaattttctcccattctgtaggttgcctgttcactctgatggtagtttcttttgctgttcagaagctctttagtttaattagatcccatttgtcaattttggctttcattgccattgcttttggtgttttagacatgaagtccttgcccatgcctatgtcctgaatgttattgcctaggttttcttctagggtttttatggttttaggtctaacattcaagtctttaatccatcttgaattaatttttgtataaggtgtaaggaagggatccagtttcagctttctacatatggctagccaattttcccagagaccaatgactttcttcacagaattggaaaaaactactttaaagttcatatggaaccaaaaaagagcccttattgccaagtcaatcctaagccaaaagaacaaagctggaggcatcacgctacctggcttcaaactatactacaaggctacagtaaccaaaacagcatggtactggtaccaaaacagagatatagaccaattgaacagaacagagccctcagaaataatgccacatatgtacaactatctgatctttgacaaatctgacaaaaacaagaagtggggaaagcgaatattcagttttgatgaagttgctttaaatgattcgtttggagatgaggctgaatttttaaaaatatccaaacaattttaagcaaaaagagcagaaataaatgcctgaaaattatgtatagaaaaatagaaaaaagtaggacaactttatcacctcaaaccaagagtttaatgagatatataaagctgcattaaaaagctgaaaatttgagaaactgctcacatgatgcaccaaaatttccaggaagaggaaaactagagataagaattttcatttggcacaaattttcctcttgaactacttgttttcaattaaatgatcagttactccctggagtaacaatgatgttagaccccttgaggttgactctagatcattccttgggaaaatggcggtgatcccttctcacatgtgagatgaggccagtcttactggatgggcttcccaacagctttctccttcccttacactgtggccttgggtaggtctcttttgctttaggagctttaatgcctctatctgggcaatgaggaatgaggggatttgaccacatattctttgagggtcttcttcccttttatgagttttcaaacactactgtgcaccatcaatctcaaaacaattacccaagacataattttaaaattattttatttcagtagtttttgagagacaggtggtttctgcttacatggataagttctctagtggtgatttctgagattttagtgcaggcatcacctgagcagtgtacactgtacccaatatgtagtcttttatctctcaccccactcctcaccttccccaccgactcccaaaagtccattatatcactcttatgcctctacattctcatagtttaactcccacttataagtgagaagatatggtatttggttttctattcctgagttacttcacttagaataatggcctccagtttcatccaagttgctgcaaaaggcattattttgttcttttttttatggctgagtagtattccctggtgtacatgtaccacattttattgatccattcattggccattgggcacttaggttggttccatatctttgcaattgcgacttgtgctgctataaatatgcatgcacaggtgtctttttaatataatgacttcttttcttttgggtagatacctagtagtgggattgctggattgaatggtagttctacttttatttccttaaggaatctccatatcattttccatagtggttgtattaatttacattcctaccagcagtgtaaaagtgttcccttttcaccacatcaatcccaacagctatggtttttttgacatcttaattatggccattcttgcaggaataaggtggtatctcattgcggttttaatttgcctttccctgatgattagtgatgttgaacgttttttcatgtttgttggatgttcatatcttcttttgaaaaatgtctatttgtgtcgtttgcccactttttgatgggattattattattattttttctagcttatttgagttccttgtagatttcggatactagtcttttgccaagacatgattttgttagtcacaaagttcctttgccttatttcctccagtcaaggatcatcttaatgatgaactcactaatgcccaagctcaaaagtgacagagaggattctggggaggtacacagagaggcttctgattgtgatcaaaagaggtggcccacatgttgaaaatagcagaaagtttactcatacaataatcccataaattgtaataactcccatcaaaaactgtaaaggttgaactgctcgttatactttcatgcccagccttcagactgccattttctgattgttttacctccacggctgtccttaacatacactgtaaccaatttttactttgaaataatcatataccattgtgtgtgcgtgtgtcctgctatctgtacatctcttgttcaaggcaatgttgaattgtgcttgtttgagtacattaacatttccctctcaaatggacttatttataaagcacaatatgttatgcataggctgaccactttatccctgtcttaaaatgagtgaagtatattgggtgcatggataatgatcacttttaatttttctttttctcctctttatggcagtgtctggcaacattcccctatgattttatattgaatggaataaacatgttgtagggagaaagggaaatttgggatggagggtgatatgagcagttacccactcctttgtgcaaagagaacactatccttgcatcatacattgaacagcagtttaccaatgatgtcaatttattttacaatggcctcaaaatgagtagggattattattcctttgaacatgtgagaaaacagaggccaagaaagttacattaacaggtcaagtatttccaacatatccgtgtatgtaggcatgagcacacactgagtaatttgtcctgaaccaccccttttctaaggaagtccttcctaatgtaatatatcctgaagggcagcttctagggcaaagtaacatgatagtagatggcagtcttccaaggagttactggtttccctaggtctctagttccttgcttatgtgagtattaaggcaaattgagtgggatattgcagcactgggttatcactcacatgctaacttgcgtgggaaaatgtctcccctgcaaagattaattaagaatcagtcctttggaattctgtgctttaaagtgaattactggtggtttctgtgaagttaaagggacagacactgcttttaatggttgttaaatggaaactacagaggagtgtaagtgggcggtacagctgcatttgtaaaaattcaggttgtttttaattaacaccacatgaagcatccagccacagcatattcccccagttcaatgatgtctgtaggtactggaggccagaattcttaaaattgcttccatgttgtgctagatgcagcagtgattgagtactattgctcagggcaattggggtaataggaacctcatcagttagctaaagaggtgtggataggagattggggtaaaaaggtcaaacctggtccaaggctggtttcagagccaggtatccccacctggcagtaaccagggagtaaggatttacccttaacaactcagctggcctcaagccttcaaggcctggaaaaggaaaatgcttctgggttcacatggccaggcaggctggagtctagacacaggagcactgatcattgcttttcctttcacagatgaagaactcaaaaggcacaaggaggttacaccagttgttcaaggcatgggggggtggcccacaatcctgctgctgctgctcttcccttcaggtggatgactcagtcttttccacaaatttaaggtagaaaagggtagtcagttttaatgccatgcagagcagactcactttgcatttatcattgaaaagtaggaggtcaaagaattgacagtagttgaataatcattatacaggcagtcaagcctcactgatttgaatcagtggagtgggactggtctgattataaagatttacaagaaatgcatctcaataaatttaggatgcaattagggtcagataagtatgagataagtgtaggtaaaaaagcatactaagtgagtgtaaaaagtcctccatgctttaaagtttttttttttttttttttttttaactaggtcaagcacaacccatgctagctagtttacactattaatttacttctcaggtagctattgcaaagataaatgtaagcctggattttgcccaacttttcagaaatttggactaggggaatctggaccaggcttgaaatggtgtatgataaaagcaggatttcattagagtgggtcaaaaactagggctctgaaataaagataggcatatgaaattcaattcaaaaatatttaatgacatctactatgtgaaaagcacagggcaaggctgtaaggggtatagagatgaagcatatatagaaagcaacttatacagagtggatataaccctcacatatgcaactgtggttaatgtgcatggtaagaatgggagactgggatgacctgactagccttgggtgcctaaggagatgatggggagccagggaaagtttttgattaggggaacaacatgaccagagctgtggttttctttctgaatattttaagttccagggtacatgtgcagaatgtgcaggtttgttacataggtatacacatgccatggtggtttcctgcacccatcaacccatcatctacattaggtatttctcctaatgctatccctcccctagccccccacccctaaacaggccccagtgtgtgatgttcccctccctgtgtccatgtgttctcattgttcagctcctacttatgagtgagaacatgcggtgtttggttttctgttcttgtgttagtttgctgagaatgatggtttccagcttcatccatgtccctgcaaaggacatgaactcatcctttttatggctgcatagtattccatggtgtatatgtgtcacattttctttatccagtctattattgatgggcatttgtgtggttccaagtctttgccattgtgaacagtgccacagtaaacatgtgtgcatgtgtctttatagtagaatgatttataatcctttgggtatatacccagtaatgggattgctgggtcaaatggtatttctagttctagatccttgagaaatcatcacactgtcttccacaatggttgaactaatttacactcccaccgacagtgtaaaagtgttcctatttctccacatcctctccagcatctgttgtttcctgacttttttttttcttttctttgagatggagttttgctcagttgctcaggctggagtgcagtggcgagatctcggttcactgcaagctctgcctcccaggttcacaccattctcctgcctcggcctcccgagtagctgggtatacaggcgcccgccaccatgcccagctattttttttttttttttgtatttttagtagagacggggtttcactgtgttagccaggatagtctcaatctcctgaccttgtgcattctgcctgccttggcctcccaaagtgctgggattacaggcgtgagccaccacacccggccctcctgactttttaatgatcaccattctaactggcgtgagatggtatctcattgtggttttgacttgtgtttccctaatgaccagtgatgatgagctttttttcatctttgttggctgcatacagaatgggagaaaatttttgcaatctatccatctgacaaagggctaatatccagaatctacaaagaacttaaacaaatttacaagaagaaaacaaccccatcaaaaagtaggtgaaggatataaagagacacttctcaaagaagacatttacacagccagagctgtgttttaagagcagtcacagatgtgagaatctgaacaggcggttaaggaattgctgcattgtttgaatgaaaagcctggtccaagaattataagccatggaagttaactggatgtgaagaaaggaaaaggcctcaaaagaggccctgagactttcagcctgggagatttggcatgatgataagggtcggtcatgtaaccagggaggggactgcattgaagacagttttggctttggacatttgactgtgatccccgtgggttgcacagttggagacatgcagtgcacttggtatatggtcttgactttgatgaagctggatctaaattacaaatttgagaatcagctgcacagaggtaagatatgaatgtgggaattagaggtagagagtgaataaaagcaaagagctggggtctgaacagtgggtaattaatcctatgtttagaaagtggtacatgtggtctgtttattctctgtacctctaactctgactgaggataaaaaagggaccagtgagtttttctgcaacgagttatacgattacgtggtgcagtcaatgactacatttcctctatgctgacagattatctttaaattacaataaaaatgatcctatggtcattcccagtttttgcttttcttttctctgtctgtgctaaatgcactttgggctcttgatttactgttagaaatttcctgtgtagtttggggccgagagtcagggggtcaggttttgggatttgaaacccaaacaaatctttccctgcttcctacagtactctcaaattaatttaggggtcagaggatatcctgtgaaaatatcaagaggaacctagacttttgtttctgcggggatctgaaagaaacgcacatttgaagaaacgcatgaagttcattccagggtagtcaaattctactaatgactgagaacatttatgtaccaactatcagaatcaatttctgaaataaatatgtgaaaagataagcatgcttaactttactgaagaagttacagaagatgagatgcagtacaggaaatccaagaacccagatcaaacattaaaacataaacaaaataagaaaattttattttggcccatccaatttaactaatgtttaccaagtgcctactacactttttgtgctttgaccacaaaaaacataaagcgttaccagaatgtggatgggtactctacaaaattagtcatgatttctgttctcagggagtacactaatgtgtgaacttatatataaataacaacaatagcaaagacaacaataaaccaactgtaatgcaatgtaaagtgaaatcagtggtgagctgagtcaaagaagcacagagtatgaggggtgataccattagttctgactagaggatcaagaaggttttctcgggagaggtggcctttgagcgacatccttgaggatagtaatggcaagcacagtagtaggtggtggtggtgacgatgatgatgatggtgaaaagagcagctgccaatcactaaattcttatgatttacctagctctatattgtttgctgaagaacttctatgttattaatattttaactggtaaagcacaggaaggggatttcagataataaaaagaatggaataaacatgtttgtgtgttggtaggtgtagaacggagagtcatttggtgtgttcaaggtccactgtgcatggtgggttgtagtacaaaataagattgaaagaggagtaggaaccagagcagcaaaaagctgccaatgctttatgaattacacaagtcatacgtagagctctctggttacttgtgtggaaagttgaccccactgagctaagcaggatgggcttgtggtgtgtgcatctgtcctctcaaaccgaatgaaatgctctctggcattgcataatcagcagcaaatcttcctcctcaaggcttatgaagaaaagaccttgaacccagtcttctggtggctctagtaaagacagatttggtgacggcctagaagatttcattaacaaaggatggccaatacattacaatcaaagaaaaagctgggcattgctttctcagatgatatggttcttttccactttaattcacatgattcctaaagcatctggctttcctctattttattttaggaattccatatataactaaaataacctacaagcacctcgacattttgctaacaaaaaaaatactttttattatttttgaaatcaactgattccacagtttaaaacacagtggggaaaaaaaagcctattcatgctgtaggtgtctttatgggaaaaaattcagagaattctgatagctctgaaagagataggaaaacagaaaaataatgaccccagggaaagatattatatttttaaaacaagttgaaatatcttcaagatactaattgtggtctctttctttaaagtatgtggtcatttggggaatagggagggaatgcatgtgtgtggcgggagggtttaatcagcttgataaagctcctcggtttattccagttgggctgagtccagttgagattaggaaggaacagaaaggtttctctatagaacaattagtggggtatgaggaatattcagttgtggtttttagttttcataaatctcaagcaaaatgaagaaataacaatgacaaaataaatacaaccaaacattcaaagactcatatctgcatttttacaagattttggagacagcaaaatcatatttgggactcacttctctggaccctgatatacagtatgcttgctctcaaatgtagaattcagatttcttccaaggtccctgggcattctaggagcaaaggcacattcagatgcagggaccagaccagtttcctaagtttccatgcatccatgagttttggtttatagtgaaaaatgttatctttaaaattccagacatttctaggcaagctgttagcatgaaagttgctgtttcttccctttcgaattcaccttgaagcaagcaacagaatatgcagaaaagaggaaaagaaatctttatcaacatgagtgaatagtaaagggtgtcatccacatgctggacagttgggtatttggttagatgtaatgcaaccagtatatagtggaatgagcaaactgttgtaaaaatactgaaatacttttatactggttgtcatacaggtacttcctggagtgtcttgagtgctctcatgctgtccttgatatccaggtggttacctcctttggaaacccttgagtctccccatggaccagcaaatgacaagataatgcttggcagagtatagtgatatctagagtctgacttcagtattacagttaatgttcattctaattgtccgagctgttaaattatagtttaaatgtcagcactcttgatttgacagctgagatggtgtatgagggaagtattattgttatttagtgtttatcttcccaaaacaatatctgcttctttgtgagaactgctttctgcctacatcaaatatgaagttctgatgggggatgacaaatagctcattattcctttggctacagtaattggttggttcagggatggccctttaactcaagccaggccaataaaataatttgttggtgtatttgttattttttaacaggagctgccactgttaggttacaaaatagaggatactggaattctccacaacaatgatcctaccacatgaaggaatttgtctaaaaataaataaataagtaaaggtatacaccaggagaagcagagttagagattccagggaagtcctcagaatgctgagtacctgggtctagttgtttatacagatcccattctgtccccatcctttctgatcctgttatagtttgatttggatatttgttactttcaataaaaaagtctttacataagaagtaaatgagagggaatcctaggagaccccctgtgaatactccaggtggagagggcactggcctccatagagaggcaacatttgttccccatgagcaatgcaaggaagcacagagcatagttcctggtggaagtggtcacacctacccaagacatggacatgggtcctgtgtcccccatctgtgctgagatggagctttcagctgtaactcagatatgacgtcttctgcttcctgactccatatgctaggtatttgggttggtaatctattgtggggttgtgtgggcttttttttttcctgctttaatatctttaatctgtgtggagtttcttctattagtttctgccagaaagatgcagaccaggttttcacaaatcccaacttaaatcctgaatatggagccaatgtcagataacattgtcaaccttattgtgtgctgggtgctgtaatttgcatgcattgcctcatttaatccatgtaaggattttatgaggtagtactgatattccgactattttacagatggagaaacaggtgaggaaaggccacagagctaaaaagtgctggagtcataactggaaccccagctatctgaccccttatttgtattgttacactatgaataaagtttttaaaatatatatatttttaatagagagtagccccaagaaagcactaaacttctggagcttaattttcggggaagcctccattctaaccttgtccattctgttgcattccccgtgagcatccttaatctagtttgagctgggtttttggctattttcaactttcaaccccaaagtgcttggctaaatagagaatggaaggagactttgaaggcttgcatgaatacttaaggcagagaggtgaacaccagctgcaaggcaaaagaagggagatttcttcctgcgagcggctaggcgaggcaagatggcagacctctgagggccttctgcctgtcaggaggtggctgaaataccctgacagctcagaactgtttgcttgaagtaacttcactgtacgaaaataagaacatttgagaaagtatttgatgagtattccaaactcagtaggggagtagaagcagtgaagtaatgggagcaaattatgtatacatgtgttaaaacattacattatatcccataaataggtgccgttgttatgtgtcaattattaaaagaaaaaaaaaaaacca

SEQ ID NO: 761 - DNA, 1711 bp, Homo Sapiens
ctggcctctgtgtgcatgtatgtgtgtttgcatctgtaggtattatttgggattttctatgcataggatcacaccatctgcaaattgagatcattttgttttctgttcaaaaatactttttctcatgtttatttttaaaagataatttggccaggtgtagaattgtaggtgacagtttttctttttttaagttctttattgcaaacttcttgtttgtatgtgaaatcttatgccatccttatatttagtgctctgtatgtaacatgttctttccctttttattccttttaggatttcctttttatcactggttttgatggatttgattaaggcgttccttggtgaagttttcttcatgtttcttgttcttagaataatcatatttctgtaatatttgaagtttatggtttccatggagcttctaaatctttcatccagtatgttttaaatatctttgtctctcttctccactacacgcccttcagggattccatttagccctatactggggcgtttaaagttttgatgccgatggtgtttttatgttttcaagtcatttgttactgtgtgtttcatttatgttagtttcaacttctattccttctagttcaataatcttctcttctgcaatgtttaatccactgccttcttccatttcagactgtaaatcatactttttatctacagaatttgatatttaaaaaatcttcaacctccccatttaattaaaatacaattatactaactgctgtaatgtccttttcttctatttccaacatgtctgtcaatttcaactagattattagattcttcattatgtgtcatgttttcctgcttctttggctgcttgatattcttttatttttatttattttttttgcggggggatagagttttgctctcgttgcccaggctggagtgcaatggtgtgatctcagctcactgcaacctccacctcccaggtacacaagcgattctcctgtctcagcctcccaagtagctcagattacaggcatgcaccatcatgcctggctaatttttttgtatttagtagagatggggtttcaccatgttagtcaggctggtcgtgaactcctgacctcaggtgatccatctggctgcttgatattctaagatttgatgctggaactttggtgtcaatgctcaaaatgcccaaagacaccactcaacctcagtgtctatgcacacccaagcttttgcagcaggacaggtagagcagagatgaatgtgctacaacatgctggtagagggtaccaccaattgtgcttggggatttcctattcctcatggaaaaatgtgtcttccttaatttttcccataagaaccaccctacttcatgccctgtctctctgtccaaacaccaggacagtcctctcaccagtctcaaccacccaatggattgacaaaggtgcaaatatgattcagtggagaaggcattctcttgtcaacaaattgtttagaaacaacttttttttacacaatttgtttttttttatccccaaaggaaaaaaattcacctgaacctcaatactaactcaaaaactaactcaaaatggattatgcaactaaatataaactataaaactagaaaaagtatagcagaaaatataagacaaaatcttcatgacacagagttaggcaaagtgttctttattatcaataaacacaaaccattaaagaaaacattgat

SEQ ID NO: 762 - DNA, 2398 bp, Homo Sapiens
gtgcccgtcttccctgcgacggttttggggtggaacaggagtggctcctcagggggaaatgaaaggaactgaggagctccagtcgtgagaaggccaatgaagcaggcaccgccagttgggaaatggacctccttggatgctgcattgttttctctggcccagctcctgcttggggcctgatgtacaccctggatggtggctacaggtggggcaccctgtgctgctctgcatctccatccagtcccccatctccacccaaaacagctcagttccccagagaagctccctggaaaccgggaggctgacttcttcaccaactgcagaaccacctgaggccacctggcagaatgcgatccaggactgcacgtggcattccgctgccgtgtctcagtgggatccttccatccagaacggctcctccgtctttctcctcctctcataattttgacagttttaaagcatccaggctatttttgtctttcataaccttgacactcttgaagagtactggccaattattttgtagaatgtcctccaacttgagtttgtctagtgctttctcacaatgagaatgaggttttgtgtttttggtgagaacaccacagaagcaggttatacccttccccatgcattatatcaggaggcacatgtgatattgctgcatcccattactggagacgttaactttgagagatgatgtagcaaagatttctccattgtaaaatcctatttttccttctgaacttaatgagtatcttacaaggagctgtcttggagactatgtaaatatcttgtttatcatcatactttcaccaaccaattttggcattcattggtgattcttgtctgcaatattaattaccactgtgttttccaacagatgatttttctactttcataattccttctccatttattaattgtaattcagtggtaaggaagagctgtcccttctctcccaattacttatgcaattatttcagtatagactcatggatatttagtttattctaccagtgataatccatgaccaacatcatttgtatcattgttccaactgtcccaggtatggccaatgtaagcatcttcaagtcaccccttgtgtttgtttgaaatgcccttattctattttgagcacttcctttctgacataagatgttccaggattattttataatttcactgaccccaccctgtacttaatcatttctccaaagaactctgcttcctttattgagggaatgtatttagaatctaagatctgggtgctggatgtcctcattgttactgaggtgtcactgtgtctagggcctctcagcagacagagctagggaatatgggttaccaactctgaaactattttatgggtattctgagattgagcaaataagtaaatacattgtatttagtgggagggaggcatctcactgtcaaagagagaactacaaataaaaagggaagggcaaagtgaaccctattgtgttagattagaatcagaggcatcagcatgagctcctgatttttagtgtatgtacagattgacagatatagaaataaatatgacctggcaattccattcctaggcatatacctagcagaaatccatggtcataaaaaaaaacatggacaagaatgatcatgctgggagtggtggctcacgcctgtaatcccaacactttgggaggctgaggcaagcagattgcttgagtccaggagtttgagaccagcctgggcaacatggcgaaaccctgtctccactaaaaatacaaaaattagctgggtgtggtggtgcatgcctgtagttccagctacttgagaggctgaggtaggaggatggcttgagcctgggagtcagagactgaagggagccaagattgtaccactgcactccaacctggggaacagagtgagaccctgaagaaagaaagagagaaagagagaaagagaaaagaaagaagaaagaaaggaagaaagaaagaaagaaagaaagagaaagaaagaaaaaaagagagaaagaggaagaaaaaaaaagaatgatcataggatcatagctgcactattatcatagtcctaagctgtaaaccacgcaaattcccgttgacaccagactaaagaatgaatgaccgaccactacatgcaacattatggatgaaaatacaattgcggaaagacattttctcaaaaaatgctgtgtgataccatttatataaagcacaaaccaggcaaattaatccatgtcacaagaactcagtatcaattttctgcaagagaaacgagggggtttctgagctgctggtagtgttctgtcatttggtctgggtgctggttgcattggtgtgtctaattcttaaaatgtatatacattattcatcagtaaaaagttttttaaaatattcat

SEQ ID NO: 763 - DNA, 4521 bp, Homo Sapiens
cgcccacagacgtgcggcttgggtgcaaatcctgtttctctgggcagaggccacgcggggacggaggaggcagagaggacgggctgtgatggagaaacgggagaggagccggccaggcgccaccgtcaccaccatcaccaaccaccaccaccatcaccatcactgactgtcgcccatcccagctcccctgcctcacctcccatctcatatccctgtgcagtgccaactttatcagatcatctctttttcactgggtactactttggaaaagcgacagagtgcgccaagtcaggaataagtacatccgctgtgggacatttatcttcccctttctatttagctacctcaattttctcatcaggaaagggggcacaatggcatttcattcctctaaatcacactgagatggctgggttgcttccagtttttccagtcctggcactggacggttatacatgcttggtgatgatgatgataaagtaatgtcttcattaaattggacagttgggagttttcagacttactcttctttgacttctgagtgtcagtataccagtagcaaatagaaacataaggaaagtgaaactttggctaacataataccaagaatagatgcaaaacaggcacttttgtagggacatcacccaagagacctgcaggcaatggtattcatctgcagtgtagaaagcaccccatcagtgccaagtggctgtgggagctcctcaatctggatgcacagtttcccgtggggttttcaccctacctaaagaatgctttaattgctgtttttcaaaattgtctttcaccaggccccagggacggctgaccattcagaacaaacacagggacagagccccagggctgttgggaagcccagcaccagagggcatgaaccttcttaggagaagtaaaacttacaaaaaacaagctcttaaaccctccgccttttcccctattggttagaaagtgaatcttaaactgtgttttatgttctagtctaataaaagacagctagacaagcctacgtttcttgacatgcttggaaaatcatcttcccgaaaagtcatgcagcagggctttttttttttttttttcgactgagtctcactctgcctctcaggctggagtggagtggcatgatctcagctcagtgcaacctctgcctcccgggttcaagtgattctcctgcctcagcctcccgagtagctgggattacaggcgtgggccaccatgcttggctaatttttgtatttttagtagagacagggttttaccatgttggccaggctggtctcgaactcctaacctcaggtgatccgcccgcctcggcctcccgaagagttgggattacaggcgtaagccaccacgcccagccagggctcctttttaatagggctatggagtcccccacctggtggtttttttgccctgtgccctgtttttacaattcaagaaggaaagtgatcatattaaaaataatgtgaacccagctgagctgcatttgtcgttaccatagtttaagatttctcaaatgttgaagtataattatatgtcattaactcaaacctctctaatttgtgaagtagggttttaaatagggtatgtaattctgtggagaatgactccgaaatcattctgaggacctgaagtttaagtaaggcatagtcagtctaaaacaatgacattgtcagaacgaagacttaaagaattatttagctatgtttttaattctggatctttaggaaataattagcatctcaaggaagcttcatgccaatgatagtgtcttagtcttttgggtctgctatcacaaaatgccttagactgggtgattctgaacaagagaaaggtattgctcacagttcttgagtctggcaagtcgtggatccaggtgctgtggattcagtgtctggtgagggctagctctctgcttcatagatggcaccttctatgtgtcctcacatggtacatggggcacacaggctcccttgggcctcttttataagggcactaatcccattcatgacatggggcgttcagaagctaatctcctaaagtcccacctcttgatactgttgccttggggattaggtttcaacgtatgaatctgtggggacaccaacattcagactgtgacaggttggcattgagtaccaagttatatccaacacgcattgttttagcccatacaaattgttatagcctatactaattctatgttaatttaggaacaattcatttgcttttgttgagatatgatttacatacataaaatgcacaactcttcagtggacagcttgatgaatttttgcctatgtgccccctgcaataagatacagcctatttccacaggcctaagggatcccctgatgccctttctagtcagtacccccccaacagagccactatcccttcaatggagccactattggacttctatcaacatagaaaaataatttcttttaaaataatttctaagtaatttattttgcacttcactccattaaatgcaattggcctattccttaaatgcatttggcctattccatttatgaccaaatctgggggccctgagcccagtgctgtgtagacatgagactgtgtagacctgagacatggtattattaatacataaggcaaaaacttccacaagcagaagcaataccctgtatgcagatacagagggttaggggaacccacaagagtctgggtctaacccagttttgttttgtttgtggggggaaagggaaggctttttggaggatgtgaattttaagttgaaaatggaaaactgagtagaagtgatccagctaaaacgtggtaggaggaaaatgaaagcctattctaggtggaaggaacatcttgaattccagcctcagaaataagacagcatggagtgtttgaagagcaaagctaagctgaagatgcttggagtatagggctgtgggagaaaagtgggaaataatgctggaaaggccatagggaccctttcagtttgacacaaaggccctgctgaggggtggggcttggctgtaagagctaggagagctctaggacaggcttgcgtggtgggcatggcaggaggagacttgaggactcagcaggcggccttagggtcgggagattacaggaggcgcaggtggggggccaagtggtcattcaggtaagagacagtggtgacctggactatgcagtggcaacaggaatggggagaaatgaatgaaatggaaagagaattacaaggtaaaatgaacacaaattgatgtttgctaggtgagaattcaaggatagcccttaggtttcttggatcttacaaaatggatggataatggtactcttggagagatgagagaagaatcttgtatatattatatgctcctttggtatgtttctttctgtgtggacttagtttcggttgcaagttagtgtgatgcattcaggtagaaatatctactggggagttgtaactcatactgactgagcacactccatatgccaggcatgctccgtcacttaggatgcagttgtgaacaagacgatgaaaaccctgcctttgtgaaacacaggtgggagctgcagcctggggacccacaaggtttaagtggtgacagaaggcttcagagtgaatgagatggctcagtcagatttcagtgaaagagcagcagcccaggataaaatctcaagaacgctaagagactaagaaggaacaaaggagagatggcaaggaaagcaagagaagttgggcttcacaggcctagggagtgatccctagtgtcatacacaactgtgaagttaagggagatgaggactagagatgatctactgcagtgcttctcaaagtggggtccccagaccagcagcagcagcaccaggagcttgttgcaattgcagtttcttgagatctactccagacctggtgactctgggagctctgagggaagggcctagcaatctatgttttaacaaggtttcccagtgatcctgatgcatgctaatgtttgagcaccacagctctattgtgttaattgataagtcactggtgatgcagcaacttggtgaaaataacttcataaaatttacaccctgtttgggcaaattttaaaaatgtttcgtgggactgttaaagttttattctatttgtttagaaatttcaaatgttttattttcttttgcaataaaaatgttgttattttcttttgtacagtttgggtttttttcccctctttgattattcattgacagttgatccatatttttttcccatctgttcagatttttgaagtttcattcctatctcctttgaaacacatcactttacagggtctcaacatgttagggcacctgcatcattgatattggttcattgcccaaaacagagtgcaatcataaagataagtgagtctcaactctgaatggcagcctgagaaaacacctagatggttaattcagctcttccaaaaagttccaagaccctattagggatatatttctaattatttgagcttgttactcatgagaagt

SEQ ID NO: 764 - DNA, 9836 bp, Homo Sapiens
agtccccaggagaggctggtgcaggaaggctcagacactgtgttctctgacataatttataggcccatggcatatgtggggaactgagaggtctttggtcaacagtcactggggacctgggtcccgccaacaaccacatgattcattttggaagcagatcctcccctacatgagccttcagatgatcacagccacatatgacagcttgatggcaacctcatgagagagacagaactgaaaccaccctgattcctgacccacagaaattggcttctatgaggctgtcttgtaggatgcccatgacgatcctccagacactaagatgagaaaactaaggcccaaagggacacctggctttcctaagacctgtaagtggaagagtcagcatttgaatggagaactcgcagctttcggagtctagacttgttttacctcaccagactgcttctactcctagtgattccttcccttagattaagccttgctctcttcccgtgcaatcatgaagaggattatattagtaaatccctgaacattccctgattggggagtgagggtcaaaccaaggcaaatggcaggattgacactcacatcaagggctggctcattaagggctcgggacctggcgatcgagttgcattgcagattttggaagtatgcaagaccacgccagccacctttccagggagagaccatgcaaagaaggcaggtgatccaagggctgggagtggtgaggactgctccagcccctgagcagctgtcatcccagcacaaagtgtcagaagagacctcaaagtgtggtctgcagacgaggcagcatctgcatcacctgggagcttgttagaaatgcagaatcttctgagagaaccagacctgctgcatcaaaatctgcattttaacaagattgtaacttagatacacagtaacacttaaaaaggatggggcagagaggctaagtcagcagcttctcatcacactccaatctgatgctgctagtgctccaaaaagctctcatatcctcactgactagcctagggctgtgtctatcaatgcattatatgacacagatgaagactattgtgtaccttcctcaatttttaccccattgtttcagccttttgtacatctttaatgcaaacatccatgcgagaattcttgtgacattaattttttggaacaacctgttttgcagagcaaatttcattaagccattttaatccagagtttaattttttatacagctcgactcaatcatttccattttttttccattagaatgtctatttgtagtaacattattttcatgggatcaattattttctgtttaaatttacaacaggcatttgactcatcagtctctttttatataccatctttttgctgattctgacttctgctatttggagaggttttcttgtttgtgtgtttgattcttttgtggccattctttctattaagtgaaaatcgtctggatcaaattttgtagatttaaattttgttattagtgatacctgttttttttccctgtcaattttagctcattacacattctagtcattttaaccctgctagttttgttagttgctgatcacttttaccataccagtaatacgtggtagaaataatcaccagaatgaaaactctgcaaaggcaggatttctgtccctttttttttttgtttttttttttttcctgccttatacttgagacttagtgcatggcacatagaaagtgctccatatggccaggcgcagtgactcacgcctgtaatccttgcactttgggaagccaaggcaggtggatcacttgaggtcaggagtttgagaccagcctggccaacatggtgaaaccccgtctgtactaaaaatacaaaacattagccaggcatggtggcgggcacctgtagtcccagctactcgggaggctgaggcagagaatcacttgaacccaggaggcagaggttgtggtgaggtgaagtcacaccactgcactccagcctgggtgacagagcgaaactccatttaaaaaaaaaagaaagaaagtactccataaatatttgtaggtggaaagaatgatattcacatatgatttaatcaaagactgacagtttatctatttgataaaaagactgtgagaagcagagattgatggagacaggagagaaagtggaggagaagagaagatggagacagcacacacacatgcacagacttgaacatgcagacacacattgcacatgcacatgcatgcacacagccacacacgtatacacaaacacacatgcgtgcacacagccacacgtatacacaaacacatgcgtgcacacaccacacacatatatgtaagcacacatgcatgcacacaggcatacacatatacataaacacgcatgcacacagccacacacatatacacacaagcatgcacatacacagaggcatatatacacatgcactaacatacgcatagtcacagatacacctgtaggtgcaaacacctatatatgtgttcacattcatacacgggagttattatatttgtgctcacacatgtagagggtagaattgtggttattagatgctgggaagagtagaggaagagaagatagggagaggctggttggtggatacaaagttacagctgaatgagagataattttgactgttctgtatactgtaggatgaatatggttaacaataacttagtgtatattttcaaaaagccagaagagaggatcttgaatgttcacagcacaaataaatgataaatgtttgaggtgatggatatgctactctgatttgatcattacacattgtataaatgtattgaaaaatcactctgtatcccataaatatgtataattattatgcatcaactaaaaattaaagaccacacatatatgcacacatagacatgcacatgaacacacatactcatgcatatgtgtatacatgcagagttacacatatacacaaacacacatatatgcacacatagacatgcacatgaacacacagacatactcatgcatatgcgtatacatgcacagttacacatacacacacatatatgcacacatagacatgcacatgaagacactatgcacatgtccacacatgcacacagccacacacatacatatatacacaaatacccataaatatgcacatgtagacagcatgcacacagagatacatatgcacacacacagccacatgtatacacacttgtgcaaatgtatgcacacacagacacacatatgcccatacataggcatatacacgtacagattcagatataaacacatacaaacactcatgtacatatgcaaacacatgtacacacacagtctgctggcatagtgatggctaaaccaatgcagggtagggtaaaatgtctctggtgcaaggtcagtaggataaaatctgcaggatcaaatggaatgcttaacaacactcctctgtggggtatcagtgtctccattttacaaccagtgcttaatcaaatgcacattgagttgaactgaatattggaaaatgaattgctacctttgaatgaatctactgaaaaattatacttgtcctgggtcagaccgtgtgaaaagcactgggtattggagatgaaaagtggttggccctttttctttgaaagcttagtccagtggggaagatggatgtggaagctgagcaattaaaatgcagcttgataaaagctgtgctgaaaaaccctcactgagctgagcagtgggggctgggagggagcaggtcttaaactgaatgatcaggtttagtgggagctgtttaaattctgagccatcaggcatttttgctggattcctttcggtgcgcttgttaatcaattataaaataataataatgaacacttcaggagagaggatggaggttgaaagacagtggagggctggacttgaggttggaagatttgcagagacctggattgtgcattcgacctttacaaattgaagcgagaggctttgcatctctgaacatcaggattccactctataaaaaggagaatgaaagcattcagtttataggtttgctgtgagggctcaacgagaatgtggatccaaaaaagctttggaaaccaaaataccgctagttagcttgctgctttattatccaaaagaggctgcaaagatttgaggtttgtttgtagtttgtttgtagattagtcagtgtctactaaaataacactgtgtaacaaccatgcccaaatcttggtggcttaataccttaaacgttatttttctcattcatgaggctgtaggtgggttggaatttggcagatgtaggctggaattagctggacctgcctccaggaccagggttggacccaagtcttctgtacgtgtcaccttcttttggtgccagtgctacctgggattttaatttcatggttttgcagaagcgtaagagggcatgccaaccacgtgaacacttttaaagcctaacatcctataggccaaagccagccacaggtccaaactcaacttcaataggcagggaaagtcctccacctactttaccaggggagtactgcagagcaatgaccgaggaaggaaatgtttaatcctattagggagggagggggggaccaggaacacaaatccctcaaggcaggacgagtaatggttggctgcccaaggttgacagactgggtctcagttcctggcactgctcctctctagccatgagactttaggcaagtcaacatttcagagcctcagtttcctcatctgtaaagtgggtataataatagaattctcacagaatttcagtgaggattgcctgattcatgacaacagccttataagtggtccccttcttttacctcgcatcttctgtaatctcttctctatgcttcatcctttaaatacaaaagtcacccgtaaagacagaaaacagattagtggtggccagaggtggtggagggagagagggggagaaatgagagaagtgctaaggggtatgaggtttccttttggggcgatgaaaatgttctaaaatcgatgtggttatggttgtacaactgcaaatatacaatccctctgcctggaaccttttccccaagaaatctgcccccaccgtaaatcctcacttgcatactgtataatgaggcttttctggaccaccctatttaattacccactcctttctgtccatgcctctctctcgatatattttctctgaatgtttgtagcaacttgacatattttgcatgcttatacactatgtactttatattaaagcacagttatgtaatttatttctctggtcctttcacctcctttcctccctccctgaaatatgccagtagaatgtaaccttcaggaaggcaaggatatttaccttctgggtttgctgctgtctccctagacagctcctggcacacagtaagccttttaaaaatatttgttgaatgcatgatataagccatataatgcttagtaggtgctcagggctgaggaacataattgatgttagcttttattatctttatttacttcaaataacctacttaattgggaaattttccgggtctggagggactctgagtttgagtccagtatcttccctgggagtccttgcttgcacaaatgtgtgggatagactcccgctgtgtctgtggactcaacgtctcagctccaggctctttgctgccaggcatagtgagccgtgacatttataaatctctgggctcttaatcccctgctgatcctcggagaggagtagacatttgttgctaaacacattgccccactttgaacaaagaaacgaagagataccccaagcatcaatacaacagctgcctgcgatggctgtgacgtcccttctatcctaaggaggagggtactgggactcagtcctgtgcactgacctgccccactcacctggctggtgaggggtgcagttactacctttggaacacatatcattgggtttttgtattgcattcttctgtctctgagcagatctgtttgtttaatggtctcttcctcacattcagctcaagcctgtaaatccttcgtataaattctgcctgctccttgataccaatctgttctcctccaagtaaatcttttaaagacaatactccagcagcaccgggagaacatttcctgcaaaatcatgcccggaagcccctgttagcatgcaaatatgcccctttgcagcatgttctgattgtaactcgtgatgcacagtgcagagaattaagccgggtcccttcctcatcagtcaccatttaatggagactgaatggttgtggatacttttgttagggtcatcaagaaggtttgccatgcttggcttggtaaggaggaggttgtgtgctcctgtaagacaaacctagcactttataggctcccaaaagcccatggtagttacaggagccatgaaaaacaaacatgtagacattcagtagtggtctcaggaacccctattggcaaactcaccatttatggaaagacctggagggcagtgtctttggccatgacatgaaacagcccagtaagctgcaaaggccagattgaagagagctgttgaaaattcatttgcttgctataggctggctttttatttcattttattttatttgtttatttattatgttttttagcaaaccatctgaaatgggatgagagagccatatttgggcataccacctattggaccagcagttctacagaggcgagggtccattttttgttttgcagaagcctctctgtcagcagttctcaaaaggaaaggagtttatttatcttcagttcagcaaaatttactaagtgctgacaatgggctaaggggatagagacgaagaaggagattcttgccctccagaaatttacagcccaacataatgtaaacacttttctatacaacacttgcaaatagtaattgtgtggaaattcaaatggtggacttacatgttatcagactctgtgtgtgtgcatatgtgcatgtgtgtgtaggtcactccctaaagaatgacaaatatgctaagattttagttactccttgctttttttgtcccccctcctcgttttttaacctttattgaagtatcattcacataccgcagactgcaaccacttcaagtgtaaagctcagtgactattaatatatttacagagttgtgcaaccataactgcaatcttattttaagtaatttctacctccccagaaagaagccttgtgcccatttgaagtccctctccttcctaaccccagcctgaggcaactactaatctattttctgtctccatggattttccttttctgcacattttatgtaatgaaatcatgccatatgtgggtttttgtgcctggtttctttcacttagcataatgttttttgcagtttatccattagacacactcggaagcagtatttccagtatcagtctatgctctcattttgtccttttccttttacaattgaaggcgcaattaactggcctaaattcgatgaagttaaaggttggccatttgtggcgtgcttactcaattcaatctcggctgagatttgatcccttattattacattagtgctttttacttttctgttttcagttactttttataaaatagtaagagtggaagataatgaaacggctaaataaatcttatcgagagatagtgaaggtgctggagcttcctcactgagcaaacagaactacagtaaaatgataactcatgaaaaaattaaagttggacatatgcattggatttaggggcaccagcgcacaatgtgtgaaagtgcagcttgctcaaaacttgaaggtgtgaatgtcagagactacctgtgaatctcgtcatcattgtcatcattctcataacgataatagcaattcccttttctgagtgcatggtatgtgctattcagttcccacacatttcctcattgaatcctcacaactgctattggaggaatatattatttttattattattttcattttacagatggagacaatgagtcccagtaaatttaaagacacatgcctaagactgagaacccaaaatatctgagacaggtctcagtcaatttagaaacgtttattttgccaaggttaaggacgtggtcggcacatagcccagggaggtcccgatgacatgtgcccaaggtgggcagggcacagcttggttttatacattttagggacacatgagacattaatccatatgtgtaagaagtacattggttcagtccaacgtggaacaactccaggtagggaggggcttccaggtcatggatagacaagagacaaaaggttgcattcttttgagtccttgatcagccgtccactgaacacagtgttcattcctgggcataggccgaactaactttgggaaggaattcagttcatggtttgactctgaaacaaaattgataataaccctttcccaaaaagaccctcttcttgctcggggaccagtctgcctttgcaagactaacaagttagctacaagattagaaattacagtttaggggtcatgcagcctctggctccaagagtctgaacctcctcaaattgctcctggggataacatcactattgtaaaacctaagatcagtgcttgagatattttgcagaccgtgcactccatggatcagctgacaccatgcagaccagtaatctggctcaatcagttctgccgtctcatccaggaacagcaagaaaacctcacttcaaccccctaggactccatctccaacctgaccaatcagcactcctcacttcccgagcccataccccccaaatccccgaatgcttggggagactgatttgagtaataataattaaactcctgtctcccgcacagctggctctgtgtgaattactctttctctattgcaattccccttccttgataaattggctctgtctagacagtgggcaaagtgaacctgttgggcagttagaaaaggagcctgagagatgggttgagggcgggtagagaaagtaatgactgtgatcagaccccgctgagagatttgccattgtcatgaaggtaagagggagacgttgaggaattttaagtgcagatgtgatgtgaacagatttgagttttacaaaagtgaattcctggtggtaataacggtgccttggatcaaagttctcaattccaagtagcaggtgagcatctcagaaaagatacaaagcttcggaccaaggtttcctctcttctcttcagcaggaatcacagtttggggaactaaacttgccaaggagaacttcaggtttctagaatccgaggctgatgaagaaagaatgttggggcagattttgacaggggtctaagctttgcctaatcacactgcccgaatgagcagccactgctgatgaattctcattttcttaactggcaaagccttcttggcacaaaaaaagtgtttatggtttttcttaaaaaagcgtttagtgcctctgagttgagaaggctggtgtactgagatgtggcatctcttttcttgtaaaagttaaggggcttttttcagtcactttatagtttgttttattgatggagaaagggaaagtgataaaatattcttgtcttctaaaatttctgtcctttggcaacaaggatgagaaggtatatgtcccggtaaatttttgggttacaaaataatcccttctcttagtgctctactgactgagttaccacagtgcttcccatacactgtcgcctcaggcaagttgtttaatttttccaggcctcagttgcttagtctgtgaaatgggaatatgaacaccaataccacctacttcttagaagtattatgaggattaggtatctaatatttgtaaa

SEQ ID NO: 765 - DNA, 2300 bp, Homo Sapiens
cacagactatccatacccatgagattttctggcttagaatcattccattggtctattaaatctgttttcttgcttgaggcagtatctttgagaaggcgattctattttagtcctcatacattatacatgataagtataaaaggaattcatttttttctgatagaaaagagacttttacctttagaaacgagaatcataacttaagttgtggtaaaaaacaaaaactcaacttgtcttatttaaatgcttttgggtttaattgtggaagacagtgtggcgattccccaaggatctagaactagaaataccatttgacccagtcatcccattactgggtatatacccaaaggaatataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaatgatgagttcatgtcctttgtagggacatgaatgaagctggaaaccatcattctcagcaaactattgcaaggacagaaaacgaaacactgcatgttctcactcataggtgggaattgaacaatgagaacacttggacacaggaaggggaacatcacacaccagggcctgttgtggggtggggggaggggggagggatagcattaggagatagacctaatataaatgacaagttaaggggtgcagcacaccaacatgacacatgtatacatatgtaacaaacctgtacgttgtgcacatgtaccctagaacttaaagtataaataataaaaataaaataaaataaatgcttttgggtttaagtgaatgaagtcatgaagaaagtgagtaaaaatctactgctagcacctagcagtaattcaactttgtgaatttaagaaaagcaccctcttcgggcaaattgacaaaaggtgaccctactggacatgacaatggacataggcaactctcagatgaattagaaaagagtgccccttcctatgagctgccagagctagagacctggccccaggagtggaggcagaattcagccccaccccttccttcctcctcaaactcattatctcatggcaggggcccaaataacacattttatccccctgtgcaaaacaaagtctatttcttagaattcagccttcttagaaggtcaataatgggaaatgcagggctgtgtaaataattacatcttcttcctaccataacatcataactagcacaattataaaagacagataggaaaataataatagtcatgaaaatgataataatgtactttgaagaggaggaacaggtaaggaatggcatcaaaggctggaggctgagtaaacttcataaggaaaagttcttggctgatggccacccagcttcaatattctgccagggtgccacttgcataatttaagagaactgatccttttccctcacctctattgccacttgtccacacatttataataatagattacacctgggcagagcttgtattgtacagtgccaagtactgtatatatatactcacatcaactgtgaagctgctctctccactttacagacaaggaaagtgagacagagagaggttaaataaacagcccaagattgtagctgatgtattaatccacagctaaatgggtctccttaaagatctggaaagctgctgacaagaagcaccgtcaaagatgaggtcaaaaaggaaactccttttcagtgatccagtacaggacattctttttaggcatggaaccctgggatctgtcataagttatgaaactttgaacaaaccattccacttccacttcctcatctttgaaaggaaggcattggatggcatgttcacttccagctctaaaatgctgttcctctaatttacatgcaaaatagcatgtagacagcctttagggccatctgaatgtaaataccacatctacctttttgaagccatggggcctagctaaaactcaatttactcatctataaaatgagaataataataatatctaccccttagggttattgagaatattaaataagagaataaatgttaaagcctttagcatatcatttagctttggctatgtgactagtacatagtaagtgttcaagaaattttcctttatcactatcatcatcatcatcatcaccctgtgtgtaggtgctacttgcgaaggtgctccaattttaattccctgcagatgcaataaagagttggcaaattcccagctgggcgcggtggc

SEQ ID NO: 766 - DNA, 1772 bp, Homo Sapiens
ctctggaccagacgccgcctgcacgggtggggacgctggtcgctgccgggggcaagtctgccgactccagaaagaaaggcgaaagaatgtgtgtagacccgggcatccttggtcgtcagcatgtttgctttatttaattacagatgttcaggctgctgtcaacacccgacaattttttttggtcatttcattccctagagattgtgaagctaagtgctgtgagggaaaccagaggcagctgagatgtcgtggaagtaacagcgaatgaagccaggatgctggattctgaccttggaactgttctgagtaaatcacttttctcagtaaatcttctggagttgtttccttatctgtaaaatgggataacgatgtttcccttacaatttaatggaggagttaatataactaatagaatgtctgagaaaagcctttgtgaactgtaacgcatcctgcaaatgcttaatattcccttataaaaacgagaggcttggttaacatgatctccagaattttagcttagctctacattcagtgtttctgtgaatgagttcaggtccttacttccaaggaatttgtaatctacagtggttggaggaatataacatacagactagtcactaaaattcaaagcagtgtaataactgtataaatgaaaagctataaatgcttagagacaggagaaatttgatgggggaggatctgtgaggaagatgaatttttaacctaggatttaaagaatgtgtagattcccaacaggctaaaagatggagagaggatggataaaagtaaatgaaacaattacatgttttttcattgtcaagttggcagagatgaaaaagttcaacagcctttggttggtcaagatttggaaaaacaggctgggtgcaatggcttatgcctgtaatcctagcgctttgggaggccgaggcaggaggattgcttgaggccaggagttcaagaccaacctgggtcttgctatcaagaccccatctctgtttttaaaaatataaagagatttggaaaaatggacactcaaagtcaatattggtaagagtataattggtacaaacctttaggaggacaatttgacagttactaaaatgtacataatctagttctggcccagtaatccactatgaggaatttatcgtacagatctgtgcaagtatgcaaagaaaaatgtacaaggatgtttactgcaatactgctttttttttttttttttttgagacagtctcgctctgtcgcccaggctggagtgcagtggcgcaatctcagctcactgcaacctccgcctcccgtgttcaagcgattctcctgcctcagcctcctgagtagctgggactacaggcacgtgccatcacacctggctaattttttgtagttttagtagagacggagttgcactgtgttagccaggctggtcttgatctgctgacctcgtgatcctcccgcctgggcctcccaaagtgctgggattacaggcgtgagccactgcacccggctttttttttttttttttctgacagagtctctctcatgtcacccgggctgtagtgcaatggcgtgatcttggctcactgcaacctccatctcccgggttcaagcaattctcctgcctcaggctcccaagtagctgggattacaggcacctgccaccacgcccggctaattattttttattgtatttttaacagagatggggtttcaccatgttggtcaagctggtttcaaactcctgacttcaggtcatccacctgcctcagcctccc

SEQ ID NO: 767 - DNA, 3602 bp, Homo Sapiens
acacgccgggcgccctgcgctccgagcgctgagaaagaaatccgccccgagatgcacctgcagccccgcgcccatccgtgcgtggctgcggctgtgcgtgcccgcgaacggggaccagcggccgccgagtccgtccacatcgccaggccaggagtcagaacaaggacgggcctgtgatgtgtctgtctatgacgaggaggacaatgtcctaaggaatggagaggaagaaagtgaagggaaccaggtccctggattccatgtggaacagtagcccaggatgtgcactatggactgttacaagagagagacatgatcttccttaaggcattgatttgtcatgagtctctttgttatagccacttaacgttaccttaatacacccacttcatggataagtaaaactgaggcttggagaagcccacattgacacagcaaagaaggctggggctcttgtgctggttaaatggaccttgatgtcttccaaatgttttcatgctggattctgagccactctcctggctgcaactctgaggccgggcagactttccgctggaaagagaactcaaatactggtcctggggacaggaggaggcagtgctggggtcttctcacctgagccgcagaaagaggacaaaggccaccaggagggccaccagggagatacagtggcccaggtagttgatgatgactgcgacatggtagtgcaccttgctttttttctggagcaggagagaggggcagagagccaccaaggagctactggccaccaaggagctactccataggccttcctgttggaattacagaacccacttgaaaccagagatcaagtccagccctatccaccaggcatcccaggagaagccaagaccctatgcccagttccgcccggccaccaaggcccttctgaaggagcaccctcattggggaacctctccagaggctgctacagaagctctgttcttggagctggtttccaggcagaggctttctggaacatggcagctgcccttggagactgctcctctcatcccagttctttccgtagaagagactgaataattggccacgccacgcagccggtatctggaacctgggtctgcctggctttaagctccctcttttccctgtttcccagggacatttctttttttgggtgggggagggatggagtctcactctgtcgcccagtctggagtggtgcagtggcaggatctcagctcactgcagcctctgcttcctgggttcaagtgattctcctgcctcagcctcccgagtagctgggatcacaggcatgcaccaccatgcccagctaatattttgtattttttggtagagatggggttttgccatgttgcccaggctggtctcgaactcctgagctcaggcaatccacctgtctcggcctcccaaagtgctgggattacaggcgtgagccaccgtgtccggccccctgcgacatttcttgggggacaagcaggaattgaaagcagaggcactctctggggtggtctcacgccactttgggcccaggagcctcgggggacctcctgctgggacaatagcgcccaagagggctttcctccaagagcctgagggagaatcaggccaaaccattcccgggggacaaagtctcagtgtgcctccctgagcagtcgggcctgggccgggttcaagccctgtctctcatcggccacatcagcatcatgcaacctgagaagacagctggagagacagcctgagggatggctgctgataccctgagacaaatacatcctgcgacacccagacagaagccagtgacactgtgacatttccaataacaaccagagttctggccagcattatttagagagacagcaaggccttaagaggcacccaggaacaccctgagaggtggccagtgatacctggagaggagagtcagcagcacccccagggacagccagtgacaccccgaccgatggccacgataacagcaaagcagctgggatgtccgaaggacaaatgggcacagctacccctcgggccctgaccagcactccatctccatccagtctggagacctaagaccagcaggcaccccgccctaaggagggtggcacagcgtggtacttggcagaggccactccgctgtaccctcagtgatctgaattgaataagcaatttgtgcccggctgactctgactggactctctgcaggacaccacctcgtcccaggcgctgcagtgccagatccgtcctgatgcctctctgggttggtggcaatgagacctcccttccaagctccccactggtgcccactccattctggcacgtcctctccaccgaggcttccagagctactcctcttaccctgcagtgggcactcactccagcccctcgatcctcaaagggtggcccctggcccagcaacagcacgcagaggagcacgcagagatcttgaggaaagtggaatgtatgccctacgccaggcccatggaatcggagcttggttttaggaaaaagcacctctgcagttcagaagccctggtccaaccaccactcacctctccccacacgctagcactgatgctcagcttgggagagtccccagagcccccaggggtcagggaccgcactggccttcggcagagccacagctggacagccatccttcaacacggtccctcgcccttctgctgagccccaaggcagtcctgtcactggctgtgtggctttcggtgagtcacctgactcctctgagactcaacatcctcatctgtgaagtgggggcaatgtggtctttcttacccacttcactgggagatggaccatttgtggggaaccaggagacctgcatctgcaatataaagtccctacaagcatcggcagggtcatcagcccagcttggctgttctgggccccagaatgcacctccactgcagagggctggcctggagcagctttcctgatgtcccttccgggccctgggggaggccccgcaggctggacctggcctctcctcatcttccgccaggtccttctgccttctcaggaagccttgctttgggaaggagtttttccatttaaaaggctgcctgcggagggcctcagacactgggttgagatggatccagtcggcctggagcaccatggcaggttcctgagcagtgaattatcccagcttgtcaccctcatcatcccagcgagacagccgacagtcacctgttccacggaggcggttcagcaggtcagagtgaaaccaggccttgttgccttccctggcctgggagactctggcggaccctgactcggggcccagagaagcccttgactctccagtgtggccaagatcgaagatgtacctggtgaccccagaggcaagggccccagcccacactttccatctgctggccaaggtcctgggtcctggggtcctgcaggctccacaatcccaatatccgacccttctgactctgctttgctttgcactgtgttcaggtggagcctattttaagcaaaggcaagagaagaaaatctaaacgcgaaaaagaaatgaggtcataaatgaagatttctgtaaaaagctgggtccgccgttgcatttaaatactgggatc

SEQ ID NO: 768 - DNA, 10783 bp, Homo Sapiens
gcacttgcacaacagggaaacaggagtgtcatcaaaagtaaattccagccgagacattctctcctatatgagaagcaaaagtttctggtcctcataccgtgtggttgagtgaaatcaaaacttccacgatagcaatgctgattggacaaagaatgtgttgtggacacaaaaccaaactctggaggacagaggattcattccaagggtctgcttgtattcaatgactggtctacgtgggggtgtgaagtccccttactccacctgtgaagagtcttcccagtttcagaccaccctcccagcctcctgttattggctaaggccattttgtgactacactgcaggtagagatggattcctggaaatacctcctcaaggccagtgtagagccctcaatcacccactgcccccagcttctccttctcccatctcctgcaccaagcaggtctccaggtgttccagctgctgatgacgtaaagtgtggagttggtccaggaaggtcatgttccatgcagcagaggagcgctttgtgtgagaagttgaagacctgctgtaacacatcatagaggaaagacatagcctgggccttctgcaactggctgacttccaccttctcctgggggaatctgaagtcacttctgtcctttagacacaagaagggagagattctcctcatttggcccaaaagcaccaaggtgttcctgcctagcaggccatggttctgaggcaggttatatcctagagatccagaagagccacagctgcacacctctagggctgccagtagagggaagaggagggccattgagaaatcaggatgcttttggcctggttgagctgaggtcttcatagaaccttggatcctaggttctatgaagacattctatctatgcatggctttaatggagcacaaatagttttcatttttctgagcatttctctaaatttttaattccatttattgttttcatttacatgtcttctatatcagcatccacaaccttttggccaccagtttggtggaagataatttttccacgaaaaatggggtcagggagggaatgctttcagaggcattagattctcattaggagaccacaacctagatccttcgcatctgcacttcacaatagggttcctgctcttttgagaatccaatgccactgctgatctgacaggaggcagagctcaggcgttaatgcttgttggttggcctgcttgcctcctgctgtgcggccctgttcctaccaggccaggaccagtaccccggtccatggatgggggttgaaaaaccttgttctatatgacctaaaaggaggtcatcactctacactcttgatttttgcaatggatgttcaatattcccagtaaacttaagatatatcaatccaaatgaatattgatcaatcagatgagaaacatctttgtgctactgttagaagtatatacttttagcccagatcctagcctccagttttaccctccattttgcataggaaatcaggatccctgggccctatgggtttctgtattcagttaggaaattacctatctctggaaattaaactttttaggactatctttgtttgatatttgattcacagaagacgttgatggttattagtgaaagaacttctctggtgcttccctccttctagaatatattcattcaggttcatgtggttatgcttccctgggggctcaagcttagatcaatgaacattgccttttttgcattattttcttactggagaaatatagcactcctcaggctgcgccaatacccctaaaagaaattctgttggtttgtttttttttcttttttaagatgcatatgggtgtggaaattttaatcttaaaataatgttatttcctcagcagtgatgattcacaaggtatttatcacatcaagtcactccctaaatgcaggctcaccacatcctgatgactttagaactccttttccagggaggttcttgcttctttgttgccaaaacaataaatcctttgtgacctttgtccttgctcctagaatatttgggtgaaggagtatatgctgtcagtggtgacctcctcttcttctgacccatgccctaggtatcaaagtctcaacagccctagaacgctgataacaaaggtttgttttgtctaagtaggtaaaggaattatccaattgtaatcattttatcttcagtagttaaataatttttatttcaccaagtacagcttttattctttctttaactcttttgctatctttaattcttttaaactattaacagtttttatgcttaaaatttatgagctatgcacaggagagtcaaagatgctgctgcctctctttagaggctcatattacagaaactggcgaccctcagttgttcactagttcagtgtgatctgttgaagtttcttacatctctgtctacatgaaactttgacggtgcagggcagtgagccccatgctatcacattaaatagtcatagccatctttcctttactgatttgtgattcttcattttaaatttaaagctcaacaacaaatgaatttttagaacacctttttaacatagtggtttactgggcagtttgtcttgctgctaccacattatattctaattcatgatgaagtaacacaaacaaaggaaagtaaaagaaaggcaaaagagctacactgcttttctctataatttccaaaattcgtgtttttcttgtttctcatttaaacttttgtagaaagtactacttgacagttgtttgtagggagaaagaaaacagaagcaattctgattgtcatgaaattgaaataaggggagtgactttccccttactaactgcaaagtgtaagttagcaaacttcaatgcagcaaaaattggggactagagagttttcgaagatcagctacttgactttctttcacttaatccacatgtgatcagctctggagagaaggcagaagtcacaccaaccaactcccaaaagattgacaaccaggctgcagttgctagaacaccaacaatgctctctggcagggtgttagacattaagcttgtctgaagactctacctagttaataaatccacccaggcaatgataagataggcttgaggaacctggaattaatagaaatagaattggatgatcccaaaagtttctattttaatctggatgatgataataataatactaatattaaaaatgataacaccaacatttattgcatgcctaataggaaccatccactgttttaagattttcttttttgagacagggtcttactgtgtcacctaggctgcagtacagtggtgcgatcacggttcactgcaatctgaccttctgggctcaagcagtccttttacctcagtctcttgagtaactgggaccacaagcatgcacgaccatgcttggctaatttttcaaattttttgtagagacagggtttcaacatgtgcccagcctggtctggtgctcctgggctcaagcgatcatcctgcctcagtgttccaaagtgctgggattacaggcatcagccaccatgccaggctgttttaagatatttttaaaatactaactctgtcttctcagtaacactatttggattacacccttttatacaactgtttggagagaaatataaatctggagggatgaactattctgaccacaccaattgtgcaaggtgaaaactttagggagaatcaatataatggcttttctggaagggtcctttaaaggaagtgggggatagatatgaacatagaaagtaaagaagaggacatcaaatcaatggagcagggagagtgagatgactaggattctgagatgcattttgaatgtcaaatggttgctgtctattgctttacagagcaacagggggtgtagtgtaaatgaattgaactgactgccttaagttcagtggaaaagtagatgaaatacattccttttttttttttttttttttttttttgagagagagtcttgctttgtcacccaaactggagtgcagtggcgcaatttcagctaactgcaacctccacctcctgggttcaagtgattctcgtgccttagcctctggagtagctgggactatcagtgcacaccactatgcccggctaacttttgtatttctagtaaagacagggcttcaccatgttggccaggctggtcttgaacccctggccctaaatgatccgcctgcctcagcctcccaaagtgccaggattacaggtgtgagcctctgcacccagccaatgaaatatcttttaagtagtaaaatgaagtagatttgtctgccaattaaaaaaataaatcataacatttaattagtgatttcttcaaaaatatactaaaacaactctattaacctatcaactgcaaactcctagaagccaatttattttttactcttgagttttcttgtgtatttaagaataaagagaaaacaactaataatttctgggacagcccagccatatggactctgactttctcctccttcaggactcacaggtcagcctgctgctcttattgccaaggagaaggatatttctatccccagcccattcaggacttaatcttgtgtactgattgtgtccagtgaagaatctcttcccctctttctctttcggtccattggttgagttgtgagtgctgaaaagatcattcatatgaccaagattgtgatgcttagatgtttatccccagcaaacatgtaaactatagaaatctcagttgtctccaccaaacatctaaactgtatagcatctaagcagcctgaggctttcaccagatgcccagtcttccagccagcagcattgtgagccaaataaacatttttttctttataaattactcagcctcaggtactccttgttagtgaaaaggaacccaggttcagctgctcatctctcgaaaaccaaactcaagagaagagagatgttgagggggaagcagattcattaggaaagcctgcaaactgagaagacggtagactagtatcttcaaataccatcttaaggcagtacaaatttcaggctctttttatgttaagggcaggcagaagaggaggggggtcaggataaataggtgaccatcaatagcagacaactgggcaccagcacaggaccaaggaatttgaaaaattctttgttctttgtcaggtcacaatgctcctatgaatctttaaggtaacctagttagttgtttacattcttctcctttaatcccagagttagttttaaaaattacatgattgctgtttttgcacattatctctgctctaaaatcatcccaacctacgtgcaagaatgggtgtaggccccgtaaacaaaatggagttagttatgttaggtattttgctgtctcactgctacaattgcaacacaaaatgaatgcttttaaagggctgcttgccaaggaagatctggctttaactacagattcagccacattgcttagtatggttgtctttggctgtctatggttggcattacaatagatgatattttccagtcatagtaatagaaggttttatcaaaaaataaatgtttacaaagtgaaaattgtaaggaacacctcttacaaccaagcagttccaaaacaaacagaaacaaatatggtgggcgcactgagcactttcatgcattgttgtgcatctatataagtgtcatatgctttatgaatttttgttttgcaatcatttgtactccttcattcatttattcattttccaatccacttattccgtttcagggtcaagggtggcaggaacctatcctcacagatcagggtgtaaggtggaaaaccccactgcacaggaagctatttaatcacagggcacattcaaacacacacacacactcactcactgagactggagaaatttagacaaaccaattaacttaacatgcacatatttgggatgcaggaggaaactgaagtacctggagaaaactcatgcaggcatggggagaactccacacagacaaggccctggtgggcactcagtttcttctctcatcagtgttacaaggaaatgacatagaatgaaatgtcattattgggaggtcttcctgtgacccttctgttcaagaattgtcttcgtattgttggtctttaaaggaggctgcatcgtgagcagaatttaagagatcccttgtactgcattgtccccatgaataattttccctgcactgtgatgacttgctgggttctagggagaaatcaaaagtttgcatctgggaacggactaacccccatccttcccaatattctgcaggctgctgtggtgtcagtgttaccgatgccatggacactgatgttggccacagctcaacagaactctgtgttctcagaatccacttcatcttctctccttctgataagaatgatctgaacagttgacttaatggtgctcgttggtattattccatctgctgagtacctgacactgatgtctatgctttaaacatctctgtcctccttccacgttctcaggctgctgctggcttttccagcttattccagtgcatgatgtgtgctttcattgtttgaacaaatgagagtcctgtgcctggtgcagtctcttcctgaaggagtcagaacgtggaagcttctaaacagagtcacagatgagctcctgcattctttatcagctcaatggacatagaggtataggcaggactcccttcatttactgcattttgatgccagactggacatcagtgggtctacacccctacagctcatgactcacccggcaggaagggtggaagtaaggccacacgcacactcctgcttctgaggcttgaaaaacaggactatctccagagggtgctgcatggtgatacctcgccatgtctctctgggcaccaggcactgatccctgcctccccacaccttttctcaggtggactagatgttcctgggtggaggtgggcctgggagcagtaaaacctgtctcctcagtgggacgagggcagggccagcggcccagcactcagtgcccccaccactccccctgcctaggtgcctccaaacctgctactgggttccccaatactgtagattatatataacaagttgaaaactgtgagatatgaaatgagatatggctatagagatttttcaggggagggtgacaatatgaagccaaatcagaacttttacatataaatatggtaaaaagtataatataaatgtaaggaaaaaattacattaaaatgtaagcagttacccaagaatggaaggggttctaatatttgaaaggctaattaggcaatcacaaaagacagaaccaagtgaattaaaaaatgttgatgttgtcctgacgctaaactggttccctacaattggtggaggaggaaaggaaaaatggtttaacatgtaaattagggccctctaacccacgaatagaagagaaacaatctaatggttgggtttctaacctgagtcagagttgagagatccctgctaaattgaatgcctgcctggctgcctgagcaactgaccatgattacttctttaattgcaatattgccaagatgcctctcaattctaccctgttgacacctgtggcagtcactatattctctgaagttactttatgttagtgctctctaaaactattgaatccagatggaactgatgcaagctcattccttattcaaagggaaagtaagaattttctcaattataaagtcgaggggcatgatctgataggaggagtaaattagtaaaactgacaacttacgctaaagagttaatgtaccttcaatcaggacagttttcctgatttcccttgaagtgccacagtcagatggggtggctctcacttccacgtgacctgcagtaagtagagtgagggacgagtcaggaggtcctgggaggctgcataggctggaggcaagggacacctcctgcccctttctctccccagagctgcccattgtccaaagaggacatgtcctgcctgaagctgggagtatatcccctctctaagacatgaaatttaaagaaatgggctcattccagtgtttgggtcagttctttccaggaaatttcctccttttagctctgaagaaaaagctggtggaaggcgacagacttatacagagaacagacttgcccactgtctctggtcttggcaggtaggtggctctctcacagtgtgaagttacccttgataccccaaaagccaaagagatcagggaactcaaggcaagggagagcagagctccagatgcaagaaggacccacccatgactcttggggttcctgaggaagacagaggactccatgtagtgggggggtctgtggcaccttttttttttttcattcttcaaggaatcccaggctttctagaagtcttctctacatccctttatgtggtagccagaactctgatgtttctgcttagtaattttccaaccactgaccactaaatgcagaggcaggggcttgtcgatgataagagagacctagatggaagattgaaggtggcagaaggaaggagggacagaagtaaatggaagaaaaagtcttagaggagccagactgggtaggtcttaagcttcccaaaaaggccaatgaagttttactcttttttttttttttttttttaaccggtaaaaatcctgcctacaagaaaggaagcaaacagaggaatcaagtttataataaaaaaagtttaagtttactgaaaaaaattcccatgggataaacaagaacctaaggagaaaatcagaaagactcttaaaaaaatggtagcctggatatcagctttaaattaagctattatttgaccacagagctcttttaaaaaaatacttttaaatcccttatcagatttcagcaagaaaaaacaaccaatatttctaatgtttgaaactttcttttttttctcttcttttaaaacaacgatacctaccaagcgactcagaaccaaaaccaagtcttttgtgacttaaccaaggatacatgagacatcattaaagaaatgtaaagatgcagccctctcaaaattcagagctacccccacaaatagccaaaagaaagaaagatttagatgccttgagagctggcaataggcaatatgtaagcttttaatgggagcctccaacatttgtttagcccccttcacacaccaaagtgtgtcctgacaggcagcaagccaagttgggttctcaggacacaaaacaggaaaatgacagctgttcgttgaagggaaaggatcaataacaaatgagtccctgaaatccaaatttacataagagaacagttcaaacaaatgatctcctgctgacctgcatttggaaagtaagatataaagataaatttttacctttagttcttgaccagaaactacaggcagagattcagaactcaccttggtaaaaattcttacctttatttgccagctctttatcagttgtcccaggacctcatcaataggtgagtcaggtgcttcagacatcccatcttcatcatcagaactataagggcagaaatagtgtgatctctttccttcctatcaaaagggtcacagctgacacggctataataaggcaggttaacaagcgagaagcatagcacgtttatttaatcatcgttttatataactatggaagccttcaaaatgaagacccaaagtacaggaaaaaactatccatttttatgcttacattccatgaggaatgggcagctgtgcagaaatgtgattagacaaaaagggcatcatctaatgctaatattctgagtaggggaaacccagcaaggcctttctggtcagatacttcttggcctctccatgcaccattccttcctcttgggtatgtggcagagctctttttggaatgggggtcttagtatctacaatcaaacaaggcaggtcagagaatttctttatggccagttcagttcttacacacaaaggtaagggaaagttcaagtaatgtttataggtttttatggctggctttggagagaaagggctctggtttctattaccagccttgggaaagagagtttctactttttatggctagcctcgggagatgaggggtgacaaacaggagggcaggagaaggccagagagaaactttgcttctgaggctgcttcttagatcttcactttggcgtattattttccgagcttcaataggagtgaagaatgagatccagaaaagctggggaagaaggagagaactgtgctgggtattggaatcagcaaatgaatagtatgtctatgtctatttcacttaggtttaagaaaataaactcttccagatttttctgtaagatactgtttcctgactgaatatacaaatgagacttatcttcagtatgaagggtgacttatttttcagttttctccagaatactccaagaattctgctttttatattatatgtgttacagagatttaggagagtattctcttttctgttctttctttcttttttttttttttttttgatggagtctcgctctgtcacccaggctggagtgcagtggcgccatctcagttcactgcaacctctggctccagggttcaagagattctcctgtgtcagcctcccaaatagctgggattacaggcacccatcaccacgcctggctaatttttgtatttttagtagggatggggtttacaatgttggccaggctggtgttgaattcctgaactcaagtgatccacccacctcggcttccaaagtgctgggattacaagcatgagccacggcacccagtcccttttttaatgtatatatataaaggaaataata

SEQ ID NO: 769 - DNA, 2718 bp, Homo Sapiens
atcaagcgatcctcccacctgggcctcccaaagtgttgagattacagcatgagccaccacacccagactaaaaggcagtttgattttacaaatcaaaatagcagtaatctatggagatttacttgtgagattggtaggaaacatcttaaatgtaatcaaacaataacttacatcttgatgaattcacgtgtaggtttctcttcctcagaagaaatcagatgctgttcagagcacgaaggctagaattttaccctggttctcatgctaccttgcacccaggttggatcctgagtacagtttttggcaggtgggcctgcatataagttagcaatgggggatacccagctgcctctcttcatacagctgaggttttggggagtcattcttatagcccctgggttgggcctagtcctgcaaatgaattcaccagccctaaagcccaaattgcagcctctgtcattcaccttccaggagtggaaagggcagtaagtttcatcttattattattgctattttggtggttttgttgaggttggtgtgtgtatgttagtaagataaagctctcagaaattacatagcatttgtcaaggatataagagggactgtgccacatctggctgtatagaaggtggttccatatctttaaatagagccccaggtccttagccaccagaaaggttttcaggggaagtgtgcaccctcagcagctgctgctggtgggcaggatgggcacgcatggaacaggctttcctctgtggccaggtgagaagcaggtggtgagacacagagcagtgctgggctctgcttctgaagcctccaacctttccttccctaggaagccccagagagattggtgagggtgatttcccaggaagacgcagtgtgctctgacttctgtgacagtgagcaacgggaccagtggatgtccagatgctggcaatgagtaggccttccctacgctgggtggcgtccacaccctccggcttccattgcctgggtctcctggaggtggtttgctggatgaataccgcatgcacagaggctggccttgggtttgaatatggcagccagtggacagcatgtgcttcagttatgagactgcccaggagatgcttcttccaaggcagagcacgtgcagagtccagtgctggagaggccgggtgcgcagttgacccatttccagttctgttttccctctcatgttcctctgtccccatctaggacatgctctggagtcagaagacagcgaaaagagaagcagaagccccggtggcaagagtctgaagcaggaaggatgactgtagcctgtggattgtactgcagtaggaaactgtcctagcaaggctccactttgccccagcttcaagctggaaaggaggagaacatgaaacattgcttgaagacaatggccgagacagcaggtcccaccctgcacagccaccagcatctctcccctcagccctgtctcctcttctgcagttgggatctgcacatttaagcctgaaattgtcctgtgaagtgaagtatgatcggacagcctcttttcagcttttatgacaatggagacagaggaattgtggctcttgccaaggtcacaggattggaatacagagccaagccaccccaggacatgcaagagcctcagaagggaaaaaagcccagcaggaagggagaacaagtagcctctgtcctgaagttgtaacagccaggggccaggatggaggaggaggaccccataatctgcccatctgggacttggcaggggacctgggaaaatgtaccccaacccatcccttaagggcctttgtctttggcccattggcctagcatctacttcttcaccgtgtctgttcttgtcacacctagtcaggtctgtttgggtctgaggtgcatggaacattctgggtaggcctccagcaaacggaagctcttcaccgtgtttccagcctgggaccaagggcagcatactggcaaagttgccaaagcaagggactccagcctcttaggagttaatgactccctctccccagctgtcctccccttggtgctcctcttcctccctcctcctgctcacagcaggcagggcctagacccgggagccatgctgctgtgctgttgccaggggagcacggaggcagatctgagctatgcagggaaaaggcccagcctgtcaaagtgtctgagatgaaccgccgccgtccctgtgcagctgggctcagacgtgtctcagctcttgttctgtgcctgagaatggcgaaacccagtgaggttcaagggcaaactcgctattcattagtcaggggttcttgacgtcccgtctctcccagggatgagttcccccctcctctttctccccctcctatgacacattcctgggtgcctttggtgaggactgcacaccctcctcctgcctagccccctctccaaaggcccctgaataaactccccccaaggagaccaggcagggcagagacaatggctgcaggaaatcattcaggcgggacatgctggcctgccctccacccagtccccctgtgggccccactcccttctgattcagggcacccttgggcccccagcctatacaggcctggacaggaagaaaccactgggaaccaccctaaggacaacatgctagtccagtgccattcttcgctggctctgtgggtgcctttgtggcctgtaccgactggctggctaattttgtggtttctgtac

SEQ ID NO: 770 - DNA, 15344 bp, Homo Sapiens
gtccccggcgtccgggcgccctgcatggatcccccaccccagctcctgctccccggcggcggccggtgggcagaaagaccgaaacccactcacggccgcctgccgaatcgcggctctgctgtttgtggggcgtgctagaaacgtggtcctaaaaagaatggcgtccatttacataatgctttgtttgcgtttcgcaagtttctttcggttaaagccacagaaaccccacctcctgcccttgtgtcgtttccaccgcggcacccttttccgacattagaaacaatagtgtacgcctgtggaggcctcgtttgttcaggggctgccggccagggcttcaggacgtttctgcggctttccccgcgcggcctgggctcccgcggctgcttttcgggcccatgggcgcagccactgcgccaggctcaaggggggcggccccgtcagggcccgccatcttggaaggccttttttgccggttcttcccgctgaggaagtgtcgctcaagacgctggcctatgagttgtgatttctgccttttccccttcctccttgggctaagccagaccagaaagggccccgtgcgcaacgtgcttcacaatctctcagggaaagcggctaacgtggcgctactccgcctcccctgttccttacccttggggcggccgccatgtttcctgaacacaaaatggcgacacgtggttagcattcgtcgccaacgagaaattggggtcggcccgaaagctctagaatgcacccctcttcctccccggggccttccacctccgcgagttttatgacttaaaaaagcccacaggctggtctgaaggtcggaggcctaattttaacgcgttttcctccctttaatttgaaacgggaacgcgaatgactgtaaaatgtgggcacaatatttaatctctcgcctttttaaagcttaatagtggataataggggggcagtatcaagggataatttgggtccccacagtaccaaagcatttagaaacctctgtttaatttaaggaatgagataagttactgcttttctagacttcctagcatgggctgttgtgctggagagaacgagagctacgaagagactacagtgcctctgactttttcataggacagttggccgaggaagacaaacataaagatgaagtgcttaattcaaggtcacacaatgtcggggatggacctccagatttccttactgacctgcattatcttgtggatacctgagtgaattccacaccacccattttatagatgaaaccactgagacatggagcaattgactgagtagtcactgccccacccctgcctggagcctcacacatgactcgcctcctctcagtgaccacaggtgagacgtggtcttgtaacacagtggttaagaatgtgactttggagccagcctgctaggggctgaattctgactcagccatttactaactgtgtgaccttaggctggagtgcaatggcatgatctcggctcatcacaacctctgcttcctgggttcaagcgattctcctgcctcagcctcccgagtacctgggactacaggcactcgccaccatgcccggctgatttttgtatttttaatagagatggtttcactatgttggccaggctggtctcgaactcctgaccttgtgatctgcccacctcagcctcgaaaagtgctgggattacaggcgtgagccactgcgcccagccttgtattttttttcagtttgggtagctgtccctaattcatttgttaaaggagaagcaagagcaagaacctttaatctgttctcctcttccctaatttgaaagtagcttgttattttgaatatcactttctctgaaatagcacatctccatctcagagaatggatttaatgtttggatacagccaaaagtcatttcattaccaaaccatggggtgaatataccatgtaaagcagtttgggatcagaactcacagtctgaattgtaagtgatgagactgctgtctctctgctacagcttcttggctggctctgaaggctctttgaaggcagatcctaacaaggggactgctttgaagggccattgttcatttggaatgataaagtctatgttgttcaaaaaacaaatgcttgtagcaggtattttttcactccagactgagaatattggtgggatattgataaggggtactgaatggtaataaacatgtgctctagctctgtgctagtcagcttatttcagaactctagtttgattcagtttcttgcctctgactcaaaatggagggagagtgatttttacataagagaacacacccacatatccttttggcagcagctacctgccagagatgttgaagaagagtagccaacctttacacagcagatattgtgtgccagtcatagtcctaagtataataccttacatgtataaacttcttataaggttggtgctctgtaccgaattgaatagtatcccccaaaattcatgttgtcccagaacctatgaaagtgatcttacttgagggaggggggaggggggagggatagcattaggagatatacctaatgctaaatgacgagttaatgggtgtagcacaccagcatggcacatgtatacatatgtaactaacctgcacattgtgcacatgtaccctaaaacttaaagtataataataataaaataaaaaaaaaaaagaaagtgatcttacttggaaataaggtctttgcacatatgatcaagttgagatgaagttgtactggaaagtctgtctagtgactggtgttgtcataagaagagagggacacagagggaagatggccacatgaagatggaggcagagattgcagttatgctgctgcaaactaaggaatggctctggccctccaaggattgctgataaccaccagaaactagaagagacaaggaaggattcttccctagagccttcagagggagcatggccctactgacacctggatttcaaacttgtagcttcctaaactgcaagagaataaatttctgttgttttaagccatatagtttgtggtaatttgttatggcagtcctaggtaattagtgtacactcttaccatcttcattttcagataaaggaaactgaggcccagagaagtcaaatactttgagatctctgtaggcccctactgtgctggctgtgcatagattccatacctcctgctgttgctgttgttgggtctccacctttaccatggccatcacctcctggcagtgctggagctgagctgctggaataacttgtttttcttttttcttttttttttttcttttaagacagagttttgcactgtcccccaggttggagtgcagtggtgcgatctcggctcactgcaacctttgcttcctgggttcacgccattctcctgcctcagcctcccaagtagctgggactacaggcacacgccaccacgcccagctaatttttgtgcttttagtagagacggcatttcaccatgttggccaggatggtctcgatctcttgaccttgtgatccacctgccttagcctcccaaagtgctgggattacaggcatgagtcaccacgcctggcctatgacttgtttttctaacacaccaggccatagcctttcttaatgttttgcctgcttcatactgtaaatcagaaactcctctcgggaggcttctgactgtagcctgaccatctcacctgatctcttctccaatccctcttcccctctcccctttattttccctttgctatttttacttttcatgcagtgtcagagaagtgtagtgactatgtcgggggaggatcccccagctgcctctggtagttggttttatacttcccacttttggcgtgctgtaccttctagaatttctgtcagtagacaattttgtgtttttctttggagctttcaagatcttgcacatagcttatatagttacatggctgtgaacagagaacgggcagtttcatggtggcattggctgtgagggcacttacattgatgaattcaacccaccacagtggctgtctcccctgtcaaagtgagtgaggggatgagagcattttctgaaccagctcatcttcctgaatagcttcttgcatgcccctgggcttttctgttggcatttaattgctggctgtggaatcttgcctgttttccaatatagacctttggctttagatcctgttcttgttcttacccactctcactaaactgaactccaggaaccacatctcttttgtttgctgctgtatcccaggactgagcaaaggcctgatgcttactaacacctcaagaaatatttattgaatgaagaaatgaatattgacctggaaagttcaaactcttggttttccttgcttcttcctgaagtcaggggccagattaagaatttgtttaatagtcttaagcaatagaaaaattattatgtccctcatactttcatccctccgtatgtattttaaaaacagcgtaaatgcaaaacaagtataaagaaacctagcaaaatataaagaaaatgcagcaaaattctgatttttaccttggttaccactttcataaatataaagtaacttaaaatatttgttgttgttgttgttcttgttttgccagttccctgagcacatgctgttgagtaatcctgcctggaccagtacttccctcaccctagacttcaccttcagttcccctttataccacctgctgaagctgccagccagccttttcgaccaccctccctcccccaggggtgtttggcttctcagaccccagcctgagctagtgcccttggcttcctagggtcttgccaggaaagcaaaggagaacatgcataccgccaaagagtacctaataataagaactcccatcctgaattgtgatttatagtcagcatagcacatgtgtcaggtgattatacttaggctgattttagccttaataatctgcttctgtgatcctgtatgtgggaagcctagaaatttctctgtgatcctccttcctggatcactaagagacaagtcaagacataggtccattctaccacctgtgttaatctgggccttgttgagaccatttaaagaaaggcgtgatgctagaagtaaggtccaggcctcctgcacactgtttcaaggctgtgaccatagtcagatcctgttgcttgagtccaaagagtttaaaatagtgttggaaacctcctagggaaaaaacaaaaaacaaaacaccacatcttcctgggtaaggaagtgacatgtgctgactagagcaggaggggtagccaaggctccaagttctattctggacctgttgttgatttgaggtgtgacattcagcaatctgagctgatgttctgtagctctgattggtttctcatcttctgcagagagagtgaaagaggctgtgcttgcaggggaaaaggtgaacactggtctcctgtcctttaggagagcttcaccattacacgtcctgcctctcatttgaatttccaggcttttttagagtctcgctctattgcccagattggagtgcagtggtgtgatctcggctcactgcaacctctgcctctgggtttaagcgattctctcacctcagcctcccaagtagctggaattataggtgcgtgccaccatgcctggctaatttttgtgtttttagtagagacagggtttcaccatgttggccaggctagtctcgaactcctgacctcaagtgatccacccacctcggcctcccaaccaggcttttttaaatgcagaaaccgcccgcccccagagttaatatggaaacccagcaatgttgtttatgttttacttgaattcgtttcatcagaattgcattccttttaacagtgtgattagatcagctcttagaggggatggcagcttcagtagggtttaggaaaggaaaggaatatttgtgtggggcacacactttggctttgatagcttgaggataccaggtacatgataatttagatggataacagaaacttgtgtcccttgagagccaggcatgtattagatgctttcatacattatttaattgtaatacaaaccaataaagtattcccattttttgcacatgggcaagctgaaagtcaaagaagttatgtaacttgcccaaggtcacacagctaataaaaaggctgagctaggatttatttctcctcaagtctgtacaacgccagagcccatgctgttttcacagagcttttctgtccctggtgagatttaggaaaggagggtaggagaaagaagggtgatgagatgccatttttacccaccttgcgattttgcttgttgggacgtgtttagccagaacattctgtttatagaatactagattctatatatagagatgctgcagcaacatatgtgggaaagataccaattggctgtaggtgaggatttcaaaaagcctttgttcttcatcacagcataggccacacgtgtcaaaacaccactggtaattggtttactgcttaagtggctctgtcctatcatctacataaaatctgttgatgtggctcacaaagtcaggtgtgatggggccagaggtgagggtgtggtgtatcctcactgcatgtactggagctggtggcacctgttgtgtgactactgcagtgaatgattactgagtaaataagaggtgtctcagccaggcgtggtggctcacgcccggaatcccagcactttgggaggccgaggtgggcggatcacctgaggttgggagtttgagaccagcctgaccaacatggagaaaccccgtctctactaaaaatacaaaattagctgggcgtggtggctcatgcctgtgatcccagccacttgggaggctgtggcaggagaatcgcctgaatccgcgaggcggtggttgccgtgagccgagatcgtgtcattgcactctagcctgggcaacaagagtggaactctgtctcagaaaaacaaaacaaaacattaggtgtctccttttttcttctccaagggagaccagatagcagtgggtgctggcacacatccagggatcctggcccctgggctagcagaagagatggcttgaaggtgtcaggtgatggaataaaaagagctggtctgtcaagtggtataatttcaggggaccaagaatgtgtcctgcccctcaaaaacttgccctagctgtttgctattgcttgggatcccacaattgaaatttctttttcttgatttaaatctttgagaccctattaaaaatgaagagactccaggaagagttttgattgtgaaacattttggtcatgttaactggaagtatgaatgagtttataagattgatttctgagaaccagactgaggaagggatagggaggagaaggcactgtgcccctagttgcagggacaagaaggagacaccaatgagtttgagataaaggccttgaagagagatgctgggtctctaaagaaatacttggtttccttcacagttttgtctgagaaaagacaagcagctgacagtgctggttatggaggcccatgaccccaaaagaggttgtgctgagtagatagcccaccagcatgttcggatggaggcacaatgttgtctggagagcagctgacagctataatgtaaccaggagtgctggacctttgggtctgtggtttactgtgatgtactgagacaaagactgtcacagatcttagaagggggaggcacagcttccaagaaatgatgcaaaatggtggcgcaaaagaggccaccagtggcaacaagggcagggcatttcctttgtggctggtggtcacggacaacttctggtctcaatttcccaatgagctatgctaagaaatttaccagaaagcaaaataagccatgcaaaaagcgatgacaaagcacttggggtatccatgcaaaggtgcagttcccccttgtccactaattttgtggagccaaaagagctgatccagaagctgcaaagatagtccctgtgattaagacatacaacttttttttttttaaatgcgagactctgtcttactctgccacccaggctggagtgcagtagagcaatcttggctcactgcaacttccacctcctgggttcaagtgattttcctgccttagcgtcccaagtagctgggattacaggcgcgcaccaccacgcccagctaatttttgtatttttagtggagatggggtttcaccatgttggccaggctggtcttgaactcctgacctcaggtgatacacccgcctcggcctcccaaagaaggcatacagcttttttggcctgagttcttccaaagagagacccttcctagttgacttggcatcatctttcattcaccagtgttctctaactgcctttatgattagaattctcacagcgttttctcccccaagggcatattttacagaggcaactcaaatctcagtgcctttctgaactccttacaattgggtttatagatgcctccaccctgaggttcaatttcactgtccatattcctattctaagtctggagcactttatttttgatccagacttttagcttcactgaggcctcttgggttctagctaatttttttggacacatttccctagtgggcagcctaggaatggcctgtcctccctatcccccaaagtttggcaaggtctgtaccccctaccttaatggaatcagcactacttgagatttctgaacatcctacaccgtttcctctcccctcaacccctgcagcctcatacacgaggtctagtggaaagcaggatctgctgatcactaggatattagagccagtgtctccagtagggaagaactcctgggcatgtgttctatgccctgaatgacagctctctgcctatcagtttctgctttccctccatctcacctttattttggcttttacctagaagtacaaactttgtcttgttcctctgcctggacttcctaaccctgtccaggactaaagccctgctgtcagtccctcaccagggactttccacactttccctggccaggtcacttatctgatactagagccttttcttgcatctaggctttagtaggtagagttctgtccatgcacagatctccctgtgttgaccaccttgaacttcgcctagtgctctttgcgctaattagatgccatgctagtctgtcctgctgccttctggaacaaggctcttagctttgttgagctcttgccctggatttcatgttagctgtccagctgcctgcacctcaaaaagagcttttaatatgcattataaaactccaaaagggaaatagaatatataacatttttcaaacgtatttaactagagatccattttttttttctgaaggaatatttattaaaatcttacagaatatgtgtttggtggaatacagttttggaaagagtgaatctttatcccaaaggaatggacatcaaatagagtaattccagatgaagataatgttactattaccttcatctgaaattccagatgaaggtagtaatcactatttcctgtgtgtctgcataaggatagctctaatccgcagtggaactctaaaatagggaggaaggaagaattctgcattctttcttccactttgaatcctcttcttcccaatggaaacaggaagtggtaaatgcaatggtgccatcacggccatggtcgtcactggcttctggatacaagataggagggcttctctgaggctctcttccctagattggacctctcagaatttctctagagtgctcctgagcacccttccttctactctgggactatattcatctcagcatcagtctcaagtttaactgctagttcaggattttgatgttacacatggggatcagtgccagatgggatgtagctcatttttatggaatgagtatgacataaattttctcctttccctattaaatttctcttctatatcttgtgggcagtccagactataatttttttttcaatccttgaatggagataagctcatgctctgtgggcagggcggtgttacaggtgggtcgccatttaaatccgactgggtgggtgaccacgtaccaggaatggaagttggcttagctagtaaccaaagagcaagccagttacttcccctgcatgccattcccaaccagcacagctggggaaagaccacctgaaagaaatctctaagacttctgatgaagaaattactaggtcctcttgagaccctcatgtatgtgtctttattgtcgtgagtgagatcattagttggctgatctcagttggcttagctaatcataaactagatggaaaggctcagctttgaccatgaccttaaatatggatggaccatgtccttaggtatgttctttgagcatccagtaagcagcattctccgtagacaagccccacccttggggccttagcctatggcatttgtccatttttgccatttcttctgaaagactatggttttaactgaagaccagggagtcagctcgcttataggaagtgggaagagggcttgaaatgggcattcagagatcttaaatagagcttgtagtttatttggtcagtctacaagtatttgccacgttagtttagtttagtttagtttagttttgagtcggagtctcactctgtcacccaggctggaatacagtggtgtgatctcggctcactgaaacctctgcctcccgggttcaagtgattctcctgcctcagcctcccgagtaggtcagattacaggggcctgccactgcgcccggctaatttttgtacttttagtaaagacgaagtttcaccatcttggccaggctggtcttgaacttttgacctcatgatccacctgcctcggcctcccaaagtgctgggattacaggcgtgagccaccgtgcccagccggtatttgctaagtattaattggcttataactgtggaaaacttgttaacagctttaggaaggctgttagggaaagtctcaggttgcagtgagctgagatcaggccattgcactccggcctgggtgacagagcaagactccatctcaaaataaatgaataaaaatttaaaaaataaataaagagacaaagtcttgctctgtcactcaggctagagtgcggtggtgtgatcacagttcactgcagcttcaaacttctgagctcaagcaatcttcctgtctcagcctccctgagtagttgagattacataggtgggtgccactatgcccaactgtctctactccctctatatactgtctctagatgatgccatctatatttattggttcagctaccactgatacatcaagtactttaataccatcatcctccacctagatttttctctcttctgagtttcttactcataatagccaaacactattggcattgtaacctggatagctcttaagcaccttaaactcaacatgtctcaagccaaattatattgttcatcacaccattctctttccctttccaaacctcctcctcctcctcatttccttgatttaggagcatcactgtctggcgtcatttgttaacatgcttttgcattactgttttctattcccccactgggaatttaatagtctccggttgtaatgtaagatgtttaggatgtggttctttcttttcttattcaagaacaattaaaggttaagctgagattcagactctaagtaaaatggaagtcgtggagaggaagcatctgagggctagaaccttggaagaaaacttgagagttgactaaggccacccttaggtgcagtaggggccagaagacctttttaggagcatgcagaatggagaagaggtggggcatatgatcctcagtttgtttcttgtgcaagcagagtaattggcacctcccctgctggctgtttgtgtaaatcactgtggaacctcatgtaatctggtttaaacgtctaaggattgagcatcctagtataacccatcagctagctggagtcatccttctccttaaagttttggctgaaaatgtcattcttcaacttacagcaagttgttctgattccttcttcagatttcttcaaattcccaggagctctgattttgagctcttgcttccattgaatttgtttagattatggatggtttactagatcaagtacactgaccctgtttccatccacaatgatacagatgtagaactcccagctaaagcctttatatgcgttgcagactttatcaaaggtttgggataatggagagaattcaacattgcaacaaagtaagcaacttgaattctaatactggttattcctgttcctcagagtacttttgcccacccctccactagggatttgtcattattcatatcacccacatatgttggctttgttttttttttttttttgagatggagttttgctttcgttgccccggctggagtgccatggcatgatctcggcttactgcaacctttgcctcccacgttcaagtgattctcctacctcagcctcccaagtagctgggattacaggcatgtgccactatgcctggctaatttttgtatttttagtagagacagggtttctccatgttggtcaggctggtctcgaactcccaacctcaggtgatccgcccacctcggcttcccaaagtgctgggattacaggcgtaagccaccccacccagctggccttggtcttttataatcttatctttctctcctctgcaaactctccttagcatattaccactagaactccaaatacttctgtcattctattttgcaagcaatttaactctctcaaactcttcctcctaaaatcacttctgggttcacttctgtgtgtccagagcctaccaagggggaataaagagcttcatacgcttttttttcccccttgagacatggttttgttctgttgccaaggctggagtgaagtgctatgatgtggtcatagctcattgtaacctcaaactcttggcctcaggcaatcctcccaccttagcctcctgagtagctagcacttacaggtgatcaccaccacacctggctactattttttttgtcttttagtgacagggtcttggtatgttgcccaggctggtcttgaacttggtatgttgcccagcctggttgcccaggccactggcctcaagcaattcaactttcttggcctcccaaagtgttgggaatacaagcatgagccactctgcccagccttcatgcatttctttagctacacaaagaataatatgtagaccctctgatgtttacttttccattatcttccatcttttgaaggtatttcttgttttgagtagcacttactgcttatctgcataatggttttacattgaaggatctatggaggaaaaataggaggatattctaggtaaaagcaacaataaaagcagcaaccttcacaaaacctgttgtggacaaatgaaaaactagtccaactgggcagaagaattcttgtcaaggaggagagctcacaatagattagaaaatccagaaacagacctaggtttcagcaggaaaggatagtgttaggacaaatgatacaggacagctggctgacaagaaaaaaaatttctgtcaccatataacaaaattaattctaaatggattacaagtttttacataaaaactaaagtaataaatgtactagaagataattttttttttgaagtatggcactaaaggcagaaactataaaggaaaatgtgtgatgaattagctaaaaaaaagtaacagcataagcaaaagtacatgacaaactggttaaaaacagttttcaacatatctctaatgtacacagagcttttacacgttaataggaaaaaaaataccacaaaaaaatgggccaaagtcatagaagaataaattcaaatgtgactaacaaagcatatagaaaaaggctatttcagccaggcgcagtgcctcatgcctgtaatcccaacactttgggaggtttttacaaaaatgaattagccaggagtggtggtgcacacctgtagtcccagcagtagctcaggaggctgaggcacgagaacggcctgaatgcaggaggcggaggttgcagtcagctgagatcacgccactgtgccccagcctgagtgacagagcaagactcatgcctgtaatcccagcactttaggaagttgaggcaggcagattgcttgagctcaggagtttgagaacagactaacaagtcactgattatgccaaggtgtttatctacaccaaaattggaaggttacctatcatgatggaaatggggctaactggaaaggggagccactcctctagaaggggaagatggatttgtttcctggagttgaatttgaagagctagaggtacatccaagaggaaatgttccataggctggagatttccatttagagaaaaaaattacttctaaagtagaagcaataggtgggagtggagactccctagatttggcacctttgacaggcttggaggggaggtggtattttggttcttcccttcctgccagaagtctccttgagagagactggagaggagtgtgtggtctcaattagaacctgaagagtagagactggggagaggtaggagtgggcagtaatcataaacaacagccacaacagcatttaaaaattactttaggccaggcgcagtggctcatacctgtaatcccagcgctttgggaggctgaggtgggaggatcccttgagcctaggagttcgaggctgcagtgagccatgatcgtgccactgcactccagcctgggtgacagagtgagtccctgtcttggaaaaaaataaaaattactttagaaagtgacactatagtgacttaagtaacagaatcctgtgtgttttagattattacttttttttgttttttgtttatgtgtacacttccaattttggtgtagacaaacaccttggcattatcagtgacttgttactctgttctcctcttcctgcctgagagactgtcaaatcagcacttattctataaagtgtctttagattgatccatttctttataatcccacccgcccacgctagttgctaccttattatttcatacttgtattgccattacagcttactaactggtttctctaatttcattttctgcttcattcattttgcatgctacaacataaaacctgccctgatcactgcttttatcaccactatctgctcaagagcctacaatggctcttcattaccaagcccaccaaggtaaaataattttgtccggtttcagcccacccaccatattcaagtaacagggtgtctctttttctgcccacctcttcactgctcctagctccaggctgcagcttttgctctgtctgcccctctttggaaaattcatctctaagagacagggagtggagaaatgagaaatgaactttgagg

SEQ ID NO: 771 - DNA, 1315 bp, Homo Sapiens
gcaaagtgctattccaaacagatataacttcatcttaactttgacattttacagataccttccaattttttttttttgagatggagtcttgctctgtcgcccagggtggagtgcagtggcatgattttggctcactgcaacctccacctcctgggttcaagcgattgtccggcctcagcctcatgagtagctgggactacaggcgcccgccaccacgcctggctaattttttgcatttttagtagagacggagtttcacgatgttagccaggatggtcttgatctcctgacctcatgatccacccgcctcagcctcccaaagtgctgggattacaggcgtgagcgaccatgcccagtcccaaatatttttaaaattgcaaatgacaaagtcaatggggttcaaaactaaattcttaaactaagtaaggagataacagacaacatttaaatttgtctttggaaaacaactatgaaatattaccattttctcctatcagatcaagtcagtatttcattctgaaagcaatgtattaacatgtgattttatgaaataatcaaggtataggcaagctctcttgcggagcatacacattaactcaggatcatcctcattgctgttttttttcccccagcacttgtgaggccttgtaggggacagtggattaaatagccttcagggtcaaaacagttccttgacatttggattttaaactcctggtaattaaaattgattgcataatttactcctattacaggtgtgacacactgtgagattcaggattataattctttggacttaaaatggttggaaacaagctgggggatctggactttttcttccctccatgccttccctcttcaatctgaagactcagaaattatcccaaaccatagaaaagtggagtatttgagaatgaataaacttataatccaatgagtagatttctaattattatctataaagagatgaagagcagtggatagtggaacaagaattaacacagggagaaaggaatctcacctttagaatatctctaggataatatttttcagacaactgactccctccaatcctcttttgggtaatgataaaactaaatgtctgatctgcaaagaaaactctcaccagagacctgctgattcaagaattcagttcctgcccaattggaatactgccaacatttttccaacctaacaggaatgcgtctgcagtctaagtaagagcttcttctctgaaggtaaaagacgggaagttttggtgttgttgacatttcagtgagtgctgccaacatctggcatactagaattgatctac

SEQ ID NO: 772 - DNA, 2442 bp, Homo Sapiens
taatatatgcaacgcttggccctcgtgtctgacatgtaatggacactgttatctttaattgcaaagctaatatttattcaaccctgtaataaaacagagtcctaggtgtctgtgaagtaatgaggaggatataaacctctgagcaaagctgagtgagctttcacaaccatgaggttctctaaaaatgacaaagcagacccttgagctcatctggctctaagagtgtcctaagcactcactccatctcctactggattgatgtaagtataaaacaccttcatgggcaattcaactgttaggaaagaggtgtaagcctcacaccacagactgcagagatagtaatacctgttgtgagaagctgtctggtatccaactgccaaagcctgtctcaggatatcattcaccagctgttctgtagcctacaatggaagatgctgttattcttcaaatggccatctgcttgctggcaagaagggacacatttaaccccatcccttaccccaaatgtttgaaaccactgcaactagggattaaaaagtccttaagaaaaaattaaaggcctcaataatagaccataatgataaaggccatgattctgagaaattatgaattggagtgattttcattaatcagacattattctatttatttatttattttgagatggagtctcactctcgcgcccaggctggagcgcagtggcgcgatcttggctcagtgcaacctccgcctcccgggttcaagcgattctcctgcctcagcctcccaagtagctgggattaccaggcacccaccttcaggatcatgtcctccaccacggacgcatacacgttcctgtggagtgccacgggctgcagggtgatcccaatctggaaaagcagaagaaagccgtttgttcgtatcgctgctttagaaacagcctctctccaaacaagcatacctccctgacatgcaaagcgatgcctggttggaaggaggactctgcaaacatattgggcaaaattcacgggaaaggaacacggaatataacatctagaagaatgttatcttgtttttccacatttctggctgatatttaaaatatgactataatcctattaaaatctctcaaatctccttcgtgggagaacatggttgggatctgcctgggttctgatacgcaatcaacactttgaaaggtctggaatcagactccaacgtcctgtttgcacttggaaactgcatcttgcccattcttcatggcatccaatgaaagcacactgtctttcaccttgggccctgagcaactggcagatgctgaagagctgttaggctccagcagggtggataaatacctctctcctgtatagtaaggcaggtgcacgccatctgcaccacaggcggggcactcaggagctatcaacacatcaggggaggattacgcgctgacgtgcaactcagaaagagtacgacgtgcctcatgagggaaaggtgcttctactgaggcagatgagaaaaacaagatgaagagtaatcaaccatttctatctagccagctttgcttcacgtctgcgttcaacaagcaatgttttcacatgtaattagcatttctgcccaagggctctgatgtgggacggtgggagccctgagagcacacctgggtcaaccaggcagaaggaagtcaagcatctacggcaccagaagagtctgggtctgagtctgtgtctgtgaggctgaacacctgggtctgggtctgtgaagctgaacgtctgaacatctagctctgagctggtctgctgcatgaactattaacaccacaacccctaccttctgtgtgacatccccaataaattcagaccctggggttggtggcaggtagaacttgacttcctcttgtttctcttcctgctccttcttgatgtttatcttcactggctcggagaggctgaggatgtccacctcctcctcattctcgggttcccttttctggaactgttgcaggtcctccagtttgcggcagaggttgtcagcagaggagaatgatgatgggcactctaaatgacaggcaagcagtgttacaacagctgtggggccaacggaagaggactttccgtctccaagagacccatggtctgaggaagggggataagcatcaggggagctgaccttctttccagttctaacattctatggatctataatgatgagaactagtaattcacgagggagaaaggcataaacacaggcatcttgtgtgtgatctatgtaaggtaactgccatctaagatgaaagagtaggaattctcacttctgccaccaaaaaccaggtcatccccctccctctgagtattaaggactgacctgatttttcctcatctcaaatctggaaaatttagaaatgcagagtgaagaaaataaaaagaatcacccctattctcactgctcagagagcaggactgttaa

SEQ ID NO: 773 - DNA, 3135 bp, Homo Sapiens
tccgggtctaccggaaactgcgctctaggcgttcgccccccgcggtccgcttccgggtttgcacgaaattgcgcgcgcatcctagaggccggactggctgggaccagggcgggccgggacaaagcctgggccgggcctgcgcttccgttcgcttgactggctgcgcttgttttcagggttttggtctgaaaacggatcttacctgcgcagagcaaaatcggttgtagattatatccacgaaaattccttctattaaaatgaatttcaagtcccacctaccctggaagcagaaagagagagaagagagagagtaaagagaaagagaaaagaaagagaagttgaaaaagagaaagaaaaccaagaaagaaagagaaaaaaaccgaaaataaatggacaagaaagaaaagtaaggagggaagggaagggaggaagggaagggaagctttaggaattgaattaacacactttggaattgtctgtgaaggggatgatgcaagctaaaatgtgaaatgcaaaaccctgccagggtagaatgttctatttcatgccagtgcccatagaagataaatacttttcatttatcttccccattcactctagacggtgaaggtcaaccctgtgctcaattccagagactttcctagggacatcgtgttgggcatggaggactaaggccagtgtgaagataagtcaccgattctttaaaaaaaaaaagccagtaacttataaaaatagccataaacgacgtagttttttgttgttgttgttgttttgagacagcgtctccctctgtcccccaggcgggagtacagtggcaggcactcagctcactgtaacctccgcctcctgggttcaagtgattctcttgccccagcctccagagtagccaccacgcccggtccaacttagttttttaatactttttaaaattttaagacagggtctctgccaccgaggctgaaatgcagtggcgcaatcatagctcactgcaaccttgacttcctggggtcctgggcaggtgaccccctgtctcagcctgccgagtagctgtgagtaaaggcctgtgcctctccactgtgctaattttctactgtttgttgctttgtttttaatagagatgtagtctggttttgttgcccaggctggtctccagcttctagcctcaagcagtcttcccatctgctcctaccaaagtgctcggattataggcatgaatcaccttgcatgggagataaggacccccacatcaagccctcaggttatttttgaaacacaaatacataaggcccacaagcaggcccattggctgcagacagtggggtcacctgaagaacttttctttgatctgagtaccaacttctcacctaggtcactgggatcctggactacggcactgctccaggcaggcctggttatcctgcttgaggcagcaatcctcttgagcctagtgaaatgcaactggctgtacctcaatgatgttgccctgagattctgccagtcgaggtattacttcaatctcctgagaccagcctctacctccagatccagggaggtcagtgcacatgtaaatggactagctttattaaaggggatatctgggccaggcgtggtggctcacgcctgtaatcccaatactttgggaggccgaggagggcagatcacctgaggtcgggaattagagaccagcctggttaacatggtgaaacgaagtctctactaaaaatacaaaaaaaaaaaaaaaaaaaattagccaggcatggtggcacacgcctgtagtcccagctactcgagaggctgagacacaagaattgcttgaatctgggaggtggaggtgcagtaagccaagattgcgccactgcactccagcctgggagacagagcgagactccgtctcaaaaaatataaaaataaaagggatatctggattggcggagagactgcaggacagcattcaagtggggttgaattggcccagttgcatctgacttctcacttgtagttcccaagaatgaatatagaatgtgctggaaaagcaacatcctgagaggaagggaccggtgagaaaaggacaggatgtgttccagatccccagaacaggatcccctttgttgctttaggccaacgtgccatgcatccctggagcatgaaacccaggatgggccgccttccagcctcccacagctgtgatgcaagttgaacacatacagagagactgcatctgcactgggtggttttcctgagccttggggagcagaatgcatgaatcccaggtatctgccgatctgtatgtaacaaattcacttcatgtaacttactgtgtgtccgtgagattatctctcactcaactcagacacattggcaaccagtgtgcagtgaacctgcttcacaagcaaggatgtggagaaactattttcgtacattttgtgggaatctgaaatactgcggtcagtatggaaagcagtatcatgggaaacttcctcaactcaagatcacctaccaatccttacagaatcagaatcatcatacaaactggtgaaagcatagtttcccctagaggttgggatgagggcaagaatgtcccctcttatcactactattccacacaatatgaaaggttccagccagtgaaataaaggaaaaagaaataaaagtgacaggctgggtgtggtgtctgaggcctgtaatcacagtgctttgggaggctgaggaaggagggtggcctgaggacaggacaaaaaaaatagtgtaccaacagaaaatatgttggttgtgcaggctaatacctttcccaaaggaaggtagctacatccctatgacctgtgttactggatatatcaaaagggagtttgcaaatgtggtctagataaggatctttagatagacatcctgaattatatggtcaaagtgatagaatcacaaggttcaatatcagaagggtgcaggtggatgcgaagggacagagacagtggtgatgtgttgaaaatagagggataaagagattttttttctcacctttaaagatggaggaagtggaccatgagtcaaaggatgtaagtggcctctggaacctacaaagggtaaggaaacaaattctcccctggagattaatgaagaatcacagaactatggacccat

SEQ ID NO: 774 - DNA, 2616 bp, Homo Sapiens
taaaatgtcgaactcctttgtatgtatggatcagttttcagcattttatcctttgcactttcaatgtcatgaaataatctttgattccctttactatgaagttttttgtcagcatcacttcctctgggatatcttcatcctttctgtcgtggccactttcctctttatgtcaataattttgcctccactgagtttttctggctagatattaagagtgtctcaaacagtggaagtatcaacatttccatggtcagctgtttcttctataacaccgttcaattgatcttccctaccaatatcttcatttttagtttctttgctgcattttcatctttgttgtccaattccctcatttgattattcatttttgtaaaatgttatggggatttattacagagagagaaacaaggaggcaacacaagtaactacatattgtgctttctgtgcatgaagtgaacaataggtatgcttcaactaatcactatcactgacacattttgaagtgatgtgactagtcaatgatcacagtgctcatctgttgttttgtactgacttgtgggctgaagagctagcagtaagtttgtgctttatgcagttttcacagtaagtctttgttacaaatttgtatcgccttattgggagacttgttatttaagtaaaccacagtaactgaaattttaaaatattggaaccatcaaatccagacccaaaacattaatacctacacatactctctagggttaaaatatctgagctaaatttatatttaaatttgcaagagacagctttcatacaaatatatccatttatatataaatatgtttatatgtatacatacagtctatgttttcatatatataactaggttatatataattcaattatatataatttatatgtaataggctgtatatagagatatagattatataaataaaattatagctgtagcctatttattggcctagtaaaaaccatataatactacaacagactagaccttcatttgagcacacaagtaagtctgttttgagtgagagcttctttgagtgattctgtgaacttcattgcgtttggtctagctgaacttgacattccttttaatttttctactaacgcgccagctccgatgctccacattcttacaactaactcatgatcagcttttatttctcagatctcctgtaattccatcttaagctcttatttatttggagaccttcaccgcaatatacttttcccagccattaatttcagtattgtctgggttttttgtttgtttttgtagcagattgttcattctgctgattgttgtatattagtttggggttacagtttcttgtatgaatatgtataactctcctactactttgtaaagccagggcagttactaaacatttagcattgagtctggcatgtagtaagtcctcatacatgatagtttctttgtctctttgctgtctctagtaaaagtagctgcacgtatcagggacttatattttaaaattttaattgtaactttggctctgcagtgcccatgtcaggcttttacttgtcaggcaaattgttatggtataccattttctttttctcctttatttgaatctcccctctttaagattttcttactacccttacatgttttagattcttgtttttgcaattgtggattattttcatctctttttagtcttctcctgtctgttctaattctcaaaatcaagtttttccatctctgaccatatgcttagttggcattgattgtacacttcctgtgagtttatgcatttacataaattacactacaatggggcatttttcttattaattaagaaatactagtattcattaaggaattattgctctgtagttataaattctttaagttaaatgcaaaatatcaaagcagcttctgatttttttctttttgttacagaaaaaactcccatgtctgcacattcatagtgtgcatggaagaagagggaaaaatacctttttacagttttggtgcttggggcttattgttattattggtagctggtttatagaaatttgagatatttttgactttctatattaaaatttactataatagtcttacatgaaaatctttagataagcaggaggatttgccaaaataatttttttatcagattttaaggttttgtgtgtatttctaatttttgtttcaattgcttttcctgtctgctttcaacttagcatgagggcttcctatctaatatcaaataaaattatgttaaatatgaatatattagatacagattgtaggagggggggatggttaagtgaggtatcctaattgatctatacttaactctaaattccaatactctacggcaataccatcaaatgacagtaaaagttgtgttatcacttcagtgaaatcatttcttaacataagaagactgattttgacttactagttttagaataagattaagtaagaagacttaaaggcccacctttgaactcataaaaagcctggcctagtgaaaaagcatattttactggtttgcttgcttaaaattatttaagactcatattttaccttggagatgattttgcctataaattaataaagatgtatgtttctgg

SEQ ID NO: 775 - DNA, 1653 bp, Homo Sapiens
acgctaggggcctggcagggggcagcaagagaccgcgatggcctatatacatatacccatagagtatattgaatatttttattcaaccctatgaggcaggtatcatagttttgcagatgaaactgaggctcagatgaattaagtgactgtgtgtcttcgtccatttttgtgttgctataaaggattacctgaagctgagtaatttataaagaaaagaagttcaattggctcacagttctgcaggctgtacaggaagcatggcactgacatcttctcagcttctggtgagggcctcaggaagtttacaatcatggtggaaggcaaagggggagcaagcgtctcatgtggcaagagggaacaaacaggagacaggaggtgccacacacttttaaacaacaggatctcacaagagcttactcttacaaggacagcaccaagaatatgaggaatctgcccgcatgacccaaacacttccctccaggccccacctccaacactggggattacatctcaacactggatttggaggggacatccaaactatatcaaggctgtacaagaagcttggtgccagcatttgcttctacgcagagcctcaggctgcttctactcacagtaaaaggcaaaagggcatgcaaagatcatgtggcaagagaagaagtgagggatgggggatgccatgctctttttaacaaccagctctcatgggaaccaagagggacaactcactcattatagcaccaagcctgtatccctcccattatgccctacctccaacatcgaggatcaaatttcaacatgaggtttggaggctcaaatatccaaacaatggcattatgtcaggatcataaagctaatgtttgtgaaaccaggatctgaacccaagctattgcttctagaacctgtactcttaagcccttgcttatactgcatttgaaattatgcttcattgtataaaaagtccttttcacctcaagcttatagagaagtcaccttgttcttaaaaagtcctttacacttcaagttcataaagctcaggcacatatattttcttccagtacgttcattattatttttcttggttttcctttaaatctttgaatcatctggattttattttggaatgagaaatgaagtagaaatttatttttgtttcttttcagaatggctggtcaattgtcctaacatcatttaatgaatagtatttatttcccctttgctttgaaatactactttatcatatactaaattataaagtaatcttttattatcatttttgaatgactgcattccagttgtggaagatattactcaaagtctgttgtgattatctaacttaagtgttgatatgaagaaaggaaagtaggtttcagcctgatttaagaattttcctcctctccctctccctctccctctccctctccctccccctccccctgcccctccctgtctccctctctctctccctctctttctacgtctccctctcttgccgagcctggactgtactgccatgatctcggctcactgcaacctctctgcctcaggctcccatgattctcctgcctcggcctgctgagtgcctgggattccaggcacgcaccaccacttctgactgatttttgtatttttggtggagacggggtttcactg

SEQ ID NO: 776 - DNA, 2375 bp, Homo Sapiens
attctgtactagatcaggagagagaatgttggttcaaatctaagatgcagagcagattggttaaggactaagttagttgatcatttcctaagacaagactaggactagcagcaaaggtggtatggatactatcaagatgagaggagaagtggacaaactgaaaactagttcaaggtctaactttacaaacatgacctacccactgtggcatccctcttacgcttagcctgatgtgctttggtagaggaagcaccacccatatgagtctgcatttgccaaaggtgccttagaagaaagggaaagaactggaacaggtcagcaagtcccatgctaatgggactcatgtcaagctgggtcaagttggggtgtagatctctcattgagagctaaagcatggcgctaaaataagggaaagcagagacatagaaaacaatcaaatctgaagaaaccagaggatggagatggaggctgtagaacaaggtgggaatggaagctggtggagaacaataaggtaaggacctgatcaaatccctcaaccatcaggggttgctgctggtttggatctgtggacaagtaggactataaatgtggcttgatctggtgggacagtttaaaataccaggaacaggaaaaaaaaaagatatactttgcagaccacctttctaccctaacataggaaagctttagtttctctttcttatcctggtttacccaagaatgaacttaatggttccatgaaaaggatatgtacagtttctgttgatctaaaatcaagtcaggtttagatgaagtctctaaagagcctttgtcacacttagaactccaaccatgtgaggtcagactggggaggctaggggaaggcaactagggtttacaggtctctctaaaatatgatcacttaccctttcctcaccatgcagagccttagttaccaaagagtaggaaaatggccacgtgtctgggttgccacagaagaggatttgtggcttgaatcctattaagaggaactgagaagtcataagcctatggtatagatttcattctcttagtccagggaaaacaatttaagaagggcaagtatcaacctccatgcctttatttggacctcccaacatctctttcaagtagatgacatgatccacttctccccaaacaagtgcctaataatgagctttagaccattctctcaggtacaatgtcacaaagacctcctcagacatggaaaaggggatggggcaaggagagaacagctgttctgtagacaaccagtagtgcctgttgctggggcgattgggctgtctttttgatttatttcccgaatagaggcaaactcacatcatttgaaaggcatcttaggagatgaaatctgcctccatgagatcatggatattgttgatgtcctagctcaggagtaagcaattccattttaaactcttgctgtgatgtgactctccaaaaaacatttcctaagttacatgtaaaagcaagtcattaaaaaaatgcagcttgcttttatttctatgtttagcctgcagttcatcaaacctcaccctctgggctagcagcccgcaaatatctcatagcacttactaaagtgtgtaatgatttgatgaatttgtttatttctctgcctctccctccacctttactgtaagattcatctgtcttgttcaccattctatctgaagcatgtagcaccaaacctagccatagtagtcattcaataaaaaggctgaatgaataagggaatgaatgaaaattttggattggtaaattgcaaggcctctctttagagcagaagagacacctagcactagcaacatctttaccaaatttttattgaacacaaaggactatttttaatgcttgcccctgtaggtcctgctgaggatccctggtgcccagtagggaacaccgtgaggaggaggattaagaaaggcaccctttccactgatttgcatcgccatttgtacatggagtttggctacagcaaaatccgttgctatctcaccagctacaagaagcaaagaacgaattgcaattcatttttgtgctctaggacccggttgagggtaagagaaaagaagtcttgtctttccaattctccagggatctcaaactcctcattttttattgctgtgtaccaagctcccagaggtgacttaaaatgagctccatcctgaaacagatgaaacactggctgcataagtactgccccagcgttaagatgtgtggtctttggaccacttttcctcctgggcagaaaagcagagtagagtcctagtgaatgtgagaggatgaaagaatgggagggcttcagaaaggtactagccaatcaaggctctgatgatcatggaatagttatatctgttcag

SEQ ID NO: 777 - DNA, 1605 bp, Homo Sapiens
ttttataattaaaatgtttataattacatattttataattaaaatgtttataattacatattttataattacatattttataaagtatttataattacatattttataattaaagtatttataattacatattttataattaaagtatttataattacatattttataattcaatattttataaatagttaaaaagacgaggaaaaaattaaaaagacgaggttattgatctcaggaattgtatttgccaagtgagaaggaaaaaatattcacaaaggcttgtacatactttgatcctgaggaacacctctggtgtcttcatgtgccacatagtcttcctcactgactgtctgcctttgcaaggcaaggctctccggtaggcctcgagatgaaataacaagtcctttatttcactcagcctgccaggagtggagaaggaatggctagggagtcctagccccaggggcttcatggcaatacggaccccagatgtctccctggagctctgccaggatccattcaaggccaagaaagtatgattgggagaggaggggtggagatgtagattcctaacaattctgtgacccagcatacatgtatgctctttaggctcttaagcatccttatttttccaaatataatatccaacaatcccaagtgtagtaaaaacccaagggtttctcctgccacatccactcacttcaaactctgattttaaacactggcaatatccagtcagagcctccaagctgagctctagaaagagaaagctgcaaaaaacctgtgcaacaaaacttgcactcatattactgacaagggtagatataaaacagcgcattcttttccatgacactgaagagcaaagaagagtgtaacttgggggcaataagaaattggaggtcaccacctcccaaatcctacatgaggtctatttggaaaagacctccttttttaattcaaaaatccttcaacctccaccattctttcataaagcttcacattctcttggtgaagcccactgttaaaatgcacaggcgttacctggaaaaggaaacacatagccttaacaatattcttctgtactgaactgaagagtgagaaagagtctatggagctataatacggtagtgtatgaatctggtactcaaggaaagtctgttggataatggatggatggatggatggatggatgggtgggtgagcgaataaatgagtggataaatgaggggtcagttttgagagtgagagaaacatggaaattagactcaaatcccaaggcaccacatggaatagttccaggaatagttctgcaagagtttccctgatgagctataagcagcaaaaatttagtgagtgttcaaactgaaaggaggcctggaattgtggcttaatttggagggaaagagggagtccaagattcccagtgcttatttgttgatatctatctagtgctgaaaagaaaaaaaaatagccacaaatccaaaatgattgtgcagtcacatggtacccactgcccagttccttgaccagtgtccctcatacaaagggcccctgatgagctcagaatgtctttgttgtactgaataaagtttgaagaacaaggga

SEQ ID NO: 778 - DNA, 10376 bp, Homo Sapiens
attctgtatcaccctcgctcaaggacctggactgaaggatttctgctttcaagaagaaaaaaaaaaatagaagacatgtttactaatacactggtaattatttctattcatattttattggccaaagcgagtcatatgggtatacaacataaaatgaggtgcagaatttcaatcctatcatttgcttggaaggtggagagtcatatttggagaacatgagttctataattgttggatgtaacagtctatacatgtccactaagtcaagtttgctaatcgtgtttaaataatctatatccttactcatgtatctgttcacttcttgcagttttgtcaatcttagttttatatttttgaagctatattatgtgtacaagttttataatcattgtactttctcatgagttaaactttttatcattatgataatgctttttgccttaaagtctactttgtctaatattaatatagataacattaatttttgttaatatttatatttttccactttttaatttcaacattataatacaaatgttttaggtatgtttcttataaacagtatgcagattgttatccaattcaatctttgatttttaattgaactatttaatttatttacatttaatgtaattactgatatatttgaatttaaatataccgtcttcttaagtgttttcaattgtctcacatgctctctgttctctttatcctcactttttgcctgcttttggaaaatattgtttttgcctccattgttttggaagttacatatctttttagtagtcttttagagtttatcctatagatcacagtatgggtctctgagttagcaaaggctaataatgttaattggcactttcattttcttccataatagtacaaggaccttagaacgtttcaattcatttacttcctctcctgatttgtatgcacttttaatatttttaattttttaaatcttcagcactgtgttacattgtttcatacggtataattcatttagacttcctcaaatggaccttcgtgctggacctcatttctttctgcatctatataacctatcatccttaatcatcttccttctgcttaaagaacatcctttagtatttgatgctggtaaagaatcctgaaaatgtcttaatttcacttttattattgaaggctattttcactggacatagaattctaatgttgacagttattttatttcagcacttgaaagacatttaaattccactaatttctagtttccattgtttctatcaagaggtaagctaacagtctattacattttttcaagtaatgacagctgcttgtaatttttttttccctttgtctttggttttcatctgtcttattgtgatgtacctaggtgtggcttttaaaaatttctcctgcttgcagctcccagggcttctgagatttgtggcttgttgtctttaatcaattttgggaatttttcaactattttctcttcaaatattgatgctgcaccattctctttctcttctccttctgaaattttaattctcattttatctccatatctcttactctctgtagcattgctatccttttgtctctccatgtttcgtcatgatgttgtcttctaacctactttccagttcatcaattttccctacagctgtgtataattttttgttaaaccaagtaaagagtatccactgagctctttgcttttgttagtatatattttaaattctaaattgttcactggttattttttacaactttttcatccttttttaaagttttcagttctctgccaaatttgttgatactgtcttttatctccgtatgtgtagtaaacataattaatttaaagtccgtatctgataaatccattaactggagttctgtggtattgtttctattgtagttgtttctactggatctcatgttttcttatttctttatgggcctggttattctcttgtgtgctaaaattgtatatgaaaaattgttggttgaagtaaagtaaaacttattgtgttatattcctcctgagagtacagtcatccctcagtatccacagcaggattggttccaggacctactgcagataccaaaatccatgcagatttcatttccacaatcaaccctgtggaatccatggatataaaacgtcgaccctccatatataagtgagtttggcatcctgcaactactgtcttttatatttatgtttggttgcagatgcagaattcaccaaagcctaatccagagcaaggccctaactcttcaattctatgaaggctaagagagctgaggaagctgtagaagaaaaactgcaagctagcaggggttggtttatgaagtttaaggaaataaaccattccgtaacataaaagtgtaagataaagcagcaagtgctgatgtagaagctgcagcaaattattcagaagatctagctgagatcatggatggcggtggttacactaaacaacagagttccagggtagacaaacagccttctattggaataagatgccatctaggactttcatagctagagaagagtgggctgactatatttattttaaaaatccatgtataggctgggcgcagtggctcacgcctgtaatcccagcagcactttaggaggctgaggcaggtgggtcacctgaggtcaggagtttgagaccagcctggccaacatggtgaaaccctgtctctactaaaactaaaaaaattagctggcatggtggcaggcacctgtaatcccagctactcaggaggctgaggcaggagaattgcttgaacctgggaggcggaggttgtagtaagccgagatcgcgccattgcactccagcctggatgacaagagcgaaattctgtccaaaaaaaaaaaaaaaatccatgtataaatgagccatacagttcaaacccatgttgttcaagggtcaactgtatttatatttgcttttgcaagatacctggggatgtgaggacctgggatcacctttatccaatttgaagaattaagctaattggatctcagctgaggccccacaaaatctcatctacttccatccaagtcatcctgtcttttctcttttttaaatttttttggaggtggggtctcactgtgctgcccaggctggacaacataggtccagtggcacaaacataggtcactgcagccttgcactcttgggctgaagggatcttcccaagtagctggggctacaagcacatgccaccatgctaccatgctgcgctaattttttcattcagtcttaagatgaagactttcagggtcctagcctgctatggggagttatatgtctaccctctcctttggtgagcaccggattccaacttgtgtttatgtggccacacaaagctgcccaggtgctgcttagtctcttcagttctttttttttttttgagagggagtctcactctgcactgtgtcgcccgtgctggagtgcagtggcatgatctcggctcactgcaacgtctgcctcataggttcaagctcctccgcctcctgggagcctgggtgattctcctgcctcagcctcccgagtagctgagattataggcacccgccaccacacccagctaatttttcttttgtattttaatagagatggggtttcaccatgttggtcaggctggtctcaaaccctaacctcaaatgatccacctgccttggcctcccaatgtgctgggattacaggtgtgagccaccacacccggccatctctccagttctttgttgtcgtttccagaagcagcaaatgtcccaaggggaaaagaggcccagttattgggcttgcctccttgaatacccatctttctccagctcttcattggtgattcttcattatctttttaagtctgatgttttcaagcacattttattttaattttttcccacttttctaattgttctcagcaggacagtaggtctgaatttagtctgctattaccagatggtaggaaatagacaggtatgcttcattttgtcatagtttgctttactacactgcagatattatattttttacaaattggaggttcgtggtaaccctgcattgaagaagcctttaggtgccatttttccaacagcatgtgctcactttttgtttctgggtcatattttgataattctcataatatctcagactttttcattattattatatttgttatggtaatctatgatcagtgatctttgagattactcttgtaatcattttggggtgccataaactgtgctcatataagatggtgaagttcattgataaatgttgtgtgttctgacttctccaccaatcagccatttcccatcttttacattcttttcagtcctccttattccctgagacacaacaatattgaaattagactaatcaataaccctacaatgtcctctaagtgttcaagtgaaagcaagggtggcacatcccacactttaaatcgaaagctaaaaatgattaagctcagtgaggaatgcatgaggaaaagccaagagaggccaaaatagagggcttttgtgccaaacaggtagccaagttgtgaatggaaaggaaaagttcttgaaggaaattaaaagcactactccagtgaacacacaaatgataagagagtaaaacagccttattgctgatatggagaaagtttgagtggtctggatagaagatcaaaccagcaacaacattcctttaagttaaagcctaatccagagcaaggccctaactcgcttcaattcaatgaaggctgagagaggtaaggaagctacagaagaaaaattagaagctagcagaggttggttcatgaaatttaaggacataaaccatttccacaacataaagtgcaaggtgaagcagcaagcgctcatgtagaagctgcagcaagttatccagaaaatctagctaagattatggatggtggtggctacactaaacaatagaatttcaatgtagacaaaacatctatcagaataagatgccatctaagactttcatagctaaagaggagaaagcaatgcctggcttcaacgcttcaagggacaggctgactgtcttattaggggctaatgcaactggtggctttaagctgaagccaattgctcattttccatacagaaaatctttggacccttacaaattatgctaaacccaggccagacacagtggctcatgcctgtaattctagcactttgggaggtcgaggcaggcagatcacttgagctcaggagttcgagactggcctgggcaacagggtgaaaccccatctctacaaaaaaatacaaaaactagccaggtgtggtgaagtgtgcctgcagtcccagctactcaggagggtgaggcaggagaatttcttgagcctggaggctgaggttgccgtgagtcaagatcacgccattgcactccagcctgggtgacaggagtgaaaccctgtctcaaaacaaagaattgtgctaaatctattctgcctgtgctctataaatgaaataacaaagcctgaatgacagcacatctgtttatggcatgtttactgaatattttaagcctaccgttgagacttactcctccagggaaaaaaagggattcctttcaaaatattacttcttgttggcaaatgcatctagtaactcaaaagctctgacagagatgtacaaggagagtaatattttcatgcttttaacacaacatccattctgcagtccatggatcaagaagtcatttcaactttcaagtcctattacttaagaaatgcattttttaaggctatagttgtcatagatagtgatttctctgatggatctgggcaaaatcaattgaaaaccctctgcaaagaatttaccattttagatgcccttaagtacattcacgattcatgggaggaggtcagaatatcaacattagcaggagtttggaagaagttgattctaaccctcacggatgacttagaggagttcaagacttcactagaggaagtcactgcggaggtgctggaaacagaaaactagaattagaagtggagcctgaaaatgtgcctgaattgcttcaatcttgtaacggttaatactgagtgttcacttgattggattgaaggatgcaaagtattgttcctgggtgtgtctgtgtgagcttccctagttttgaggttttgggacttggactggtttccttgctcctcaggttgcagatggcctattgtggcacttcgccttgtgatcatgtgagtcagtactccttaataaactcccgttcatttatacatctatcctataagttctgcctctctagagaaccctaatacaaatttcatgataaaacttgaacgaaagaggagctgcttcttatggatgagcaaagaaagtgatttcttgagatggactctactcctagtagagatgctgtgaacattgttgaaatgacaataaaggatttagaatattccgtaaacttagttaatacagaagcagcagcatttgagaggactgactccacttttgaaagaagttctactgttattaaatgctaccaaatatggtacagagaaatattttgtgaaaggaagagtccattgacatggcaagcttcattactgtcatattttaataacttgccacagctacctcaaacttcagcaaccaccagtctgatcagtcagtaaccatcaatatcgaggcaagaccttccaccaggaaaaagattataactcactgaaggctcagacgatcattactatttttttagcagcaaagtatttttaattgaggtatgtacatttttagacataatgctcttgcacacttactagactacagcatactgtcaacataacttttataggcactgggaaccaaaaatttgtatgattcactttgttgcaatacttgccttactgcggcagtctggaaccaaacccacaatatctccaaggtccacctgcaaatgcaggcagtgggccaggtatacatgcatacatatgccttatgtgaggggtgggcactgaggttaactagaaagcatgagcctatttttgccttgtggtaataagggcctcatattgccaaatttttccatttttttcaaaagaagtaggaaaggaaatgcaggcttttaaaatgtgaaatcccaattttcaattgttggttcaaaaaaaacttaaatctcaactagccaaataaaatgcatctggggtccacacccagctaccctataggatactaatttaaaatatctggactatagtctatattgatgagagaagtggggtgaaacttggcattcccttgccattaacttctagcctcccagtagtccaggctgccttgaataaacaccagaccatcatacaaaacagagtttttatcttatttatttatttatgagttgggtgtcttgctgcattactcaggatggagtgcagtggcacaatcatagttcactgaggccacgaactgctgtgctcaagtgatcctctcacctcagcctcctgagtagctgggactacaggtgtatgccaccacataaggctaattttaatttgtttttgagagacagagtcttgctatgttgcccaggctggtcttaaactcctggcctcaagcaatctttccaccttggcctctgaaagtactaggattatagaagtgagccgctatgcttgaccaaaacacagtttttaaatcaatttatgtctttactgaaatctcttaaagatgccaaagggtggggtttgggttccattcataacaccaacatttctgaagaatcctcttctcttgtctctttctcaagtcctcctcatgacatctgtgttagtccgttctcacactgctatgaaggactgcctgagactgggtaatttataaaagaaagaggttttaattgactcacagttccacaggggtgggaaggcctcaggcggaaggggaagcaaccacatccttcttcacatagcggcaggaaggagaagtgccaagcaaaggggaaaagcctttcataaacccatcaggtctcatgagaactcaagaagagcatggggatatgtggaggaaaagttaaatcttaaatttgaactcaattgaatgtggacacaaacaatggtcaccaagtcccagaacaggttgcatgagccccttgaggcgttcatccagacggttttggagaaatctgttcctgtatgttagttattgaaaaacaacaaacaatcataaaaacaagttgacctttttgtgttccttgagtccagtcatgaagggccctcgtgactgggcctcatgccaaataagtcgttacaaaaagaactagggtcccataccacgccaaagcttcatgagacctctcctcatctgtgcatggatgagcggtcaactctggagcccaggctgttgcttccctgtctggtgatgaatcctctatagtctggtaagtgtagtggccgactctggagcccaggctgttgcttctggtctggtgatgaatcctccatcgtctggtgagtgtgtgtgtatatatatatagtctatattgatgggagaagtggggtgaaagttggcatgcccttgccattaacttctagcctcccagtagtccaggctatatatatatatcttctcccttttccccttcccattgcaatttgcttgtatcatttgcttattatatctgcattgccatttacatgggataaaggttgtttacccttgaaggtattgcatgtgtgtcttttcttttccctttgtgcatctccctcatagaaaagagtaaccgcccccatgattcaattgcctaccactgggtccctcccacaacacgtggggattataggaactacaattcaagatgagatttgggtggggacacagccaaaccatatcaacagcccagcagctacttcagtcctccttaatttatctcttgaattctcccaaacccagctcatccctggcttgtttctcttattctttctctcgccttctgatccattctgctttcgttagtatgtaactccctgccttctcttaggtagacccatcaacccatcctacccatggtactgcacaattcagaatcctttcccaaattttcccttattatgcacaagaaatactccagggccaggtgcaatggctcacgcctgtaatcccagaactttggaaggctgaggcaggaggatcgcttgagcccaagagttcaaggctgtagttagtgatgttggtgccactgcactccagcctaggcaacacaacaagacactatctcaattaaaagaaaaaaaaagaaaaaagaaaaagaaatactccagaacttggctagtgaagactaattcctccttcacaggaaggaagtgggggcaggggaaaatgatgctgtaaatactctaaaatatgtattttttcctgtcccatcagctatgccatctgggatggggtgacgcctggatgagatgtcattttaaaggacatttctgggacatgctggcatcaaggcaagttttcaggctggaagccatttgggcagaggcagaatctgggctcagagtctagccctgcaggacccagtgtggcagctgcgtgtctctggagcactggagagggggctactgcaaattaagatctgctgtaaagagcatcttcctggttattctctgggacgcaaaaccatggtggtatctgatctcatcacacttctgccaggaggtgaaatcgaagaggctacattcttgatgctcagtgtcttcttcaggtcatttgcctgaggacacctggggatactgagccctcacagagcttccagtcctccatgaaatgcagggttgccgcctgaaaacagaccaaagggggcacacgacatggttctgacagcatgggtaaatacaaggaagctgggagccgtgcaatgctgcacacgtcccctccccggcttcatctcccattccctcccacccagctgctgttgcagggccccctgccttctttttcactctcaacagcacaccctcagtttgcccttgttttcatttccttttccccttacctcccatacctcttttccaatctctccccctcccgttctggttttgttgtaaatcacaaaatttcaggaacaggcccagcaaggacagaagccccaaggggcaggggaaaaggagagaaactgcatagataagaacaggcttcttctcagagtaaagactaagaagacacagccgtactgtaatagtagttacccttgtccgaagggcagtgcaagcctggaaaagggagaccacccgtgggctagggagtggggaagaagctcattagggtgtctggacacgagctaaaccttcacagggcacggggacttgggaaagcagaggggacggagaggccatgccagccc

SEQ ID NO: 779 - DNA, 2529 bp, Homo Sapiens
tcatgatccacccgcctcggcctcccaaagtgctgggattacaggcgtgagccaccgcgcccggccgagtccaggatttttaagggcttcagaagggaagaagtgcatgccgattggcccatgggcagccacgggcaggccagaaaaagcaccataagttctcactctgggccgcagacttcacccagaactgacagctgggcccccatacttcaggccatccctggcttgaaagtggtgcttcaccgggacctgcccctttctgctgagaagcctgtctgcctcctgccaccatcaatcatgttgtccatggtgcccaggctgttcctgcggaggagctcctgcaggccccaccaagccaccctcagcccctgtggcctccctcccgtgctcgattgcacccaaagtccaaatggagccaaagtagcatagggctggtgtgtcagcaccgccccaagcgcacgcaaacctggccgagtggcgatagtgcccaggctcagcctcaactttactcggaaataggagtgggcgccaggagcagggagaagccaggaagcgggagcaggcacttctgagcctgcgaagacagggaggcttccccggctcaagagcacagggatgcctgggtctgcagcctcggctctctgttgcagttgtgcctgtgagggctgggttcccaccccaccaactcagaaggggccagggctcccgcctgttcccagctcctgctggctgcatggaactgcagccctggccacgcctccctccactgcaagccgcatcttcaaagcggccgctccagacaggctgccactgccatcaactgggacaccccgaatgcttacccgaagcagagagattataataacacagctctactgggacaagtaaaagcagacatcgtttcctctacataatccaaaattagaacatttaaagtgtaagaaccctgaattcgtgtcctttttctgctactcattagccctctgacttcagtttctcctttttaaaaaatgggtaaaataatgtacctcccagagttaaaatgaggtagatccccaggggcatctttcccacccacctatacaggtgtggaaaggaggtctcaggtaccagcagtcagtcggcagcttcaatctttatgcttcaaatagcattgatgttggtgccatgagaaatcagaaatgatgaagatacagtatctgtcctcaacaagttcagaagcagaaataggagctataaggaaatcatccctaattcaaatcagaaagtgaggtatgccaacacagtagtgtaatcctaatctttattgtgttagaaagttcctcaagacgtagatggaagtccataccccaggagaattactcataaaaatgaaatttcctgttttcaaaaatgacacatatggtataaaagtggaaccacacatggtgatcttactaccctggggggtgctatgtaaatgggccagggatggtgtctggacattttcctaaaattgctcctatgttctttatttcttcacaggcagattagggcctttagcctaaagcttgccaataccaaattcagattcttacacaaccaattgctttaaatattaaaaataaaatccaaatatctttaatttatatttaagtcttaaaaatgcaaaatcttttttaaaaatcaaagtaagcatatatttagccatttagaacctacctactttgcgtacctcacaaaactacacccaacatctgcagaccatagaggagacaagccctgcagctgctaaagaccccagacaggtgctgcccttcaaggctgtcagagcccccaccttgctgctgcgcaacgtgatgtagacaggtggtccctctttggttcccctctcccctgggtgaaggcgtcacaccactgtctctggaaggtctcctgctggaagaaacttcccccctcacataaccctgtccacgcaccacccaagaacacttgttgtgtatttactgcctctcacagtcgtatttcttccttgatcgaccctgaaatccttaaactggccatagagagcaaccaccatctaatggaatatcaagcccttgccaaatggaacacagtttttttgggttttttgtttgtttttgagacggagtcttgctctgtcgcccaggctggagtgcagtggcgcgatctcggctcactgcaagcttttgaccttctcccctgagtctacaaatgtccaagagatatttcttctatgatggaaatattatatgtctgtgctatccaacatggtagccactatcaacactgaggacttgaaatgtgactagagcgactgagagactgaatttgtagttctatttaaatagtcccatgctaccaaattggacaacacagctatatataatttgtacattcacatgctcctatgctattctttaaccatactggttagttttccttgctctctctcaactacagctaaattcctctcaagtcttagagcttttagactaggagcttaaccagtttaatttaaataac

SEQ ID NO: 780 - DNA, 2280 bp, Homo Sapiens
gagtggctggacttgtgtgaagcgaaggggttgcaagacgctcccccttcccttttcttttttattgggggtggtggtagtgtttgaggacattgcgtcacctctcttcggggtggagggggggaatctctgcttataggagtgtattttgtgaggaagaaaacccataaaatatccacgaccttgcagctgttaagaatccagacttttcagtcccagggcggggctgcctttccccccatcccgctccctttctttggactaaagggaaagccttcctttcctggggatgggacgcccgtttccactgaaagtgaaatcactgtgaacaacctgaaaattggaaagttggaccagctgtggggagagaaaggtcttcgtgtcctttcccacgttcaccgtgccagttacacacaaagcagagatttttttgcttgaatcattaaaagccgggtgggtggggggcaccctatgtactgtcttgccctccttcggcccctttctcacatttatttgccattttctttttgctgacaagttccattacagaatgccccctccatcccccgccgccagattttttatatttcaattgttatttactccaagagtgtggaaagttctcctttaagattcccccgccttgaactctaaactcagagtggaaagggaatctgaaaagtctctcatttagcaacacatcacatcagtcctttttgtcagataaacacaggcacaattgcttttaaagatcttcagaaggaggagtccaccacttccacagtagatccagagagacccgaactgaatgctttgccttctccttgtgttaggagttcagaggttccatttgctttaaaacacaagaagctactaataaaatatatttatttcggcaaggtacctattttctccaaaagtttcaccttcagtaattgccacaggagtaattagaactctgtgttctataaaatgcctgacacattaaagacacaaaattagcatttgtttttattcatgcaaggatttaaaaccaaaccaaaacaaagcaaaacacccagcaaatatcagtttcctacaaatagtgtaaaaaaacctcttgaggaatctttgtgacccacactccaaattgaaagagtgccatggatttccccaaatttagaatcctgtctgggttagaggatttttttggaatttctcatcacttgacaaaacagttttctcttttcaaatataaaagagctccttgtaaaatgcttggtaaatttctgggaagccgagtgtttcttccagagggaaggatacctggaaatccggatgtaagcaagataaacctgtagctaaagctttcttaaaattcattgattctgggggaaggaaataagtgattagaaaagtatttggtcaaccaaaaccatgatagtttgatatatttactgcactgaaaatacactagaatcatatgcatagtggagcttgaagtggaaagcccaccttacattttggaagaaacttttatatttcaatcccatagatatctaatttatttaaggaaacaggatatctctgtctcataagaaaaaaaataacatctgactgatttttataggaatgcttgggagtttactcttttacttgaaaggttttttttttttttgcctttttttttaaactttagaaacagaggcgtttcttagttaagataacagggcttactacagtattctttaattatcaaggtcccttgtaactctaagtctgttatctctaattggagagataattaaatcttaaagaccactctgactctaattcaaccaacgtgtgtggtgtccaggatcgttggacttccttaagaattctattttatccaggtgggttcttcctcagtaaattgtattctcctattggtaggaaatactcttggatttctttctttctttctttttctttctttctttctttctttctttctttctttctttctttctttttccttctttccttctttctttctaaaactgtattcagagagagaaatgtgacaaaaaaagggaaatcaatagagacagaaagtagattcatgggtacccaagtttatgggctgggaacaggaattaactgtaaaagggcacagggaatcttattgaggtgatggaaatctgtgttctaaaactacattgcagtgatgactgtacaatttggtaaaagcttcaaaattctggggattatacacaaaatgagtgaattttacggtatgtaaattatgcttcaataaag

SEQ ID NO: 781 - DNA, 986 bp, Homo Sapiens
tttgcaaatagtaacgacaaagatgatcaagttttaaattgccatttggcagtgaaggtgctatccccggaagatggaaaagcagatattgtgagagccgctcaggacttttgccagtgagtagcccagaagcaaaggagacccaaagatttggatgtagatatgttagtttactcagttcaaatggttgtcctgatcctgatttagtactgaagttcggtcctgtggacagcacacgaggctttcttacctggcacatcagattgactgagattgtctctttgccttcccatctaaacatcagttatgaggactttttctctgcccttcgtcattatgcagcctgtgaacagcgtctgggaaagtcgtggtcattggttgcataattccatttgaggcttatggaggaaaggacccaagtgactctgatgtttagaaagcacctatgaaaccctgtacacacctagttcataatcttcataatttatcaacaaacaaaaaagtgtcttacttgagagtgagtgtgtgcgtgtgtgcgtgcacacatgtgcacgtttgtatgtgtggaaataaacataaatggggacgtgttggagaaggaaatacatagacctacaactttgagcatatagcagtgatgttttaggaactgaaatgtcacacttaataaagtcttcagcccagctacttccctgttttcgtggggagaagagggcctgattagaactgttctggttgtgtttggcgggaggggaataaattttgttcagtccttcttagtgaccaaactttaatttttaagaataatatattgacttactgaactgaagcattctgagttgaaaggagctccagaggaaaggagttctgtgttgctcacatgttaaaagcttgctcaccttcagagcagagggaatacctatcttcagatatccgcccattttcatctcttcattatagtcaaacagtgtgacttgagagtgttg

SEQ ID NO: 782 - DNA, 5178 bp, Homo Sapiens
gggttccgaggcggacctggggagcagaaacccctgtttagggtgaaccgtggcgggcgccgatggcctcttggaagaggacagactagcagctgcgagggagatgggactgggtttcacccctgaaagggcccctggagacagcggggaaactgacagggagatcatgatgtcgccattttgatggggtccccagaggagagatgtcctccccaacggctcctggacaggactggggaaagagttcaggagggctgctgaacgccggagccttacaactgttaaactcaggcagagctcgggaaatgctgcccggatgggtgagtccttttaacacctcttgggttgatttttctcacaggttttcggggtttgcagagctctgagactgtgaccacagggtgagacctcaagctgcccagtactgtggccccatttcagaggccttgggcctgggccagagatggacgctggggctgccttttactccaagtttttttcttcattggtcattggtcattgggctccaagaaaagcactttttcaggaatcaaagaagcagtgatggaacgaaaagcagagaaagctgatgagccctgaatggaggtgaaacttccaggaaatatcacttgcctcttgattaggggaaatcacttttgaatgaccccgagttttgtgccccaagcatagattctggcagaaagaaacagtctggactgatgacacactacaacatttggtcatgtggaaagaatgatcttcaggaaaaatcacacccttggcaaaggctttttacagaggcaagggcgagccggccaattctgacaatattccagtggcaagggagccaggctgactcagtcatcattacttgtgtttcgtctcttcctcccacatctccttgtataactgtcttttggggaggggtgaagtgatagtaagaaaaacaacagcactttgaaaaagggacagggggagaaacaagaaggggagaaagagttggggagagctcttgggtgatggggagatagcactggggatgttctggagcctgacagaactgtgtggtccctccagctggagatgctgggaaaacaggaagggattcgggagacggcagggatgaagttggctcatgaaatgcagggctcccttagcactttacaaataccagcttacaaacactccacagtcatcaggaaacccttgatggatgctgcacagagatcgaagttcaggagcagcaccaatattcatccggggcaattggagtgagagcagcacaggatcacagcctgatttggcctcagaggctttcttatctcttgcaagatctggaagccatgcaaaaggtgtcatggggagaggcgctgatgtcaggcatttatgggaccactgagtgggggcaaagaggcaggagaaaaagccagtgatgatgggtcgacacctgcaggtagacccatttgcaggttattagaaactagcttatttatccagcttttttttttttttttttggagatggagtcttgctctgtcgcccaggctggagtgcagtggcgtgatctcggctcactgcaacctccacctcccaggttcacgccattctcctgcctcagcctcccaagtagctgggactacaggcatctggcaccacgcctggctaatttttttgtatttttagtggagacggggtttcaccgtgttagccaggatggtcttgaactcctgacctcgtgatccacctgccttggcctcccaaagtgctgggatttcaggcgtgagccaccgcgcctggtcctccagctctctttttgtggttatcttagacgctatgaatctacttgaaaaccaagacgattgatcctttaagtgagctgcaggtgtccacctgggcgtgttttctgcttctaagccacaggcaattcggtgtgcaagtttaacaccctgataggccctagccttagctctgttttaaactcccaaaaagtgtttttgtgtttgtgtgcatgtgggggagacaccttaaaatccagcaatgctgtgtccacagtgctctcctgggccccttccaaagatgggaataatatgggcagctggtttcgatttttataacttgcaacagctactctgtgaaagcggtgtgcagcaacagccaggcaatccggacagacttattaaatgtgctgggcactgggcactgggcactgggcactggaattctcctggttgtaggcaagctgggggacagggaggtgagagctggaatagtcattctgaagtgtgatatttattggaccccatactaggtgactgatggagaggggctaccactcttccagctaaactccgctctggttgggacccagcaattattttccatagcgaagtgttaataaaatatctgttactcccaacacaacctcctgggggaagggacctgtctgtctgcttcaactttggatcctcagtgcccacatcaggatacctggcctgaggtgagtgctgtagaaatagctgttgaatgaatgcatgagggcctgctctgcctgagggctggggacagattgggtgttttctgtgtcccctccagagcatccggtgacccagttttaggtctcaaggtcactgccaagaaagagaagctgctaaagtgacacctctgtgcacccacatgacttaacacaaaagttaacaggagctcttcaaaaacaagcctctcgagtgtctgtctcctgttttccctgaggacagcatcagtggcatcagataggggttggggctgggtgacctgctggtcctcagccatcactgtggcccagaggtcatttaagcagctctctgcttagcagacaggcagagggaatagatggaaggtacaggtaaacactgcatgtggccaccgcgaggataccccggagcctgggaaacagacagggacgtcgtaaaaccaacacataatggaccagtgcagagacaggcaaaaccagtcagaagaaataggatggtgcctagcccagggacacctgacttaaggtatttttgtttgtttgttttgttttttgagacaggggtctctctctgtcacccaggctggagtgcagtggcatactcactgctcactgcagtctcaacctcccaggcttaagcgatcctcccacctcagcctccttagtagtagctgggactacaggtgtgcaccaacacatccagttcatttttgtatttttttgtagaggtggagtttcgccatgttgctcaggctggtctcgaactgggctcaagcgatctgcccgcctcggcctcccaaagtgtggggattacaggcgtgagccaccacacctcgttgacctaaggtattaactaaagaaagcaggtgattctcaggggggctatgaaagcagcatgcctaagggacaggaacgtaccatgaaggtgttgtcttttgaggctcagtccaggagaagcaggtcttttagacccaatgacaacgctccctagtgtgcaggtgcgtctctctgatgacaaaaggcagtgtgattgtgatattttatatatatatagtttttgttattgttgttttggggacaggtctcactctgtcacccagactggagtgcagtggtaagaatacggctcactgcagcctcaaaatcccagtttcaagcgatcctcccacctcagcttcctgagtagctgtaactacaggcatgcaccacctggctaatttttcaaatttttttatggagactgggtctcattatgttgcccaggctggtctcaaattcctgggtttaggcaatcctcctgcctcggcctccctcaatactgaggttacaggcgtgagccactgcaccaagcctatattttgttttttgttcacggttcctggcttataactcccatggcccttgttacagtaaacacgatctccctccctgacattcttctaccctcctttcacctgcccacagcaggactttaatctgattctgcgtgtaatctcattgcagagagggtcctgccggtattaccctggaggaaggaatgctgcacagaggccgagaggaatttgaacagactggccttgctgggtttttatctctttttgtccaatcccattttgacacagttgtccatgctccaatcatgcttatccaatgaagtttccataacaggcctgagaggacagggttcaggagcttccggacagctgagcaggtggaggttcctggagggtggtgtgccagggagggtgtggaagctctgccccttcccccataccttgtcctatgcattcctttatctgcatccttcattttattttatttttttttgagacggagtcttgctcttgtcgtccaggctggaatgcagtggtgcgcgatcttggcgcactgcaacctccgcctcccgagttcaagagattctcttgcctgagcctcccgagtagctgggattacaggcacccgccaccatccctggctaatttttgtatttttagtagagatggggtttcaccatgttggccaggttagtcttgaactcctgacctcaggtgatccacccacctcagcctcccaaagtgctgagattacaggcgtgagccacagtgcccggcctgtatcctttataatatcttttataaacaaccaatcagtaaatgtgttactctgacttctgtgagctgctctagcaaattaatcaaatccacagaagggtcatgggaaccccaacttgaagcctgtccgtcagaagttccagagtcctggacttgtgactggtgtctgaagtgggcaagtcttggggactgagcccctagcctgtgggatctgatgctatctccacatagatagcaatggaattgaattggcgggcacctggctggtgtctgctgcagagctcattgtttgcttagtggtggagagaagtctccctccacatgtggtcacagcatcttctgtctgtgttgattgcttttgatgttgatcgagagaacaggaaaaagcacattgaatgtctcaatgatgaagatgacaataatctggcttctaggttgttatgcggcaggcaacagctgtgcagatcctaataatctactctgggtgacagtttaacacaggggttggcaaatgtggcccacttcctatttttataaataaagttttattgaaacatg

SEQ ID NO: 783 - DNA, 4177 bp, Homo Sapiens
gcgaccgccccgccgggaggccctgcacgcacgcgccgccggccgggccagattagtgtcatctttgatcactctatctacatccaagttatcaatatcccttcaatggcacagcactcaggacagcactgccactaaagatgccaccatctggctatgctctaatcgggcatatgtgtcctcatcccatctgcagagggtctacaggggcttgcctcttgttgccagcactgcctggctctgcagcctactcaagaaaagaaaatgaaagcagcctgactccattcgtcatgattccttcttttccttttgaggctcacagacagaccgttggccagcctcgcccaggactgacgtcaagttcatcttttgcccttgtttgggctgggtcctctggcccagcgatggaacacttgtgtaccttcacctggtgccctgggctgctccagaccctggcctctggctgtgccaaagcaggaaggacagactcagggtgttgcctgtttgctctggtggggagaggctaagaatcgcagtgacgtagggagagaagaaagatggacccatgtggcaggagattgtgctcagggtagagtcagcaaaacactgacaagattccccaaaactctggccagaaagtgcctgagatctccgtttttagattctgttctttaaagatacttcatctgtatgtgtccttgagtagaaggcaagttctccttgaaggggacacgtttctctgctgtcatcttaggacaacttctttgagaaggagactctagttcctgcagccatttgagaagggggctggaggggctgagccaggaggttttgggggtgaggcccaggtagaactttgtggcagggagtgctggggtgtgcacccacatgggccaccccacaagttgatggggaaagggggcaagtagggagtacaaggatggaaggggttctcttctccccacccactttgcctggctgactcccatttgtccttcatatctcagtttcagcaccaattcctcagggaagccctgcaggcctcagaacaagtgagatccccctgtcattccctcccagagcccacactttttatccatagctcttaccacagttacagttaaggctgtcgcaaggtgtgcgggtatctcgcctccatccacgaactctctgtgatggcagtggccaagtctatctgttcaccactgagtccgagcacccagccctgggcctgcacacagtaggcactcagccatatggagtgttgtatgaatgaatacatgaatggaagaatggacaaatataactgggaggacacagtgcagaggcactgcagccccttctcatttttcgctggcctagttggacacagaggacttggatgaccagaggagggacgccacctggtggtaagagtgtggagtgagcattgagttcccttctcaaaatttgcctccagtaaacaaaataatcctgccttctagtcaaccctatcaaagagctgagcatcagggaaaaactccgatctccaggaacaaatgacaaaaaaaaaaaaaagtagaaggcactgtttccaaatggagcagaggaactgaaatccaagttagagacatgatctataaacacacaggaaagcaaccaaaagaaagcttggatttgctcatcatttcatctaaatgtagtgataataataatgactttccacttactgcgtaatactacgttccagatgcatgggtacactgtgctgtgtgctgaacatatttaatctcctttaattctcagcaacaaccttataagggagatattactatacccattttatggggaacaaatgtcagttcagaaagtttgagtaactcccaggatcacacagccaggacctgacaagctgggatttgacttcaggtctgtggactctgaaactcatgatattaaccattaggttagacacctgatagatatggccattcaacaggttgaaagtggatctcatcatctttgcttctcttcctcctccacttcacacctcagcgaacagcacaacctgtcctccccacacctatccagttgaccaagccagacatccaggcaggtttgtttttgtttttgtctttgtcttatgtttgagacagagtctcactctgtcatctaggctggagtgcagtggcaccatcttggctcactacaacctccacctccagggttcaagcaattctcctgcctcagcctcccaagtaggtggggttacaggcacccgccaccacacccggctaattttttatatttttagtagagagggtttcaccatgttggccaggctgctctcaaactcctgacctcaagtgatccgcccacctcagcctcccaaagtgctgggattacaggcatgagccactgtgcctgtctcacccaggagttttgataccacacctaatcactcaccaattttgttgattctctctcataaattcacatttttttcctatgctctctatcctcactgctgctgccttagttcaggccatgcccatctcttgcctgattagagggtctcccagcagtccctctgcttcccagcacatgtgtgattatttatttatttttatttatttatttattttttgagacgaagtctcactctgtcactcgggctggagtacagtggcacgatcttggctcaccgcaacctccgcctcccgggttcaagcaattttcctgcctcagcctcctgagtagctgggattacaggcacctgccactatgcccagctaattttttgtatttatggttccacaggctgtacaggaagcatgatgctggcatctccttggcttctggggaggcctcaggaaacttacaatcatggtggaaggcaaaggggaagtaggcacgtcttacatggctggagcaggcagaagagagggagcagggaggtactacacacttttaaacaaccagctctcatgatcactcatttactcactatcacgagaaacagcaccaagaggatgatgctaaacattcatgaaagaccatccccatgatccaatcacctcccactaggcctcacctccaacactggggattacaattgacatgatatttgggcagggacacagatccaaaccatgtcatccctttaaagaagtaattaaggctggatgtggtggcttatgcctctaatcccagcactttgggaggccaagggaggatggcttgcagctaggagttggagaccagcctgatcaacatagcaataccatctctaaaaaataaaaagtaactaagttaaagtacagtcatcagggtgggccctaatccaatgtgactactatccttataagaagaaattaggacacaggaaacagagggacaaatgtgaagacatagtgagaaggtggccatctgcaagccacggagagaggccccagaagaaaccaagctgctgacatcatcatcttggacttctcgcctccagaactgtgagaaaatacattttcgttgcttcagtcacctagtctggggcattttgttacagcagccctagcaaactaatacaatcaagaaaggaaatcagactcagcaaggctgagggacccacctagcgctgtctagctccttagtaatgcattcatcacattctgcctgtgaccactctcttatgttgattatcagataaaataatggatttaactcttattatttaacttcttgagtgtttgggtcttattgctccaactggcactcagggtaaggggccttgtcttccccttctcagtatttgcagatatcctagctgagcttggtgcatcttaacaataactttttgatgcatttcttgttgttgttgtgtggttgattgacacatttggatgggtaaaaaggagcctgatggctgggcatggtggttcattcctgttatcccagctgcttgggaggctaaggtgggaggattgcttgattccaggagtttgaggccagcctgggcaacatagcaagaactcatctcaaaataaaagtaaaaattaaatttaaaaggagcctgatggtaaattcctgatccccaagagacacatacaaaggtaaattcctgatccccaagagacacatattctgccagtgatcacacatattcccagaagtagaatatgactcatctctgaatgtctaaata

SEQ ID NO: 784 - DNA, 2672 bp, Homo Sapiens
agtcgggcccggagcccggaaggagtgccccgcggagagtcgagcttccttccccggggctgggggttccgcggagctcgctctgggctgtggcgttgctcgcccgcgagctcctggggagttcgggggagctgctgggctggtgcctggagcgggggccgcctccaagtattgtctttcgaattaagttactgtcgtctgtgttgtcaggcaacaactgaccttaaataaaaatgaaaaccagaagtaggctacacatgcaataggctacacatgcaataatggatacttaaggaatgggagtggctgctggtgactggagcagagagggtgtggtttccccatgtttcggggccggggggaaggagtaaagtctgtgttcagagcccagacgccatgtcggtcatcacatcaccgggagaactcgtggagcctgaggaaaggctacggggtgccagagtctgaaggggcggaagattgcattcctatcacgttcgccgtggcgcacaggggctccgctggggccgccgctcccgcaggagaagtgggcctgagacggtgcggcgtcgaccatagccggcccagcagaagccggggaaggccacaagtgtaactgggtccgagtactgtgaagaaggcgcctcccatggagaaagctaccgggtagtttaacaaggtggaaaagcgttggcctggggaggaggaaaggatgctcagaaagttgcctcaaaaggacgcagaagtggaggtgaatcttctgtttcagaggcatttttttgtgcctctgtgagaatgcattgcttcctggttgatccatcttcaggttttctctccgtcctagtccctgttctgccaccattctgtgtttgaatctggtacctaaagccgcagatacttggttcatagtagatgtccactctgcagtggctgaaaacacggaagaaaaaccatctttgcctgggaaggacattattgctagtgccattactgtcaacagttggaacaagataaacggcatgcccaatctagttgaggattttggacaccgggcctcccactgggactccgccgagaaaccaggtctgccattgccacctccgccgggccttgctgtcttagcacaacggagtctcgctgtcacccaggctggagtgccattggcgtgctctcggctcactgcaaacttcgcctcctgagttcaagagattctcctgcctcagcctcccaagtagctgggattacagcgcgctcaggaatatatgttgaaacacagagaaggaggagactgacttcgaggagatgcacaggaagatggccatgtggagacagaggcagacattggagtgatgctcagaagaaaaggcactctaggagcctgcagaagcctcagagagcaacaaagataaaaagaggcctgaaccagcagccttcattacaggcaagagtactgtgtccactgtggcctggacaactgtcttcttcatgctccaccattattgcacagaatcaccactgtcatagccagtcagtcacagggcatccagcagctgctgcaggttgagaagcaggccgttgagaaggtgtcagaggcctgcagccaaaagaaccagaggctgaagcaggccaaagtggcagttcaggctgaaattgaatagtgccacctgcagagggagaaagagttcaaggccaaggaagctgtggcactgggaccccaaggcagctgcagcacggaagtggaggagacccaggataaaatgaccatcctccagacctactttcagcggaacagggaagagggtgtggataacctcttggcctttgcggcatccagccagaaattcatgaaaactacggcataaatggataggaggagaagcgcctgttccatggactggcattttagctgccctcatgaaataagaaactttagcaagctctagttatattctaatgagaaggcatttaattatttctgtatgttgtatagttggtcccttcactttatggagagcagcaaatccagtttcttgtgcagacatagaactaaatgtgtcatccttttacttcatgtttcttaggaatttaatggttatgtgctgtctgttttcctatgccttttggctcaagtaacatatagcaatgttgactttttcttttttagatctagtaaaacaacaacaacaaaacaatctttgaagaaaggaagggattaagtatttttcctctaatactttcttgaaggtcaatgaaaaagtggtaaatagttatatgtaacctgtgtgaagcagcagccagccttaaaggagtccattccttccaaggcttagaacagtgactactgctgtaattgcttaggctgctgttagtttctcttaatcaaaattactatgtgatagaattcatgttattacttggtgtactgaaaataatttaaaagtaaagactctgtcgtgcaagaaaggaaaaaatgagaggcaaagaatgttaaaatagaaaaaatgtttttatgagagagttaaccttttaatggcaactatatgtgaataaaattaaaccatcacttaaaatattcattagaatgaataatagaataaccaagttcataattagtaagataaaatatattgttgttttttcgttattttttaattcatattagaatttctgtcagt

SEQ ID NO: 785 - DNA, 3569 bp, Homo Sapiens
aaaattttgttcaaaactatttttcgatgtcccatgccatatcagaaaaatagtgcatgttttcttgcctgaaatggagaaaactctccaaattgcttttaaataatgtccaatctcaggccaataagcactgtattaagtagtaacagactgtgaggagacagagagagacagagactcagagacagagacagagattctagaatatgcaaagacaacaaattccagaaggctattacaaaatggaagcaagaactaacgtctgccaaggtagatcatctgaatacctggactctctaaggaatgctcattgtgttaggtctctttttaggaaactctgtggtgttgagataggccactgggagttctacttgcatgattttactctgacatggtgggccgctattcaggcagtgtcaacatacttgcagtgatggaagatgtttgggtttattctgagtggaaaatgatgtatttttgtttgtttgtttgtttatctgtactttggaagtcctgattgaggagcctgaagatatccacactgagcattgatctgtgcatcagtaagtctggatctaaagaggaagatccacactggagcacaggtcttctacaatgtagtcatcgtgccctgtgtgggggccaccatgggatgggccccaagaacatggtgtgaacaacaacagcaaaaatggtcttgacctcagagagttcaggtctactctgatgggaaagaaaatattacacagtgcccacctttccgatggagctgaaggagacggagtcagagggacttaaaacagtaacaacaacaacaaagtgacatggaatccatgaaagggagtgtgacagataagcaacttttcaactgtattcgcatttatagagtgttttaggaaggtaaatattgaaaggaacacaacgaagtaaatgaaattagaaatgcacattttattttgtgaaaatacaattttttgtctgtactaggactatatcaaccagaaagatagctctccatgagacatcatgactctctaaaagatgcttattgtacagatgatgtttttctaaatttacagatctttttcacctttagtgtttatgcctggtatacattttatcctatattatcttgcacttttatcattcatgaaacattcagcaagtctttactagctcgttggtgaaagcaaaatgaatacacatttctccccatttggcagacattttctgagggtgtaaatttaataaagttatactgagaacttcttaactacctcctatacacaagatatgcacacactgagagaatggtgcagatgtgttaattagtatacatagaaaagtaaataacaattcatggcaatcattgtatgtaggcaatcagtagggtttctattagattcattagttctttcattcactcttccaattattcatttgaaatatatcttcacatttcattcaaaacctaagattctctgattgtatgatatgatggcttcaaatccactcacttgtctaggtttaccttgaactcttctttatgatgtgtgtgctctctttccaaacagccctaagaaaagaggtcagaggacataatttctctttcttcagaggcgtattctctgaaactcctggaagcatgctatgaaagcaagtaatattctctccatatctacttgctaaaagaattagtgtatatatgcacataaacatacaaacagagatacataaatacatgtattttctaaatgtggtgtcaatatctcatcaatattctgtatctcatcctggattgagttacttatcccaaggagtctcttgctaaactgtagaataaagtatcactcagggcattttgatatatccaaattaatgcagctattttaatgccaccatttttatccaggaggttgtttgtagaattttttttatttggtcccattaaaatatgaactcactgcatttctttgttcttatttatcagggaggccacttaagagaagtcataattatcagcccattcttgatcctatctccaacacaattcccatccctcgagtgaggtaggcaaataaattttcccattgtgccttcatttgtatttatgcttatttcctgtctattcaaaattctccatattttcagtccaaattgcagaagaagctagtttggttggcttatttaattactattaactttactgagtagagtcatttatggctgaacatgttattgttcatcatggaaagtatggcttggttacctttcaataacaaaagcatctgatcctgatctaatcagtggccaactctgcctataggatacttcactacttatttcataagcattggtttgtggataatgcaggttcacaaagaaacagatattgggtatagcttggctgaccaaaggtgctaatttgcctacaacaaccccagtttgcatccgctgtttagctctcccagctgtctaactcacctatccttcctcaagtattaatgtagatacagtgccctttgtgtcattggttgctatctttctatatgcatagtttcaaggatgtgcctatctaaaatgatcaaacctacacacaattattgccttccaataaggatggaattcaaaggcatctctggttactatatccacagagaatatcacaggctcctttaaatgctgtttgtcttggaatccacagtctccatatgttgtatatttttcctctaattccatcataattccacccagatgttaccagatcatctataagctatggactacatagtaaattgagttaccaatacagttagtgaagagaggataattagaacacatgcaaacacttatgaacaatggcagtaataaccaggcacagatgaaatctgaagtcctttttctacttcacaacagtttagcagtttttttgttgttgttgttgttgtttgtctcttattttctctgtggcatattcttatagtctttggctttcacccagaaccccagttggctataactcttagtataatggtgtgagacaaacccctggttgttcagaatccaaggcctttgtggtcttgcctgtgcaatgcagtggtagactgttgttaacttttaccactgaccatggtcatacaagaaccatagcagagattccccaagtcccaaattcacctgctatgaaaattcacacctaagatgtctgcatagcatgatagcacctatgatcacttgtttctctaaaattacggagttttgagattgttaatgtgcagttttagtttccaacttaatgaaatgtaggtcttttctctaggttgaatgatacttcttttgccttttataattgtagaggagaaaaagtaaagattttgaaatttatccattaagaataatcatgagagattaaatccaacacctccaaagcacggtgtcaagattcaagtgttattgcagggaaaaaaagagataatgtttcagattgcagaccacatcttagaagcaagttcatcaggaaaacctcaaaaatcccattttaataaagacatttcacttctagagcagtc

SEQ ID NO: 786 - DNA, 20589 bp, Homo Sapiens
acactctcccctcttcaaaagaggagggactggaaaggaaggagtccaatccttaagagagatgggagaaggacagagagtctcggtctccgaggataagtccagtcaaaagctcgcacgggctgtcctagcaggggctacggcggccgacaagtcccatgagcagcacctccgcttctgcacgcgcttcccaggccggaatgctcggcgctctcgcgaggaggggtaccgactggggcgggagtacttcggcgagacttcctcctctttcggcccgacttcctcctctttcggccccgcctcttggcgcggggtcgcaattgggcgggaggttctcgcgatctccccgtccacgcctgcgccgcgagaggccgctaggtggaaggggacttcggttccgcacgtcgtcatgttgttggatggcaccagtatgtgacgttcctaggaacttagctctgaggaaaaaacaaagcaaaccggggaagtacgtagccttgaaccggagtaaccagggacagaaaggaaggaaaagggtttcataccttcacggaacgacgctcacttcgtccgcctgaggaggaaaaataagtttaaacctttctgtgaaaaagaacgtggagccctttctgccgaatggaaacccgctaaaccccgttatggagtctgctacaattaagcatctaaccaggaattgtctatggacacaactctccaggcaattcatgcagaaagtgtgttgacgatttcctgtttcttgcagagcgcttcaccgttaaggctcttagtagctggcgattgtaaagcacattttccgcttcatgaaaatacagtgctcttcttgtgtttgtaaccttggaaagtaagtctgctatgataagtttagggaagtggcggggagctactttcctaacatatctgtgattgttttgatacttctcagtttctcgcgggcatttcctgcgttctctatagggctctcttgcactgaataaggaaaggaggaattctctctgcattgaggctattatcgcacattgtgcggtggatatagtcacgcgctgggtcgtagtagcgtgtcgtttatttcagtccagctcactcttggtagaatccctttattcgttttgttgtttttgatagtctctctctgcttcccaggctagagtgcaatggcgctatctcgactcactgtagcctccgccttgagggctcaagcgatcctctcacctcagcctcccgagtagctgggaccgtagacgcctgctccccatccccgctatattcgttctttaatacagtctctcagcttgttcagctgccacttctgtgcagctcattagcctgatcggtgaaaactaggcgagacgcgcacactgaccctgcagtgcatcttgggagttgtagtcataactaatcaatggtcttgttaaaacgtgcttatgttttgaccagatcgcttaagtgtggacacccttcagcagtacactacaacgtgggtcagtgtacagaacacatgctgatagaaataatttcaaaatctggattcatagtttttttttttaatctagagacctcagaaaatgtacttgaagaaaatcatcataatataatacataacaatagagccaattaattgatgtgatgaaagtggacaaaatgtattttgacctcagagaaaataacatttctgtcttggaagagtcagagaatgcttcacacaatttttgagcctgatgttagactctccagccttctgtccaagcctcaccctttggttactccccaggaagactgaacttgggaagaggattgtgcagaccctggagtcaggcttggcgtttgggatagggaatactagagtgcccacagcatggtctggaaaagggaaagtgggctgcaggtggctacagtcccatgattccatggatttcagacccctccaaagcacagggctcagtgcttatccaagtctgagggccccccataaccacatcttccccagcagatgttctttgcttcaggcagtcatcaaagttccacttcaaagagttgctaaccaaataagcccacaatcttccttttttgttgttttgaataagtaatgcctttacacatatgaaattaaaaagagaggccgggcatggtggctcacgcctgtaatcccagcactttgggagggcgaggtgggcagattgcccgaggtcaggagatccagaccagccaggccaacgtggtgaaaccctgtctctgctaaaaatacaaaaatcagctgggcgtggtggtgggggcctgtaatcccagctacttgggaggccgaggtaggagaatcgcttcaacctgggaggcagaggttgcagtgagccaagattgcaccactgcactccagcctgggggacagtgtgacagactgtctcaaaaaaaaaaaaaaaaaaaaaggcaaagatatatagtgaaaactaagtcttcttttagtctttgtctcctgccactcatagaattttcctcttggaatcacctctattccattttcctgtgtatgttgccagagcagggctggcttcatggtggtgacctgtacagataggcacttggtttaatgttttgctgtcactaacttgaaattcaggaaagtttctggacaagggccctgcggttttattttgcactgggcccacaaagtatgtatctagtcctattccagagatattctatgcatatacaggtaattatatgtagatatgtatgtagtggtccagtagtggtccagggcctgttaggaactgggcggcacagcagaaggtgagtggcaggggagccagcatttcggcctgagctctgccccctgtcagatgagcaggggcattacattctggtaggagtgagaaccctattgtaaactgcacatgcaagggatctaacctgtgcactccttatgagaatccaactccccctttccatggaaaaattgtcttccacaaaaccagtccctggtgtcaaaaaggttggggacctctgtagtaggctaccatctaggtttgtttaggtacactctatgatgttcacacaacaaaaaatcacctgatgatgcatttttcagaaagcatccccattgttaagggacacatgactgtaatggaatactattcttttccttcctttttattttttgtggagacagggtctctacatgttggtgcccaggctggtctcacactcctgagcttaagggatctgcctgctttgacctcccaaagtgctgggattacaagtgtgagccaccatatctgaacccctgtcccccactttttttttctttctttttttccatacacagtccaggctggagtgcagaggtgtcatctcggctcactgcaacctccgtctcccggattctaacgattctcctgcctcatcctcctgagtagctgggattataggtgtccgccaccacgcccagctaatttttgtatttttagtagagatggggtttcaccatgttggtgaggctggtctcaaactcttgacctcatgtgatccacctgcctcagcctcccaaaatactgggattacaggggtgagccaccgtgcccaggacagccttttttgggtcagtgtgtatatagagctaactcattctacttaatggctacatagtatcccactgtgatagccgcaaaaggcagacaaatcctaggcagacaggggcaggtccctggtgaaacccttcaagctgaggacagtttaaaggctagccacaagaccaggataaatccacagaccagattgagaacctctcttcccatttggcgtgctttcttctgattgatccccacccttcacctattttacacatatcctttcctaattgtttttttacactgttgtacctacctttgagtggtgctgttgttttagccttttttgcatactcacaaaccaatcagcatgcacgccttcattctgagcccataaaagctgtggactcagccgcactgagagagagaccacctgactttgagtgagggaccacccttgcatcctctctctcctgagagctgtttcatagttcaaataaaactcttctccaccctcctcaccctttgattgtcagcgtaacctcattcttggacgctgaagaaaaattcgggacccaccaaacgcagatacaaagaaggctgtacacactgtggccctttgccctctgctggtggagggcaaccgtcccacacaacgcgatgggaagcagcagtggggcagagccagtcctgaagccacgggcctgagtggggcaatgggactgatagagctgttaacatgccactgtccgttggcctgcagacggcagaactaaaagagtgcttagcatactgtaacacctctggggcttcagggtcatgagcacccctgtttgggtgccaccacatttccctcaatgtgacacacctggtccagccacaagccccgcacagagcccactcctgccctgtactcgttcactcacacaccccctcctgccaggggctgaggccatggtggctgcaggattcgtgcctgagcacaagccagacacatcctggtgggccgagtagttggggtgttgctggccggaggtctccagctgtcaaagtggccaagaaaaatcctgcatcaactgtacaaatgtaccctaatttatttaactcatttattgtatatttgtgtcatttccaatggttcgtaatttcaaacatatgattgtgcaaaagttgttttatgtgtgccaatatctttgtaggttaatttcctagagcaaagtttttcaacctaagcaccactgacatctggggctggataatttgttgtgaggggctgtcatgtgcgttatacgatgtatcctatccacccctatatgttatgaaaaatatttcagtggccagaatcctttcaatgacttaaaaagcccttttcatcctgcttctgcctacctctccagctgcatcttagtacccgcacactcttttttcatactcatgcccctgcttgctgtctttgcacaggtattctctttgtctggagctttcttcctcaccaatcatctcctaataactcccattttatcttttaaatgttgccactattatcacttccttggaggagccttcttggactgcctatttcaaatcccctgggttttttttttttctttgacaaaagccacattcgaacaaatcccccttggaatgttacaattaccaaaaaatccaatttaaactagtttaaatgataagagaatttattggctcacataaatgagaagtctgaagataaggtgaacctcaggttgatttgagtgacttaacagtatcagcaggaacttgatttccttctacctctcaattttctttctgatgtcagattcatcctaaggcttactccttttgtatcataaaatggtggccaggatctcccaaggttatgtagttctttgtccatatcaaaagagagtttctttcacatatttcacagtttcaatgtgattaaattaatttaggtcacatgtccgcccctaaacctagagttttgtggtctagagaatgtcaagcactgattggccagggcaaatcaaggcctatccttggaactggaagttacgttaatcccacctaaatcccatgaatgttactctatgaggtatcggtaaaatcgatgctaggaatacaatcagaatccattatatcctattacacgcttatagcaccatgcacccctccattgtagcacctgtcatacttgtagctttatatttatttgtatgatttctgattaataactgtcttctcatccagatgaaaaacctctattagtccagggaactgcattttttctcaccattgtatctctagtctagcacagggtgtcaaacatagcaggttctcaataactattgaaagaatgaaacttcccttagaagtttactactcaatttgacattccctttagcaggcaatttaatagctaccatatcagacttatattacatatttgaaagtcccagactgagatctctaatttctatctccaggcagtcagttcttgacacaccactgagtaagattcatggaataaatctgaccatattatattcccttgacatctttcaagttcctgatttcttttaggataaagttctttatgatgccattcaaagctcttcatggtttggcccctatctggctttctattctcaagagcaaaactatagacttctggccttcttcagggtgatctttctctttcaatcatagtccctccccaaccactcaccaaatatcagtttttagaagtcttgtctcttgcagggagtagagagggggcagtaatagtttattcagggattcccccatatctttcctgggtaaaggtattctagaaggaggcagaggaaggaggctagaggtcccactgtttggcattcaggctttcacttaatgctcactttagccctgcttcacagtcccctactacctactgtgactaatattctcaagtcaagagtctctcccattctagaaaataaatcaggctcctgggatgtggtgatggtgttataggggcatgtgtgggtatgagtgtgtgtgtatgtgtgtatgtgtgtggggtggcagtcctttggttatatgggattggggaatagacccaggaatgtaggtgttctttatataggctttcacccttccctaaaattttctgccctgatcctttctaatttttttgtggaaagaattagctcttttaatttatttattttattttattttatttcattttattttatttttttgagatggaatcttgctctgttgcccaggctggagtgcagtggtgtgatcttggctcactgtaacctctgcctcccaggttcaagcgattctcctgtctcagcctactgactagctgggactacaggcatgtaccaccatgccaggttaattttttgtatttttagtagagacgggctttcaccatgttagccaggatggtctccatctcctgacctcgtgatctgcctgcctcagcctcccaaagtgctgggattacagacgtgagcgactgcgcccggcatctttttatatttttaaaaggtcacatgtatgtcctttcctgtgaactgtttatattctttgccaaagtgctgggattacagacatgagccactgcacctggccttacctcttctttttttctttaatcacctgtggaggcttttagattgtgccttttgctgtcaagtctactactactcttccatcggcttgtcatacaaccatttgttgaaatttcttttgtattttgtttgccttttgggctctacactttttaaaaatttatttagctgtcaaagagatgacatactgtgtatggttaattttccatgtattctggagttctaatatattttcatggtttttaaatgtttagttctttaatcaagttggaatttttaaaatatatatgaagtaggatgctaatttaaaacttttcctccaaatggatatccatccagttgtctcaacatcatgtatagaaaaaacaaattgaaaatgctatcttatcatattatttactaaatttacatgcatatacatatacatacataacatatatctgagtttgagtctgaattcactactgtttcaattgctgtagttggtcaattctagtatgacagagttttaattgctacagttttggaatgattatggggttacttttgagacagggtctggctatcttgcccagactggtctcaaacttaccggctcaagcaatcctcccatctcagcctcttaaagtgttgggattataggtatgaaccactgcacctggccctggattgcattttgactgtggccatagaagtttccactcagatcttcaagagaacctactctggggactacaagtgactgacagccagctgccacccctttggaactaccatgcattcatgtcaatgccacatatctctggagtcgcccccagctagtggctgagcacagcaggagtactaaacttgttctttcttgcccagtgcagaactcctctaacgggcaactttggcttggggaacttctcatcagcctggatgagactatcttagaactacagtgtagtcgaggctctttctacccaatatttccttctcttctttttacagaagtcagacctgcaccacagtctgaagtctctctgccaattcctgagccttcccactttatccttcacaaacatttcccccaataaatatcttgcatgtctaatcccttcttggcatctgcttctctgaggaccagaacagacaggtggtttaccaagtggtgcaagaaaacagatagtaagatgggttttgggcaatggcttacttggtccctggcacaaagcagccatctgagtcctgatttagccagcagtgacctaggaaaacatcccagagaagggaaatcctcttgctcgtgcaatttaggcatttaaaagatatggggaatacgatgcctacaaagaaagcagagctggccaactgttactaagacaagtaatgccttgcagatggataatgagaaaccgagagcacttaaacagttaaaggctaagtgtgggagccgggggcttctctggagcttaacaaacttttatttcctgcagtggaagagcagaaatgggattggatggtcacagagctctaaagatatttgaatgctcagcctagggagatccagtatgtagtcagggcgctggttggggaaaccagcctgaagctttgaaacatggaatgggtgcccctgaggattttggctctgtagatacctctggacactcaagagcttacagaactggctcatacttcctagtaagagcaagcacttccctcattacagaaagacctcttccataattgttctcagtttttctcctggctgccaagccatggtaactggagttaacatctcagcataatctgcctaggaactgctggccctgataagaaaggaaagattacacaccgaaggaattgaaataagttaccatgactatcaggagccagagaagtatacttaggattggattttaagggtgttcaattaagggggctggaatttaagacaacataagcaagacttcatggacttggggtacttttttgggacagatttaacctcagcaagtagtcccgaggttagcttttcaaagcctggaaaaggtgatggctttgaaaaagtggaaatgaattcacaccatggcagcttttaacttgaggagaagatagctatttattttggcatatttatgtggttactgctcacttactagtcccaattgttttgtaaccactttttatttattttttgagatagtctcattctgttttctagactggagtacagtggtgcaatcttggctcattgcaacctctacctcttgggcttaagccatcctcccacctcagcctcctaatttttgcattttttgcagagatggggtttccccatgtcacccaggctggtcttgaactcctggactcaagtcatctgcccattttggcctcccaaagtgctgggattacaggcgtgagccaccacatcgggactgttttttttgttttttgagatggagtcttgctcttgttgccaaggctggagtacaatagcaccatctcagcttactccaacctccacctcccgggaggatcccttgagcctaggagttcaaggttgcagtaagctatgattatgtcactgcactccagcctgagtgacagtaagaccctgtctaaaaaataaatagtggtttttagatgatcatctgcaaatatttttgttctttccctgtatccctttttaatctcatcacattgattaggacatccagaacactggtgattcttgttttgttcctgactttaatggccatgtttccagtgttgtatacatgttcctaatttttgatacataccacttgtgacgttaaggacatttcctgatattctaaactctctaggaaatggatattgaattattaaaaaaaaaagtctctttttagcctgggcaacatagtgagacccagtctctaaaagaacaacaacagcaaaaaatttgctggcatgctggtgcatgctggcagtcccagcacctcagcaggctgaggcaggaggatcacttcagcccaggagtttgaggctacagtgaactatgatcctgccactgcactccagcctgggcaacagagcaagaccctgtctccaaaaaaaaaaaaaaaaaaaaaagaaaaacaggaccattttttgcatctggtgaccatatggttttctcttaatattatgacaatttataactgttctcataaatgataatgatctataaatttttatgtttgcttttttttaatcatctcttctaggttatgagtcctaggcaattgcattaaattttataaccatagtattaaaaaaactatttatagtcaacaactcaagtttggttttcatgaaacactgggtatttttcaatgcttcccatcccatgcaggataaagtcagagtactaaatctcatattctaaactcccacacaatctgacgtctatttactggcttcttcatccattaataaaactgttccttctccacaaagtgcctttccctttataatcgtcctttaaagcccagctcaaatactaactctctatattgaaatccagttcaaattccacttcttagaaaccttcatttttccttctagtttacctcttctctttttatagcatgactttttaaaaactttcattatagtgctcaccaacctgcctttcattaattagtaactctgtattagactatatttaagtccctgaaggaaacaaactattccatagcagagtactgtgctcctaataggtagttttaaagtttttattacattaaaattaattttgtaaatttctgttatattgaagcctcttgcaatgatctgagatatgctttagatggcaaaactgaggttgctttaaatattacctttacaaaagtcacttattaccaaattgccttttagaccattttacctgtctgttggttgatgacttcatactcatatttaatgagtcagacatctctctcttttttgagacacagtctggctctgttgcccaggctggagtacagtgggacaatcatagctcactgcagccttgaattaccgggcccaagtgatcctcctacctgagccctcagcctcccaagtagctgagattacaggtgcgcaccaccatgccaggctaatttttttattttctgtagaacaaggtgtgaccatttggcccaagctggtactgaactcctgggctcatgtgatccacccactttggaggctgaggcgggcagatcacaaggtcaacagattgagaccatcctggccaacatggtgaaaccccgtctctactaaaaatacaaaaattagctgggaatggtggcgtgcagctgtaatcccagctactcgggaggctgaggcaggagaatcgcttgaacctgggaggcggaggttgcagtgagccgagatcacaccactgcactccagcctggcaacagagcgagactccatctcaaaaacaaaaacaaccctattttgtcccttttagtttctatttatgtaacagatcctattgtcctcacaatcctcagcctgaaatccttagtcataactgccgctctcttccctccacttgccactcactccccattttatctgggttaagtccatccattatcccttatatttgctctgcaacatcttggtatgtgcccagcccactttttctgaatacactctcttctcagaagtgagctcttggtaattttctgaccagttgcttataccaggtttagggttaccagatttagcaaataaaaatatagacaattgtctgaccagttgcttatatctggcttatgggtaccagacttagcaaataaaaatataggacattcagttaaattatttgaacttcagataaacaaggaataatcttttagtgttacatgggacctacactgaacatctgtttatctgtaattccaatttaatttggcatcattattttatctggcaatctcagtcaggtttaacacctttcccaagctgagcttgtcatttcctccaaaagaacacaaacctataaaggacaggtaacgtcctgtgggacagccatcctttgccctatgctgagaaaacaggtttgcagagaataaaaacgaacaaataaataaacatttaaaaaagcagttgtgtggaaagaagcacaaaagagaggccatgagactccataattaagcagagatgaactgccctagttcttaatggcttgttagtcctcattccagtcttccacagggtgtgacttggcttccataaaataaactcacggtcccatgatcattttccctctttgctttagcaagaatctttaactaaaacaactctcttttcatttccactgtctaccactctagtctcaactctcatgagtctggaattttgcaaaagcctgataaacttgtcacatgattccagtgtctacccattccttgtaagtaaccaagatattcttgcctgattaaatgctttgaaaatatcatcttaggccaggcgcagtggctcacacctgtaagcccaacactttgggaggctgaggtgggcggatcacttgatgtcatgagttcgagaccagcctggccaatatggtgtaaccccgtctctactaaaaatacaaaacttagctgggtgtagtggcgggcgcctgtagtcccagctactcgggaggctgaggcaggagaatagcttggacccgggaggtggaggttgcagggaggtggaggttgcagtgagctgagatcacgccactgtgctacagcctgggcgacacagtgagactccgtctcaaaaaaagaaaaaaaaaaaaatatcatattgtattggccatcccttgtttcatattcgttaataaactttgctactttgctttctaatttcggtgaagaacaagcacaagattaaggagtaagactatgtgaaactgggttataaattgaaaggctgttggctgttgtatcttgtaaacaattcaacgcaatgccaagtgaaaatgaagttgttagtccctctatctagaattctttcccaaatagctgcatatctttttcctctgcttcatttaagtctgtgctgaaatgttatctactcagagaagacattctggatcatttcatattaaatagtaacttttatcactctatctctttatctagttgtttttctttaaggtacctaccactacctgacatgttgtacagttaagttcttacttaatgtcttcgataggttcttgcaaactgtaactctaagataaactacataaaatgaaaccaaatttaccacaggctaattgatataaacaagagttaagatcctatggcacatttctggtaaaaaaaaaaaattaccaaacttgcaaataaagaccaaaacatttctgatgttaaacactgaagtaaatgtgagctagacaacattcaagaaagatgaataaaacaagatgatttatcaaattacaacagttcagggttttgggtggttggagcccatcctggcagttcagggtgccaggtgggaagtgatactagacaggacagccatcacattgcagggtgcactcacacacacatccacactcactcagactgggcaacaagagcaaaactctgcctcaaaacaaacaacaaacaaaataaaataaattatccagactcaggtatttcttctttcttttttgagatggagtctccctgtgtcacccaggctggagtgcagtggcatgatctcggctcactgcaacctctgcctcccaggttcaagcgattctcctgcctcagcctcctgagtagctgggattacaggcgtgcaccactatggccggctaacgtttgtatttttttttcagtagagacggggtttcaccatgttggccaggctggtctcgaactcctgacctcaggtgatccacctgcctcagcctcccaaagtgttgggattacaagcatgagccaccgcatccaacctcaggtatttctttatagcaatgcaagaatggactaatatactcctgcagacgtgggaaaaagtgcagactccacacagacggtaagcctggccaggaatcaatgttttgtttccttctcaacaacattttaatgcaaatgatgttgaaaaaaaagttattcaaggacctgctgtatcgtaatttgctatcaatttccaaactctagaatatgagcattggaactttagctgttttgtctgtttttgttattttgagatggagtcttgctctgttgcccaggctggagtacagtggcacgatctcggctcactgtaacctctgcctcccgggttcaagtgattctcctgcctcagcctcccgagtagctagaactacaggcatgtgccaccacgcttggctaatttttgtatttctagtagagacggggtttctccatgttggccaggctgttctcaaactcctggcctcaggtgatccacccgcctcagcctccctaagtgctgggattacaagtgtgagccaccgtgcccggcctaacttaggtcttttatttactgacacatcccctgcataccttataatgcctggcacatgttaaatgatgaataaaagaatgctatgcttggctgaactgaactaagaaagatattcatgttttcattttagatccaagaatgtaagatattctgtaatagaagaaaaaatgattatataaaaactgtactgtgatagaacagtaacttatggagtatgtgtgttcctgtatcaaaacaaaagtcatgggaaaaaaagtcttacttttaagtacttgtattgagctaaccaccaaagatggcattcagtttgatctgagtcactataaattagtgtttccagcatataatatagccgtcatagaaaaacttcattggggccaggcgcagcggctcatgcttgtaatcccagcactttgggaggccgaggtgggcagatcacaaggtcaggagatgagaccatcctggctaacatggtgaatccccgtctctactaaaaaatacaaaaaaaaaattagccgggcatattggcaggtgcctgtagtcccagctactggggaggctgagtcaggagaatggtgtgaacccgggaggcggagcttgcagtgagctgagaatgcaccactgcaccccagcctgggcgacagagcaagatgccatctcaaaaaaataagaaaaaataaaataaaaatacaaaaattagccgggtgtagggcacctgtaatcccagctactagggaggctgaggaaggagagttgcttgaacctgggaagtggaggttgcagtgagccaacattgcgccgccgcactccagcctggcaacagagtgagattctgtctcaaaaaaaaaaaaaaaaaaaagaaaagaaagaaagaaagaaagaaaaagaaaaacttcattggaaagtagggaaaactaccaacatttaaatgaagacaaaaataagaaaagttcagacataaagtgtaggctcttggtttaagcagaaatggtgttcttttggtggtttgcagttagtaagctgtatttgtactttgtgtcagttcaggtttctggagtttgtttaagaactggcttcattttccatattattaggagttgggagttcctttgaaaaagaaaacagaaaatttaagaaaaacacaaattgcaattttgaaattctaccattaaggatgatatcttaaaataagaattatgtcttagaaagcagaagtgagaataaaaacttttgttactgttattaaataatagtcgatatcaagtgtagaaagcaaataaatttaatctttcattttcaattaatctttaatatttcagaagtatatcaacattgcctaacatgctattttacacacaatagatatataatcaatgtttattgacttaaaaatctttggtttagccagataaatttgtaatattttatgaactagttaaccctgagtcatgaatttaccttttttttttttttttctggagacggagtcttgctctgtcgcccaggctggagtgcaatggcgcaatctcggctcactgcaacctccatttcccaggctcaagtgattctcctgcctcagcctcccgagtagctaggattacaggtgcctgccaccatgcccagctaatttttgtatttttagtagagatggggttttaccgtgttggccaggctggtcttgaattcctgacctcatgtaatccacccgcctcggcctcccaaagtgctggaattacaggcatgagcttctgtgcccaccatttttttttttgagatggagttttactctttttgcccaggctggagtgcagtggtgcgatctcagctcactgccacctctgcctcccaggttcaagagattctcctgcctcagcctcctgagtagctgggattacaggcgcccgccaccacacccagctaatttttgtatttttagtagagatggggtttcaccatgttggccaggctggtctcgaactcctgacctcaggtgatctacccgccttgacctcccaaagtgttgggattacaggtgtgagccaccatgcctggccagatatacctacatttttataagatttaaaattttttttagagataagagtcctgctatgttgcccaggctggagtacagtagctattcacaggtatgattgttgcacactacagtgtcgaacttctgggctctagtgaccttcccacttcagccttccaagtagctgggactacaggcacgtaccactgagtccagtgtatttttataagattttaaaaaagattacacattctaaattatgacgtccacataccatttacttttctgtggaattataaggtgatattttaaatgatgggaatgaacaacttgacatgtgtatcagtaacctctaaacatctatttcaaacatctattaaccgaaagtcatgatccttcagctcttatactaagaacttccatacattagagcaatacacatattcaaattgacctagttcaatttgataagtaaacaattttttttttttttttgagacggagttttgctcttgttgcctgagctggagtgcaatggcgcaatctcggctcactacaacctccacctcctgggttgaagtgattcttctgcctcagcctcctgagtagctaggattacaggcatgcgccaccacgcccggctaatttttgcacttttagtagagacggggtttcaccgtgttagccaggatggtctcgatctcctgatctcatgatccgcctgccttagccaataatctttctgtttaggtaaatttgaaaaatatacatcattactaccacattcatcctagttagaatctcatttatatttattccactctgtttatgatttggtaactaatttgaaaggcattatattatcaaaagtgtatcagattagctccctcaactcactatatctgttaacagttctgaagaaataggcactggctttgaatatggcctgttccagtttgtgaaccgttgtaggcaagtaaagttgttgggcacagaggtgacctgtaggatgactgaaggtaaactgtcactactgtatacaaagaagaaaaataagatgtaggaagagatctgttataataacatatgacatattctatctaagtttttcatatatttcagaattgtaaaaacaaaactatgtaattttttctaagatgtataaatgacttacttttaataataaatatttcttgatttataatgtaaatacaattaaacaaatatgggttactcgaattaaaaaaatggcacatgtaaatgagcattttagtacaaataattaaaatgtatttatattatatagaaatctacacaatggaagatactactaaaatgttgctctacagcacatcaccctagacaaaatagaattctagaattctctttaaaaaaaaaaatcactgagaattagatgatgactgtgaaataggttctcccattacaatactacttctgtcattcaaagttctgaccacggttgtagctggcgactgaagcacttttcgagaaagcctcattcttccatcggctgggtcacgtccaaagtatttcacctgtgttaaagaaacagatcttcctttaaagttacagcacattgagtgacatctaaactaatagacatttaaatttacatggtccaaataaggcaatgattgtttttacttgttcactgaaagcattgttcagtgctaagtggacgtatacacttaacacatataagtagtcattataaaagagaaaagagacggggcagttagttgttcaactataatctgccgctgaactcatctgtgcctttttattctcaccaggccaagtccttatactgggggaacagtcacaggcatagtgaatgatcctagacaagggctttgagagcctaattgtgttatatactatagaggattatgcttaggtcacttggattttcactactgctcaaaggaccaacacattagtgtttatttggcttcaccttggaaaatgaaagtcaggggcaaatgcaaaggtttaaagttccttctgatgtgaaaacaacaacaacaacaacaacaacaaataaaccaaaaaatcaaccttatacagagatactatatcttagcactcatcttcccctggaggctacttggacaataagactacacattgggaataaaccagaagccttagttactcaggtcatgcgtattagcgtaagtgaaagacaatgtggtggagcccgaaaaaacagactggcaatgacttctttcatccactcataaaggactacaaagaaagggccaattttgttatatgaattctaggcctgaataacatggctcttaccaagctcaaaaactttaagtagtggagaaacaaagtctcacctcctcaaagatgacattcaaagactttaacaagttaccttatcacagttcttacgtcagtgcccaaatcatggagtctgcatagctaacactaacatgctcatgtattttttaaacgaactaagggtgactaccattttggccaagctgcaagctccttgagggaaagaattgtgtcttaaatccttaatgagtctgttcaagcaattctaagattaaaaatgaagtactgcatacaaataaaaaacttcatagatggtgactcttctttcaactttttgaaaaaaacaatggaagcttcaagaacaatttacaacttcaaggctaaaaggtggaatacaaatacctgaatttcttggccaacttctaatcctagggcagtaggatgtttaatctggaaaaaaaaatgttaatctattagttgttgtgcataattatgtagtgtccatggaagtacacattttttcctcaagctttattagtttttctgattaaaaaaatcagttagcggctgggcgcagtggctcaagcctgtaattccagcactttgggaggcagaagcgggcagatcaagaggtcaggagattgagaccatctctggaggtcaggagagtgaaaccccatctctgctaaaaatgcaaaaaattagccgggcatggtggcgggcgcctgtagtcccagctactcaggaggctgaggcaggagaatggcgtgaacccaggaggtggagcttgcagtgagccgagaccacgccattgcactccagcctgggtgacagagagagaatccgtctcaaaaaaaaaaaaaaaaaatcagctgggcatggtggctcacggctgtaatcccagaactttgggaggctggggcaggcagatcacttgagctccggagttcgaaaccagtctgaccaacatggtgaaaccctatctctactaaaaatacaaaaactagctgggtgtcgtggcacacgcctgtagtcccagctacttgggaggctgaggcaggagaattgcctgaatctgggaggcagaggttgcagtaagctgagattatgccactgcattccagcctgggcgacagagtcagactctgtctcagaaaaaaaaaaaaaaatcagttaattataaagatttaaaatacagatgtattaagaacataaaaattatccaaaacaggctgggtacagtggctcacacctgtagtcccagaactttgggaggccgaggtggaaggactgcttaaaccagactgggcaacgtgaagaaaccccatctctacaaaaaatccaaaaaaattagccgggtgtagcggtttgtgcctggggacccagcttctccagaggctaaggtgggagaatcacttgagcctgggaggctgaggctgcagtgagctgtgatcatgccactatactccagcctgggtgacagagcaagaccctgtctcaaaaccctctcaagttgtagataactactgctaacattccaatgagtatcccttcagat

SEQ ID NO: 787 - DNA, 1294 bp, Homo Sapiens
ctctgaggaccatccacctccttcctgcgccctccccacagctacggcggggcagagagaggtgatgcgtgccagggtcgggagtcacagaggcttttgtacttttttttgtagagatggggtttcgccatgttgcccaggctggtcttgaactcctgggctcaagcaatctgcccgtctcggcctcccaaagtcctaggattacaggtgtgagccaccacacccagccttagatggtgagtgtttattgaacacccatagtgtgcctaaggctgataggcatggaggaaacagaactgaagaagagatgtggctcctggctccatgaagaactgggtgagatgacatgcatgcaaggacttagcacacagcagatgctcagtgggtgtaattttctctctcttcctatttgtgagtcgacatgaaaactgcttctctgggtttctgcctccccccatgccctgcattagagcaggacagaatgtgtgccaccgtgcctgccattttaaaaaattttttgtagagatgggggtctcactgttttgcccaagctggtcttgaactcctggcctcaggcaattttcccatctcagcctcccaaagtgctgggattacaggcatgagccaccgagcctggaccagaatcttacttctttcttgcaccatggtccttcgaggatcctgtcatgagtgaccttccatgtggtgattcagcggcccaggcgccttccatctcatggctctgccatcttctctggccttggggagtttcatctctagctggtggttggggaggaaagagagctgaggactgcatgggaactgttcatgggctgagcctagaagtaatgtacatcacttccacttccaattctattcatattctactggctgaaactctgaaggagaggctgggaaatgtagtccagctacacgttgagggagagagtgaacaggctttggtgaccacacagccatctctgctcagatacccaaggaggcaaatagaagagccagtccatgccttcaacatgcttgctccacgacctccctgagcacctgtggcctctgagtttatggtcagggtcaacagtgggggaatctcatgccaccaaattccaggctggcaagagcctggaaaaccttttggctggagagcccgggtcacctgctgacttatgaaagcagtgaaatcagtggttctcaacctggggtgacattgtctccctagaggacatttgacaatgtctggaggcatttttattgtcacagctcagggatgctactggcatct

SEQ ID NO: 788 - DNA, 3223 bp, Homo Sapiens
cctagaacagtgcctggcacataatgtggatgtcagtcaatgttggatttacttgtgcttgtttatttaaaaactatttggggttagattgtcaggaaccctgctacatgttgtgtaaggcttctagtgtgtacgtgtgtgtatttcatataatacatttatgtgtatgagcagttggaattgatcactaaaatatttcttaaaggtaatataagtacaatttggtatgttgagtatcatgaatgaatcaatgcaaagattcaagtatctttgggtagaatcatgtcctttgaaatgtcagtgtacagtaaaaaggtctgacatcataactagattataaatcctatactcttgtactccaaagtcagtatagttggactggcttgtatgtcctgtttgacaaaatataaattttactttcctgtggcaattcccaaactgggctgaccacttggacttttaagaaaatgtaagcactcttgggcattgacccaacgattttcattcactagatcctggggtggggcctaggaatctgtgttttttaataatttcctttctgtaggtgtttacatatagtcagtttctctgctacccacctttcatgatatactttgaaatttggtgacaatcaccttggaccttttgggttctctggaaatggtaaccagtaaggtaattaataattaatatcttatactggtagagggaaagaaatgctaacatgtgtcatactaaagatcttttaggactagtgctgactttctgttcatatatttcactggaaagctattgtcaggacattttgcggaaggtgttttttaaaatgtggcatattcatagagttgtattgctggaagttaccttagaaatcatttagcttattcccttttatatttgagttaatcttaaaaatgttagggttagggtgtaccacttattagttaagttgcctcatttctcttagccatggtttcttaagcataagatgggaatgataatacctacctaccttatagttttttttaaggatttaactgaaattcaaaaaaagttgctagcatacatcttgtttgtagcagtgtagcaagtgttcagtaaatgtttaatattttgacatacctataatatgatctatggtatacataaaagccaaaagaggtagaaaaagttatagtaattaagttcaagttaaaaatgttgtacacccacaggcagagttttatttttaaattatggtataatacttacacaatacaccattttaaaccattttaaccatttttaagtaaatcattcagtggtgtttagtacagtcagtgttatgcagtcatcactgtctagtttgagaacattcttattaccccaaaaggaaacctgtacccattgaggagccacttcctattcttttctctgtatccgcttgcagccactaatctattttttgtctttatggatttgtttattcagtctctttcatatgagtgaaataataaaaaatgacttttcactgtataatgttttcagggcttatccgtgttgttgtgtgtatcttactgcataacttccattttttttaaatgaccgaataacattccattgtatggatataacagccttgtttatccagtaatcagttgatagacatttaggtcccttccaccttttggctgtgtgagtggagctgccacgaacatgcatgtataagtttttgtttgaacacctattttcactttttgggtatacacgtgggtgtggaattgctaggtcttgtggtaattctatgtttaacttactgaggaagtccaaactgttttccacagtggctgcaccattttacactccattagcaatgtatgagggttccagtttctccacatactggccaacacttactttctgttttttttttttttaattaaattttatagccaccctagtgtatcttattgtggttttgatttgcattttgctgatggctaatgacaggcatctttacctgtgatttttgaccattcgtatatcttctttgaagaaatggctgttcaagtgctttgcccactgtttaattgggttgtctttttgttgttgaaagcagtcttttgattatgaaattaatttatgtattcttctctagggagcttatttggaaatatatacttggtaatataaaaatttatttcggaatataaaataaaggactggacttcattactttttaagtaaacttttattggatgcttccttttaatgtatttttttttgtagaaatgaaattgttttaattttatagcttagcctgatgcctgattccatgcttgcactgactctctgtctgcactaacaaattatcagatttattcctttccaaaatatcattgattttttttcagatcatagaatattcctctcccaacttttttgttgacagctttactgaggtgtaatttacatgccataaaatacacccattctaactgtacgtagttcagtgatttttagtcaacttaacagcattgtaccacagttaacacaatgcaatattatagcatttctatcattctgaaaagttttcctcagaccttttggaagtcattttctgttcgcgccccttggtgaacactgatgctttctgttactcttgatttgccttttctgagtatttcacataaatggaatcataatgtatagtcttttgtgactagcttctctcactgaacgtgtttttgtggttcatctgtgttgtcgcatgtatctgtagttctattttttattactgagtagtatttcattctgtggataataccacattgtgtttattcattcactagttgatggggatttggatcatttctagtttttgactattatgcataatgaacattcaagtacaagtctttgtgaggacatcctctttcaactttttattttgaaaaatttaaaccccacagaaagattgaagtaagtagtatagcaaacacctatttactcttcacctagattgactattaacatttgcctgctgttctttgcctttttctataaatataccttttccagaaccatttgtagatattatactttatctcttatgtatttcagcatgaatttcctaagaatgagaacattcacatacataaccacgattttatcacacttaagaaaattagcagtaatctcatgtcagctactttatagtccatattgaaacttgtcccaaaaa

SEQ ID NO: 789 - DNA, 1392 bp, Homo Sapiens
gccatctcggcttactgcaacctccgcctcccaggttgaagtgattctcctgcctcagcctcctgaatagctgggattacaggcgcccaccaccgtgcccgctaatgtttgtatttttttagtagaaagacagggtttcaccatgttggccaagctggtctcgaactcctgacctcaggtgatccatccaccttggcctcccaaagttctgggattacaggtgtgagccaccacgcccagcctgagccaccacacccggcctgagttcgccttattgtctagaacccaggtgaggatggagtgaaggtggtgggtgtggaagagcatgttagctttgcttctaggaaagtaagtggagctatcagcctgagctctgtgagcatgcataaaaggagtaacaagtcacttctctcaatctttttttttttttgagacggagtctcgctctgtcgcctaggctggagtgcagtggctccatcttggctcactgcaacctccgcctcctgggttcaagtgattcttctgcctcagcctcctgagtagctgagactacaggtgcgcaccaccatgcctggctaatttttgtatttttagtagagacgaggtttccccttgttgaacaggctcgtcttgaactcctgtcctcaggtgatccacgtgctagggcctcccgaagtgctgggattacaggtgtgagccaccatgcccagctcacttctctcaacctttgaggcatctcttgagttgctcaccaagaagagagggagaaaagagagcaaacagtgtacagtaagtcaagaagacgatgagtgtaatgtaacaaggtagggaagaccaagaaccttttggagcaagatggctacattaggatttctggtcagtcaggtcacataaataaggcagataggaacgttgacactgggaagacaccgttcccagaagccaaatagacaagactatctggccagtcagatacacggttaaactaacagacttttaaggaaaatgaatatgttatttgtacttacagtcaaccagccaaactattatcgatattattatatggcaacaacatagcatctttctagaaatattaatgaacaaattaggaattgtcataaaacagcaaaaggggcagaggaaatcaatgaagcacactagagtttaactctttcccttaaacaattgagtttttaaataagtaaatcctgtgactcccagactgaggcaggaggattgcttgagtccaagagttggaaactagcctgtgcaacatagtgggaccctatctctacaaaaaataaaaaattagccgagtgtggaggcacgtgccagtaatctcaactattccagaggctgaggcgggaggattgcttgagccggggaagtcaa

SEQ ID NO: 790 - DNA, 4067 bp, Homo Sapiens
acgcccagcctaatgtttttcttgactcagtaagattaacaacatctgcttgggtatggaatgtgtcttcaggactcacgcctctcaggagtcacagtcctgtgcagcctgctattcagtatcagaaaatactttccaaatatcccagttttctagctgcttagggcaggaaggtaaatctggtccctcacagtcagtcatggccataagtggaaatcgagtctcttcatgcccaagagcacatcagagaaatggagagtgctcctgaatccgaaagggtcacacagacaagagtgaagaatgtctcaataaataccagtgtggaagaatgatcttgaggaccacatccttcactctctctccttcccccctccctttctgcacatcttgcatctcagaagccccctcccggaaactagatacaactccaggggaaggtgaggttgaaatccacaagttcactgagataaagtttctgacaatgcaaagaaagggaggcttgaaatcaaaattagtttctatttcttacataaatgtctggactagaattgtgtccactgctcagatcttacttatattcagggatgacgtatctcatggaagaacagggctcaacgagccacttaaatgtcttcctatcaaatgttaaggttctagaaaccaaatggtgggtatattatccaacatatgccgtgaaagcagagccaatcctgggggaaagcttctctcctaatggtaaggtgtccatatcctctgccccaagaaccaagacaagtgatctgacaagtgtgaagactgcttttcaacatgaaaaagagttttcttaaactcaagcatgatattggctctactttgaatatcagttacgaaaattcataacgagctgaggtatcttcactaacattgcaaattaatttcttgtattcatcacaatgacatttatgtgtatttgaaaagtaatccatatggatgagcatatttttcattcactctacagacggaacatgcacgctggtttgcagatcccttgcagtgactctacagctcccaggaatctgaggttcacaaggtgaaacctaccaggccaaacaatttaaaattggttttgttttgaaaatccagtaagtatgatggcaatgtcttgcagaaattcctcttttagtattccagtctgtgggctctggcagaagtaatagtctgctgcaaacagatcactcttttttgtttgcaaagtcttcgtaccagctgaatcacagcttgcttttcacttttcgtaacaccttgcaacatcgcaaaatatttgctggagtttgtgaagggcggctgcagaattagtaaactgaaaggaggccttcctttactcccaccccttcaatgccgcttgtccttggtctataccttgagtagaaagggactagttaacttgctgtctccttgaatgtgttttctgtgagggtcagccctgaccaccccagtcacaggaatctttctggcctccggattcctagtgctcatattgtatatatcgtccacaaggtacttaggtactgttgtatattggtatgtcccatatgtgcatgtcttctgtccccaaccagattgtaagcccatctgtgtttgctcagccctgtgtgtgcaacagaggtgctgaatgaagacctatcgatgattgattgatacgttaaagattatttcctccttcctcagaatgctacacttcgctcatcaatggagctcaagatgtaaaagtctggtttaagagacattgaatctattctgccttttattatccctttcttataagttgacttttaagaaatcaatgactgtgtggagagttctaactgggtacgtaataaaataaccaactgtgggggtgggcagggggccctatcgcaccaggaagcttgtttattggttgcattagaccactaaagtggaagcactgagatattctggaaagaacacagcttgggggccaacagatctgggttcagagccttactgcatcacctacaagttgtgtctctttagaaaatttacttaaaattactgggaatttatttcatcatctgtacaatgggctacttttttctgtgattgttgtaagaattgtaataactgttaaattatgttgcttatactcttgtggtttaaaatgtgttgcagctgctgctaaattgaaatgatttgggggatcatttggagaagagaggttatcctctggaaatctataggaagttgcaaggattaataaccactaaggagcagaacattgctgggtcagaaaatagctgcaggacttagaggttttctgcaacacaggactttcagcttcaaaactgggacattctcatggcaaactatggcgattggtcacctggcagtgagccagactgggaggatctgatgtacccatggaagttaggccgaaacacttattgaaatctggggtcaatttgaggccttggccacagaccaatgcagaaaaggtgggcaaagcgtggtacaacgagtaccttggtactcagtccctagattaccaacctagagcacctgctgtaggccttgcatgcagaattagttggccccagttctgagggagggctcactagtccctagttcctctcaaaagaatgagggtaataagttatgacatctcctcatagatttgttatgcagattagatgggatagtctatacacagcacttagcaaaggatcagaaacattttaagcactcatacttaaacccaaagtcactcactaggtaattggcgtgataagatacatgggctataattaccaaaaatatagctggtaatttaagaaaatggccaaatgtgcaaggtagtaaaagtctagggtggggcaggggacataaaataccataggaactgaggaacagggggtcaggtctgaagaatctgttttgcatgagacactttgtaggcctttggagagaaattgtgaggaggacttgaaggacggacagttggcccccaaactccaggctttcactccctgaactaagagggaccttgagcaagccttcacctctgggaagaagccctcagcagcccagataggagagctgaggtgtctggaaaagcccacaccgaggcccagggctgggccagttatggaaggccatcagtgcagccccgtcttgactcttgccaagacactaacatatataacaatatgttatgcaacatattgttatagtatatatattagttaaacatatagtgaataatataacaatatactgtgtccataaacaatattttagttctgtcaggtttttatctttaagtgaaggaacacagtatatttttctttttcttggcctttgtcaatatttgtgagattcacccatattgaagcatgtagttattgttcatttttactgccatatggtattgcattggatgaacatatacaaatttacaagtttgtttagtggtggggatggatatttgggttggttattttgaacacatggcacaaaacattcttgtacgtatcttttggtaaagatctttcttatttcatttattcaatgtaccaactcaaatgaaaacgtgcctactacatggcatggaagaaacaggcttcttgtcttatctcgcacagtctgcccacgcaaaccatctgtccagccaaaccaaaatagcactgtgcttccagcctctgcaccctggctcctgccttgtcgctggcttgaaccaccctcccccaactctctgcttaatgaaacttaatcatcctttaatccgaagctcaactgtcctgtcttctatattgccttcctgattattacagcaggaagtaatttctcttgctcgaaatgcagttaattaaaaaaatgggcgactttggtgccatcatactctgccttggattgtagtgttttgttggtgaattttatctccccaagtaagctgtgggcctgaagaaggcagcaactgtatttcacacatcttagtattcctcacagtcttgcgtatgatgtaagctaaatatttattgaatgagtcaatgaaagtgattttcagtgttgag

SEQ ID NO: 791 - DNA, 2126 bp, Homo Sapiens
cccatctctggcccatgcagcctgagcccagagttgacaacatgaccatcagtcagtccttccctggacaaacagacaaagctcctcatgccagcacaacacttggtcccagggctggcagccaggagcacagagaagaacccacagacactcacagtgaccccaggaagacagatatccatgcagtgtggcagtgctgtgggatgcaggagcaggctggacctgaggttgcattctgagcaccccagggaccagctgagggcctgcaagcacagcgggtagcctcttttctgggggtagtagcagtggcccctgggacttgcagctgggccctacccagactcccccagggctgtgcagcagtcatccacacttgcagccttctgcagaagactggagtgccagcatccaagggccgagcagtgcaggggcctgactccaactcccctgcctcagagggaggctagctgtggggtcagttgacactccggagtccccatggaatcaggctagacttccgctacaactgcacttctgtccagcctcctcctctccctgcatggtgcttgtccttcccacacagatgtctcctgagagcataccctctctaaaccccttctatcagaatccccagcccatgcactgagtcatagccctcacaggcaggaacgagatgagagggcacagaacaagcactcagaagccaggtgccaccgctgcacgttcaggggctcaataggccagaggaggggggcgtcctcacctccaggaggtggaggtgctccccactggggccatccagctgagccccaaggtgggagtgtgcattcaggaggcacacaggcaggggaaaccactcacaaaggcaggaagggggatggccagctcaggagctggacggaggggcagggcggggacggcaggaaggctcggagagatgaagggaggcaccagagaaccacaccacctgctaacatgctccctagagcacgggagcgacctggcctcaacctctgcctctgcccctctctgcagaccccagaggctcactggcaaaatcagtgtaatgatgctggcatcaaaaagaggcacattaagtcacatgtcagtgaaacgcccagcagagcccttggacagtaggctggtcaggggccctcccagcatctgggtataaatgcacacacccagaatgaatgtgtacacccagagcccccaggcacatgactgtacaccacacccaggcctgggcaccggcagggtggaccgagggcaccagcctccccacacctgctgctccttcctctccactctgcaacctgggccctgcctggcactggtgctgtcctggagatcccctcctgtgtcttcccctgacagcgtccccggttgcctcacataagacagctctgcactcggtgcaccaccggatgcatctggcgtcctgcccagggctgagaacactgtgctgccctggagtccaaccctgggtgctatggcaggccagagagccactgtggaaccctggtccccacgggcaggggctctccagacgtcagcaggcagcagggcatgtagccctcgacggccgtgatccacagcgctcagcattctatttttatcatttaaccccaaactttctattccattgtttctttgacccatcattcaaacatgtgtttcaaattttctaaatatacaactcttttagagttatctattttgttatcactttctctcttaattgcactgtagtcggaacacttggcccgaatagcagcttctttgacatttgtgcgttgagtgtcccaggatgggaggaggagaaccaggggccggccaagcccaggaaatgggtgtctgggaacaaggcagtggacatccacggcggtccaccgggcaggggtggccacagcagcagtcacacccccaccccgtccatcacagcacaggccccgcttgagtcctcacacctgtccactcctggccggtcacccctcacagccctctgtcatggtgcctggaggggagggcctctgacacccccagcaatccaccagtgggtatcagaggccctcctctatggctgtcagcccaccagtgccacttcagtcccctccctccgcaca

SEQ ID NO: 792 - DNA, 1477 bp, Homo Sapiens
acacaaaggacgcaggaagaacaggtgcgcacaaaggcacaatggcggcagatctgcccgtggatcactgaagattcctgctctcctgctgaggtggagattgcagtgaactaagatcacaccattgcgctagagcccgggcgacagagcaagacttggtctcaaaaaataaataaaataaaataagtacaataaaataacaaaacaaaacaaagtaagaggagatgatatctggtcgtgttttatggccatctggtaagctagattctttcctttggttttattgccaatcaatgattagaaagaagcagtttgctgttggcttgtttttcccctcaactaaatgtaagaaaaaaaaagagtcaaaaataccgaagctaattttaaaatgtatgtatagagagagacttggtcttaccttgtcatccaggctggagtgctgtggtgccatcacggctcagggcagcttcgacctcatgggctcaggcaatcctttcacatcagtcgaccagatagctgagattacaaatgtgggaaaccacaccctgctaatttcttgtattttttgtagagtcggggtttcaccttgttgccgaggctggtcttgaactcctgggctcaagcaatctttctgcttctgcctcccaaagtgttgggattataggcatgagccaccattcccgccgaaatatttttgagattcatagagatgagtaggtcataataagagtgcacaacttgtagttatatttaatatcttttgaaattactcggcacccccattgtaatttaaatgatttgttcctgacctggttttactttgttcctgagggttgcagatcccttgaacaatattccacgaatgaagcagtgataataaacctgcagctgccccgagggggcgctgtgcggaggttcacaaagggacctgggtctccctggtgcggatgcgggggccgcctccattctgctttctgacactgccaccgcggggccaggcttgatgtgaccccatcactgctcagttcactacacagtttcatcttttgatatggaagatttgactccatccacgttccttaggaggttactggaaatgacagcgctgtaaatttctgggtaaatgagcagccaacatttttgggagctgtcacacaaccacactgcccttccctctgcctgaaaacctttaggcctgattgactcggagaaagcccattaaactcagcccccactgacttgttcatttccactcaaacgtttgtgatagtcccaacacaaggcttgtcctccaagggacaacttgtaaacacttctaagagaaagggttgactgggcccggtgcctcacacctgtaatcccggcactttgggaggccgaggtgggcagatcacttgaggtcaagagtttgagaccagtccatgatcttggcttgaagaggcaagaccctatagtttattgaacattttaagcccac

SEQ ID NO: 793 - DNA, 3379 bp, Homo Sapiens
agcagtttgccacgtttaggagctggaggattcacttgccattccacagagttcttcttctttttttttttttttagacaaggtcttgccctgtagcccagggtagattgaagaggggcgattttagctccctgcaacctctgcctcctgggctcaagtgatcctcccacctcagcctcccaagtagagtagctgagtagttgggactacaaacacacgcagccacacccagctaatttttgtattttttgtatggatgggatttcacaatgttgtgcaggctggtctcaaactcctggactcaagcaatctacttgcctcaaaagtgctgggattacaggtatgagtcactgcgcctggcccaaagagttcattaacgcttcttgatctaaaataattactcctttcttctcttggacaattcaagaaaaaaagatatatagctattcatgaatgaaaaaaaaaagcttctcttatcttaggcagtgagacattaagatttataaaactatatactcccatcctgagctaaaaccacaaacagtattttgacataactgtgctagaaggaaggaaattgggaattatattccaatggtaataactactattattctcaaagtatgttcatacctctacaattttatctttacagacatatgttagcagagacatatttggacccaacctatatactttttctctataaagcattcaaagaacaatgtgacgattacagttgtgtggtaagaaatattaatataaagaatgtattaactgtaaattgattgttaaagatattttacacattgtggttgttatgttgtacaaatgtcaaaaaataatcttgggataaattgcttacttataatcacttgattaattgcaatttttttgtgtgtgtcagatatgcttttatttcatcctgatgactagctattcagagataaatgtaatgcttacagtacctatattatcctagatttctttctggtttacttaataacattttaatttttaatatctattttaaaaattttactctacttgtatcttttaaaagactctaattcttcctgaaagcagaaatgtatagtaaaataggagaaatcattcttacatgatatggttttacatgatatccagaatgctgctggcttccagtttttttgtttgtttgtttgtttgtttgtttgtttatggtgtcttgctctgttgccaggctgcagtgcagtggcgcgatctcagctcactgcaacctccgcctcccaggttcaagtgtttctcccctctcagtttcccaagtagctgggactacaggcacacaccaccacgcctgctcatttttgtatttttagtagagacagggtttcaccatgttagtcaggatggttttgatctcttaacctcgtgatccgcctgcctccgcctcccaaagtgctgggatgacaggcgtgagccaccgtgcccagtcacttccaattttaaaatagagaattcgactggctaggccaatgtctctttgagttctcacactaagtttttcttgttgggtagttgaattagaagaagttatcctaggaatttaggttaggcatggtggctcacgccttccatcccagcactttgaggggccaatgggggcagactggttgagccccagagttctagacaagccagcctggacaacggtgaaacctcatatctacaaaaattacaaaaattagccaggcatggtggcacatgcctgtagtcccagctactcaggaggctgaggtaggaggatagattgagtcccgaaagtcaaggctgcagtgagctgtgaaggtgacactgcactccaggctgggtgacagaacactgagcaagaccctgtctccattaaaaaagaaaaaaaggaaaaagaaaatttcttctaggaatctagtctctaaatacacttatgggtattttctcatctactctttcaaattctgatgattccttttacaactcaatagtagattaggacagagtttccaagttattcaactgagatagaatttgaacattattcatgatttttggctaagacagtctaggcagagagcagctgtggcaatcagaattcttagcaattgcctgactactactagtctgacagagatcttcctttggccaatgatttctcttttctctcatcttcattttcttgcctctcctttgcactacctccatcctgtaaccctaatcagatcgtccacaattccagagccccagttccttttataatataattatatataattataataaaagttactttttaaattgagggcatactctattagagccactctgctaaccattttgcatgcattacgatgcagtctcatgttttatggattgagtgaccatgtgttctgtttttcaagaacaattctatttatcttgattgtactggtatacttaatcatagtgctccctttcattctcagaagtgacctggttaggacaataaccgatatgatcattacatattttattagcttcccagggctgttataacaaattacaaaacacttagtggcttaaaacaataaaaatttattctttcacagttctggaggcaacacgtctgaaatcaaggtgtcagcagggctccctcccaaggctgtaggggaaagtccttctatccctcttccagtttctgctggtgcctgactctcttgatttgtgacagaataactccagtctctgcctccatcttcacatggccttctccatgtctctgtgtccttttctcttctgtttcttataaggacactttctcttggatgacaatgacagataatctttctaatccacataatcttatctcaacatccatcctcaccttaccttaacttaccttatctgtaaagaccttcattctaaattaggtcactttctgaggttttaggtagacatatcttttgggggctataattcaaccaatgacctatagatacatgtagtaagtttttaaactggcatattaaaaatatgccttgttaaaattgcctttgaaaaatatctccatatctgtgagggattgcttccaggaccctcactaataaccaaagtcttagcataatcaaatgctgtagctggcgctgcagagcccatggatacaaaaagtcatcattccttatacgtgagtttcacatctcgagaatactgcacttcccacctgcattttgttgccaatgtggaacctgacaatgtggaggcctgactgcacttattgaaaaaaaatccgccataagcgggatttgaactgcccattcagttcaaacccgtgttgtgtaagagtcaactgtataaaataatttttattcacattaaaatttgaaactgc

SEQ ID NO: 794 - DNA, 1492 bp, Homo Sapiens
tcacgcctgtaatctcagcactttgggaggctgtggtaggcagatcacttgaggtcaggagttcaagaccagcctggccaacatggtgaaaacccatctctactaaaaatacaaaaattagctgggcatggtggtgcatgcctgtagtcccagctacttgggaggctgcggcagtagaatcgcttgaacctggaaggcagaggttgcagtgagctgagatctcatcattgtactccagcctgggtgacagagcgagactccgtgtcaacaataaataaaataaaataagaatttattttagtgtattcatgaaaattgattttatttacttttagttaatgtttacagagactggaaaaacttctgactttatatacattttcataaacatttttctttcaaatgaacccttgaatctacacattgagagccttatgggtaaatacttaaataatgacaacacacttatatagtattttctacatgccaggcactgttctaacccttcttacatatatgagatcatttaatcattatcaccattttacacatgaggaccttaaggaacaatgaagttaaagtaacttgctgaaggttgcattgctggtaattgatggggcgtggaactgaacagtctggctgccgagccagtgtttttaaccactgtattatattgtttcatatttaaatgacttcataccatgatattgtgacagtttataattggaacaagattcattctaggaagaatttatatggagtatttctaagaaaaaactgtgaaatagaaaagtaagtcagaagtgtgttaagtgtgtttagcaggttattagcttcctgctctattataaactgatacccacttaacaattttagttattttttaaaagttgtatattttgtatataacaactctgctgatgtagtcagtaattagttgtcagagttataatttctgtttggtttgtttttttcattaaaccaagaatcttatccattttatatccctactgttcaggcacataatttgttacaattgtttttaaaaaatgcacaggagttgaacttaatatgtggctcacagtgttttgcccattataggtactcaacaagtgtttattgagatattgtgttaaataataaattgaactaaaggtacaaccaagaatataaattttagtaggagaactttattctcttttattaaaatttaaacgtagaaagttgtatgatccaagatgggttattatctgggaagaatttaatattcttagaaccatattgttgaaaatagctcttagtaattcccactagactgtggcctcctttgagggcagagactaatttatttatcattatctcagcacctagcacaatacttgaaacataataagtattccgtagtatttgataaatgcatgaatatatttaatattatatttgagaacatgtgatatatcatataccatgtaataaattaattttgtctgtt

SEQ ID NO: 795 - DNA, 910 bp, Homo Sapiens
tttagctgtcagggatcctgttgcagctctgcctcagccagtctgtgcacagagcatggagcaccagggccatggagcatgtgggctatggaatcgggttgcctattttcatcttgactccatcacttgctgggcaaccttgactcaatgaatgacatcataaaaatggaacattcaaatgagaatgtccaaggacctgctgacttcactgatgaattctaccaaatatttaaagaagaactcatattttccaaaaaaccaaagaggaaggaatacttccaaactctttttacaaggcaagcattaccctgataacaaaactagacaaggacactgcaagaagagaaaattatagtccagtatgcttcaagaacataaatgcaaaaatcttcaacaaagtaccagcaaaccaaattcaatagcacattagaaagaccattcaccgtgattacatgggatttaaccctagggtgcaaggatggctcaacatatgcaaatcaataaatgttatacaccatattaacagaagggataaaaaccatatgatcatctcaatagtttcagaaaaagcatttgacaaaatgcaacattttttcctgattaaaaactctcaacagattcggtatagaagaaatgtacctcaacacaatgaagcccatatactgcaaacccatagctaacatccaactcagtggtgaaaagttcagagatttttcctctaatatcaggttcaagaccaggatgcccactctcatcacttctatttaacatagtactggaatttctagccagagcaattagacaaaggaaggaagtaaaagatgccaagaacacacaatggggagagaagactttgctaagttgtgctcagaaaactggatattcacatgcagaagaataaaattagacc

SEQ ID NO: 796 - DNA, 3022 bp, Homo Sapiens
tgggaggaagccccttcacctgatgtcaaggggagctggtggccggggttttaccacacagcccttcagcatcacccctgaggtcacgtgggtgagcaatgcctcagtgggctgggggtaagaggtgcctcagtgggggccggggggtgtgagtggtgcctcagtgggccgggggtgaatggtgcctgcacagctgtgcggggtgtgcctgggtgggtagtggagcttcctcagcagagaatggggtgtggggatctcagggctgcattcccagactctgcagagagtgaactctggagagtgaggccctggggttctgttgttctctgggaggaatggggttggggccctcgtcagcagggcccatgggcaccacagtgagaccctgggctgcctccacacgaggactcaccttctcccccttggggccatcgctgcctgggctgcccttggtgccggggtctcccctgcgcccctgcagagaacaggcgtgtgggtgagggagggggctgagtccaagcccagagcctgtggagggtgggggctgtgccggggccgatgctccttctctacaggagggctctggctttgggacctgggacctcgatccccaggctccttcccaacagcctcagcctgcgccagtggctctgctgccagccctcgtccctctgctgcgtcggtcccgcccatgccgaggatttaggaatgatctggggaggctccaggtggagttggatgtctgagcccaatgcggcaccatggtgacagcagagatggtggccagcgtgactgttcatctgggccatgggcgtgagtgtggccagctcagctgcaggcgaagaggcagaggggctcaccttgcttcccttggccccgatttctcccgggggccctctgcgtcctgggcggccagggtccccctggaagggtttgcagaatcagcctcacgtcttttggcaggggaaggggggtgcaggatgcccgctgcgggggcaggacccacggtcgggcttgggactgcacctccctgatgtccacggggcacctgggatgccagatgctggctgggggctgctggaacctccgtgccagctgagggcagagtgtgtgtcacgggcaggacgcctgtgcatctgctcagaggactcagccagacttgggcttgggctgagggaaggtggacagaaagtgggaagccctaagtccaagctcccagaaaaaagcccttggggatcctggggccgccaggggcggggcgacactgcaggcggcccaggagggcagagcccctggggcaccaacgttcccatggggagctccaggaggtgtgggtggggctccctggggctccacctgggaggaggtgggtttgttgccgaggcctcggtgagcagcggcggggccgcccaagccctggttagaagctgatgaagcaacgggcagggcaccctccaccacatcccacggccattggctcctcactgaccagtgtttccagaaaggccctctctgctcagcttctcagctggggctgcctccaggaggcccctggaagctggtgaccccgcctgccccgtaccctgacaaggccacttaccttgccgccttggtctcctcgctcccctggactccctgcttcccccgggtaaccgtcggggccctgagagaggagtgagaggtggagctcggcacacggcgggtggggttctccccatgagccagggcccaagtgctccattgtcccagcccgggacgcacctcccaccctcactgtgaggcccaggctcagtgaccaagaggccaggcctggatctgctgctcagggaaatggagctgtccagtgacaccgaagtttgggatgcatcaggtctccaggccacggggatccgccaggagctcccagggggagttcctcacatgactccgacccggcagaatgctgggctggggctgctgggctggggctgctgggctgccgggagaacccacgctcccactgcagcagcaactaccctcccacccggtcaggcacccacaccccctgggccgaggctgaaggaggggtgcaaacggcccttacccggtttccagggtctcccttgcagccaggaggtccgatgcgccccagcttgccctgaaggagaagggggcaggaggagtctcagggcggggttctggggtccatgtgtgccaacgaccaagacacagcccacccggttctgccccgcagggctgcagcgctctcctcctggcacacgggtgcccacatgaggccacggctgctgtggagctgtctccggggaggcagagtggccgttgtgcaggaacaggccatccctggctgcctcccagaggccctgagggcagagctccctgggcacagaggatgttcccacggggagccatggaaggagtgggtggggctgtcctgtggtttgacctgggagtgggtaggcttgttgctggcctctgtgtgcagctgtggagctgccccaagccgggatgtgcagccatgaattagatgcaggctggtgaagccctgggtggggcagtgggatgtggcaggagctgaagttcgtgtgtgtgtgtgtgtgtgtgtgtgtgtgtatgcgtgtgtacacatgtgtaagctgacagatcaggctggatctgggggccctgcagaggctgggatgcctctgtgagaccagtccagctgtgagcccgaggctccctctaccttctgtccatcggtcccgttcttgccagccaggccaggggccccctgaagagagaaggaagagggaactccattagccccggtccttctgccctgagcagcaggaaggaggggctctgcctacccagccagcctaccttgcgaccgtcggctccaaattcaccctgtgtaggaggaaagccggcgcagtgagctcggtgcctcaaagcatcatgggcactgctgcctctggggggcaaagcccttgggccaaactcaaggccacaggaccccccaggagcccccaaagccaccactgag

SEQ ID NO: 797 - DNA, 2300 bp, Homo Sapiens
cctctgctggtggaggacaatgaaatgatggctttgaagctgacaacaccatgggatggctgcggtgggctagggaaaggagggtgtgcagcaggcacataaactttctagagtagtgtgggttgcaccactgcaggcatgaggtggggcgccccggtgtcacaaaagtccgatcaggggacatatggtcctgccaggagctaagggcccagagcttggccaccgtgcagagagctgggcgaagaggaagcgccgcagccagtggacttggttccactcagctgcaaaaggaagagagttggtcaagacgacgtctgcagtcccttcactataaaattttgcaaaatacaaactgctcagtgggtgtgtagttggccgaaggtactccaccaaagaggtaccaaaagctggtgggcttcaaagcagcatcgtccccagcagccaaaaagtgggcaccccaagtgtccatccacagatgatgggtaaacaaaacggggcctgtccatgctaggaaatatgacttggccatcaaagggaatggagctctgacacatgccacacgtggaccttgaggacatcatgctgagtgaaacaggccagtcacaaaagcacaagcacaggatgattccacttatatgaggtccctagagtagtcaaattcatcgaaagtagaatggtggctggcaggatctgggggaggggagtggggagttagtgtctaatgggtacagagcttcagtttgggaaaagttctggtgttggctggtggtgatgattgcacaacaatgtgaatgtacccaatgccactgaactgtacacttagaaatagttaagaaggtaaaatttattaagtatattttagtaacccctccccccgcccccgccaaaaaaaaaaagcccatgtgcacagtggtctctgctgaatgaagacttgaaaaccagagcccagccctaaacagctcatgcatagtccaggcagagaaacagagcaggtaatgccccctcaactgatggcagacgggccagggagccctgctctgggctggagcagggaggcaccttcagggttgtgggagatctgcagggagagccacttctccctaggggtgggtgtctgagcaacagcaccagaatcccagcgacattctctccttcctccttccagactggctttgcctgcctctgaggctctgggaatgctgttccctccacttggaaggcagtttcctcacttcaccaattctttatcttcgtcatcccaaacccaacccacatgcaccccacaagaaaacctccccttgccagttatagactctcaaatcccccagaaattctgccctctgatgttgatcataattgtcatgaaatagctatttgtgtcattgtgtgacacgttctatgaaattctccattgcttccccagtactcattaaggaaatgctttttgtcagatggacagatggatggttgggtgagtggatggatggatgaatgatggatggatggatggttggatggatggatggaagcatggatagatggatggatgggtggatggatggatggtggatgtgtggatggatggatggatgaacagatgggtggatggatggatggatggatggatggatggttggatggatggatggatggatggtggatgtgtggatggatgaatggatgaacagatgggtggatggatggatggatggatgcatggatggatggatggatggatggacggatggacggatggatggacagatggatggatggatggatgggtgggtggatggatgataggtggatggatggatggatggatggatggtggttgggtggatggatggtggatgggtggatggatggacaatgggtggatggataggcaagcaaactgaagggtctacccacccaaaggggccaatgcatggagtgcctaggcctggataacagggtgcaagtatacgtgtgaatgggtgctttcgagtcttttgcctagaaccatgaattacagttcaggcccactgtcagtcctacctgacactgtgtggactgtggacctgtctgagaacggcttcctggatctagaggtttggctgaaggacagcactcaccatctcctgggaggatgagctctcaatctgatctgatctgattggcttggaggacccatcccagatggcaccatccaactgtacctagcacttgctgtgacctgggctggcactagctgagcacttcccatagaatagcaggagctacttttccctgttttacagacatggaaactgaggcac

SEQ ID NO: 798 - DNA, 1614 bp, Homo Sapiens
aagggggcagccaacaggaggctggtagaggagcttgaagaagctgcaaatgcggaatgaaagcctcccgcaacatccaggttgaagaagctaatttattgactcggcaagggcttattgtccctgacaacctccataggataaggcggccttcagaatcaaaatcaacctatgagaagattacccattcaaatcataaaagaccagatttaaaacaaagatctatcacccgaacatcgactagaagtggaggtccgtctgcttggaaattagtactgagaagagaaagccagcaaccagggatgaccacacactccagtccagcattggttacccagcctgagcatctgctcagcctgacactcctggctcacctagccgaataatactttatgaaatgctgaagagtttacaaggaaacatggggaaagcgacctgtggacaaaagtctgccagggtgcattccaccacgtgtgagcagagcctccgcagtgtgctccaacactctgcaaagcaggactgtggagaaaggacacatccatcccctgccttttgcttgtggtagtgactaactttctacagttttctcaatcaacagtggtccaagtaaactgtaattaaaggattaaaaatgaaagatgctccagttctgctttctttgttttaaaaatcactgctgcaatctgcttcaaaacaacagtgcttcttttcttgcccaaatttattcaaaatcttcaagttgtgtttagccgagaaggctctgcaaaggagaagagacggctctggtgtctctggtgggttttcttctcccgtactgcactgctcagtgtgggagttaattcaaattctcctgactccagattataacatccttttgaaaaatttgaaaacaagcaaacaacaacagccctcctatcctgactcccttctccaaaaacaacaacaaaaagccatgaaaaggcaaggcctagctctggagtaaaattcctgctaatattaccccagtaatatcgatgaaatgggcaaaccctgatgtcagtgcatgattgaactctagcacggccggcccctgcaaatgtaggtctgcggtgaccccgaagggagggcctgccaaccagggccactgtgcatgctgggtgtgatgaatctctcaccagaaaggctcctgaggccaaaggctggcactcttccctgaatccattttggaagacttgctggtcattgcaggcaaagctaagccagactatccctttgaaattccaagctcatctgtcaccaggctccatcccagtgtgccactgagctcactcttcaactcctcagggtggcaaccccaccacagctctccctgagcacaatttgaccttttgcatgattgaaattggtggaagtaagatattagccggcaccagtctgggattgccagtcccttgctgtcccctttattctttccttcaatgcagcccaggagcaagatggccttccctctccctttggactcaccgcttttgcagactcaagctccacttaaagcttactcagtattatcctttaaacgtgttttatattgttttgcctgcttttttgtgtgaaataaaaattaaccttagaatt

SEQ ID NO: 799 - DNA, 2570 bp, Homo Sapiens
gaagtacaatgttttataggttgtaattcagaaatacaagtacataagaaccatctgttagaggatatgccactgaaagggacaaccgactaatttaaaaattatctattgggtgatatgattaacaatatttcaaagaatttttttaagtgtttggttcttattaacggactggtatttcatttctgaccagtatcatgtaaaagcttccctaaaatttttattctggtttacacggattagcataaagatagagcaaaaatttcatctttgaaggagatctggttagatccatggatatctgaatggcattgatttataaaccaacattattacttgtgcgttaataatgaaatctaaaacttagtataagttcttaaatgaaattcatttgactttctgatatgagtgactcttaaggttagaaacatatgaatttagaaaaatgaaaccaaatgttttcaacaaagtaatttatttttttcctgagactaaattcagtacagtatttgtttttataacatccaacatgtcttatgttaaacttaaccactttctatgcagtgactgtggtgagatgatctattttatttgactaccctcaatgtaattcatttgggtagttctaaggcatatcagtgatcaaaatgtttctccctacagttactcttgcattctcaatcagtttcttctgcacatcatctaaagaaaatttatgtggtatgattacactctttttttttttaataccagaatttctaaaactaagaaaaacactaacatttaaaacatcagtgtttctagtcaaggatatttcaattaaatttcatcagtacattatagtttaactcatgctagaaatgttaaaacccaagatcttctgagtcacataataccaacatttcatattaacgaataaattactcaagttctatacaaagatactaagtgatgagaaacagaaaaagttaagctttcaatagttttaaaaaaatacagaagcaaactaatgaacacaactacgcaaaatataggctaaccaattgcaagctaaactagttagagattaacctttaaaaaatacattttagaacttagaagcaaactaatgaacacaactacacaaaatatacactaaccaattgcaagctaaactagttagagattaacctttaaaaaaatacattttagaacttcgtgacaccctcataaaaggcagcaaactaagggtattaaaacagtagtcattatttcagttactgtgcatcaagtctaaaagatccagataaagggaatgttttgtgattcaatttaaataactttaaaattggaaacatttaacaattgataatataattaaaatttaaagaatatacacaaatgatctgaataggttttatattcagtaacttgcatggtttttacactgacacttttatcattaatttaggagaatcagatgcatttccctccatatacctaggcattaagattccaaatttataaatatggtagtatagtattttaaatattaagtttgtacatgaatattgggtttatccgtattttcctttgtttcccaggtattatccagttttgtaaggaaaacactttgatatcacaatcaaaacttgtcttggttactaggctgtagccgtaattgggttacagtcacttagattcattatttggaattatacttaactaagacaaacctaaatgaaatttatctcctagaagaatttcacatttgcatttacctgcatggcagaatgagtttaagcacattttagctgttaggaaatatttaatttacttaaacttgttatctgactactcagaactctgagtagtcaactgtacctttgcgtttacttaaaactatatcggattcacttcaaatagaagatttttaaatagaagttagacttcattaaggtactggtattaactttaaatctgaaagaaaacatactgaaagtttgacaagttcattaaaacatttttagcatgtcttggtatatttatcagctttttattcttctttctgctggcatttccttaatgtttgtttgtttcacctctctggttcattggattgctactatttatgctttcatggactttatcttcacagtttactgtatcttgtaaaggctttaccacatcagctgtactggctgtttttggcaaggtcatctgcagtgcacaccacagggcagtgcgtgttttccgagtagccacacacatctctttaattgcagaagcaagggcaaaaacatctgtaaaataaacattcagggtcatttcatattaaatgccatttaaatatctgttaaatcttacaaaacccagtgcttttgctactaaatgatcaaatgttatttttgtaaaaaaaggatagttattgattgaaccaaagtcctgtcctttatcattaaaatatttaaaagtattgatactttatttctgacttgtacaatagtgactatagtttgagtagaacacagactgtcttgaaacagttataacagacaaaattaataaaatggaaatacttttggagtaaa

SEQ ID NO: 800 - DNA, 2569 bp, Homo Sapiens
gaagtacaatgttttataggttgtaattcagaaatacaagtacataagaaccatctgttagaggatatgccactgaaagggacaaccgactaatttaaaaattatctattgggtgatatgattaacaatatttcaaagaatttttttaagtgtttggttcttattaacggactggtatttcatttctgaccagtatcatgtaaaagcttccctaaaatttttattctggtttacacggattagcataaagatagagcaaaaatttcatctttgaaggagatctggttagatccatggatatctgaatggcattgatttataaaccaacattattacttgtgcgttaataatgaaatctaaaacttagtataagttcttaaatgaaattcatttgactttctgatatgagtgactcttaaggttagaaacatatgaatttagaaaaatgaaaccaaatgttttcaacaaagtaatttatttttttcctgagactaaattcagtacagtatttgtttttataacatccaacatgtcttatgttaaacttaaccactttctatgcagtgactgtggtgagatgatctattttatttgactaccctcaatgtaattcatttgggtagttctaaggcatatcagtgatcaaaatgtttctccctacagttactcttgcattctcaatcagtttcttctgcacatcatctaaagaaaatttatgtggtatgattacactctttttttttttaataccagaatttctaaaactaagaaaaacactaacatttaaaacatcagtgtttctagtcaaggatatttcaattaaatttcatcagtacattatagtttaactcatgctagaaatgttaaaacccaagatcttctgagtcacataataccaacatttcatattaacgaataaattactcaagttctatacaaagatactaagtgatgagaaacagaaaaagttaagctttcaatagttttaaaaaaatacagaagcaaactaatgaacacaactacgcaaaatataggctaaccaattgcaagctaaactagttagagattaacctttaaaaaatacattttagaacttagaagcaaactaatgaacacaactacacaaaatatacactaaccaattgcaagctaaactagttagagattaacctttaaaaaaatacattttagaacttcgtgacaccctcataaaaggcagcaaactaagggtattaaaacagtagtcattatttcagttactgtgcatcaagtctaaaagatccagataaagggaatgttttgtgattcaatttaaataactttaaaattggaaacatttaacaattgataatataattaaaatttaaagaatatacacaaatgatctgaataggttttatattcagtaacttgcatggtttttacactgacacttttatcattaatttaggagaatcagatgcatttccctccatatacctaggcattaagattccaaatttataaatatggtagtatagtattttaaatattaagtttgtacatgaatattgggtttatccgtattttcctttgtttcccaggtattatccagttttgtaaggaaaacactttgatatcacaatcaaaacttgtcttggttactaggctgtagccgtaattgggttacagtcacttagattcattatttggaattatacttaactaagacaaacctaaatgaaatttatctcctagaagaatttcacatttgcatttacctgcatggcagaatgagtttaagcacattttagctgttaggaaatatttaatttacttaaacttgttatctgactactcagaactctgagtagtcaactgtacctttgcgtttacttaaaactatatcggattcacttcaaatagaagatttttaaatagaagttagacttcattaaggtactggtattaactttaaatctgaaagaaaacatactgaaagtttgacaagttcattaaaacatttttagcatgtcttggtatatttatcagctttttattcttctttctgctggcatttccttaatgtttgtttgtttcacctctctggttcattggattgctactatttatgctttcatggactttatcttcacagtttactgtatcttgtaaaggctttaccacatcagctgtactggctgtttttggcaaggtcatctgcagtgcacaccacagggcagtgcgtgttttccgagtagccacacacatctctttaattgcagaagcaagggcaaaaacatctgtaaaataaacattcagggtcatttcatattaaatgccatttaaatatctgttaaatcttacaaaacccagtgcttttgctactaaatgatcaaatgttatttttgtaaaaaaaggatagttattgattgaaccaaagtcctgtcctttatcattaaaatatttaaaagtattgatactttatttctgacttgtacaatagtgactatagtttgagtagaacacagactgtcttgaaacagttataacagacaaaattaataaaatggaaatacttttggagtaa

SEQ ID NO: 801 - DNA, 1711 bp, Homo Sapiens
accatcatgttaccatattcttgccaaaaaaaaaaaaaaaaaacaccagagtcgttacatgaagtatctttgatcactgaatttccagcacttctttgttgtgtctagatgctaagcccttttctaatttgaaaaaaaaaaaacaaaaaactggagacctgattctgtttatctcttgtagtttctcttatctctgtttctaaccactctatgtagtgcctctttttttctgtctacacacacacggagcatccaccataccaataatcacagtatgtggtaatgaaaagtggaagggaaaaatggcccttgcttctcacagacaaactcactatctcaatggatcatttttgtttttttgttttgttttgtttttgagacagtctcactctgttgcgcaggctggagtgcagtagtgcaatcttagctcactacaacctctgcccccgggttcaagcaattctcctgcctcagcctcctgagtagctgggattacggcacctgccaccatgccctgctaatttttgtttttttagtagagatggggtttcaccatgttggccaggctggtctcgaactcctgacctcaagtgatctgcccgcctcggcctcccaaagtgctgaaattacaggcatgagccacagcgccccgcctcaatggatcctgatgagctacgcaaaccattatttttatgtctttatgaatgccaccagaaagtttcattttgttctttctgaaaacaaccatgattataagatgtcttctgaaacacggaagtgagagaacatgttgtacagagaagcatgcatccctctgccctgccaccactgcacctatgctaagcatattatagacagaaggatgtccatctgcctatgtaagctcttgcccgtttattcttgggctctgtccaggctgtgaccctattactcctttgctccttcatttgaggactatgactgtgaactgtatttcttcctctctgcacctatataggctacaggaggaagtaacaaaaatcttcccccacacccagagctaaatattttttgccccaagctgaaagttctctagtgaaaatgcagttcaaggccatagatgcaggagagaagtagatttgttggcttctaaaaggaatatttatacagttttgtctaacagcaccatcctaacagcattctgatttgttttattttccatttttaatacctttgttgatgtgtaatttacatacagtaaactacacacttaatgtatacaatattataagtttttatgtacatgtgtactcgagaaaccatcaccactatcaagataataaacatccatcaccccttggagaaatcacgttgcaatccctctcttgtgcccctacctacattctccgttctaaggaactgctgatcttctttctgtctctgtagattagtttgcattttctagaattttatataaatggagccatataatatgtactctttttttggtctggattctttccatcaacataattatcttgagatttatccattttttgcatgtttcaatagtttatgcctttttattgctcaacagtattccattgtatgtatataccacagactgtttatccatttgcctgtagatggatatttgggttgtttctagttttgttgttgttgttgttgttgttgttaccaataaagctgctgtgaacatttggcaccagtc

SEQ ID NO: 802 - DNA, 6952 bp, Homo Sapiens
ggaggcctccccacgcacgctgtggagaagagagttaaaaaacaattcggttggctgaagcctgtgtcagttttcatgtgacccgccttttggaggcatgacaacacaaaaaaaaggggctgttctcgcgagactctaaagcgacggttaagggacaggggacgagtggagcaagtgggccttaatctgaaaataacttgattgtttaatgacattaagagaaaaagattacgagctttgagaaggaggaagcctgggagtaacgacagttaaggagttagcttgcggaaccaacataagaatttataacagggaggtgtcgtttgggatcagacgcgtggcctgcattgccgtagccaccgtggtgtaatgttgccacgtaaaaaccacaaatcccagaattcagtcgggtgatacactggctcagaatgtgattggctgcgggaactagtagcttcctcattggctcccgtggaaggagtgaatgctgggatttgcagtctgatgggggagccgtgctgggtaaaaaccttagaatcgtcgcgcactccgtttctgccgcggattcttatattctccaatacaggctttttctgttatgcagtatttgcagagcaggctgctgcagtttggccaggcgcattgcggatcagttggtgttcttgccagaggcctagcagcagcttcctagcgctactacttgcacctcccaaggcagctgagcctccccacttctctggccagacacactcctaccgtgcatcgtagaaccacctctctgacgccagcaggaccttagtaagagtaatgggtatgcgacagatggctgtagtcaggccctactgatttcaaaatagctaaaagactatctctgtagttagcttttgtggccttgatggacctgcagctgtgtattgctccctcagacgtacaaattcgtggagatgagttatgaaagtatttagtatccaagtttttcatctgcttaatatttgggattttaaacacaagttttgccagctaggggtcaacatccctgaaagtgttagggatggagctagctgacaggcctttctaaaagaacagagagcctggtgaagagatgaaaaatcaatctcacttgatactcctgttaaaaacaacaacaaacctttaaatagctctctactaacacataactcaaatccgatcaaatctacctgacctttaccattgttttctgtattcatcaactattactgagtacttcaaagtcaggcaataggagttaataaaacagatgaaacttggtttagcctcataatatgtgtttaaatttcacacatacctctgatctgctctcatgtatccttctacttgaatgtatgtaatataaaggccgggtgcggtggctcatgcctgtaaccccaccactttgggaggccgaggcgggcagatcagggcatcaggagttcgagaccagcctggccaatatggtgaaaccccatctctactaaaaatacaaaaattagctgggcatggtggcgcgcctgtagtcacagctactcgggaggctgacgtagaaaaattgcttgaacccaggaggcggaggttgcagtgagccgagatcgtgccactgcactccagcctgggcgacagagtgagacaacgtcttaaaatgataataataatatatacgtaatatatgatattttttctccccagtaatgccatatttcattttaccaatctgccatgattaatatatctttcatcaaactgtccttagtgcttcagccacaattaattgccttttgctctgaatagcctttccaccatatttaatgtaaaacacacacacacacacacacacacaaagaagcaggtctttttttgtatgtgtggacctcaaggcctcagtcatttggtattatcaataatactttcttttagcctgtgtccactcagaaagcaaatcatggtttgtctttttctgtgtgtaaattctttcacttttgaatttccagctgaactataatatttggagtcagattccttaaatataaatcatgtttacagccacttacttggtgtcataggcaattcattttcatctttctcaacttcagtttcttcgtgggtaaatgatgatcaggatattacctcaggttgttttaagagttaaataactcctaacctcaggtgatccactggcctcagcctcccaaagtgctgggactacaggcatgagccaccacgcccggcccagccaaatatggtgaaaccctttctctactaaaaatacaaaaattagctgggcagatgataaggagaaaataatgaatgtcaaaggaaacgtaattcctccagtgctggttgtctcaactgcgattgttgtggtttggaaatgtatcaacacccaagaaggctctctcttgtggatgtatcacttaaaacacccagaagttgttgacggcggcgggcagaagggccggtggtttccaagctgcttcaacaatgggacccacaatcctcaagcagaggaagaagaagacatagacaaagaaaaagagaaagaaaaaagaaaagaagatgacaaaaaaagagcttcggctatggaactggtttaatccatacgatcgcccagaggtgctgacggtgaccagctggaatgagccggttgtgtgggaaggcacttagaacagaaccatcctagaaaattattatgccaaacagaaaattactgtgggttgacggtttttgctgtcggaagacatgtagagtattacttgaaggagttcatagcatctgctgataggtacttcatggtaagccacaaagtcatgttttacatcatggccgataatccaggatgctgttgatagagctgggtcctctgcgtttcttcagagtgtttgagatcaagcccgagaagaggtagcaggtcatcagcatcgtgggcatgaagaccaacagggagcacatgttggcccacatccaacaggaagttgacttcctcttctgcatggatgtggaccaagtgttccaagacaattttggagtggagaccctgggccagtccgtggctcagctataggcctggtggtactggacacatcctgaggagaatacttaggagaggcagaaggagtcggtggcatacattccatttggccagggggatttttattaccacgcagccatttttggtggaacacccattcactttctcaacatcacccaggagtgctttaagggaatcctccaggacaggaaaaatgacctcgaagccaagtggcatgataaagccacctaaacaagtatttcttcctcaacataccctctaagatcttatcaccagaatgctgctgggattatcattataggtcatcatgcagatattaaaattgtcaagctatcttggcagcaaaaagaatatacgttggttagaaatgatgactgacttcaaattgtgccaacagttttttgaatttgagagaattattattctggctacttcctcagaaaacaattttaactttaagaaaatattaatgaaacaccaacattgcaatcacatactatctctccttgtaactttgagcattgtaatatgagagaatgaatctatggtaatcaggtgtaaattcccagtgatttcttatgtattctgaatttgggggaaatactatcagctgaaccagaaagaacttgtcataggcaaagataaagccagaaacaggccaggcacggcggcttatgcctgtaatcccagtactttgggaggccaagggagtggatcacctgaggtcaggagttcgagaccagcttggccaacatggtgaaatcccgtctctactaaaaatacaaaaaattagccgggcatggtggcgcacacctgtaatcccacctactcaggaggctgaggcgggagaatcacttgaacctgggaggcagaggttgcattgagccagattgtaccattgtactccagcctgggcagcaagagtgaaattccatctaaaaacaaacaaacaaaactctacatgtgtcagataacatcctggagaaaatcaggtggtaagggaagtgttggcagcgagatatggttgtagggggttatacccttgattccaatgttttcctgtttccgatggatctaaagaacatggagtttttatttgcagcaggggaactttcagtaaggacaccgtttgccttggcaatcctcaaaatacttcaagaacagattgtttcagaccatctgtagtccattcttttctcatcaggatgtcatttggtttctgtgtgaaagtttggtggagattcccagtagatattatgatggtgcatggtcagagtcccagggaacctgaatgaaccaaggtgctcaatgtgaagtgaaaacagcctcaacatgagtgccatgaaatagcaaagagagagtgcaagagaggggctgatcgctgtggggcagtgccaccttgcaggaacacatgccatgaggttggtgcttaaatacatcatggatccaggcactgaatgggaggcagtatgggtgatttccagcttggttgaccccatgactgacaaacagcagggacttgaatggaagatgcttcttgttttgcccaagttgtattcggtctaccagattctgcaacttatgtcttcagatccttggtgaggagatatggatgctgtcagagaaggcaaatgcctgcagtggatcgaagaggttttcaaggagttccatttccagaatgtggcttcatcagaggacaatggatcatcagctagtcccaccacttagctattctggaactcagggttcctgtgccactcataccccaacttggagggctgacatcaaagagtaaactgaagaaatcaagtaacctctcatttttcatctgcactatggaagtgtaacaactagacgtgtaaccagcaaaagggttcggccatttgtttatagaaaggagtcaaaataataatgacatgtgaaagaaagagagcaagactttactacttgtgttagcaaggggaagaatgggtgaaattttaaaaaatttccactcttccctttgtggagggaagatagagatttttaaggagagaggggtttggaatgtaggagaggaagtgggtatgaggtggcacggtttgttttaatgacttattgtgaattgttgttttatttggtgaaggccctggtgtcattttgggctttaattaggttacaaattaattgcagtcaattttatggtcaatttttgttttttcttggagatggggtctcactctgtctcccaggctggagtgcagtggtgtgatcttggctcaatgcagtcttgacctcccaggctcaggtgatcctctcctacctcagcctccctagtagctaggaccacaggcatgcaccatccagcacagctaactttttgtatttttttttggtggagatggggtttcaccatgttgcccagactagtctcaaatttctgggctcaagcagtcctcccacctcggcctcacgaagtgctgggataacaggtgtgagcctttgcatctggcctgtagtcagtttttagctgggattgagtttcagccttgactggggagagaattttggaggtgtctggtttgtgttaggatttggcctttgacgttttaatggaaatatatgactagatatgtcagtgtggcatgtacttaacaaggatgtaagtaaataaatatgcataacgcatgggagtatagtatgggaaagaaggggagtggcgatttatagtacattttgaggctgtattttaaggcaaaaggaagcagatatatagtttgtctaaagttatattttgagattgggagaagggaggaaagaaaacattttgaggttgtaaaatacatttgtagtttattttcaagttatattttgaggctggggagaaagttggaaaggaaaaaaagttttaaaatgcagtttgaagttaagctgtttggttgtaatttttattgtcaaattttattttatttgtatggaaaatggctgccataattgttttggctatttttttgttgagaaggggcatagtttgggggtattagaatggaattgatttatttggatttggaaatatttatgagtatttgggcctatagacaatatttattggagtgttatagtttgaggtttagaaagttttggggaaagtctgtcttacagttttacatagagggtataatagtagtaagttttataacacagggatatatctacccctgtaggccaggccaatgttataagtagtttttgtctctaacatggtcctgacttgaattagaatgtcccctattgatttagtgacaatgtagggtcgcacatagatttaattttttggtgtatattttgtagggctatttgaggcatttttgaattttttaattatgtagggtttttattgttaattgtaattggatgtgatgacacgttggctaatatatatatttaataggctgtaaatagggatatgaatatttatgaaggtggctttaagtcttgtttagtttatgagggtggattagtttagttagttgttttatttagaaggtagtattgtacatgggctaggcctttttatgtgatgaaggcagaaaaaagtttattaagaggcatttttatggaaatagaaaagcaaatattaatgttggaaactatttggatgttaaagtacttttagttatagaggaggaaggcagtagtaatttgacgttttctttgtctgtgttataaggaataagctttagtttgtaaagcctcaggaaagaggtagtagtaattttattgagtttaagttagaaaaataaaagaaaaaaattgaaaatattagtttggaaatttgtactctagaaagaatttaggatttagttaaaattatagaaaataataaaaactcaaaaacagtggataaga

SEQ ID NO: 803 - DNA, 18269 bp, Homo Sapiens
agggcggaagccacgggacgtggagcagatggtgaggatagtggggaggtagcagcagaggatgacccgaggcaaaagtgcaagtgaagaaaagtcgccttgccgggcagaggaaattactccaggatttgaatcatcacaagagattcaccagaggattttatacacttgggctgtggcagcagactaattacatcacagcactaggcttgcgtgaggagccatgcagcactcttaccacagacacttggagcaccactggatagacagactggaatgacactgcctcgacccactgtagagccttctcttgcttcaggcaccattcagaagtagcagccttacaagttacttggtgtaaccggatcagagcagagcatccacttgtggtttgtgttgcctacaaaatctaaagaggccgaggactggcacaataatcctgaacttggaaaacaaagactgcataacattacctattgatatagcggccagatgtgactttggttgttttcccttcatatgtggttgtatacaaaatagtacattttgttaagtaggaacttttttggacttgtattatggtaagaaacatgtatgtgtgtcctcctgtaggctgtctgaatatttctttctggtctacatagcatctcttggtctgggcaaacttcccttcccaatttaggtggttctgatgagtaaaggtaaattaccagatagcaaagcaagagggcattctagaaaataagatcagtggaagcaaaggcctatgggcattgtgggttctggaagcagtaattagttcagttgagtagtaagtagcactaggggtgaagagtatgaagagtggagtggtgggagataaaacgggaaatgttaggtagggctatactggaaggagctttatgtaccatatgaagaaagtggacaaaatcctatgctgagggaaaagtagtgattttttttttacaggactgtgatgtgatcacatcacattgatatgaaagatattccatgagggagaatttgagatgagcaatactaggggtagagctattatttaagattacctagtaattctgaataaaatgatgagacatgagctaagtaaggtagtgtgaattagaggagaaaatgaatttaaatgatacataggaagtggaattgacagacttggtggctgactatgtggagtgggaagagagaacaggaatttatgtatgtggttaaaaattatatacttgtatgaaacaatctggtttgagcttgagtggggttcagagagatctgggcctagtgtagagtgaccagctgttctggtttatccaagattaagggatttcgatttcctgggatgtgagacttccaatgctaaaactgtgaaagtccccagcaaaccaggacaaattggtcatgctagcctaatatgaatgggcggacagattagtgacaggagcttatcggcataagcactgaaacaccttctgggataaccatgacctggcaagagagcctttagtggtgcaaagaaatggtgatccttgataatgcatggtagttgctattcaaatctacctcccaatggatccaatctggggtcccacggagaaaggaggctggaagtaaaatacgaaagaactgtttcactaatctgtgaccccgtttaacagagtgtaactcagagaggacagattctttctcaccgtggactaccccacagctctggaaacctgagggctttagtacattgggagattcagttaaatacaggttgggggagttccaagggatggagagggtggggaaagggagaaggaggaactggtaacctgtactggtacaagaaaaactaaaatacttagcagaacagaataacatctgtgcagtggggtataagtcagtgaaatatgagttattacagcacaggtgacatcagcaggcttttcttgaagcaattcctttcagaaggaaagaatgtgttgattactttctttgttatgttgcgccatctactggtaactctcatgtacttttttcctagttagatgtttaaaagaagacagatgaattaaaaacttgagaactgtttccaaagtcgtcatttattcgttcgttcgttcattcattcattcattcattcacttcacaaatactgagtgagtatgtataccttctatattgcagttacatttctaggcattggggttacagctgtgaacaaaactgaaagaaccctgaactcatggaagcttactttgatgaaagagtacatttcatttttttcccatgtgaatgttctgttttcaaagcaccatttactgaaaagattatttttttttctttaggactctgcagtgccgttactgttatatatgaagtgtccatttatatgtgagtcattgcctatcttggttatgctccattgatttatttgtcaatttctgtgacaatatcatattgtctttatcattttactttataatcattgttaatatttagtacatcaagaactcccacctcattttttaaaagaatgttttggatagtcttggcctttaaattttccataaagtttaaaatcagtctgtcaaattctgtcaaaaaaaaaaaaaccctcctgggaatatttattgggattgaactgaatcattaaatcattttagagtgaactgatatttttatactattgagccttccaatcacgatttacttcagttttccttagtgtctttcaatagacataaaagtcttatatatcttttggtacacttatttgtagatacttgatttttttaggctaaaaaggcatctttaaaaaatcatttgctaacaattatggctggtgtttggaaatgtaactacttttgtcatattgattattcatctagggattttgctaaatgctcttataattcaaataaatctctttttcctacatatacaatttatcatttgtagataattataccattaatttgtttttcttatccttcatgtactagttagaagctctagtacaacacagaatagaaatggtgatattaggcaccctttaattgttcctgactttacaggaaaagcttttgacataaaacattacttttctttggttttctacagatactttttattagattaagaactttcattctatttcttttttcttaagtgtttaaaaatcttgaatggatattaagttttatcaaatgctttagaaattttgcatctatgtagaaatactgtaactttttttctgcttgaatctcttaatgtggtgaagaactggtaccaattctactgaaactattcaaaaaatttgaggaggaaggactcctctccaactcattctataaagccagcatcaccctgataccaaaatctggcaaagacataatgataaaagaaagctacaggccaatatctctgatgaatgtatgtgcaaaaatcctcaacaaaatactagcaaactgaatccgaagcacattaaaaagttaattcatcatgatcaagttggtttcattcctgggatgcaaggttggttcaacatacacaaatcaataaatgtgattcaccacataaacagaattaaaaacaaaaaccatatgatcatctcaatagacacagaaaaagctttttataaaattcaacatcccatcatgataaaagccctctaaaaaatagtcaccaaaggaacatacctcaaaataagagccatctatgataaaccagctaacatcatactgaaggggcaaaaattggaagcattcccctggagaattggaacaagacaagaatgcccactctcaccactcctattcaacatggtaatgaaagtccttgacacagcaatcaggtgaaagaaagaaataaaagacatccaaataggaaaagaagaagatagtttgacttcttctttgctgatgataggaatctatacatagaaaaccctaaaaactgccaaaagtctcctagaactgataaacaacttcagcaaaatttccagatacaaaatcaatatacaaaaatcagtaacatttctatacaccaataacattcaagctgagagccaaaccaagaatgcaatcccatttacaatagctgcaaaaaacaaacaaacaaaaacctaggaatacaagtaatgatggaggtgaaagatctctccacgaactacaaaatactgctgaaaaaaaccatacgtggtacaaacaaatggaaaaacagtccatgctcatggattagaagaatcaatattgttaaaatggctaaaagcaatctacagattgaatgctattcttatcaagctaccaacattattttccacagaagtagaaaaaactattctaaaattcatatggaaccaaaaaagagtacagatagccaaagcaatcctaagcaaaaagaacaaagctggaggcatcacattagcaacttcaaactatactacaaggctacagtatcaaaacaacatggtactgggacaaaaacagatgcacagaccaatggaacagaatagagaacccagaagtaaagccacacatctacaaccacctgatctttaacaaagtcatcaaaaataaacaatggggaaaggactctctattcaataaatggtgctgggataactggctagccatatgcagaagactgaaactggacccctacctttcaccaaatacaaaagttaactcaagatgaattaaatatttaaatgtaagacctcaaactataagaatcatagaagaaaacctaagaaacctattctggacatcagccttgggaaataattcataactgagtcctcaaaagcaattgcaacggaaacaaattgaccagtggtacctaattaaagtaacaagcttccaattaaagctaccaattaaagtaactatcaacagagtaaacagcctacagaataggagaaaatgtttgcaaactatgcatctgacaaaagtctgatatctagagctataaggaacctaaacaaatcagcaagcaaaaaaccaataaccccatttaaaaaatgagcaaaagacatgaacagacacttcccaaaagaagacctgcaagtgggcaacaaatacatgaaaaaatgctccacatcgctaattgtcagagaaatgcaaatcaaaaccataatgagataccatctcatatcagttagaatggctattattattattattttatttttattatattttagatggaatctcgctctgttgccaggctggagtgcagtggcacaacctcagctcactgcaacctctgcctcctgggttcaagtgattctcctgcctcagccaccatgcccacctaatttttgtatttttagtagagatggggtttcaccatgttggccaggatgtctccatctcttgacctcgtgatccacacgcctcagcctctcgaagtgctgggattacagttgtgagccactgcgccgggctggctattattaaaaaataaaaataaatagatgctggtaagcctgcagagaaaagggaaacttatacacttttggtgggaatgtaaattagttcagctactgtggaaagctgttttttgagttgtgtgagttctttacatattctacatacctaactcatcaggtaaattatttgcaaaagttttctcccattttatgggttgtctttccactttgttgttagtattctttgatacactaaagttttgtattttgatgaattctaatttatttttttcttttgattgtgcttttggtgtcatatctaagaaaccattcccagctgtgcatggtagtgtgcgcctgttgtcccagttacttgggaggctgaggcgggaggatcccttgagcccaggagtttgaggttttaatactgtactgtagtgaaacagtgtattatagtgaaacagcatagtgaaactttgtctctaaaaaaaaaaaattctttttaaagaaataaatctttgctaaatccaagataatcatttattcctatattttcttctaagagtttcatagttttagctcttatgtttagattttttatccattgtgagttaacttttgtaaatggtctgaggtaagggcctagcgttattttgtgggacagttttcttcttgtgtcatttgtaattttatatttttctaaaataatttctatttcatccatatattcaaatttattaaagttgcttataatatgctttgttagcttttaaatatctgtattattggtaagagtagctccccctttttatatgatactgttacttgtgctttctttttttcttgtctaattttgccagtggtttgtcaattttattagtctttttaaatagaaaccactactagcaaagaaatagaacattgtcagtctttcttcttttctgagcactgatgatgctctagaccttggcctagatagttgggttttatttgtttgtttgagacagggtttcactttatcgcccaggctagagtgcagtgagtgcacaatattacctcactgtagtcttgacctcctgggctcaagtgattctcccacctcagcctcctgagtagctgggactacagatgtgcaccaccactctcagctaatttttacatttttttgtagaaacaaggtcccactatgttacccaggctggtctcaaacttctggactcaaatgatcctcctgcctcagcctcccaaagtgctggaattacaggtgtgagccactattcccagccataactcgtttttgctacatattactcaactacatattactcaactaatgtttttgctaaacattactcattcattcaatacatattttgagcacctactatgtattgaggatacatcagtgaacagacaggaaattctgttctcatgaagcttacattctggtcggggagatagataataaataaaataagtaaattacataatattttagtaccttagaagggattaagggctgtgaagaaaaataactggagaaatggataaggagggaacagactactggaatttttaaaaaaatggtagacatgtaagacctcattgagggtacatattttttaaaaattagtttgaaataattatgtgtttatgggaagttacaaagatgattcagagagttctattagccttcactagttacccctaatagttgcattcttgtgtaactatagtacagtataaaaaccaagaaagtagcattagtataatgtgtgcttatagtagtatgccattttatcacacatatagattcttgtaccaataccacagtcaagatactgaactaggctggtagcagtggctcacacttgtaatcccagcactttgggaggctgagacgggtgggatcacttgaggccaggagttcaagaccagcctggccaacatggtaaaaccccgtctctactaaaaatacaaaaattagccaggtgtggtggtgtgcgcctgtagttgcagctagttgggaggctgaggcatgagaattgcttgaacccgggaggcggaggttgtagtgagccaagatcgtgccactgcactccagcctgggtgacggagccacactctgttaaaaaaaaaaagatgcagaactattctgtcctcacaaagatattccttatgctatgttataacacaaagatgtctttatagttcaccttactcccctcacttctaccatcactaacccctggcaaccattcatctgttctccacctctctaattttgtcatttcaaaagcattatatagatggaatcatacagtatataaccttttgaaacgatatttttttcactcagcacaatgcctttttggtctatctgagttcctttctttgtgtattccatgatgttagtataccacagtttgtttaaccattcacccattgaaggacattttggttgttttcagtttctggctattacaaataaagctgccatgagcattggtgtgcagggttttatgtagatataagatttctttaggataaatactaaaagtgcaattcttgggttgcatggttgtatatatttagttttttaagaaactgccaaaatacttttcagagtggttataccattttatcagtaatggtgggatgagaaacgttgtttctctgcatcttgccagaacatggtattgttataattttttattaatattttagctcttctaatagcacctggctaatctgaatttatatcagaaatgaaagcttaattttgattaataaaaccaatcgatataattcactttattaagaaatactggaaaaagttatttgatcatctccgtggacacacagtttgatgaaatttaccaaatattcatgataaaaattcttagcatactagaataaaagaaaatttcctgccaactaggtcaggacaaaaatgaaaaaaaaaaaaaaaaagaaaaaagaaaatttccttggtacaatgaaaggtatgtacaatgtaatacctagagcaaccacttaaaaaaatctatatgaagagatacactcgaaaacactatcaataaatcaaaatggaattctgaaaaatgttcaagtaatccacagaaaggcaagaaaagagaaacagaggaaacaaaaaaacaaagggaacaaacagaaaagaaaaaataaaatgtcagacctacgccctaacatatcagtattaataatcagtgagctctggactctcttctttatcccctttgccgctcaaggttttcaaaagcaccactcattctcttaaaggacttttattaaataggcagatgaccccaggggaaaggtcatctcaaatgccgggctaaccctcctgagcctctgtctttctggctcagtaattaccctcctggctaagtaattccaaagagttatggtagatttctgatgtcacaaagaaaatttttaaaaaatacttttttcagctttgttttagggcctcagccttagattgtatttcctagtgcagttttttaaaaaaaaaatcggtgacctctctcatctaatgctttctctgttcttgtagatgctttactttttccctgtcattttgatgagatttggggcaagaccatggaaaaggatgtaaagatggcacaggctcattattccctgagcttctatcctctaagatcctaggctgggaattctacgtaatcttgttagctctgtgatgtcctcaattggtaaaagagttggatcttatttcctagactagagattgacaaattatggcctgtggtctgcctatttttgcatgacccatgagctaataattttttgctttacatttcttaaacttgtttttgaatagttttagatttacaaaaatttgtgaaaatagtagagttcccatatgacccacaccctatttcccctattattaacatcttacattagtatagtacatttgtcacaattaatgagccaatattgatgcatattattgactcaagtctacacttttgatttccttagtttttatctaatgtcctttttctgttccaggctcccaaccaagattcctcactatgtttactaatcaaatctcttgagactcctcttggctttgacaatttctcaaactttccttgtttatgatgactttgacagtttgaggagtgttaataactgcaaagtttcgagggcctacagaatgtctctcagttgggatttgtctgatgtgtttatcaagaacacactaaagttatgggtttttgggtggaagaccacaaagataaattgcctataatagactcatgagactgtcataacaaagtaccacaaattatgtgactttcaaatagcagaaatttattctttctcacagttctggaggccagaagtctaaaagtgttaaccgggttggtttcttctgacagctgtgaggaagaatctattccacacctctctccttagcttctggcgatgactgtcaatttttggtgttccttggcttataaatacatcattctgatttctgcctctgtcttcacctagctatcctctctgtgtgtctgtcaaaatttccctcttcttataaaacacataagtcatattggattaaggcccaccttgatgacctcaccttaactaattgtaactgcaaagactatttgcaaataaggttccattcataaggtttggggtagacaaaacttgagaacagagactcattttcttctaaaatgctttctctgaaagatttttaaaaagaaaagggtggaaatttgaaagaaaaataagtctcaggaccccaaaatcagtaagccaaagggaaaagtcaagctgggaactgtgttaggcaaacttgcctcccattttattcccaaataagatagccacaaagatttaaaaaaaaaaaaaaaagctacacacctccctcacaatttatccacaaggaaatttcttgtgggcctcaagatctttaccctaaaacagttctgttgaatttcaccctggcaaagtaaattggtagcttatcttcacaggtgcaggtcaaagacagaactcaaaagtgatccctctgctcacctgagacaaacgcacacctgattgcttgctctgccctgttgtttatgtaaaaatgtagattcgctaagccagactaaggcataagagattattcctctaccctcctctcacatgtaaattgtgtattcagtgaaaggctaatcaggctcaaaagaattagccttttctctcttatctacctatgacctgaaagtcgtcctccttcctacctgtttgagttgtcatgccttttcagaccgaaccaatgtacatcttgcacgtattgattaatgtctcatgtctccctaaaatgtataaaactaagctgtgccccaactaccttggacacatgtcgacaggacctcctgaggcggtgtcgcaggtgcatccttaatcttgggaaaataaactttctaaattgggggaaaaaaagaacttcagcacatcttttttgggggacacaatttaactcataacagtgccattctcatcacatcgtatgaaggacacgagttatcaacatggcttatcactgttgatgttaaccttaataacttggctatggtagtttttgtcaagtttctccacggtaaagttactctcttcctccctgcttctaaattattctctttggacagaagtcattatgttcagcccacacttactaagccagaaggatgggaaattattctctacctccttgagggcagagtattcacatcaattatttggaattcttttgcaatcattcatttattcatatctgtgtggactcatggatgtttgttttatattttgggttagaattcagttctacattatttattttgttgctcaaattgttccattggaagctcttttagttggcttctttttgcctttgacatactcttttcattgtgttctttttgggcacttccttgcttctgggactagaatatactccaggatcatcttgggatcatcggcatgggtagggaaaatgtacagaaatggtatgagaatgtgtcccctttttgtacatattccatacccatcctctggaatcagccatttcttcaaggagctctgattccttttattggagaatggtattaaaaaccaaaattttggttctaggtctatttgttgctactggagtgtcattgtttctaagccccactcagctgacagaacaaggaaatatatgtttctactaacctgtgtatacacacatatgtttataaacatttctacatgtattcatttgtatcgatattaagctaaacatgagttcatattgatgtctccaactctcatgcattaccacatggatcattccggccccctcctctggtttgtctgtaatctcacattccaacagtaagaaacatggcccccaccatccaccatccatttacttaactgttcaattccagtatgtccatgtatggtggtttcagaattattaacctgtacccccatggaaacaacaatttgaccaactagagtccagcacttatgtacagttcctttttagtcttacagtctccactcatttccaaagttaggtcaggatgttttcctcacaaactcttcagtgagatcatttcatgcatttgtaatacatttagattattttttgtcacactctatattctgtcctgtgatctccttaccccctatatgatttttcaaaaatttgcatacattaagatgtggttggtgctgtaaagttctatgggctttgacataagcatagtgacatgtatcaaccattacagaatcatacagaatagtttcactatcctgaaaaatcccatgggcttcacttatttagccctcccttccccaaggtcctggcaatcactgatctgtttaccatctctatagttttgccttttccaaaatgtcatgtaaattgaatcatacataatctgtgatagtcaattttatgtataaacttgaatgagttaagggatgcccaggtagctgctaaaacattatttctgtctatgaaggtgtttgtggaagagattagcatttgggtcagtgagactgagtaaagaagatctgctctcaccaatgtgagtgggcatcatccaatttattgagtgtctgagtagatccaaagggtagggagagggtgaatttgctccctctttcagctgggccatccatcttctcctgccctcagacgttggccctccaggtgctcaggacttagtgtttgaactgaattacaccaccagctttcttggttctccagcttgcagatggcagagtgtgggacttctcagactcaacagtgtgagccaattcctataataaattttctctttctttctgtgttatcactacacacacacacacacacacacacgctacagtcattctcagtatccatgagggatttgtttggggacccctgtagataccaacatctgtggatattcaagttccttatataaaatggcatagtatttgcatgtaacctacacacaacctgctgtatactttaaatcatctctaggttacttataatacctaacacaactacataaatagttgttaggttgtatgctttaggaaataatgaccggaagaaaaagtctacttattcaggataatttttttttctgagtattcttgacccttggcaggttgaatctgcagatttggaacctggggatatggaaggctgactgtatatatgtgtctccatcctattgactctgtttcattggggcaccctgactaatacagtgcatagttcctcacctacttttgaagctgtggttgcaatggcaatataggtttcagagcctatacagagctattcgagtcttctttgttcactttgttcactgaagctcccacttgattctgctgatgcttcctgcaggggtgagtgcactttctcaggcctggttccactaggtgaagtgtgggagatgccaggccatgggtcagtgagtgcttccctgaacctgacctctgggctggctagtgccagtggggctcttgtttgatccctgctggtgttacctgagggcgtggaaggtgctttcctgccctccttagtgccagcttatgggtggaggatgctggggctatggatagacaataattctcagggcctgctcatcaggtcacttggtgctgatgagcttccttactgcatctctgctactgctgctgaggtgggaaacatctacctgggtgccttctgccaccgatgttggagggagagtgtcaggaaacagtgggcttgggttactctgggtcaggaatcagcatggcttggctagatcttctgcttctgtgtttctcacgaagctgtaatcaagatgttggctgccagtaaggtctcatctgaatattcaacgggagaaagatctactttcaagtgccctgatgtggttgtcagatgtattcaattccttaagggttcttggactaagagcctcagttcctttctggctgttggctagaggctgctctcagttacttgctgaaggagtccaacatggcaacttgctgcacccaaagcagcaagcaagcaagtccagtagcaagacagaagtcacaatcttatgtaacctaaccatgaaaatgacatctcattacctctgtcatattcttttggttgaaagcaagtcactacattcagctcacactcaaggttagggcgtgggggaagtagattacataaggacatgaataccagaagtggatcattaaggaccatagtagagtctgtctgccacagtcatcatcaatattccttacaattttagggttttaatggccaataattcttatcattgtagaatacttagtaaacctcagttttttcaattttttctctcattaaaggggattaaaatataactgtgactttagaacctccagttcttataacatttctttctttccctttctttttctttctttctttctctctctctccctttctttctttctttctttctttctttctttctttctttctttctttctttctttctttctttctttctctccccctccctccctcctctgtctctccctctatctatctatctatctatctatctatctatctatctctctctctctctctctctctctctctctctctctctttctcccctttctctcctttctctctctgtcacccaggctggaatgcattggcataatctcggctcactgcaacctccatctcccaggttcaagttattctcctgcctcagcctcctgaagtagctgggactacaggcgcacaccaccacactgggctaatttttgtatttttagtagagaagggatttcaccatgttggtcaggttggtctcgaactcctgatctcaagtgatctgcccaccttagcctcccaaagtgctgcgattacaggcacgagctttttttctttttttgagacagggtctccctctgtcacccaggctggagtgcaatagcatgatcacagcacactgcagcctcaatctcctgggcttaagcaatccttccacttcagcctcctgaatagcaaggactacaggtgcatgccaccacacctagctactttttttgtttgttttttgtagagatggggatctcactatgttgccccagcttgtctccaactcctgggctcaagtgatcctcccatctcagcctcccaaagtgctgggattacaggcacgagccaccatgcctaaccttcttataactatgctatgatgcctcactaaatttatgaaaacataattagtatgattacatattcttatagaggcaagttcttcctttcctgagccatcatagcattttagttatgtcttccttgtgattttgagcacttttaaacttgcaaaaggaatatttgtgaatagtcttctctcccttgctagactgtagggtctttgaggataaattattattattacttgagacagggtctcactctgtcactcaggctggagtgcagtggcttgaataaggcttactgcagccttgacctcctgggctcaagcagttatcttacctcagcctcctgagtagctgggaccacaagtgcatgccaccatgaccagctaattgttgtatattttgtagagatggggtatcaccatgttgcccaggctggtctccaactcctgggctcaggtgatctgcccacctcagcctcccaaagtactaggattgcaggcgtgagccatcacactcggtctgacaaattatggtttttaacattttttacacctgactgcacccaaaagagtacatttactatggagttcagtaaatatctattttaaaaaaaaagtcccatagcatttttaaaaatatgaactcaacatctctttgtatcaataaaagtgagatatagatttgatttatgtatctctagttcacctaagttcactcagatagtagacagactgaatactaattgaggagattaatcacaagcagttcatatccaaacactgaaaaatgtagtaaatatctgatgaatgagttgatgaatattcatttttctccatatatatatatatatatatatccctttgacatagtctctgtgcatgtttttgtgcatgaatgtatgtgtatgtgtttgtgtatatatagacacatgtatatatacacacatacgtatatatacatatatgtttatatatgtatatatgtgttttatatatacatgtgtatgtgtatacatatatatgcacacgtatatactcatatgtatatacacacacatatatatgtttctgagctagagtctgggtatgtttcttcataagaaaattttatgcctccaaagtatttccacattatttataataatatataataacatcacattgtgtaagtaataacattagtttatcatccatttattctttatccagcataggtagaattagatgattcaaaattgcaaagagaaacataatttattttggaagattgtacatttttgtaagtttctaaaaagctaaaaactttcatgaattttgtacttgagaaattactgtgattcctttgttaattcataaacctaatggtataaccatcacctttctgactgccatgctatcttaacatttttaatttggggaggggttctaaactttgtatcccaattatattctggtgataacagcttagtaggtttattgacaaaaaaatatttgtttaggtagctttcatataggctgttaagtttatttgtggtgtcctgaacagttcctttctgctattctttttttttaaattttattattattatactttaagttttagggtacatgtgcacaatgtgcaggttagttacatatgtatacatgtgccatgctggtgtgctgcatccattaactcgtcatttagcattaggtatatctcctaatgctatccctccccactccccccaccccacaacagtccccagagtgtgatgttccccttcctgtgttcatgtgttctcattgttcaattcccacctatgagtaagaacatgcggtgtttggttttttgtccttgcgatagtttactgagaatgatgatttccaatttcatccatgtccctacaaaggacatgaactcatcatttcttatggctgcatagtattccttggtgtatatgtgccacattttcttaatctggtctgtcattgttagacatttgggttggttccaagtctttgctattgtgaatagtgccgcaataaacatacgagtgcatgtgtctttatagcagcatgatttatagtactttgggtatatacccagtaatgggatggctgggtcaaatggtatttctagttctagatccctgaggaatcgccacactggcttccacaatggttgaaccagtttacagtcccaccaacagtgtaaaagtgttcctatttctccacatcttcccagcacccgttgtttcctgacttttttaatgattgccattctaaccggtgtgagatggtatctcattgtggttttgatttgcatttctctgatggccagtgatggtgagcattttttcatgtgttttttggctgcataaatgtcttcttttgtgaagtgtctgttcatgtcctttgcccactttttgatggggttgtttgtttttttcttgtaaatttgtttgagttcattgtagattctggatattagccgtttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttctgctaggctttttatggttttaggtctaacgtttaagtctttaatccatcttgaattaatttttgtataaggtgtaaggaatggatccagtttcagctttctacatatggctagccagttttcccagcaccatttattaaatagggaatcctttccccattgcttgtttttctcaggtttgtcaaagatgtcagatagttgtaaatatgcggcgttatttctgagggctctgttctgttccattgatctatatctctgttttggtaccagtaccatgctgttttggttactgtagccttgtagtatagtttgaagtcgggtagtgtgatgcctccagctttgttcttttggcttaggattgacttggtgatgcgggctcttttttggttccata

SEQ ID NO: 804 - DNA, 7664 bp, Homo Sapiens
gaaagagcgtagattcaaatataaacttacctaatgatacgctcaaactgttccttccattttgggaccagggaacagagctcacttaatgctgctctcccactgatgatgcccacccattctcggcctgcaagccctaccactcacagcttcaaaaatggctccgcccttcctgattccaccccacacagaagaaagcaacttcttgtgatgcttccttattctggatgtggctcacctcttaccccttccaactcctttgggtcccctagaaagcctccctggctaaggggtacaggccctctcctcagcagtgggcactgaccgtctaaccagggctctgtctcggcacctggtagcaaggacggcaagatacaacaacatgctgattttaatagcctctggctttctccactgcgtttctcacctgaatgccctgcacaccaaatcttccatggggtcacccttgacctctagggcaattcccaagaatctagcagaggagtgggggaaaccaaaaggctgacatgaaggactcaagggaagcctctggaaagaagagaccagacactaaaagggatgtgtgtgaaatactggtttttattggttggcacaagattacaacctacaatttcaatgcccttccctcccacacagctcaaatggaaggaaactgattaacacatagaaaggaacggcaggctcacaggtttaagcatttgtttttacaaaaaggagtgggatatgggggtggtcaagttttacgggtaataacaacattctctctagatggcagggggtaagtctgcctgtcctccattgctggtaccacataagggatacattagtaaagtagggaaagggttatatgtgtggctggcctgttctttagagaggaaggtgggatggtatctgctgtgtacctgtctcagaccaaacctggggctggaccagtgcccctttcttctcagccctcctccacagcctgactgtactgccagccgcacccatgagaaggaggtgtgaaggaagcctgaggacatccacctcgagaaaaggaaacaggaaaactatttccttccgccttctctggaccaaatttcactcccctcagctccagagagtgctgcaaaaatcttccttagggacgctgtgaagacacggggaagaggccagccctgagcgggcaagaagaaaagcttgaactttccatgcagtaccaagcaaggctattttggaaacaagcaaacaaacaaaaaatggaaaccaacaccatataaccacaggttgggtagctcctaaatcctggacagcatttggattgggggtaagggcaattttactccagctccttgttttataacccgcacaaggtgccaagaggtttaaggaccacaactgacctctctttccctacaagcaccattccttggattcccagttttgttgagctcatttgaggtcatccttgccatcctcttaaaaaatgacacagcctcttggttattccattttctatccctttctacaattatgaacacactctctaaacaggagatctatatatgctctcatcctgcaacccaagagattaggtgacctaatgatgagaaggctaacttatttgctttcctgggtggtcctgatggaaatgaacagcagcagagttctggtgggatagagcagtctagtctgagccactgtgtgattccccaggggactggtccctgggtacatgggtccctggctctctgtctcagttccacagatattactcaacttggccatttacgcctcagctaaaacatatgagcatgagggaaaagggacaagaaatacttttgtcctctagaaaaacttaactcaatacatcttggctactttgcctcaacccacggggttccctggaaacatttgttgaacttggccaagaggagattgtatatggatggcacacctggaaaaggggagaaagcacactagttcatctcttttataagtagaatggtcccagggatgttaacctttctgatgctgatagtagatgagtggagtggaggtaatcgtgagaaaacttaaaaacccttaagctgtttggagactacacaccacagtggagcaaaccaaggtggggcctcactgcctcctcagagcccatccctgaccatgtcattggataggatggaagacaaagtctttgaaatggaggctgggctggcaaaagtaagtatgaagatgctactactggccttccacttcctctctctgatacacctaagaaggtgagagacactagcttcaattccattttacaacagttctcaacaacctgaaatattcttgacttccttaagcacatggaaaactggtaagctatatctttctaactgaaattttacttattctaaccaccaaccttttctttgattatcaaccagtttgacagtcttcagatcacaaaacaatagaacagacctgacatttacaaaactgtactacatacttatttcttttacagtagagctgaccaattacttttctaactactaatgcaacaccatgccactgggccctggactctgatgtttctgatccctgagcaacacatctatgtccattcacagatggaaatgaaagagtgagattctcagaggctaaacaacattctgggagcaaattggatttttgaagggagagtcctcttagaaaattctgagcaaacatgctcccagtcacgagggatggggtgagcgggcaggtttctgtctgtgagctatagctcccttctgaactccctcatgttcttgggaggacacaagcctcttgctcattaagcaaaggccctccaagtctcctttttacttcagcactttggaaactctccaagacttaacttccgatctggggaggttctacgtggagcagacctatcccttcttattcctgttcctgggtgtctccataatcagcctctaccttccctggcataagtcatatctgttatgctgcaggaactgagtaaccaaagctagatatcccttggaccactgattagtgacacattttctccacaacaaagggaggttaaagacaaaggtttaacctgagaaactttttttttggcaagataataaagaggttaaagaggctacgtggatctgtcactgctttagcttaccattttcaattcagcaccaaagtgctcagaaagacaggctcagatcaggacgacttcttaaagggattcacaggcaatattactggcaaaatgattttccaaagctgagccacgcgccccaccctacagggaggggagtagaatcttatggcccagcattggcattgaggcatcttgctttttttcctcagaattccacaaaggcttaagagtgatctaaatgcctggctggaagctcaagtctaggagagctattttactgcactgttgagatgttctctgcaaggtagtcacagataataagcaatttagtagataattattctatacaagaattaatgttctctgaaacagtgattaatagaatcttcacatctggcctggctgggaggcttgggggcaggaaagggagggtggaaggatgggtagcacatcaaaatggtgatgaacctggcaaaacgacaatgctgctgtttttgtatcctttaaagcctatatccagggttttaaatgacgctttttttgtgtgcttcctgataggaagtcaaataagttttagtattaagaactggggatataaaccaaaggaaacctagagtcaactgactgctggaggaacagaagcaatgacttctttccaccttctagatagtaatcttacttttgttggctaaaagcactttcttcagcattctgagttaacacgggttccctataagctcccctccccaggtggacagtcttattttctaagacaagctcaaagctcaaactcaccaaattaccactataaacaaagcttcagggaagagacataaccttacttcaaaagcttcaggtcagagacagccaaaatcatgtgactgctagcctcagctcaagtagtgtgcccaaatcatcacaaaatgggattcccttcccttttcttttttttttttttttttttgagacggagtcttgctctgtcgcctaggctgcagtgcagtggcgggatctcggctcactgcaacatccacctcctgggttcaagcgattctcctgcctcagcctcccgagtagctgggactacaggagcgtgccactacacctggctaatttttgtatttttagtagagatggggtttcaccatattggtcaggctggtcttgaactcctgaccttgtgatccacccgcctcggcctcccaaagtgctgggattacaggcgtgagccaccatgaccagccctccatttattaatttataaggggactagaaggacaaactatttgattaatttgaaggtgagaggtatcattttctcagatgctccaactaggcttctcacatccctcaaaggttatcagctaaagacaagagtttctgaggctaatgcaaaaacatggtcaaatgtgaaaccgcccttttagaggcagggtttgtgaaaggctgctggcctccaaaggagagtatgcctaaactctctgggctcccaggacctgtggtgacctcaagctaacctgatgcacagacaacagtatcttttagggactgcagccaatgttccccaatttactttttttttataccttaaaatatcaaatgtttcatttttaggtgatatcccaagtgacacagaaacacagctcctccggatggtgaagtctccgctgcaaaactcacgaaacagcacagaggatgactctagggtgctctcccacttgctccaagttaggcaggtgccctgatggaggcaaggctgagccattaacatgcacagctccatatcctggaagcctctgtagccttgaggagataggctctatccaacaggactcagaataaatgactgccacctcaactgagcagtatgaactgcccacctcaactgggcagtctgacctcttccacagtctttaagaaacagaagagccatttgcattatttaatcaccattcaataatctcctccctccccatagctgcttgagttaactgtcccacaagtgtcctgtgttttgtaaagatgagggttattttctgaaatgcagatgggactaggatgaagctgtattatcaattacagagacagccaactctcatttctcttaaagcaaaaattcattccactgtgatttctccaggtatttcctgcaattctaaatccgcccttgatattagagaatattaaaatcacacagttgtggcaaaaatcacattgtggctattaaatcctttttgtgaactaaaaaaagtgaatgtggcttaggctaagctgtttttttttttttttttttaaagatgaggatgcggactccaacaaaggcattaagaaagtactagatgaaaatgagaaatatgtgaaggataacatgtgaaatgtacactcaggtctaacaaatacctattatttctctggttaagaaggtttagcaggagcctccaatgagcactgtatgtagagaaaagggaaggagcaggaggaggaacagatctgcacagaatttttttcttaaaaaccacaaagggtgacttttttcttctaagcaagcaagcctgagaggcattacatgggctggctcctaatatcaaaacaaaatatttctttgccacaaaggaacttgactatgtagcaacacatttacaaaactactgcaaaacactcccagagggcagtgacctactctgctccccagaggctccaagaagcaaggcctcaagtgcctcatgttccatggggctgtgcagtgcaatgcagaaggcggaaatcctgctgtgacgccaccctcgagaccttctgcagcctgagagggggtgatactcccacaccctttgatccttccagatggctcagcctagatctagcagtgagagagccctctccatgcagggcagatggagtggtggacacttgtgaaaacaaaacactaactgttccatcctgttatatttgctgtgaggaaaattaagattcctgttgtatgggctgcactgtttctggaagactacagaaaatctaacatggttgacacttcctggtagcccttctgtacatacacacacacacacccagagagaagacagagagaaaatcctggtccaaaagatcacatgaccttactagtgtttccccaatgactgtaatttataaactaaaaatttttacaaatccactgctatcttcttctgtcctgagtttggtagactttaatggatgctccagcaataaccagaatctaggacatgcagactcactgtgagcgagaggctagggatctgccctaaacataggaacctgtttctatcaagcctgaatgaggtcagctctggtagaattaatgacaaatcaatgtcagtgaaatattctgcaaacagggtagcttttgtgctttcttttgattattttctttggggagataaaggtattgcaaccatgggtctaactaatctatcactaaaggactgtgacgacattctcaataaagacagtcatggtgtttactgtgccaaggagggaaaatcccagatcatcagaatcccagtgcaacagaaaacagcaccagtttcaacaattctgatgttggacaaagcctctttttgtcagttaagaaagcgtaagcacaatctctcagtcaattgcattaacaggaatccattcatgtcactgaaaaatacttcttggcacagttcactttcctgacccaaagacaccaacaacaatcaaaactgcactttcagggtagtatattgttacactagcccagtcaaaacatactcagaacatttaaaaatgtataaattactgttagcactgcagttccgttttattttcttatttatttattaagacagagtcttactctgttgcccaggctggagtgcagtggcatgatcttggcttactgcaacctctgcctcccaggtttaagcaattctcatgcttcagcctaccaagtagctgggattacaggagtgcaccatcatgcccagctaatttttgtattttagtagagatggggttttgccatgttggtcaggctggtctcaaactcctggcctcaagtgacccacctgccttggcctcccaaagtgctgggattacaggtgtgagccactacacccagccctgcagtccctttttaaagagtactgactgttttcctgcaaagtactttcaaatccataccataaaggtagaatttatctggaagaatgtgttttttgaattccacctggcacttggttaaatctactttattttgccctttatttatttgaacagaactttagaatgctctaggtcaggaaaagaaacagtgtgttcgtttttaagaaggatgtgtgaatagtaagttggcattcagactcaagtcccatggtattgttcttatccaatgggacctctccttgggaatataattcctttcccagaggtatcatggtatcccaagaatataactgctctttggctctgtgtgtgaagattgggggagaggatgtaaactaag

SEQ ID NO: 805 - DNA, 3444 bp, Homo Sapiens
gtggcagtgcctttgagggagctcttgcagagggcagccttttgaggtgaagagccagagctctgggtcttaagagttggaaagcaggttatatttcacatccttccctgaatagagaaattgaatttggtcaagaataagtcctaagaagcagttgtgagcaccccacctgtccatcttgttgatgaatatggagtgggagaaaagttgagtgtgggcatctgacaaggtctttatgatcctagatgcacttactataccttcttcctcctcctctgccttggctaatgggttgtgggtacccaccgcacagagggctataagacagtccttgtggctgatgcagaagctgggccctgccctcctggccttctgaggaaagtgattatcgtttttggcttgtttttcaactatccctttgcccccagcaggactgaacctttccactcttaccatctctgggtcccttcagatcttttatagccttgaactacctgctacaagatttttttctgtcctaagaatggaggtccggtctgcttcctaacattaatcccttccacacggcacagccttgttttctctagatcagagagatggcttctggattcatctttccctgcaatccagcttctcctcctggggccctcatactggagactgggatcatcatccaggcttttgcactgggccaggaatttgggagtcatcctggatccgtctgcccctgtcaacctttcgctgtcaacggatatttattgggcgtcctcaacagccaggccctgttcatggtactgaagaacagcttgtataaaacaaccctgccctcacagggcgatcaccagtgacctgtggtgtggagtctccttttacctatgtctcctccttcccactgtcaccatccttggtcctcctctgtcacctggaatactccacttggtaaccagcatgatcttataacgctagttttacccttgtcagcactttgccaaaaacctcaaataaagactttttttaaaatgtgcaatggaaaaataaagttataaattatatcataaccagtggacctctttttaaaatgcactgaagccttataatgttattcatggatatatatctatggtaaaaatagaaaaaatatatgatggtggtgcctctgaaagggaggggaatggtactggggaagggacaaagggaacttcaactttatctgtaatgacctgtttattttgaaactcaagagcaaaattgacaaaattttaacagtaacttaacaaaacctcaagtctggatagtgggttcaagagtgttactttatatggacaggcagtgactcatgcctataatcccagcactttcagaagccaaggcaggaggatctcttgagcccagccatcctcccgccttggtctcttgaagtttgagactagcctgggcagcatagtgagaccctgtctctacaaaaaaaaaaattaacagcaactcaggaggctgaggcagaaggattgcttgagtacgggaggtcaaggctgcagtgagctatgactgagccacttcactccaacctggatgataaagcaagactctgtctcaaaaaaaaaaaaaagtgttgcctgtaatcccagcactttgggaggctgaggcaggtggatcacctgagctcaggagttcgagaccagcctggccaacatggcgaaaccctgtctctaccaaaaatacaaaacattagccagatgtggtgggatcagtctgtagtcccagctactcaggaggctaaggcaggagaatcacttgaacccaggaagtgcaggttgcagtgagccaagatctcaccactgcactctagcctgggtgacagagtgagactccgtctcaaaaaaaaaaaaaaaaaaaaaaaaaaggagtgttacattagttgtctgtattgtagatacacttgtcaaaatttaagccataaaaccctcagtgtccctcactcttcccacccccttagcctggcctggcatactgggtctttcacaagcttgtgtcaacctcctctacagactcatctctacactgagggacttgcagtttccaagtgctctggccttggggcctttgcccatgctgttctcttctgaatgccctttcctgctttgctactttgttcttgcccttctggattcagctcctgggaggccctgtggatagaagtcagatggctcaagtaggcagctggttaggacccaggagacagaaacgtgtctggggaggacaacactttcttgtcctggtttctattcagctgcaactagagaaacagatcacctgtttcttgttcaaaactaggatcagtgagaggagggtggaaagagtaagatcctccacagtaccctcccacctcccagcctccccccacatagactagccccaaggcagaaacttcccagcagaaaaaggaaaactgataacctcattccttggtctggctctgttaggattatcatctggtttcccctgctggtgttggaagagctgtgttggtgcaggccagtgctatcctgtgactagagggaagaagctctgcctgggcctgatttggccacaagctcctagtaagatgctgaaaaggaacacaaactctaggcccaggacgccctccccatgccatcccacacctgacttctgcgcaccttgtgagcagatcagatttggtgttgcttcttccacatcatcctcgcatcccctttcacagactcggatatatcccctcatgggaacctatggatctacagcatatctatggatatgccaccccatggcaactgtcctttccccttcatagcatacatcaccctgaattatagctgcctgtttatgtatgtgtcttctgcaccaggtggtactccctgatggggcagggattgggtctgtcttgttcacagttgcatctccagcacctgcaactctgcctggctcagagtaagtgctcagtactttttgtttttgattgaatgatagaatgacgagtgaactctatttcccactagactgtgagcaccatgttgacagggaccatgccctgatcatctctggatccttagggcctatatagtgcttgccacataggaggtgctcagtagacacttatcgatttgagtgaatggacttcagtttctccacttacaatctgagtaagaggaagatattctttgtcctctctccctccttctccaaccacattgggggttgtggttgatgctgtgaggtcattcctgccttattcaacttcatgtccaaatcttctaatggcaaaacacaacatggtggccaagtctcagagtccaggcatccctcccatagcccatagccaagtatgggagaagggtgcttcagggtctctctccattcactttagtctccagcattagccaagatcccactgtctaccctgaattcttc

SEQ ID NO: 806 - DNA, 2635 bp, Homo Sapiens
caccaaaggatgaggatgaagaagtgactctgatgagcttgcagcaagccctagcagggcaagccccagccccaaggatctgcaccccgcacccggtgggcccagcgtgggagaggccgggagcagcagtgggtacctgtgcccaggaaaagcacctcatagcgcccgtcggctgcatccacctggtccacggcaatagtgccagagcaccctgcctgcctgctgggcactcacggagctcatcaaagtgagtctcaatgccatcctcgcccgggacagagcagacgagccgcgccttcaggaatgtgctccacttgttgaccaggcaacagtgaccaccgtcatcgttctggggggtggggcaagaggccgggtcagatcagctcttgaccccaagccctggctggagcagggctgatgaagccagaactggtggaaggggcagcctggtggctctgccaatgcataccaggcaaatgcgcccgatgcgggcgtacaccgcggggctctgcggcgcctctgccgaccgctcacggaagaagaagtaaagcttatcatcattgcgctccgcactgtcaggaatgagctcagcatggatgaacgacgggtctgcaggtggcaggggtcagctgggtgagcccctactctgatggtgcccctgatgttctccaacagaatccccagccaggtgcaagaacacccccaactcctctccagataagaaactacccctgccccaggtagtcataggctaaacatgtccccacttcccccacatgtgcttctttacgacctccttgccgcatcccagacacatggccacggaagggctcctggggctgcgcttaccgttcagccaccgggagttgtactgatccgtgcgcatggctgtctgctttccaagtgtgcggaagatggctgcatcagtgcccataaaatcgatgtacacaccagcatagagctcctcatctgtgggtaggccagtgggtcagttggggggctgctgtttgctagggccagggcacagctcagatgacttccagggcagggccttatctccccgctcaggctccctggggcatgatcctatctccagtggagtgctggtcagtgtttcaccactggctctgggagggttgggattagtaactatcagctctgattagtagcaatagcccatttctgtggtgtgaatactcctgccacaactaatttcaagctaccaacctgaggtcactgaaagcaaaatcaggaagagctgccaacaccactgtacagtatttctaccccacagacacaacaaatgtaaatcacctcaagagcatagctaatagaccagctgcagtggctcatgcctataatcccagcactttgggaggcccaggtgggtggatcatttgagggcaggagctggaagccagcctggccaagatggtgaaaccctacctatactaaaatacagaaattttctgggcatggtggcaggtgcctgtaatcccagctacacgggaggctgaggcaggagaattgcttgaaccagggaggcggaggttgcagtgagcgagatcatgccactgcactccagcctgggcaacagagcaaggctccatcttaaaaaaaaaaaaagaggccgggcatggtggcttatgcctcctgtaatcccagcactttgggaggccaaggctggcagatcatgaggtcaagagatcgagaccatcctggccaatgtggtgaaaccctgtttctactaaaaatacaaaaaaattagctgagcgtggtggtgcacgcatgtagtcccagctactcaggaggctgaggcaggaagatcccttaaacctgggaggcggaagttgtagtgagccgagatcgcaccactgcactccagcctggtgacacagtgagacaaccgtctcaaaaagcaggaacaaaaataaaaaaaaaaaacacaaaaaaacaaaaaaagagcatagctaacaataaagtgtagtgaaagaattaggaagcatatgcacacctcagtttactgggctttgtgcactgcaaatactgcattttttacagaaggaaggtttgtggcaaccctgtgtcaagcaagtctgttagcaccattttttcaacagcatatgcttactttgtgtctctgtgtctgtgtcacagtttggtaattcttctttttttttttttttgagatggagtcttgctctgtcacccaggctagagtgcagtggcaccatctcagctcactacaacctccacctcccaggctcaagcaactctcttgcctcagcctcccaagtagctgggactacaggtgcccaccactacatctggctaatttttgtatttttagtagagacggggtttcaccatgttggccaggctggtctcgaactcctgacctcaggtgatccacctgcctcggcctcccaaagggctgggattacaggcatgagccaccgcgccttgcctacattttggtgattcttgcaatatttcaaactgtctgttatggtgatctgtgatcagtgatctttgatgttactattgcaattatttcggggcaccgtgaacctcacccatataaaacagtgaacttaatcgataaatgctgtgtgtgttctgactgctccactta

SEQ ID NO: 807 - DNA, 6945 bp, Homo Sapiens
agccccagcgctggctgcggcggaacccacggcgtaccttcccgcctccaacaaactatccggttgctgaggttgatttagcaacaccccagggcatctgggttggcaggagcaccacagtgacagcctggcccaggctcgggtacgggaggcagcccagtggcccgcagtagagggccaggctggggaccagggagctggggctgaggagaatttgtacagcctagggaggcgcagcacagcagtatcagcctctggcatttgtaccacctttagtcctgccactttctctcactgtggcttcgcaacagacttgggaaccaagaaaggcataggtgaggaagctgaagcccagtctgggctcgcggaagaaactggtggatccaacttctgcatagcgcaaatatctgcttcctgcctccacccacccattcccacttccgtgagtatattcatccatccaacacttattattactccttgccaggacagttctaggggctggggatagagtgaacaaaaccaaggttctgccctcctggagttcacgttccatgggaatgcccttcttccaggctcctccctcagtgcccaggttgtggctgtgggaggctggtctacctttgtggtttagcggtaacttacgtgattcccacgtcaagtgtaagctccttgatgattggttcaatcttcacctcaaatttctgaggacctacaaactacaaagcactcttctaggggcccaaagataaaacgctcccctcgtgaaaatcccggacttttggtgggaggtggggaaggtgacaactatgctcataagcttggctacaagaccggcgaggccaagagctactttggtatcctgacaaggactgatgtttgggagggggatccagcagatgggaacaccacgaaggtggtggtgggaaaagtcagcagtcacagggtggttcaccttgtggatcccactactgcaccagcaaagagcaggctgggcacacagagacagtcaaaatcccagcttcctttccctctgcttcacattcttccttccgcaggcaggggagtttgaaccttatccacagggccaagcctgtcccagccctctaggcaaactggcagaacaggcagctggcccctcacaggcactccgggctgggccagtgcaggtcgcagcagttgttttacctatgaacatcaagcacatggtcaaaccctcagcttaggtgccccaggcaggcgggctacacacttggtagcatttcctttgacacaaggagcagccatggcccgggctcagagactgacagcctctgcctgcagggtctgcgtggtcatttctcctgcttctcagaaggtggtgagcttttcccaggaaaccattataaggaagtgcccattctttatcttgttctctctgctcacttcccttagcctgattggggaactctagagccccacatcagagttcaacatgtgcctcaggagcttcagcacctcttttgtgggaggagagtccgctggtgactggggctgcaggccatgacatcagcctgcccagcttcacctcaggctgcttccaacagtgccaagtgaggtcccttggcaggatccctgcaaggcagcggctggccaccaggaggcagcagcctactctacaaggcactttcttcattccaaccccttgtaacaggtctgaggaaacctgttcgcccagccatgtgctgcaaccatcctccactcccaatcttatctcccaatagcacagattcccctatcatgagtccagacttggccttcatctcctcttgccttcctctgtccaaggaatcactacagagattctttctctatccttctttgtaaatttccagaaaattgtttccccagggcccctccccttgaagaaattaaacaggaagctggagtagactgtcccttctttcccccacctctcacactccaaagctctgtttaactctgtgggccagtggctagattccccaacatggatgacagagaatacacatgcaataagaatgttttcgctgccaccagccactcacagacacactgtctcccaccctctgaaggcattgtgcccaatccccagccactcactgtctagtcagggctgcccctgcaggacttgccttggctgaggaccagctagcttcaagccactctgaagtcagcttgctgtttcccctggagcctggtaatacatccttcttcaggtgaacaaaagcagaaaaagcccagtgaaccccactgcaacaaagagcctgccatcagtcttccttctgttcctgcctatctcatcacccaagggctatcccagagcccactatgttctaagatctattcctttcaccaccacccagccaaacaactatccagacaattccttgatcaaacaacactgccttcttgagtttaaattttattttacaaaaagagaaataaagaaaactgataggcagttatactgacttacaattgttctgtttgcttttttttaaaaaagtgacatgaaacacaagtaaaaataaatacgtcatagaaacagccagttgcccagtctctggggcaggagcgcctgccctgctgagaggagggaagcccatgatcacaccagcagctggatcacccagccacagatgctcctcgaagccaggcacaggtcccaggcctcaggggcgtcctgaggaaagaagacggaaaaccaaagccaggtgccaggaccctggggccacctcattatcccccactcctcctggcagcagtctggtcttagtggttatccatagcgaccccccttaacccacctggaccctcttcccctgacctctctgaagatggtacaagggaaaaacctgtcttgggcaggctgggggggattcttctggtgagtccccagcccaccctgagtaacacaaccagataacagtcattttacacccaggtgcacatgagcacagcacacaaacacacacacacacactcacacacacacacacacacagctgggctgagctctcttccagggagggtcctgggtccagtcacagtatgaggtcctctctcttctgaatatcatcccagtagtggcagcagagagtacccaaacctccccaagccctctgcattgcagacactgcagcctgcttggctacccctccccaacacactagattactatgtcaaatagacctgcaaaagggaaaggtgcacactcaggtccctgaagagcaaagaagttggacactgcctgctcaagaagttcattgttataagactcaggtattcataaaaggcctagggctaagctagtagcacagaaaagccgttaaggggatcacagcagaatacacagggcagaagagaagagttggcagcaggggaacggagtctcaaggtgaccaatagagagcacaacattctcaaatagtccttgaggtgctgattcctgggagtagtcagcagagggccagaacatctcccaggggtccttttggggaaggatgacttcacttagttttaggggtgaagagccactgagctgggtgcacagaaggccatggctcagaagggaaagactgatctgagaaatcaaaaggaagtgggggccaggagcagtggctcacgcctgtaatcccatcactgggaggccgaggagggtggatcacttgaggtcaggagttcaaggccagcctggccaacgtggtgaaaccccgtctctactaaaaaatatacaaattagctgggcatggtggtgtgcacctgtaatcccagctacttgggaggctgaggcaggaggatcgcttgaaaccgggagtggaggttgcacggagccaagatcacaccattgcactcaagcctgggtgacagagcaagactctgtctcaaaaaaaaaaaaaaggaagtgggaagcagaaggtaatatccagaacactagtaacaaggaatgtaaagcccccagaagaccttccccatgggatgaggactcaatttcagagcaatgccaggtttgaatagactcacacagagggcccttctctgctgacaactttgggagtgatggtcctacccaggccacttaagtttggctaagtgtttcaaccaatctgcaaaactgtaccccagcactttgcttcctgctcctgaattgagaaatttcatatttagttgtgaatcacaagcatatagagactccacacactaattcctagggaagagagctccaaggatcacaagcatatagagactccacacactaattcctagggaagagagctccaaggaccagacagaattatccttaaatcaggagatgatgagatagatgcctaaaaagcataactcaaaggggtgtggacttcatagatatccaatctaaagaaaatgatatgacccaacatggttcacttcctttcttaaatagctactttgtccctgttcaatttttatctacaaatatattaagaaaaggaaatcaagcatcactataaatggtaaacctcaatcattaagtagtactgtgttccccaggctgagaacttggctaaaccagatgaatggggcttgagaggcccttgaaaacattccatggaagacaatggtaagggaaaacgcctaggcctgattttctgccctccctcttatcaccagccaccctgcccccctcaggcctggataatgggtggaagacaccaccaagtgtttatgatcaaagaaactataaaacatggttcttaggctctgagatacttcctgcttccctcacaaacatgcttatgtttggtgtgcatgcacatttgcctatcagcacatataaagagacagtggaaaagtcagaagtgttttcaggttattttctttaaaaaaaaaaaaaaaaaaaaaaaaaaaaaaaaaaagcaaaaaccatggacctggtagcactccaatttcccatgatcccacccccaacccctctacacaatagaaactgcacatataaaagaaagccttctctagtcaggtcagcctcccagaatgatggcctctgctgagtagaagcaagacccagtccctggaacactggatagacagtaggcatgtgctgcctctcagaatacccatttactttctgtcaacttcaaaagccaagcccatccctccagggaatggtttcagttcccggctgggaaggtttccggattcttggaggctagtacagtgatttcctagaagtgaacacagaaatactacccccttctcccgacaacacacacacacagacatacacatgcacacatgcatctctgggatcccagtgctccagggcctgagaggcatcagtgtaacccaggttctgagtgtgtcccataaattggagattcagtctagctcactcctactgcaccagcctcaacctgagagctcactccaactgagtcccttcaccatccattcttgggatgcatctgaaagagaaagcactggttggaactgctatttttaaattattaaaataatttgcatagctaaattgtagatctaaggcttccatgagtagaagagttaagtgtctggcagggtgcttatgaaaacacaaagcttcttaagttccacttttggtgttattggacagcagacaaacacacatatacacatgcaccccatccatcatctccttgtctcttctctgaggacaataccccagagtctgctaaggccctccaaagatggaaatgggctggtcagaagagctgtaggagctactactgggatgacctgactaagctgccttctgggctgggaagaggcaggtacaccacctgcccagtaaggagggagccatgggtaagtggtaaagctctaaagccaaagtttgttcatcataaagaactgtctggcaaagtgttggggtgggggatacagagggggcggggacaccagtaggaagacagccagtgtttatgcttaaggactagacgaccctcccctggcaatggcaataaggggagacccagaatgactggtgtgttcttttaagataaaacccagacttagggctcctacagagaaagggctcctccatgttccttcaaagatggaggcagcagacaccaggcctacatggaccacctgaagatattttcgaacatgaaatcaacagtccctcaacccagcaaccgcctatccacagcttcactattcagcatagagagccaacatctaacatcatcccaggaggacacagctccaaatctggggtctcttacttcccaattgcaaactccatgatcacaactttcgatttctgtggaatgagtcccaccctccactaactatccagtctcaggattccctgatcttcctgaaaagccatctctcaaaaatatagttgtttaatccaaaccttggtcaaacctaactcttcccctggtcaatttaccatccatccaggattgtttttcaccagtggctatagggtctgggatatcttaaaacttccctttctatcacctaccctccttacccctaacctccccccacccccaaataaacaagacacatgaaaagtccaagtaataaataattgcccataagaaataaattaacatggagctctctaaaggggaaggaaaggaacagaaaagactaccaggataggcagctctcttgggaaagaatgttcccaaagacagaaatgggatgtgcgcttctacactcagatgggcgagcaagcaagcagacagcataagcaaggcaggaaggaaaagaggctgcactgcccctccatccctgttttgggtccctgatttcccgctattgctgctgtgttggacttttttttttttttttttttttttgcctcttttgttaaacagcaacagagctctgccactttggccaaccaccctcctttgtcctcttccttttccctcctgccaagtgtcc

SEQ ID NO: 808 - DNA, 3422 bp, Homo Sapiens
ggagagccacgggcccgcgcccgagacccgcccgaagcgcgccgagctcgtgtgggggcccaagcccaagcttcctggcgccgggcgccctcccgtccggtacttggagcaaacggtgtccatgaaggaggcgagtggcaaatgatgtggtcaggaccatggacaggtctccttggttgaaaaggattcccacccactgactctcagatttggtaatagtaagtctgttttggtttcgtttggttttattttgttttgttttgcccgaatcagccacatactcgtctcagatctccgctgtggagaaacagctagttggcaaaaagcaaaaaggagagaggaatcctgagcacagcagtggtctctctctctctctctctctctctctctcacacacacacacacacacacactcacttcaccccttagcctcgctcttgataagccttgctgccacacagagcttggcttacctcttggaactctgagttggaatttgtctacacattgcaaacgcacatttgaagccacacaaaagtcagggtcagacggacgttttgacaaaggacctggaaagcatgtcacacgcaggtttttaaaaatttgtaaacctgtgaccattgtgaacagtcccaggccaaccctgagcacaacaacaattggccacttagtttttacttaagatacttgaaccgctcaaccatttacccaactctcaacttcatttagtaatttgagaacctggacaatcaacggcataaacaacattgagaaatagggagtttagtgattctctcttgtggaggaaatgctaattcctagagcaaaatagctatattagggactgaaacaaagaagaaaatattttacacttatgtaagtaaggttggactgtaaatctagagcagaaactgtcttccattgcttttatataacctctccctcagtcgcattttatgctcaatagacattcatcctttaccattttctttagttcagtgagtatctgtgaagccggcactgtgctgaaaactggctacaagcaagaattgttattgaaggatcaaagaaaatactgttttactcaggaaacattaaaatgcctatactttaggaaagctccatgagagagtttatgatggacatctagaggattcgggtaaaatgtttaatgacattttccccaggcagcctcccttaaaacagtcttgaactccaagacattgatctgaacttgacaccacagttgtaagttgtggtttctggctagttctgagtaacccaattgttcaaacttttaaagaatttcatattgaaagcccgaaaaatgtattcatcctttcctcaccaattacatagttactaagtaaataaccagattatgtgagtttccataacctagattaacatcgctactatttgtccaggagacttatttgtccaggagactcatgtggatgaactggggaagaaggaagatagttcctagaaggaggttgttggacagaaagaacttaacttatgcctagtgttccattattggaacgctaagcacgcgggagttgtttacatcctgctgctcaaggtcatcgccaaggtctgattgcaaaaattctaaaaattgcaacctcagggataaatgagttaagtagtaactacaaaggtactgtactgtctagacatccacctcttgtctaccttctaactcttttgcaagcacttgcctttcatcgtacttccctgcagttcccttacagcagagctatccaaaagaattgtccgcaactattaaaacactctgtatttgtgctgtccaatacagtggcccgtagccacctgtgactattgagcactttaaacgtagggagtgcaactgaggaactgaatttttagctttatttaattttattcagtttaaagtttaaaaagccacttgtggctattgtctgccatatcaaacagcatagacttagagctacagaaatggcatggtagtgttcagccaggaactaagaaagaagattatttaatgagcacttggtgagataaactgtaatgtctgtagtgggaaaagaatagcagcaatttcccatgtttggcaattctatctaatgacctgacactgttaagaaatatatccatcatgctgtgtggaggtagttaaagatggagatggaaaaaaataaccagaaatcagaataattttgttttctcttccatttcctccagcaaatattttcctcaagagttgtcatttactctactatagatagcacagttataacagggaaaaactaacatgaaatattctagaattatttttgttcacttagatcaaatggtagtttttttcctgccacctaaagctttagaagtaacacaagctctagcaaagaaaagaaagaagtaagcaaatagcacggacactaatttattatcctgtgctttccttccatggtatcttctaagcgtttcattcagacagaagggccaactacacttccttttcctctgtaactatgatattattcctgtataatctgctataattttcttattgctcactgaagttattgctattggctagctgcatagagcagtacacagaggtttttcaaaagaataataacacagcacgatactggcctgtcagctcgtaggagtgaacagaacttttaaacatatagaccaatttaacacaaaatgatcaacaagtacatgcttagtaggatacaggctactgtaactaagtgttcttattcacaacaaagaagttattattttgttctaggtaacagtacttgactatatttaaaaccttttttcacagctgagtgttcccatgataatgacaagtgacatttatatagtgactttcactcagaggtcaaaaagtgtgccacacaccttttacatgacataaatatgtcacccaccagtaaatacagccacctatcatgtagaaagcggaagcaacttttagaagccctaaagaatatatatatacaggaaagaaattgaattttacacctagaataaattgagttagatgagaaaatggtcttctgctgcaaaaacattattcaactcttcttggtttatataattgcaaatttggacagggtaatgatgtgtggaatagaggaaggagagtcaaagcaaaagataatttaggataatctggaaaagagatgattagggcatcatttagaaaaaggaggtaaaataatgggcttgatcagaccagagagtctatgagggtcactaagatcttttattgcttacactgttcaaatacaatgctgtcaaacattgttctttgtataaaaataggtgctcaataaattgttgttaaatgaataaattataacaggcttggtgtcatgtatcctttataattgtagttcttaaactctgatgca

SEQ ID NO: 809 - DNA, 2679 bp, Homo Sapiens
gatctatagtgatttgctcagtgccttgcacacaggcactgttgggggctgctcccagaggttgtgttgcagggactggagagaggacttcccagtacagggggtggccctctgatcaggtgggggtgggtggcagcagagcatttggtaggaggtcaggagctcacaggagatgggattctgccgatgcctgctgaatgaatgagggagggagacggcaggaccagggactggggaattggtactaaggtgctgggtacctgccgggcactctgtccatacatgatctcagttcagctctccaccttggaaacacaagaaaggagccgtggctgcagagaaaaacagaggctggaaacaggggtacatgggcagggtggtggtggtgagagaattgcctgaatcagctgccaaatggtgcccaggttggaaaagcaaatgtgcacacatgggttcttcccactctaaccctgaggaattagaggcctgcttctgacacagactgggcagtggctagtgactctaggtatagagtatccaggccctgctcacccaggctagagcttagggagccagaaggaaggaggtgcatgttggggtgcaggacaggagggaaaaatactcgaattgcaaggtgagggcacagtctatttatattgggttgaattaactcctccccctgatgccactaaagcaggaatcacactgcagatggcactgatttgattggcaagagacatgccaggaagaatattaagggaccggacccctataattaggcctaatcatagcctgttgtttgaaaagggcatgaaggacattcatcaggcctggcactgtgccctagacctgctctcctgggtagtgggaccctccgtggcaacagaggtgtgggtgggcctgggtgagtgtggcaagaaatgcctcggaggctctatttggccttaaagtgctgtgtgaccttggataaactgccctctctgaatctctggtcctttccatttcccattctccaggctgagaactgcactgtgatatatggttattcccataataataatgtgtgtatcatgcataatgcactgcacctcttcaccacgctggtgcccactcttctgctccccctgccggattcctcagccccttctaccctgatggttctctcctttcctcctcaggccagcacttcccatgatctgagatgtccgtcctccttcctcttcaactttttctccagcagtgagttcctcctcctaactgaggcttccaggaaggatatcctctgcttctcagacctgaacctgccttgaatactcatgaggacccaggagctactcctcacctcccacttctcttccctcctgtcagataaccaaggcacggccaactgatctccaaccatctgaggaacccaaccgtgtgagaccacccacacctttcaagaatgttcctcccctccccttctttgtatttatactgatgcaaatttgctggccatcttaactcagtcctgtgcctcagttctcccacctgtaagatcaggaggaggataaagatgtaagactttctgcacacgttttaagatgaattccttgttaccacatctgagggtgtctgtgtttactgtactatccacgtgagaggattgtacagacacgaatctaaacaaggaagtagcaagtccattcaagcattaagaggctgattagtggtttattcattctgtctgcaagcatctactgatcatctattcagtgcagaccattatcacaacaaaggtgaataagacactatgcaatagccagggaaacagcctcaaaaacagttaaactctaatccagccatgagtacaatgctaaggagggacaaattcccttctagggctagggaagtcaggaaaaaacctctcagcagaatgtgtgcctctctaccaggcccagggagaaggtgcagagacagcattccaggtggggagcagtggctcacacctataatcctagaagttgtgtgggaaccgctgagcggaacaccctcccccagcgggaaatccgggacacgcaggagcctcagtgaatccgaccattgtctcatctcaccaggtcacccggctggaaagagtggcagagccccgtctggtcaggaactgggttgggatgagctccccggacaagcggctggatgatgtcttgtacctgttggagagactgcagggtttgaggagggagagaagagccaagtcttggaggcgctggacttgctgcgacacaggaaaacgagatgtgcagggcaagggatggcgatgaggaggaaaggggccacttggatctttcctaaggtaggagagtagtcacagaggataagagtccagctggagtgaagcagtacgggggtagtccttctattttagggttgccagataaaatacagtatgcaaaatcaatgtgtctgatgtcttgaacagctgttgcctgccaaaatggacaaagaaccaagagcagctgcaggccacgcaccaccactgggattgctgtgaccttcctgccttgcccctgggtcttaaatcaccaaactctatggctcacactgggctgacactgctgaccttacagccttgcaaatgatgtcatcaccatacgttcttcactcatgacgtggcatggatttgaccaaaggcgtgat

SEQ ID NO: 810 - DNA, 1055 bp, Homo Sapiens
gcaagctcaggtggcaggtcccatctgatggaggagaatcaattcaaggagatgcccttcctttacagaacaccctttaacagcatccaggaggaacgagaggctgcaatactgaggctttcaaagtactcacgaggatgtccgagaatggctgtgatgccaggcttctggcaggttccagactccatcacaagcccagcatccctgcaccagatctgacatcgctgctgttgtgccagctgtttatgaagggcctgagtagctagcaggtttttatcaggagccctgctgggggcttagacaccaaaagagaagactcatcctctgtagttcttcttgtgaatgtccttttagaaaaacaattagaaccaaccacaagcaccaaagtcctaatgggatctcctgcgagcacatatcaagcaggattgttgctatttctcctcactggctctttggacagactgtgtgagctcctggagggttccactgtatctaccctttgacactgaccagttggcacatggtgacatattccaatgtgttgattgcaaatgtgaacgtacagccagtgctgtgtgcgggaggactctctcctcctcagtggggccacaccgtgcactattaatggagccccactcctttgcacagcctggccatgcagtggctcatattgaggttttagccaactgaaatctcccgtgcatttttctgacaagccagctaggcctctgctatgctgtccttgtgtctttcatttgatgaccttaagggtgggactgttttatcttaagttacaggtggtcaagtccagcccaaggacagcaactctgagggtcaagcctcataggctaactggatagatgttctctgctttgccacccactggagcccgacctgccccactaatttatatttcccctggtctcattttgtactttttatttataattcacccttaaagtgtatgtgtctcttataagctgcctccgatctttcatggtatgaggtggttacctaaataaagaaggagatttggcctttgtttttatgtaaca

SEQ ID NO: 811 - DNA, 11532 bp, Homo Sapiens
agcacgctggcggctaccaagctggaggaggcggcgggcgcgagactgggaatgcgcagggccccctccctgcccccacagcctgggccacgggccccatcttccccgctgctgcgcggcactcagtgcccaccccccgacgaggccggcagctgctcccacccgggggcgttgtcagctgcgccgggccgcgcgctgggaggcgagggcacgcatggggagcctccgttgatgccaccaccacgccgccctccgaggctgcgtcccgggaagcccggctacccgagcgctccggcctggcccggtgccccggacctgagtgtgtccgcatggaggagccccgactggcccaggcggccgtggcggagagcgacccccgagaggtgtgggaggagacccccggctgggcacccgcattctgccccagccccaaggcctggtcgccggagccgcctgcccaccgcctgcaggacttcgacacactggccaccgtgggcactgggacgttcgggcgggtgcacccggtgaaggagaagaccgccaagcatttcttcgccctcaagttgatgagcattcctgatgtcatccgcctggcaggagcagcacgtgcacattgagaggtgtgtccggaaggaatcatccgcccgtccctcatctgcgtccggaaggaatcccttcctcatctgcgtccggaaggaagtcatccgcccgtcgctcatctgcgtccggaaggaagtcatccgcccgtccctcatctgcgtccggaaggaagtcatccgcccgtccctcatctgcgtccggaaggaagtcatccgcccgtcgctcatctgcgtccggaaggaagtcatccgcccgtccctcatctgcgtccggaaggaagtcatccgcccgtccctcatctgcgtcccgaaggaatcatccgcccgtccctcatctgcgtccggaaggaagtcatccgcccgtccctcatctgtgtccggaaggaagtcatcagcccgtccctcatctgcgtccggaaggaagtcatccgcccgtccctcatctgcgtccggaaggaagtcatccgcccgtccctcatctgcgtctggaaggaagtcatctgctcgttcctcatctgcgtccggaaggaagtcatctgctcgttcctcatctgcgtccggaaggaagtcatccgcccatccctcatctgcgtctggaaggaagtcatccacccgtcgctcatctgcgtccggaaggaagtcatccgcccgtccctcatctgcgtccggaaggaatcatccgcccgtccctcatctgcgtctggaaggaagtcatccgcccgtccctcatctgcgtcctgaaggaagtcatccgccctttcctcatctgcgtctggaaggaagtcatccgcccgttcctcatctgcgtcctgaaggaatcatccacccgttcctcatcggcgtcccgaaggaagtcatccgcccgtccctcatctgcgtccggaaggaatcatccgcccgtccctcatctgcgtctggaaggaagtcatccgcccgtccctcatctgcgtctggaaggaagtcatccgcccgtccctcatctgcgtcctgaaggaatcatccgcccgtccctcatctgcgtctggaaggaagtcatccgcccgtccctcatctgcgtctggaaggaagtcatccgcccgtccctcatctgcgtctggaaggaagtcatccacccgtccctcatctgcgtcctgaaggaatcatccacccgttcctcatcggcgtcccgaaggaagtcatccgcccgttcctcatctgcgtcctgaaggaatcatccacccgttcctcatcggcgtcccgaaggaagtcatccacccgttcctcatctgcgtctggaaggaagtcatccacccgtccctcatctgcgtcctgaaggaatcatccgcccgtccctcatctgcgtctggaaggaagtcatccgcccgtccctcatctgcgtctggaaggaagtcatccgcccgtccctcatctgcgtcctgaaggaatcatccgcccgtccctcatctgcgtctggaaggaagtcatccgcccgtccctcatctgcgtctggaaggaagtcatccgcccgtccctcatctgcgtctggaaggaagtcatccacccgtccctcatctgcgtcctgaaggaatcatccacccgttcctcatcggcgtcccgaaggaagtcatccgcccgttcctcatctgcgtcctgaaggaatcatccacccgttcctcatcggcgtcccgaaggaagtcattcgcccgttcctcatctgcgtcctgaaggaatcatccacccgttcctcatcggcgtcccgaaggaagtcatccgcccgttcctcatctgcgtctggaaggaagtcatccacccgtccctcatctgcgtcctgaaggaatcatccgcccgtccctcatctgcgtctggaaggaagtcatccacccgtccctcatctgcgtctggaaggaagtcatccgcccgtccctcatctgcgtccggaaggaagtcatccacccgtccctcatctgcgtccggaaggaggtcatccgcccgttcctcatctgcgtctggaaggaatcatccacccgtccctcatctgcgtccgaaggaagtcatccgcccgtccctcatctgcgtccggaaggaggtcatccgcccgttcctcatctgcgtcctgaaggaggtcatccgcccgttcctcatctgcgtctggaaggaaatcatccgcccgttcctcatctgcgtccgaaggaagtcatccacccgtccctcatctgcgtccggaaggaagtcatccgcccgtccctcatctgcgtcctgaaggaagtcatccgcccgttcctcatctgcgtctggaaggaagtcatccgcccgtccctcatctgcgtcctgaaggaatcatccacccgtccctcatctgcgtccggaaggaatcatccacccctccctcatctgcgtccggaaggaggtcatccgcccgttcctcatctgcgtccagaaggaatcatccacccgtccctcatctgcgtccagaaggaagtcatccacccgtccctcatctgcgtccggaaggaagtcatccacccgtccctcatctgcgtcctgaaggaagtcatccgcccgttcctcatctgcgtctggaaggaagtcatccgcccgtccctcatctgcgtccggaaggaatcatccgcccgtccctcatctgcgtctggaacgaagtcatccgcccgtccctcatctgcgtcctgaaggaatcatccacccctccctcatctgcgtctggaaggaagtcatccgcccgtccctcatctgcgtcctgaaggaatcatccacccgttcctcatcggcgtcccgaaggaagtcatccgcccgtccctcatctgcgtctggaaggaagtcatccgcccgtccctcatcggcatcctgaaggaatcatccacccgttcctcatcggcgtcccgaaggaagtcatccgcccgtccctcatctgcgtctggaaggaagtcatccgcccgtccctcatctgcgtccggaaggaagtcatccgcccgtccctcatctgcgtcctgaaggaagtcatccgcccgtccctcatctgcgtctggaaggaatcatccacccgtccctcatctgcgtctggaaggaagtcatccacccgtccctcatctgcgtcctgaaggaatcatccacccgtccctcatctgcgtctggaaggaagtcatccgcccgtccctcatctgcgtctggaaggaagtcatccgcccgtccctcatctgcgtccggaaggaggtcatccgcccgtccctcatctgcgtcctgaaggaatcatccacccgttcctcatcggcgtcccgaaggaagtcatccgcccgtccctcatctgcgtctggaaggaagtcatccgcccgtccctcatctgcgtcctgaaggaatcatccgcccgtccctcatctgcgtccggaaggaggtcatccgcccgttcctcatctgcgtctggaaggaatcatccacccgtccctcatctgcgtccggaaggaagtcatctgcccgtccctcatctgcgtctggaaggaatcatccacccgtccctcatctgcgtcctgaaggaatcatccacccgtccctcatctgcgtccggaaggaggtcatccgcccgttcctcatctgcgtccggaaggaatcatccacccgtccctcatctgcgtcctgaaggaatcatccacccatccctcatctgcgtctggaaggaagtcatccgcccgtccctcatctgcgtcctgaaggaagtcatccgcccgttcctcatctgcgtctggaaggaagtcatccgcccgtccctcatctgcgtcctgaaggaatcatccacccgttcctcatctgcgtcctgaaggaagtcatccacccgtccctcatctgcgtctggaaggaatcatccacccgtccctcatctgcgtcctgaaggaatcatccacccgtccctcatctgcgtctggaaggaagtcatccgcccgtccctcatctgcgtcctgaaggaatcatccacccgtccctcatctgcgtcctgaaggaatcatccacccgttcctcatcggcgtcccgaaggaagtcatccgcccgtccctcatctgcgtctggaaggaatcatccgcccgttcctcatctgcgtccggaaggaatcatccgcccgtccctcatctgcgtcccgaaggaagtcatccgcccgtccctcatctgcgtcccgaaggaagtcatccgcccgtccctcatctgcgtccggaaggaagtcatccgcccgtccctcatctgcgtccggaaggaagtcatccacccgtccctcatctgcgtccggaaggaagtcatccacccgtccctcatctgcgtccggaaggaagtcatccgcccgtccctcatctgcgtccggaaggaatcatccacccgtccctcatctgcgtcctgaaggaatcatccacccgtttctcatcaggctgtgctggacggggcatgactagcgcttcctctgcaggctcatggagtatgttccgggctgtgagctcttcagctacctgcgcaaccgggggctcttctactctgcagagatcatctgtgccatcctgcactctaaggagatcatctacagggacttgaagccggagaacatcctgctggatagggacggacacatcaagctcacggactttgggttcgccaagaagctggtagacaggacttggaccctctgcggaatacccgagtacctggcccccgaagtcattcagagcgagggtcacggaagggctgtggactggtgggccctcagcatcctgatattcgagatgctctcgggatttcctccatttgtgtgtgtgtgtgtgtgtgtgtgtgtgtgtgtgtgtgtgtgtgacaacatgtttggcatttatcagaaaattcttgcagacaagatagatttccccagacatttggatttccatgtgaaagatctcattaagaaactgctcgtggttgacagaacaaggtggttaggaaatatgaagaacggggcgaatgatgtgaaacgccatcggtggttccgctctgtggactgggaagctgttcctcagagaaaactgaagcctcccatcgtgcccaagatagcccgcgaaggcgacacctccaacttcggaacttaccccgagaatgactgggacacagccgcgaccgtgccgcagaagggtttagaaatcttcaagaatttctgaggacaggagctcacatctggaagaagcaggaaggctggaatctgcctgcaacaaagagctgctcctgagcagaccagtagcaatgtcttcttcacgtgataaggacatttccacttttctgtctttgtgcctgtatgtatagaaacagatcagagcacagttgaaattaatgtaactggcattatttaagcaactggaattccacactgtaggaaggttttgaaaattgtttgcttgtagattttatcttatcctttagtgttgtgttcctactgtgatgtcttggtttttctcatagacttaagtttataagtttgaactggacttgttcaattataaccacaaattgtgtgtgtgtgtgtgtgtgtgtgcatgcgcgcgcctgtgtgtatatatagaagtcattatggcagatccacagaaattgtgcaatgatgtaaatgttcatacttcacagagcctataatttttatttttcaatttgttttttcaaaaatctcttctcttggggacaacatctgaagggtctgttgcatggatttaaaaaaatcatctcacatgcattttttagtttgggtgaagaaaacatcatggggaggtccatcttcagtatctttagtgcttcctacctggtaacttgagactttaaaagaagaaacaaagagaagaagatatgggagtgaatttattccaagaatctacaatgacattgaagttgttggaggaatatactgtatttaaaaaacctgtgtcacattcaaaaatttcatctaagctgggcgcagtggcttgttcctgtagtcccagcacttcaggaggctgaggtgggtggattgcttgagcccaggagttggagaccagtctgggaaacatggtgagatgtcatctctctacaaaatacaaaaaaattagccgggcatggtggcgcttgcctatagtctcagctactcgggaggctgaaatgagaggatcacttgagcccggggaggtccaggccgcagtgatccgagatcacaccactgcactccagcctgggtgacagagtgagaccctgtctaaattaaaaaaaaaaaaaaggcaatggctttgtgcttttgaaggtggaatgaaaggtggaatgaagacacatccaccttaaggctttaaaagaccatgaagctgggtgcagtggctcactcctgtaatcctaggatttggggaagccaaggcaggaggattgcttgagcctaggagtttgagaccagcctgggcagcatagcaagaccccatctctataaaaggaaaaaaatgttaaaacacagtgaaactgcagaaacagaacatagccaccctttttcattaatgaccttttcttcacgtggtggtcaactcagcaggtgagaataattagtaggttcagtagaataaagtctttacaattaataacttagtggaaaatgatgttcagatgatgaaatgtggaaatgttttagacagctgtattttcagcctgtgtgtctcagtcaccatcctgttgggattaacagttgagggccatcattttctaaacatttcacatgcagtttcccataatttttaccgtgaatgtgaaaaggtgaaactggtgctgacttcagcggcaggtatactaaaattagaatgacacagaggagattagcatggccccctgtgcaaggaagatccagattcatgccgcattccatatttttttttaaaaaaggttacactgtgcaccgagatgtgcagctagaaggaagagcatgaagtctcgtgtttgctgactataaaaataaatcatagtaataatattgttgaaaattctgctttaaaaattattaataaaaccataaatgaaacactattcttgagcacactttaaaaagtacatagacccataagtccatgtactaaaaaatgcctatttttaggttgcctgttttgtaatccaggatttcatactgagatgaaaattagcatcaggaaaagcctgaaatgccttgccttaattgtgaacagatactggggaacctgccccgatattcacgtaggttcttttctgttttccttaagcatcggccagcttgagaaataaagggacagagtacaaaagagagaaattttaaagctgagcgtccgggggagacatcacatgtcggtaggttccgtgatgccccacaagccacaaaaaccagcaagtttttattagggattttcaaaaggggagggagtgtgcgaataggtgtgggtcacagacatcaagtacttcagaaggtaatagaatatcacaaggcaagtggaggcagggtgagatcacaggaccacaggaccgaggcgaaattaaaattgctaatgaagtttcgggcaccattgtcattgataacatcttatcaggagacagggtttttgagatcaaccggtctgaccaaaatttattaggcgggaatttcctcttcctaataagcctgggagcgctatgggagactgaggtctatttcacccctgcagtcttgaccataagagatgaccacgcccaggggggccagttcagagacccacccccaggcgcacattctctttctcagggatgttccttgctgagaaaaataattcagcgatatttctcccatttgcttttgaaagaagagaaatatggctctgttccgcctggctcaccggcagtcagagtttaaggctatctctcttattccctgaacaattgctgttatcctgttcttttttcaaggtacccagatttcatactgctcaaacacacatgctgtacaatttgtgcagttaatgcaattattacagggtcctgaggtgacatacatcttcgtcagctgacaggattaagagattaaagacaggcataggaaatcacaagagtattgattggggaagtgataagtgtccatgaaatctttacaatttatgtttagagattgcagtaaagacaggcataagaaattacaaaagtattaatttggggaactaataaacgtccatgaaatcttcacaatccacgttcttctgccatggcttcagccggtccctccgtttggggtccctgacttcccgcaacaaacagatatgcatgaaaatgaaatatgcaaagcacattgatgaccttgttctttacggacattgtaatcagcctctagccatacagaacaaatgagaaattagaagcacttccaagaacgtgtgatggtgtgaaacccacttttgaccatcatgcacatttcaacatttgaagtgagacaggctacctggtaactgccccatggcggggtcatagtttaaatggcccaatgtcctgtagaggttaatttaatcaaaatgagctataaacatagaacaatcactatgtataattttaaaatagtttacctggcccgtcatggtggctcacgcctgtgatcccagcactttgggaggccgaggtgggcagatcacccacggttgggagttcgagaccagcctggcccgcatggcgaaacccccatctctactaaaactacaaaaattaggcatgctggtgggtgcctgtggccccagctgctcaggaggctgaggcaggagaatcgcttggattcgggaggcggaggctgcaatgagccaggattgtgcctctgcactctagcctgggtgacagggcaagactccatctcaaaaaataaaaataaaaatagtttatctgggtgggcattccaaaatttccgcatagatgatcacgtgaaacaatcactgtgctaaatgtggaggaaaattcatcacgataatcacaaaatttgtatcagaaaaaaattacaaatgtactttgtttcatgtaattttatgagttggaagtattttcttaaattggaacactataagataatatctttaggaaatggatatgccacaataggaagtatagtggggcaagtcttgtttttctcaagggaaaagccaccagcctgctttcataggcattgataaaaccaggaagaaaataaagtcacaaccaaatagtatacactgtctctactgaattcttctaattccttcccaacagaagtctaaatcctgcttagcctaaacatatctatagccagcgatgggcaaattatatttgctgtcagcatgatagaataagaatcagaaaccccccagcagtggggtaagatcgtgcacttcatcccctcaaaatgctgtcaaccccattccctctccatgccctcaaacaactgcacagtcacttgttagtgaatttctcgttcagcgttttgtttttttctctccatacttaaagaccaaatcatttgtttgctctgaagaaaaagaaaaaacaaaacaaaacaaaaaaccacccaccaaatcatttgaaatcactacccgttaaaaaaaatcaccagtggaactaaacagttgagtggtttgggatgtgttcgccatttctgtgtttgacctacatggcctctagttctttggaccactgtaactgtgaaaccatggcttaatactgttaaagaccccaaggctcaactctgtagccagggtgtacctcaggctgcacaaatatcacaccagaatgtcacaatcattcattgctccagctactgagtgaacagggtgcaagacagcactggcttgggttgtatttttgcagccagttaactttgcatcaggtctacacagtccttgcagcctttgatttctccagttgtagagatttgaaatggggtgcccgggttcctctcgtttttccttcaacctacctagcatgcattttacacacattggaggagtcttatgcactgtttttctctgttgctgatggaggcaagaaggccttctaattagtctaacttaaacggacgggattcacctaacaaaagcaagaagaaaagcacaagaacaggtgtcttaatgcatttggataatttatttggggtgtgtgcgtgtgtgtgtgtgtcttggtggaggtgggggccgtgttctcaccaagccttttcataatcaagtttgctttgcaaactttatggccttacacccagcagaacagtccttgctaataaaaggaggatgccctgtcacagttctctgtaaattatcatgtgttgggaagttctgttgatgcttagtttgatcttccatggtggacacatctgttctgtatgtacaaggcattacatgtgtgttttagcggatgggaattgaagcctttccacagtccttgtgctctgagatggctgttgagctctgctcagctgtcgtagctgaattctttttttgtgctgaacactgggcagcctcaccatgttgtcaatgtgcttctggggcccctgtgactgctgccagatgccatgcacacaagcagagtgcctttgcaggtttgtgcaccccttggcgagctggaactgggagccctgtggggtgatctcgccttctcatggggggtcggggaggggagtgcctatttttaatcttgtctgtttgttgcaccatggaaatcactgtgatttgtatatatgccctaggaaatttttactgcagtctaatttatgtaataatgttgattccaggtttgtttaataaagctttgtatcttttaagaaaaaaaaaactgtagcatgtagaggaaagtgcactgggataatccaaggccaggctttgaggttccaccgctacattatgtgactcttagtctaaaccttttggtgtaatttctttggtctgattatttataagtagcagataataaatgaattttatactacaaacacaagtgacaa

SEQ ID NO: 812 - DNA, 4068 bp, Homo Sapiens
acggagctccagccagggccgcggttcgcctgcacgtcacggctactcaaacccaagcacgtcccgaaagcggtattttctgcgtctgggaggtttttgcatcctcagttcccaccgctggggctggcggcgaccaactcgcagacctgtcgcagccagagagctgtcatttcagtaccgggattcagaattgatccagtccgcagcggagggggcacatcccagctaccgagctgctgagtgtctctggctggaacaatagtatttttttctctgcgaggctgcaattaacatcttatttgttctggctccatacaggctttgtcaggatcgcggtgcggcgaccgacgttgggctcttgcattgctttgtgcttggcaatggaatcatggtttcggggtctaaacttttgtttcgttttgtagtcttaatgtatctgattctttttcaagtttccctagtaacaggtttggggacggggtgggaagaagcgagaaaaggggtgaagagaaaaaaccagattatatagaaaggaaaaagggaaaagggatgtttccccaccttttaatctaactatctatctgtctgtctatctatcatcatagatagtcattttgcctcctggacagttggctgacgaagtgtctgataaaccagcttcagatacatgctacaaaaggctactgagctggcctgatgatgatccttctgagatatatttatagcagatgatttgtggatgataactacgccaagcaagacactgtctccagtaaccccaggctcgtctgacttcctcaggggattataataaagaatcacaaaaagaaccctatatggacagtctggtctctggacactaacaacagcacaatccaaaggcaaagaaaggaggaaccaccttgtttcatgtctgcaagctgctccatatgaaagcattgctgacatgttgacccaacagcaaaaagagagcagcagtttacacaccctcagctctctgtcctttcctttctattgatgttggtccacttttatgactgaatacatattaaaatcaccatttcaaattataattatctgctttcattggtctctttcacaagtctatgtctatatttatgtttacatatataaacacatatacacatattttatacatacatatgtatatgtatgcacgcattatttgtaagtacacatacacgtgtgtgtatatatatgtatatgatatgtatatgtgtatttcagttgatacacatatatttgcttgggaagtttcactacattgctttgtatttctcttttataaggtaatgcatttaattccaaaactaccacattaattgtataaattgattattacataagtttccttgatgatttacagaagaactattgagaggtcagtgttagcacatcaaaatatagtctggtatggcattttaaattgacccaggtatctaatattaaagcctttcaaatttatctctcctgctattattttattaagattactttggaatgatgaggttataagtgtgatttatttctgtttcatctttttgtctgtatgtgctaagtttagtccctccactttgagaataaccctataatccaggatcattgcttaaaattcagtatcatttgcagaattctcatactcaaataagaatgtttctagaatatgtttactcaattttagaaagtattttctctttccttctttctgtcatagtttttctgatattactgtattaccacattctaaactctgtgacttgttattttcagtaaggctttaagaagcatggataggtttgtaggttatttcttgttaaatatgccttaattttttagtatttagtattagtatttagtttttagtatttagtatttagtatctcccatatatatatatgcacacatatatatatacacatatatatgtacacacatacatatatacacacacatatatatacacacacatacacaaagctttggaatgttaattaaatgatcaaaatattacaagattacattgttatgagaacttatccttaatattagcatatttactataaagttaaacaacttcttctcctctgtctcctgtttattatcattattttattattattaaaaaaggaagtctctcagaaaccaagctgtatatcctctagtctctatgtaaaaaaacaaattggtcattttctacttggacatcccagaatagaaagtacattgaagtactaaaaaataaagggatagacttggggttaagggagatgtcatagaacagctatcctgggttagttcaagtgtagtcctattccatgctaggcaaagtcaaggttacaaaaatcccagttgcatcaggtttccattttttatcattatttccctatacaacgatacaagttaaaaaaaagtcggtaaatacttttggccatcaattttcaagatttcattggtgatattaaggaaatgctgtaagtaggtaacacataatgtcatatttgtgtgctgtagaagtatcttggaaaatatggactttaaaacctcaaaatatgggtttgcaatcgaacatacattcacccccaaatttgacctttttcagctagttattttctcatataaagttactatacttacaccattatctttaatccctgaaatttcaattatactagaaatcaagattcttcatttttactcacgaaactgacactaagtatatacctcattaaggacaagaagctatgaattctctggacttcagttatctcacagaaaagagcttgattgaataatgtctaaggctcttcctgacatagtctaaataacagaaggtgtctcacaagaaatggaagcagtgagagaaaaatgcaattaaatcctagactagaaagaatcacaattttcccactcacaggttggaaatgcctctctattctatcacaattttgaaaacctccatagttttactagctttgcctttctcccttgctatcatcttctgaggtacagacagtcctttccatttttattcctctcccactctgataatttttttctttgacagaagtcccactttatcattaatgatgacaataactaaggctgccaggaacagcacatctgctgagctttatcaacaccagattctctcattttgccttctggatctccatgcttttttataccaacaaacaagaggaagaatattctctacccacttccttgactgaagcctgctcttttatgaagacatggcatctcttccaaccgtgtcaaacagatgcaatttatatgtctgctgcttccataccctgattaaatgggtcagtggcagaatcaagcatttgtttgccagtaagccaggtgccatgttgtcatacagccctaaatagagaagtccatgtgagtttggccttctgaggcctgtcaaaagacacatgagtgagctcagaagtggaagcttcctcattcaagtcttgagaggactgcagcccagccaacatcctggttgccactacatgacaggcttgagccagaatcaagcagctaagctgcttctggattcctgacctacagacactataaatcaggaatgtttggcttccaactgctaaatttggggataatttgttatgcaaatataggtaactaatgtatatcccatggattccacgcccattgttataataatttacttacaacagtcttcagctatttaacatttttctggctggatcaccacgtttactgtgatgaacaactgcccttcctgatccaggacccatgcagcagagcattactgaagaaattcacaccctcaggcagttagatgtccctgtaaagttatagtcaccaggttctcatgatctcaccacacagactgttacttataagctccctctcttattacaccctatgaatattttgtaacttttctctgattattaaaaatgcttctcctcaactcttgaatgataagtgataaccttttttcattcattatttataaaacagatgtgattagatggaaaatatcttatattcatt

SEQ ID NO: 813 - DNA, 297 bp, Homo Sapiens
gccgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgggcaacatagcgagaccccgtct

SEQ ID NO: 814 - DNA, 299 bp, Homo Sapiens
ccgccgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgggcaacatagcgagaccccgtct

SEQ ID NO: 815 - DNA, 2638 bp, Homo Sapiens
tcccttgcaccaaaaacagaaaggaaggcctatgaaaatcagaccatgaagtcttatttttcattctttggtctagtaatttaatttcattttccagattattaatgctgcagtttattatatatttgatgctgaattgctgaatttgacttgtccaaatgacatcaatcctgcctttatctcattgccagaagtagtgaatatattgctttttatcctggtgaaagggaagattcaaagttgtttgaaggagaggggctgatctgtgtggtggcagtagaacatattctgattgatgtcctctaaccttgcaaacttgccagagcatccacctagttcaaccctagttcagttatcatggtggaaacccattatgggcactcttagcaactattgtgcctatatattaataagtctactgaataacaattagttcatccccttacttcttcagcccttacttccacattgaaagaagtaaaaagtagaactcaccaattgctatttaagcacatttgctagttttgtaaagtctatagacttctaagaggaatatatgaaacctcaagtaaatatattaaaacatgcacaaaataaatatatttatgatatatactttttattgtaactatcaaattttaatcaaaaaatttgtaatgctagggaaatctcaggttttactaatggaattatgaaaaaatattaatcttaatacaatttgtaaaatgccttaaaagttagatgttgaaatggacttccaggtcctgtagctacttctattgaaattatcatcataatgttttacaaaatgagaaaagtaatacagtttctctttccagttgccctgaagcagactaactgatgcttgtaaagatgtttctcagcataaatggattgttagagaatgaacttcagttaattttgaccttaaaaaaaagtcacgtagatatgtattttcatctgaaacattttcaagagtcttgcaaacaagtcactctaaaataatttatgacaatgtttatgtgctcaattacattttggtttttcaatacatattcttaccttaagtgaaagtagattgtatccctggttttcatttttcagcacattttcaagttttctaagagaagtacaaaatcataatctgtcactacataacatgtcactacatgttcaacatttgtaaaactcaatttattataaatcctgagttattagtaactgttatttgaaagccattttagtaatcatagaaagcactaatattaaggagtaaaaaatcaacaattaatatcagaaataaaccatgagctcttagaaactagtgggataccattaggcattcataagatataataattcaaaagtaaaaattatatgctttgtagctcaaaagtgctttcacctattttctcatttgtgtagccttgaaatagtggtagatgagtatttcaaattcaagcatcagatatttcataaatactgcatatgcctgtgtgtggaattattgatgttttgaacctataaacaggatagaaaggaagagatggtcaggaaacaatactggagaagaaaaagaggtaaatggtaaaagcagaaaaaatgattagattatgtttattttagaatagattcatttagtgaatatgaattgaggaacctacttaatgccaggcactatttgcagctctggatgtacagcaatgaacaaaacttttaagtcatgcccacaagataaagtgaccaactcatctcagtttgcacagatgttcctggttttagtactgaaagccctgcattccagaaaccccttagtcgagggcaaatcaagacggttgctcaccattatcagaacctcactttctggtaactgtcatcttgatttccaaattcatattaatatttttatctcattgttaatgacaatgcaagttagcactgaccacaagtaaccaatggctagtatacctgtttctaactggggcaaagttatgacaagagcaaattatagtaatatcaaacttcctagaattatttctagacaacactccttggagtgcaactgaagtatcaaaagtacaacttgccctcaaggaagagttagtgtctgggaatgtgaacgaacaatcataaccaccatttgcaagacacctacgtatatcatctctagttcttacaaagccctctaaggtagtatcatcatctccgttgcaaggataaagactttgagagtaaactctcccatacacaataatgagaaagaaaacccaaggtaaaagaagagaattggagctttcagatggctatagcaagtcttgtataagcaatagcatttatttttcagaacagaaaactattaatgctctcagtgtattttacttcttgtgttctattggattatattttcctggaaactggcttctctttggggtcacattttggtaatcaatgttagtcttattcttgttcagtcaagtttactaatgaaatggataggacagtacctttgaagcactgacttggttaatgtggcaatgtttgaactatttttatattgactattattgaatttcgtagaggaacttcaaattgaagacgttatggatcagccagcattcaaagatgaaaataaatcaat

SEQ ID NO: 816 - DNA, 1353 bp, Homo Sapiens
aataattgcaaatatatttattacaatttacagattagttatgttatatacacaaatataattttaactataaaatcccaactagttacatttaaattattgatctgtagaagccaatttagagtcttctagtcccctaactttaccttccttaaattatacaaaaataaaatctgatagttttgatttcaagttaaagatgaagaagtgttacatttcatcactcagaaatggaacttttacctgtctgtacaaagccttttacatgctacattgacacttaaagcaccattaacaagactttaaatgtataaaatgtttaattaaaacctccaaagattttctctttaagattacgggggtttaactttgttctaactagaattgggatgaaacaagaattttgcttttttctccttcagtccaactttaaaatagtcctttctgtccttcttatcaccttctgatcacttcttccaaggaggctagtatatggaagaactcttaatcaagctttcactcatttggtagtgaggttagaatcccatggggaacaattttccaaaatccaatgaaagatgtctcattattttcaaatacacagaggtgctaggtttaagaaacaggaaacacaacgttaagtctcggaaataaaatgtttcagcctggttttaaaagaatgcctgtatgttgtcaaaaggcttttttcaaggcaaatgacgcctgctttccaaccgacattgctgttgcttgaaactagcctgttttcatgttattagaccatcctgtaaatgtgctccctatgattacctaaagtggaggtgcacaaaacacacagaatcccagcactttgagaggccgaggcgggcggatcacgaggtcagcagttcaagaccagtctggccaacatagcgaaaccccgtctctactaaaaagacacaaaaaattagccgggcgtggtggtgtgtgcctgtaatcccagctactcgggaggctgaggcaggagaatcgcgtgaacccaggaggcggaggttgcagtgagccgagatcgcgccactgcactccaagctgggggaccgaacgagactctgtctcaaaaaaaaaagaaaaaaacaaaaaacacacagaataagggctctgcaaaaatttgaccagcttttatagtgttgcattctcaatgtgtttaattatgaatatataaacagtggaggcagttcttagaactggatagaaataaaataatgaccaggtagattgtaaactgaggtagtaaccctgtaagcacttctgatgaaaaattcatccccacacttaaataagttcaaaactaagaggtcacctattctacttatg

SEQ ID NO: 817 - DNA, 2284 bp, Homo Sapiens
gctattggctaaggagggcttatcggctgggaccccttgtatgcggaaggccggggacagggagctaggcggaggctgtggtcgaggccggagagcgccctgcggggggcctgcggagacggcgcccgcattttcccagctctgggtgcgatcgactgctcctgccggtccagcagcgcccgaggcggcccctgccttggccccaggttctcccacttgccccggtctctccctccccagactgggcgccgctgcagtggtctcagctgcgtgaaattccttcaagccccctcttcccgcctccacccacgctgccttccagctattcattcacgagaatttcttgaatgcccacactaggcgctgagctgataaactggggtccgtggcctggaaccctgctgagtgtccctggcggccttgccacagggtgcaaatcgcgttgaagagtggaccaagggctacttgaaaaggcggttgcggagaaagaaaatagctttgataataagaattagtagtttaggcaagtctttgagcctatcaagtaattcatcaagaggagaagataagttattttgagaagcgaagccagaaaaataacacaggtccttgacgctggtgttcgtcctcggataatagggctgctttggagacaggcaacagtagactggtagaatcgttctattgcttaaggctttgatggtggaagagaaaaaacactcttgttgaagtggcatatccaagaacagtgctttctttctggtttaggatggagaaggaactgactgctgtacccaagtgaagatctttactcagttacccttatatttggctatatggaataaaattgtgtgatatgtttattctgagcaggtacaaaacttcagcaaacctattggtcccacattttcccccccatttatcatatgatttggagtgaccggttgacctttgagttaatgaataatttaaagcagtgaaaaattttttgcagtaaactacggtgttttaaccttgataacataagcatagtggttaagattctaggctttgtatctgaacatacccagagtcacatccatttacatctttgattttgggcaagttatttaatctctctgcctcagttctcttgtctctaaattggggataaaaatgttttcctgataacagtacctttacgtgtaatggttcatgtatcgtatttattacagtgcctgttttatggtaaatattcaatacatattagctgtttttataattaattcctcccactacatcatgatccaaactgactcttttcttaagtgatggggaagggaactgaatattttaaggaagtagctataaaatatgatttcaagttgttctgtagtaattttggtgttccataaggacattttaatgtgaaaaagatactgacagaatctatacatggtttgaatttattagtttctaaactatgaccagtattagcagatttaaaattcataattatagcaagaaaacgtcaaagttgtttaacagtgttaaaatttgaaactgtaatgatccagaaaaatgaaataccaaaccgataattttgggaaaaaaacaaaacttgagtggcattatgcaggccatttactttttaaatgtactcaatataaacaggaatcccttctctccaaatttcagtttttcagaatttgggctgtcatttgaaacacttactttgggcactttgactgttaaagaagcaaagggtatgctaagaacttcaatgagtcttgatgttagtgtttttgtaattaggtggaatctcctaccttttcatgaaaactgggtttaaagcagtagctgctgggtccattctaatgataatctcaaaaatgtgactgacttgtaaaaatctacaattatttattaatgtgagactaggtaaagtatgagttgaaaaactaggaagaaaggcagagtggtgatttttaagcttgtataaaggaaggcccgctttgggtactatgaggtacctttctcactcagaggcatgctgtgaggatttgtgacttttaaatcatttagctctttttataactttgtggaattaaatctaccacgtatttcaagtgtattcaggatatgaattttcctggtagagagttttaacagatttttttctcttaacccttcattgatgaccaaacaattttgttgtctgtaataagaaagtactcggttttgtagggtgtcagtccttaagaaaatgttaggtagtcatcaataaaatagcaacaatctctgg

SEQ ID NO: 818 - DNA, 1707 bp, Homo Sapiens
gcaacctccacctcccgggctcaagcaattctcatgccccagcctcctgagtagctgggattacaggcgcccaccaccacgcctggctaattttttttgttttgtattgtttttttttttttttagtagagatgagatttcaccatgttggccaggctggtcttcaacttctgatcttagctgatccacctgcctcagcctcccaaagtgctgggattatacgcctgagccaccgcacccagcctcaaatcataaacttttttttgttttttgagacgaagtctcactctgttgcccaggctggagtgaagtgacacaatcttggctcactgcaagctccgcctcccaggttcaagcgattctcctgcctcagcctccccagtagctgggattacaggtgtgcgccactgcgcctggctaattttttgtatttccagtagagatggggtttcaccatgttggccaggctggtcttgaattcctgacctcaggtcatccacccacctcggcctcccaaagtgctgggattacagacatgagccactgtgctcagcctcaaatcataaactttttaaaggtttatccctgaccctctaaattaggttatgtgccttgttatatgctcttttagcacttatcctaattgtgattgtgtatttattatatgattgtttattcaacagtttctttcaacaaatatttaccaagtgtttagtaaatcttgttttggattgtaagcttcattaaggcagagtaaggactgggtctgtggtttctcttaccatgtgtacctagcacctagcacagtgcttagacatagggagtacttaataaatagtcattgaatgtatacattaaaatggcgttaataatgctgcctatctgatgaggctgttgtgagccttcaatgaaatcgtgtgtaggaagtgctagtttgctcacaggctggtggtaacagtctactgtggtcattgagagcagttattgtggacacaacccccagttctggtcaccccacccactagctctgtgaactcacataggtacttaatatctctgatttttattttatttatttgtaaaatggaactaataattacaaccaccttataggacagagtcttgctctgtcacccaggctggagtgcagtggtgtgatctcatctcactgcaacctccgcctcccaggctgaggcaggagaatggcatgaacccgggaggcagagcttgcagtgagcccagatcgtgctactgtactccagcctgggtgacagagcaagactacatctcaaaagaaaaaaaaaaaaaagtattattgagaatataatataattaacctgaataggttaattatattgtggaacctaaaccgtataaatttaaaatgccttagaatgcccagtcagcaagtgacagtattagaaatcaacctggattttagaccgctgtgtgttcatggataatgtttgtgtgtttaggagactattctgaatagtggttcacagtcctttacatgcatcccctgtgcattggatgcttcactagccttttctgactaaagcatatgaaaatacaagtgaaaaaggcaagttattacaggaataacttttcattttctctaattttcatattttaaaaattcatttgtaagcatttgatactttaaacctgtttacaggaacttggtataaaccaccatgtccagcc

SEQ ID NO: 819 - DNA, 2023 bp, Homo Sapiens
aagagtcacacatctctcacgttaaatcaaaagttagaaatgattgagcttagtgacaaaggcatgttgaaggccaaaacagaccaaaatctacgtttcttatgccaaacagttagccaagttgtgaatgcaaaggaaaagttcttgaaggaaattaaaaaggctacttcagtgaacacaggagtgataagaaagagaaacagccttgctgttgatgtggagaaagtttgagtggtctggatagaagatcaaatcacccacagcattccctaagccaagtcctaatccagaccaaggcagttactccgttcaattcagtgaaggctgagagaaatgaggaagctacagaagaaaagtttgcagccagcagagtttggttcttaagatctaaggaaagaagtaatgtccagaacagaaaagtgcaaggtgatgcagcaactggtaaggtagaagcttcagcaagttattcaggtatagctaagataattcatgaaggtgaacgaaggtggctacactaaacaacatattttcaatgtagaccaaacatccttctattggaggaaaatgccatctaggaatttaatagctaaagatgaaaaatcaatgcctgtttaaatcttcaaagaacagtctgactctctttttaggagctaatgtagctggtgactttaagttgaagccaatgttcattgactatcctgaaaattctaaggtccttattctcagcaaactatcgcaaggacaaaaaaccaaacaccacatgttctcactcataattgggaactgaacaatgaaacacatggacacaggaaggggaacatcacacaccagggactgttgtggtgggggcggggagggatagcattaggagatgtacctaatgctaaatgacgagttaatgggtgcagcacaccaacatggcacatgtatgcatatgtaacaaacctgcacgttgcgcacatgtaccctaaaacttaaagtataataaaaaaaaggaaataagctcaatctactctgcctgtgctctataaataaaataacaaagcttggatgtcagcacatttgtttacaacatagtttaccaaatactttaagcccactcttgagacctactgctcagaaaaaaagatttctttcaaaatatcactgctcattgacaatgcaccaagtcactcacataagagctctgatgaagatgtacaaggagattaatttaatgctgttttcatgactgctaacacagcatccattctgcagcccatgcttcaaagagtattttcaactttcaagtgttatgatttaagaaatatatttttatatatttatgaagtatagctgccatagatggtgattcctctgataaatctgggcaaaataaattgtaaacctaggattcaccatcctagatgtcattaagaacactgttgattgatgggaggaggtcaaaatataaacattaaaagaaatttggaagaagttgattctaaccaccatggatgaccttgccggattcaagaattcaatggaagaagtaactgcagatgtgttggaaataataaaagaactagaattagaagtggcgcctcaagaagtgactacattgctgcaatctcatgacaaaagttgaatgaatgagaagttgcttatagataagtgaagtggtttcttgagatggaatctacacctgataaagatgctatgaatattgttgaactggcaacaaaagatttggactattacataaacttatttaatgaagcagaagcagaggcagtgtttaagaagactgacttcatttagaagttctaccatgtgtaaaatgccatgaaatagcatcataagctacagatacatttttctgaaggaagagtaaattgatgtggccaacttccttgttgtcctattctaacaaattgccacagtcaccccaacttacagcaaccacccttctggtcagacagcagtcatcaacatcaaagcaagacctcccaccagcaaaaagtatcactagttgaaggctcag

SEQ ID NO: 820 - DNA, 1527 bp, Homo Sapiens
acatataaatgattctaaggccttctgacctgtctttcaataggatggtattacccaacaattatgacgtctacacatacttttcattttcaatcacattgggacaaatttttatctttatctcatttctgctttctcctgtatgtataagtgctgatattttactgctctctacaaagagtaaagtctattatggtcttacaacttaaatttgattccaagacaaaggttaattggtaaagattatttcccaagcgttaatattgtacatgaatcagaaggtcagatggcatttctggatctgacagctcttatcataatgaaggtttgaaagaaatgtcatcttgcgtactaattaatggttttagccctagtgagagatcttttatttaacgccagtaagttaatcgcagttgatgtctgtgaactgtcaactctcaagctatgcatctatttgaggtcattgctgacaaaacccctattttacaggcaagatcactgaatatacatcacttgccaatgtatcatagacatttgaaaacttatagaattcagcaaatattgttcattttatttactcattttttaatagtaattacaaactatgaatggaaaaagctataatttaatcattggactacatacattcaatttttaaaaaagactctgctaaatagaaaagtgtttgaagtatttatttttccctaagtaaaaaagtaattttgtgagacagtcacaattataatcctgatttctaaaatttattaatttgagatcttcattagaagaattgagacattttttcttctgaaaacaagacacatacacaaatatatatatatatatgaaaaacttccaatatttaagaagtatttcctctgaacattcttagttacaaatgctattttaaatttttaatatttgctactgataatctgagagtgtcacatttattatcctgtttcagccgtaagtgaataagtgttactgcattttagcagaactttatttacgaaaacaggctagatttggccaaggttcatagtttcctgaccacagttcttaaacatagcaaaaggtatacaaggtaaactcacattttctagatgaccaatcacccaggtttccaggacaaggaaatgtttgttagtttaagaagcagggcaatcctagacaaactggattagttggttactttactttttcctagattctaatatcatttgttcattcaataattcatttaacactgagggtctatcaacattcaacaaacgcaaagtttcaaattaaaacaaaagcacttacatgttctgccattatcagacaattatatgacatgttattttgcagccaattgtaaaaggcatttttttactttattattaattttaaatttagacataccttaaaatggacatactatagtaaacatcaacataaaacaagataatggaatattattcaaataaaaagatacaatatagcaatataaacttttttgaatttatgtcctatagaagttct

SEQ ID NO: 821 - DNA, 2409 bp, Homo Sapiens
ttgtcaattatattgacaaggtttgggtgtgtatgtcatatttaaattataagggaaacagtgattatatatttgtcttaaattatagtacttaggaaacagagtgaagaaaaaggaaaaaaaaaaaaaaaacctaagtggcagggaccctctgtttttgaaaacatatttgtatattcaatatgccaaaatatctaatattaaagtgatatactaataaatatatttggcatattattatggtactttcagttctcaaacttttaaagtaaaaatattgatcaagattaatgttcccaatgcaaagaaataataaatgtttgaggtgatggacatcccaattaccctgatttgatcattatatattatatgcttgtatcaaaacatcacatgtaccccataaatatgtacaacaactatgtacctataaatattgaaaataaataattttttaaaaagaaaattctgaatttgagattttaaaatcaaattcaaggtataatactggtcaaaaattgtgaaccaaatatgttattttagtttttttattgctgtggtaacaaattaaaacaaacttagccacttaaaataacacccatttattatcttccagtttttatgattccaaagtgttggctcagcatggctctactgaattctctgcttagggcccacgaggctgaaatcaagttgtcacctaggctttgtgttttactagaggctagaggaaagaattggctttaatgcttattgaacttggaggcagaattcatattcttctcacgttttcaagacagccaatgggcaaaagtactcatacttcaaatctctttgttctctgctgaatctgtctacatttaaagactcatgatattacattgagcccacctggataatccaggataacctccctattttagaacaatcttcactgcctctgcaattttttttttttttttgccatgtaatataacatagccatagggatgacaccaaggggtgaatgagggttatggggctcaaaattctgtctaccacatatgatggagctcttcattttcctctcacattatgagattctctattaagtgttcagtttaattattcttttagatattaaattttaaaggtaagaccaaattaactttttaatataaatgataaaagtttacaaatatccaactatctgttacccaaaaattaatctttcagagtaaaaagaatttagttatggaaataataaattgaaaagttacctttcgccagtgtctttgtttctggtttttcttttttctcaattttttccttgtgagttgcttaaacagaaaattttacattagtacacatttttaatagatttcaaaaccaagctttcttttgacctcagtttcataagtgctaaaacctaatctgtaatattttgaaaatgtatgacattaataagtctaattcagaaataaagagttaccagtgtaataacagttgtattgaattcaatgttaaagtctaggcattaagacttagcaagcttgttgaaaatcagatctactctttctcaagtcattatttcaaacaggtaaagctttcagggaagacaaactgaaagggaaaattttctataagaatttgtcaaaaaatatgtcattatgtgtatttttaaatttgaattatattaaattgtgttgtttggtagtttcccaaatcatcatacatttttcaatatttacatactattttttcaagaataacaatggtaattaaactacgaaaattaagtagtaaaatatgagatttaattgggcagttaacaaagtgtatgcactgatttgttagaggaaaaaattagttccacatatttccatttctcctacttccaacaagaatagtaataatgtacatcagctttacttacatcattaagaaatgcttaaaatatgtatttaaaaatccattatttttaaatacagttgataaacagtgtcctccagaatcttggagagatgatttaagcctcagaaagcctaatattcagttgaagagcaagtgtccctaacacatgcagagctgctgagagaccaggtgcctcctcctccagagtttcagcctctccaccactcaggcctgcccacaggtacctccactaccacttgggattatgggtaatagattagacaatgttaacaaaaggagcattatgctaggctaagcaaggcactattcaaacaaggtcacaggactacattataataacatatctcctaaaaagcaaacatcctttaattggcataaggtaaataaaagagcacttacaatgcagcattttatttctgcttttcaatttgaatacatttttttctgcagcacttataatttaagggcaaaaattcctaactttttttttaacagaaa

SEQ ID NO: 822 - DNA, 11890 bp, Homo Sapiens
ggatcacctgaggtcaggagttcgagaccagcctggtcaacatggtgaaaccctgtctgtactaacaatactaaaatcagaggttgcttgcagtgagccaagatcataccattgcactccagcctgggcaacagagcgagactctgtctcaaaaaaaaaaaaaaagaaaaaaaggaatttacatagttgaacaactattctttggacatcttttagtccagtagacggtgttaaacttgaagacaaataacgatttgacctgtgatatttgtttttccctcttatcttctaagcccattcatccagatcattcatcacctttaaaggcatccccaaagggaggcaggtctggacagagctgaagattgcacaggccatttgcaggctggattcgttctctggtgacccacctgtctgactcgaattatttttttcccatgtctggacaagactgacctctgcccagcaactgaggcctggatttagtccaagggccctcagtggcttttttgtttgtttgttttttcaggaagtgaagaatttagagggataaaaggcggaaataacttttcagcctctgacctttgtaacaatctggtttccttttaaaggagcattgtttgggcctggggccacctagaccttctgatgctctttccccacccttggaggaggaggaaaggaagaaaatgggccctgagcgatcaccacataccaggccctgggggtctagtggcgaaggaggcaggtagggtctcttgctttcatggagcttctagtcaagcgagacgcactaaacagtaaagggacaaataggattactggaggtagccctaactactgggacagaaacaagatggtaagatagagaaggaagagtggcctgctcagatggggtggtccagaggcctctcgggggaggtgactcctttttgttttattttttttgagatggaatctagctctgtcgcccagcctgaagtgcggtcgtgtgtttcatgcgcgtccgtgtgaagagaccactaaacaggctttgtgtgagcaacatggctgtttatttcacctgggtgcaggcgggctgagtccgaaaagagagtcagcaaagggtggtggattatcattagttcttacaggttttgggatagggggtgaagagccatgtttgcaggcaggggtggatctcacaaagtacattctcaagggtggggagaattacaaagaaccttcttaagggttggggagattacaaagtaccttcttaagggtgggggagattacaaagtacattgaacagttagggtggggcagaaacaaatcacaatggtggaatgtcatcagttaaggctatttttacttcttgtgtggatcttcagttacttcaggccatctggatgtatacgtgcaagtcacaggggatgcaatggcttggcttgggctcagaggcctgacagtgtgatcttggctcactgcaaactctgcctcctgggttcaagcaatttttgtgcctcagcttcccgagtagctgggattacaggtgcccgccaccatgcccagctaatttttgtatttttagtagagacatagagtttcaccagattggccaggctggtctcgaactcctgtctcacgtgtctgtgtgaagagaccaccaaacatgctttgtgtgagcaacatggctgtttatttcacctgggtgcaggcgggctgagtccaaaaaaggagtcagcaaagggtggtgtgattatcactggttcttataggtttggggataggcggtggagttaagagcagtgttttgggggcaggaggtggatctcataaagtacattgtcaagggtgaggagaattacaaagaaacttcttaagggtgggggagatgataaagaaccttcttaagagtggggcagattacaaagtacattgatcagttagggtggggcagaaacaaatgacaatggtggaatgtcttcagttaaggctgttttcacttctgtggatcttcagttgcttcaggccatctggatgtatacgtgcaggtcactgggatatgatggcttagcttggactcagaggcctgacattcctgtcttcttatgttaataagaaaaataaaacaaaatagtggtaaagtgttggggtggcgaaaatttgtgggggtgatatggagagataatgggcgatgtttctcagggctgcttcgagcgggattaggggcggcctgggaacctacagtgggagagattcaactgaagaaagattttggggtaagggctgatactgtggggttgttagaaggagcatttgtcatatagaattattggtgatggcctgaatacggttttgtatgaattgagaaactaaacagaagacacacagtccgaataagagaaggagaaaaacaggtattaaaggactaagaattgggaggacccaggacatccaattaagagagtgcccaagggggttcagcataattatttgcttggttggcaagtttttggactctatccttgagtttttttatgttgtcatataccaggccagattgatttaggtaaaaacaacactcttcatttaaaaatatacagagtcgtcctttttcagcaatgagtaaattgaggccttggcgattttggaggaaagagaattgcaaagccagcaattgtttctttttttatttatttatttacttattttttaaaattatactttaagttatagggtacatgtacacaatgtgcaggtttgttacatatgtatacatgtgccatgttggtgtactgcacccattaactcgtcatttacattaggtgtatctcctactgctatcccttccccctcccccaccacacaagaggccccagtgtgtgatgttccccttcctgtgtccaagtgttctcattgttcaattcgcatctgtgagtgagaacatgcggtgtttggttttttgtccttgtgatagtttgctgagagtgatcgtttccagcttcatccatgtctctacaaaggacatgaactcatccttttttatggctgcatagtactccatggtgtatctgtgccacattttcttaatccagtctatcattgatggacatttgtgttggttccaagtcttcactatcgtgaatattgccgcgataaacatatgtgtgcatgtgtctttatagcagcatgatttataatcctttgggtatgtatccagtaatgggatggctgggtcaaatggtatttctagttctagatccctgaggaatcgccacactgtcttccacaatggttgaaccagtttacagtcctaccaacagtgtaaaagtgttcctatttctccacatcctctccagcacctgttgtttcctgactttttaatgatcgccattctaactggtgtgagatgatatctcattgcggttttgatttgcatttctctgatggccagtgatgatgagcattttttcatgtgtctgttggctgcataaatgtcttcttttgagaagtgtctgttcatatgctttgcccactttttgatggggtttgtttttttttcttgtaaatttgttggtgttctttgtagattctggatattagccttttgtcagataagtagatggcaaaaattttctcccattctctaggttgcctgttcacactgatcctagtttcttttgctgtgcagaagctctttagtttaattagatcccatttgtcagttttggcttctgttgccattgcttttggtgttttagacatgaagtccttgcccatccctatgtcctgaatggtattgcctaggttttcttctagggtttttatggctttaggtctaacatttaagtctttaatccatcttgaattaatttttgtataaggtgtaaggaagggatccagtttcagctttctacatagggctagccagttttcccagcactatttattaagtagggaatcctttctgcatttcttgtttttgtcaggtttgtcaaagatcagatggttgtagatgtgtggtattatttctgagggctctgttctgttccattggtctatatgtctgtttcggtagcagtaccaggctgttttggttactgtagccttgtagtatagtttgaagtcaggtagcatgatgcctccagctttgttcattgggcttaggattgtcttggcaatgtgggctcttttttggttccatatgaacattaaagtagtcttttgcaactctcatcagcccagtttaatattacctatttattataatgtaatgctgctcggacaactgagaaaatactgttgctttaccccctccagctctgtagcagccacgcagaaatcatagaactgtaaacatatgctaattacacaacctatgtaggcaatcaatattaagaaaaatttttactgctcggtatttctgtggttgaaaatgtagagtctaattttgatccgcagtaacatctaggttaatgttgattcagaaggaaaacgtttgttgttgccatgagaagaggcattgaaatgctgaatcaccaccacaaatgttaccactattaatataaggagatacataggaagatggaattagaccatctcggaccaccaggtttacaattccacctgcagatacatgcaagaagtattgtcacaatacttatgtcacgttattccgttgaggtcatcaccaactaagcttataattaatgtgtggtcaatttggtcaatgtcaccagcgtagcatactaacaaaaacaagggttgcaaagtcaaatgcctataaggcagaacgtaagacggtaggaagcaaagtctatagggagctatataatagaggctgcagattcatggcagattctaaagcacagcagtccccaacatttttggcaccagggaccggctttgtggaagacaatttttccacaggcggcaagggatggggcgcaggatggtaatggtcttgggatgaaactgttccaccacaaatcatcaggaattagattctcataaggaatatgcaacctggatccctcgtgtgtgcaattcacaacagggttcatgctcctgtaagaatctaatgatgctgctgatctgacaggaggcagagctcaggcagcaatgcaagcaatggggagcagccagaaatacagacgaagcttcaattgttacccaccattcacctcctgctctgtggcccagttcctaacaggccacagaccagtacatgtccatggcccaggggtcagggaccctgctgtggcacattgcttaatagaggactgtagcagccatgtgccctgacctttcctttttttttttttttttttttttttgagatgccagaaacccagaatttttttttttttttttttttttaagacaaggtctggctctgttgcccaggttggagtgtaggagggcgatctcagctcactgtaacatcaacctcccaggctcaagcaatcctctcacttcagcctcccacgttgctgggattacaggcacactccactacacccagctaatttttttgtattatttgtagacatggggtttcgccatgttgcccaggctagtctggaattcctgaggtcaagctgtctgcccatctcagcctcccaaagtgctgggattgcaggagtgcaccaccacacctggcctgaaacccagattttatttatttatttattcattttttgagatggagtcttgctctattgcctaagcttgagtgcagtggcgcgatcttggctcactgcaacctccacctccctggttcaagcgattctcctgcctcagcctcccaaagtgctgggattacaggcatgcaacaccacacccagcctgaaacccagatttttaatatgaaatcaaagtcttcagaccttgtaggtgtcataaaaagcacgctgaggaccactagtttgcaactgccaatctaaaatatcatagacattatatcactttaaccacgaaaaaaaaagtatgtgaggcagaaaatggaagcaaccatgcctaatttattgttgaatactttttccgtataccaagagcttcctttgcactagcatctgaaactatatccagaatgacactggttttcataaaagtgttgatcctcacacctctttatagtcttgcacctagcccagtggagtgaaacactttaaatagcacttgttccttgagtatatatggaaaaaagtgaagtattgataagtgctcagctaatatgagcagcatctcaggagtctccaattcttgaattaccagggagtatttttaccattttcccccagtgaaaggcctattttgagagacttatcctccaaaatgaatgtattaagtcatgttccttttttttttttttttttgagacagggccttgctctgttgcccaggctggagtgcagtagcatgatagttacaggaaaggggtcccaatctagaccccaagagagggttcttggatcttgtgcaagaaagaattcagggtgatgccacagtgtgaagtgaaagcaagtttattaagaaagtaaaggaggaggggcaccgtggctcactcctgtaatcgcagcactttgggaggccgagacaggtggatcacgaggtcaggagatcaagaccatcctggttaacacggtgaaacctcatctctactaaaaatacaaaaaaattagccaagtgtggtggccggtgcctgtagtcccacctactctggaggctgaggcaggagaatgggatgaacccgggaggcgaagcttgcagtaagccgagatcgcgccactgcactccagcctgggtgacagagggagactccatctcaaaaaaaaagagagaaagtaaaggaataaaagaatggctaccccatagacggagcagccgtgagggctgctggttgcccatttttatggttatttcttgatgatatgctaaacaaggagtggatttttcatgcctcctctttttagaccatatagggtaacttcttgatgttgccgtggcatttgtaaactgtcatggtgctggtaggagtgtagcagggaggatgatgggaggtcagtcttgtctctattttggttttggtgggttttggccagctccttcactgcaacctgttttatcagcaaggtctttatgactggtattttgtgctgaccttctatgtcatcctgtgacttagaatgccttaaccatcagggaatgcagcccagtagtttcagcctcatttttcctggctcctatttaagatggagttgctctggttcacacacctctgacatgatcattgcccactgcggcttccacctcccgggttcaagagatcctcctgcctcaccctcccaaggtgctgggactacaggtgtgtgccaccacgctcagctaatttttgtattttttgtagagatggtgtttttccatgttgcccaggctggtctcaaactcctgggctcaagcaatccttctgtctcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtttctaacaattgttcatacaatcattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttattaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataacgcaggaacaaacatcacaactatgccaaataatcaatcctacaatgtccaaaattttactttaaaactggaatttccagacttcctttctgcattaaccagtttaactagacagtaacgaaatattcctactttatgctgtgatagtttgtttatttatttatttatttatttatttgagacagagtttcgctcttgttgcccaggctggagtgcagtggcacgatctcagctcaccacaacctccgcctcccaggttcaagcgattctcctgcctcagcctcccgagtagctgggattacaggcatgtaccaccacgcccgggtaattttgtatttttagtagagacggggggtttctccatgttggtcaggctggtctagaactccagacctcaggtgatacccctgcctcagcctcccaatgtgctgggattacagctgtgaagccaccgcgcccggctgctgtgatagttgagatgtaaaccaaaaataaaattctaagccacccaatccgactgaatggacccttcctgttgagcaaggacattccaaagtaaactgaaaagaccagcttaggccatgatgggaaggggaggtgtcaacatgcctcattctaccttcctccctctggaatccagacacaactgaccagcattaacattaaaacagagatcttaagctgggcacagtggctcatgcctgtaatcccagcactttgggaggccaaggtgggatcacctgaggtcagaagttcaagaccagcctggccagtatggtgaagccatgtctctactaaaaatacaaaattagccggacattgtggtgcacgtctgtcatcccagcaaggcaggcgaatcacttgaacccaggaagcagaggttgcagtgagccaggatcatgccattgcactccagcctggtcaacggagcgagactccgcctcattaaaaaaaaaaaaaaaaaaaattagccgggcgtggtggcgggcacatgtagtcccagctactagggaggctgaggcaggagaatggtgtgaaccagggaggcggagcttgcagtgagccgagattgtgccactgcactccagcctggacagaaatgcatttcataatgcattttaattgcattagcagtgatttaatttttttagatgttaaaacttatgggtgaaagtggattaaatgtagccaaatgcaacatcaaaatcttcaggcacaaaaacccattaactttttcatactctcagaaggtgaacctaatttcaaatgaaagctgcctccagaatatattgttaagcgtattctagatataattcattttggcaaacatactgtagaaattcacataacattttactgtactaaaagtaaattgcccatgtaacaaaaaatatcttttcagagcttgaaatgaattttaaaggatgactgatggtccttggaagagaaatagtaaacaaataaggtttgtagcaatgatgtatgagttagaaattgcagttccagatgatctctttattaaagagacgatctacacttaatttggtcaagtgttatgaacatagttcatgttaagtctccatttaaatacaacctgaaataccaaagttaattttcttttctttctttctttttttttttttttttttagaaggagtcttgctctgttgcccttcctggagtgcagtgacgtgatcttggctcactgcaacctccacctcctgggcttgagcgatcctactgcctcagccccccaagtagctgggaggacaggcgcaagccacggcactcagctaatttttgtatttttcgtagagatagggtttcaccatgttgcccaatttggtctcgaactcctgagctcaagtgatccgcccgccttggcctcccaaagtgctgggattacaggcatgagccaccgtgcctggccagaaaattgtaaacacacacaaactctcaagtggcctaattccctctcaccaaaccaatcacaatacagataaaagagaataacttgtgttcatttttgtacaaacaaaaaagatataaattgtgaatgatgcatgatttttaattacaagtaaactgggcaaatgcttctgcattatttaaagctaaaaggtgatcagtggaaactttcctctgttagtactctaatactttttatatttatcggctcactacaacctgtgcctaccaggttcaagcgattctcctgtctcagccacctgagtagccgagaccacaggcacgcactaccatgtccggctaattttgtatttttaatagagacagggtttcaccgtgttggccatgctggtcttgaactcctgacctcaaccgatccgcctgccttggcctcccaaagttctgggattacaagcgtgagccaccgcgcccagccttattataattgttactatttaaatctcttttgctctctccttcaagagagacctcatcccattcagttgcttccatttatttattcatcttctgcctcctgggctcgagagatcctccagcgtgagtctcccaagtagctgggactacaggctcacaccaccaagcttggctaaattttgtaggttttggagagacaggctcttgccacgttgcctaggctggtctcaaactcctgggctcagatgatccacctgccttcgcctcccaaagcactgggacatgagccaccacgcccagccgcaagtacttttacacaaaatgcaaacaccattcttccatcataaaagtgataccacagcttccgtgaagttttgccaggtagtactcataattaccttgggtaaactttttgatgttaaactgtatcttcttattacgagtttttccattgtattaactgcttttacaacaacacaaataacaagttattttacaaaccatttagaaatttctgtactatggtcccagtaatgtaaaatatattaatgcctattacattcagataaattatacacttggaaaccacatacttatgacttacagaaatttacataaacaaattatagaaattatatgctcaatttttaggtatatagtcttaaattaagcttaaatatacattctcaagataaattaacagttcagggcttcacaacttgaaatctgtggaagatgacattggagacaacagaactctggtggaattcttagatggaatttgccgaaactttttttttttttt

SEQ ID NO: 823 - DNA, 2840 bp, Homo Sapiens
gttttgcttttactcctcctagaagcaatggaaccttgcctgttccctgggggtgagacggatgactgcccctacattagctacctaacatttttgcttctccggacagaagagtaagggcaaggggacaagacccatctccccaaagcagctgatccccacttgcacaccaaactaccaatgaagctagccatttctggtctcccatcctgacttttctgagcacatggtgaagatctgtggaaaacattttgatgaagagagagtccttggaaggtgtcatcaggtattgaccaaacaagccactgtcctggatttgcctgtttttccggttccaaggccattcttctgccttgagtggttccttgagactctttatcatcttgaccttcccagaagagagctccacaaagagcacatcagtttgtgtgcttgaactaccgtagatgttatattggtgggcttcagtaaaggatggttgaaatgccagatcagatatgtgcagatttgtgtaaatatcaaaagcctcctgtatttctcctctgatggtaatgtactgaacccttacaagacctttcacatcattaatgctgacaaggtagtggccatctggagagacatatggagtgcccgtcacatcactattgaacccaatgactgagtcagttacaccgtccaccatgacctgtggggaaactgctccggtgctgtcaggtttgcagccaatgaagtagtagcctcccaagtgtgtatatgccaatgactgaggaacgcacttatagtccttcaagttaattgtcttgatgtatgacatggtttcaagatcaattttttgtagtgcagcttcatctttatgaagaataaatccaaacctgaaaaaaatgaaaatcagagttagacaggaagcaatggagtttttagccgtaagaaaaaaactagatacaggtggaaaggtccatcgcaggctctaattgtcaggcgaggcagcaatttgtgttacaattgtgctagaattaatctgtagattgtgccactctccttctttctctaggtcattctttcattacatccaaatcatcataactcatgctgtagaaagaaaaataattaaaagcaatacatctagttaattgcagcaacaaattttgcttttaacatagtggaaagaagaagtatacattattctgtaagtctctagaccatgtaatattaaataagcttggttaactattgccaaacccagcaagagtaaaaggctcgaatatatattggtttcactcatttcatttacttcttatattgttttttgaccattaaataaatctgacactcatcattatttagataaatttaagtataacatttttcaacctttcaatgtttatatgttatttttaatgatatgcctgcattttatttgttatcctatactgaataatgaagaactttatttttatattaaagccaattaaacaattgtttgtttgttttgttgaccttaaattagttcagaacttttcaaagcatatttgctaaatattgcttgagaattatcagagatacctgtggcaagtataaatatatttttaaactcacctagaacacaagcaactttctagcaaaaataagttaaacaagatacaatgagatagaaactattaaacaaaattaaacaaaattatatccaaagtagatattggccaatagaattgtaaaggacttttatttatgtttgcattaacaatattgattgtcaccttctaatagttctaaaagctcataataaaaataagagaaatatttttccattcactgtgttcataagtaatacaatgaaattaccttattatgagtattaagataaagcaaaacaaaaactctaaagagagccaattatgttatcatcacctgtgtaattatctttatgctaattatcacacataattatgacatgtagttttatttatgtaaaaaatgaccatttctacacatagtacaaaatatggtgcaatcagagtaatatctctttaaaattttaaatgtcagcatttagcaagctcaaaaatataaataaacatatattaaatatcatagaaaaataaaatattctcaaaatcagtcccgttttgcaattgcagaagaaagggagtgcctacacacagatgttttacgaaaatagacataaaattgtaattgtttccattcttcttacattaaatatagttgacaaaccatattataattttagctacatttaaaatttatgaggagactatttgctgtcattggagagagtacaaattcttctatatgaatgaaaattcacagtgtatagctactcctttataaaactttcttaaatatttgttaaacaactactaaatgcaaggcactgggaatatattgcagatcaacataactctccctgtctccaatgagtctagacattttgagtgataaaaaagtgaaacagggctagtgaataaagcttgattatagcattctgctatactattacctaattttgtaactatttcttgttccatgtatttgaaatggcataaagcaatatatttgaaaataatattttgagtgtatttctgaatgatgcccaccacttgtagcttatttgctaactgtttatcttttctgtgtccttaataaatgtgtttgtgtcctttcagtaaacccagctcataccatacccattcaggataaatttcagtcttgattatgatggtatgaagaaacattcatactgttgataattacttatattttcattaaaatattaatgccttgtgtgtaaacatagtgtagttttaaaatcctatctgaat

SEQ ID NO: 824 - DNA, 1430 bp, Homo Sapiens
gtttttggtggttcttacagacttgagatggggcttgtcttaaggaaacaaggtgccctgaatctaaagactgactaaaggtggtagaacttaagctatttaggtgatcctgaaaccaacagggacagttatggtattgactagtgggaacttttaagagccataagactggagaagtcaaatgctgaccaattatatcaaacccacctggggaacaaactaagtcaaaattactagggtggctaaaagctgagaaatgaactaggtggcagttaggactgctgaacaaacccatctcaccatagcagagaaatattagaatacacctagagccatgtaaagattcaggagtgctaaaagcatgaattcccctccttccctccaccacccccaaaataagcttctgcctgaatgaaggtaactgggaatctgcaatttttttctttcctgcacaaataaccacttccccttattcaaataaaataaaggatatatctagaaatctgatcatttttaaatatttccagaagtggtctagtttagaactaaggctggttagaccggggcaatgttccaggagtacagaaaggatcttccagggtcttctagataaggaatgtccttcaaatttctacaagaaagtctgcagcatactgcctttcaagattaatggacaggatgatttggttatggttttacttgatgggtggacgtaagttccactaagaggtagactttccactaagatcaaagcttctgttatctaatttataattctaagttagctggggctctgtactaataagattttgaaagacttagtacccacatatcacaattaagctactctcttcctagtatgcagataacaatcaagataatactcagaaattctgtcaaggcttggcactagtcaaaaggattaaggatgtatacagggagaagcatatgtaggcagtgcgataaagataaaaagccatgttgcaacagtaaactggtatcttctgggactaaggacagcatattaacagctaaatgtacttcactctgcttagagctttagtaatacttcagatattgttatagagcagaaaaacaaaaactgccttatttgtgaccttctataattgccctacccaaaattaaaatgaccaaccattacaaacttaaaaggccatcatacatggtatttttaacttctgtatttccttctacaaatcttgtgaaatttttaacttacaagatcttgtcgttctgtcatgctcatcttctctactattgaccagaaccaacgcttgaactgcagaagcttctcagcattttctcctaagaatgaagaatgtaaataaaatatactataccagttgttgttattatctgtagaatattactaatcttcttataataaaaggatacagattaaaacatta

SEQ ID NO: 825 - DNA, 8928 bp, Homo Sapiens
aatttcaccatcctcacctccccacagcacatctgaggcccatctggagaatggttaccagaggctgggaagggtagtgggagattgaggggaggtggggatagttgaactctcgtgagttcaattgttttcatttttagagcccacaaataactaagaacatgcaatgtttgtctttctgttcctggcttatttcgcttaacataatgatcttcagcttcatccatgaagtcctgcaacattttcggtgcccaatgtggggctcaaaaagcgaaagccatgttggttcaccacatgtatcgcatcctgataatgtgaagtgaaaaagtagagcctggaagcctttgtaagatgactgtgccagaggaggaagataaatatctcgatgctatggaggcctgtcagctctttgaagtatctgggcaatatcaagatttctacttcagatgaaaaaacaaatagttattcattgaccctgttgccgccaagaaagaggtgaaaggtgaacccccaacccacggaaagatccagccaagtaaggaactgcaaaatattgaatgactaattctccaaacaaggagaacaagaagatttatactagccatgcaaggaatctttggaagtctaacagacctgacttgaagagaaggctttaaacaagaaattcttcattctggaacagtgattcttaaagtgcggttcagagaccctgggagacactgacattctttcagagtgtgagtgaggatttcctctttgcaactacaatctgtgtaaggttggattttctttacatacataaactaaaataagattgcaataagatgaatgcagaagcagataagagaatccagctgtcttaagttagacttcacagagatttgcaaaaatccaaacaagaccactctcgtcattaaagttattttccatttgttatggtgaacttattttgcaggaaatttgttatttatagtaacatacaattttgttttttgatcattttaaataaattaataaatattataagttttctatttttaaaattatacatgtcagaaaagaacagttctttcaggtcctcaacaattttaagactattaacttgttttggatcaaaaagttctagatttgctattctagacatgaatcctttgaaattaattggcttcataagtatatttttcaagtttgtggcttgtcctgtaaccttctactgtgtagaagttttaaattttaatttaaagaaatttaaaattttttcatttttgtttgtgcttttggtgtcatatttaggaaatccttctctaccttgagttcatgaaaatatcctcttatatttagtatttacagtttgttcttcatctttaggtctataatttattgaaaatatagttttgtatgtgatgtaagctaaagatattttttaaaacttgatatggataacacattttggcaatattattcatccactcattctcccactgactttccctctgccacttacttacctacataagaatttgtcgtggagattctcttttctattcttttagtctaatggcttaattgttgatcaattaccctttttaactattgatgctttagagtaagtcttgatataaagccatgtaagtcccttgaattagtctcccacttttccttcttaaaaacattctgggatcttcttggcctttaactcctctgacttaattttaggatcaatttctcagattacattaacaacctgttcaaattgcatagattttataggtaaatctgtataaaatttacatgttataatattggggctttttattcataaacattttcaccaacgttttagtttcatatcttccaataagattttataatttttcatacctatcttagatgattttggttgcatttattttttatagttttagttttattgtcaatgcagctttttccaattcaattttataacagttttgctggttaaaaaaaaaaaaaagactatttattttgtgtattggtttttaaattgtacaatgtttctgaattttcttacttccaaacagtcgtctataaattatcttgattgtctaaaatgtgaaattcatatactatgagaatgataattttattttttcattttcaattcttaaacttctgatgacacttggctggaacctccttcactaggttgaaaataagtggcaacagtggtatccttgttctgttattgattccaagagcctgcctctaatgtttccccatgtattatgatgtttgtgtaaattttgatagaccttatttattaagtaaaaagattctcttctagttcaagtttggtctacaagtttttattgtgaaagtgaactgaattttagaaataccttttaatgtgtataaaaaattatatctttatttctgttaatgtgataaattacattaagagattttattaatatttggttatctttgtatttcaacaattatttggttatctttgtatttcaacaattatagtcatattattaaatattaatttggttagctaatattttatttttatgattttgacatctactttcataagtaactttatttttaactggttttactgccaaggttatactctcatagtaactgggggtttgttacataggtatacacgtgacatggtggtttgctgcacccatcaacctgtcatctacattaggtatttctcctagtgctatccctcccccttacctccaccccctcacaggaaccggtgtgtgatgttccattccctgtgtccatatgttctcgttgttcaactcccacttatgagaacatgtgtggtgtttggttttctgttcttgtgacagtttgctaagaatgatggtttctagcttcatccatgtccctgcaaaggacatgaactcatccttttttatggatgtataatattccatggtgtatatgtgccacattttctttacctagtctatcattgatgggcattcgggttggttccaagtctttgctattgtgaacagtgctgcaataaacatatgtgtgcatgtgtctttataatagaatggttcataatcctttatgtatatacccagtaatgggattgctgaggccaatggtgttcctggttctagatccttgaggaaccaccacactatcttccacaatggttgaactaattgatacttccaccaacagtgtaaaagcgttcctgtttctccatatcctctctagcatccattgtatcctgacttttaaatgatcaccattctaactggtgtgagatggtatctcattgtggttttgatttgtgtttctctaatgaccagtgatgatgagcttttcttcatgtttgttggctgcataatgtcttcttttgagaagtgctcattcatattctttgctcactttttgatggcattgtttttttcttgcaaatttgtttaagttctttgtagattctggatattagccctttgtcagatggatagattgcaaaatttttctcccaatcggcaggttgcctgttcactctgatgatagtttcttttgctgtgcagaagttctttagtttaattagatcccatttgtcaattttggcttttgtgcccattgcttttggtgttttagtcatgaagtctttgcccatgcctatgtcctgaatagtattgcctaggttttcttctacggtttttacggttttaggtcttgggtttacgtctttaatccatcttgagtgaatttctgtataaggtgtaaggaaggggtccagtttcagttttctgcatatggctagccagttttcccgacaccatttattaaatagggaatcctttccccattgattgtttttgtcaggtttgtcaaaggtcagatggttgtagatgtgtggtgttatttctgaggcctctattgtgttccattggtctatatatctgttttggtaccagtaccatgctgttttggttactgtagccttgtagtatggtttgaagtcaggtagcatgatgcctccagctttgttctttttgcttaggattgtcttggctatgcgggctctttttttgttccagatgaaacttaaagtagtttttttctaattctgtgaagaaagtcaatggtaacttgatggggatagcactgaatctgtaaattactttgggcagtatggccattttcacaatattgattcttcctatccatgatcatgggatgtttttccatttatttgtgtcctctctgatttccttgagcagtggtttgtagttctccttgaagaggtccttcacatccctcgtaggttgtattcctaggtattttattctctttgtagcaattgtgaatggaagtacactcataatttggctgtttttctgttattggtttataggaatgcttgtgatttttgcacattgattttgtatcctgagactttgctgaagttgcttatcagcttaaggagattttgggctgatatgatggggttttctaaatatacaatcatgtcatctgcaaacagagacaacttgacttcctcttttactatttgaataccctttatttctttctcttgcctgaacgccctggccagaacttcccatactatgttgaataggagtcgtaagagagggcatccttgtcttgtgccagttttcaaagggaattcttccagttattgcccattcagtatggtattggctgtgggtttgtcataaatagctcttattattttgagatatgtttcatcaatacctagattattgagaatttttagcatgaatgggtgttgaattttgacaaaggccttttctgcatctaatcatgtggtttttgtcattgattctgtttatgtgatggattatgtttattgatgtacgtatgttgaaccagccttgcatcccagggatgaagccgacttgattgtggtagataagctttttgatgtgctactggattcagtttgccagtattttgttgaggattttcgcaccaatgttcatcagggatattggcctgaaattttctttttttttttgttgtgtcttggtatcaggatgatgatggcctcataaaatgaggtagggaggattccctctttttctattgattggaatcgtttcagaaggaatggtaccagcttctcttcgtacctctggtagaatttgactgtgaatccatctggtcctggactttttgtggttggtaggctattaattagtgcctcaattttagaacttgtcgtctattcagggattcgacttcttcctggtttagactttggaggatgtatgtgtccaggaatttatccatttcttctagatttcctattttatttgtatagaggtgtttatagtattctcagatggtagtttgaatttccgtgggatcactggtgacatcccctttatcattttttattgcatctatttgattgttctctcttttcttctttcttcgtctggctagcagtgtatctattttgttgatcttttcaaaaaaccaggtaatggattcattgattttttagaagagttttttgtgtctctatttccttcagttctgctagcttttgaatttgtttgctcttacttctctagcacttttaattgtgatgttagagtgtaaattttagatcattcctgctttctattgtgtgcatttagtgctataaacttccctctggtactttgagtctgtgttctcattgctttcagagaatatttacccagtaagtcattcaggagcaggttgttcagtttccatgtagttgtgcagttttgagtgagtttcttaatcctgagttctaattggattgcactgtgatctcagagactgtttatgatttctgttcttttgcatttgctgaggagtgttttacttccaattatgtggtcactattagaataagtgtgatgtggtgctgagaagaatgtatattctgttgatttggggtggagagttctgtagaagtctattaggtctgcttgttccagagctgagttcaagtcaagtcctgaatatccttgttaattttctgtcatgttgatcagtctattattggcagtggtgtgttaaattgtgtgggagtctaagtctctttgtaggtctctaagaacttgctttatgaatccgggcgctcctgcattgggtgcatctatatttaagacagttagctgttcttgttacattgatccctttaccatatttaatgcccttcttcgtctcttttgatctttgttggtttaaagtctgttttatcagagactagaattgcaactcctgctttttttttttttttttttttttttttttttttttttttgctatttgcttggtaaatatccctccatccctttattttgagcctatgtgtgtctttgcacgtgagatgggtctcctgaacacagcacactgataggtcttgactctttatccaatttgccagtctgtgtcttttaactgggggcatttagcccatttacatttaaggttaatattgttatgtatgaatatgatcctgtcattgtgatgctagctggttattgtgcctgttagttgatgcagtttcttcatagtgttgatggcctttacaatttgttacgtttgtggtaccagttgttcttttccatgttcagtgcttccttcaggagctctggtaaggcaggcctggtggtgacaaaatctctcagcatttgcttgtctgtaaagaattttatttctctttcacttatgaagcttagtttggctggatatgaaattctggcttgaaaattcttttctttaagaatgtcgaatatgggcccccactctcttctggcttgcagggtttctgcagagggatccactgttagtctgatgggcttccctttgtgggtaacctgacctttctatctggctgcccttaacattttttcgttcatttcaacctttgtgaatctgatgattatgtgtcttggggttgctcttctcaaggagtatctttgtggtgttctctgtatttcctgaatttgaatgttggcctgtcttgctaggttggggaagttctcctggataatatcctgaagagtgttttccattctccccatcactttcaggtacaacaatcaaaggcagatttagtcttttcacatagtcccatatttcttggaggctttgtttgttcctttttattcttttctctctaatcttgtcttctcactttatttcattaagttgatcttcaatctctgatattgtttcttctgctttattgatttggctattgatacttgtgtatgcttcacgaaatttttgagctgtgtttttcagctccatcaggtcatttatgttgttatctaaactggttattcatgttagcaattcttctgaccttttttcaaggttcttagcttccttgcatttggttagaacatgctcttttagctcagaggagttcgttattacccaccttctgtcaattcgtcaaacttattctctgtccagttttgttcccttgctggtgaggaggtgtgatcctttggaggggaagaggcattctggtttttgaaattttcagccctttcgagctagtttctccccatcttcgtggatttatctaccattggtgtttgattttggtgaccttcggatggggtctctgagtggacgtcctttcttattgatgttaatgctattcctttctgtttgttaatttttcttctaacaatcagaaccctctgctgcaggtctgctggagttttctggaggtccactccagaccctatttgcctggatatcaccagcagaggctacagaacagcaaagattgctgcctgttccttcctctgaaaacttcatcccagaggggcacctgccagatgccagccagagctctcctttatgaagtgtcttttgtcccctactgggaggtgtctcccagtcaggagacgtggggtcgggacccacttgaggagtcagtctgttccttagcagagatcaaatgctgtgctgggagatctgctgctctcttcagagccatcaggcagggatgtttaagtctgcctaagctgcactcacagtgccccttgccccaggtgctctgtcccagggagatagataggagttttatctattagcccctgactggggctcctgccttttttttcacaaatgccctgcccagagaggaggaatctagaaaggcggtctggccacagcagacttgctgagctgttgtgggctctgcccagtttgaacttcctggtgactttatttacactgtgaaggtaaaacagcctactcaagcctcagtaatggcagacgcccctccccagctcgagcatctcaggtcaacctcagactgctgtgctggcagcgagaatttcaagccagtggatcttagcttgctgggttctgtgagtgtggcacctgcccagccagaccacttggccccctggcctcagccccctttccagggcagtgaatggttctgtcctggcagtgaatggttctgtcctgctggcattccaggtgccattggggtatgaaaaaaagctcctgcagctagctaggtgtcttcccaaattgccacccagttttgtggttgaaacccagggccctggtggcggaggcaccagagggaatctcttggtctgcgggttgcaaagactgcgatgtatctgggctggagtacaccgttcacagtctttcacagcttcccttggctagggcagggaatccctgaccccttgcgctccccaggtgaggcaatgccccactttgcttcagcttgccctccgtgggctgcacccactgtccaacgagtcccaatgaaatgaattgggtacctcaattggaaatgtagaaatcacccatcttctgcattgatctcgctgggatctgcagaccggagctgttcctatttggccatcttgcccagaatctcaa

SEQ ID NO: 826 - DNA, 2221 bp, Homo Sapiens
acagaagtggttgggcgtcgtgaggaacgcatcggcggcagaacactcaagcggctggttgttgagagcacgccagctgaagagcacccctgcacactggcaggccatccacaggtgtcagaaactcagctcagctggaagaaacttgatgtaccaggtatcagagtagcaagtaaagccacaagccaaaaatgaaagagaatcttttaagtgcttatcgtgatggtgtaagtaattgtccaaaagaaacgccgattccttctgttccatttttacctgtggattgtggattgaaataaccattggaccatgaggagagactctgaagagaggctagtgatatgtgatataatactcttttgtgacgttggaccatggcagtgagccgcagctcccagtcagcaatgcgatcccaagaataaacaaccgattcttgacagtgtcctatgttgccagtcgattttgttcaacagtaggtacatatcacctgtagacccaaaacaacttcaaatagccatttccttcactgctgtgagcagatgtagacagcctgctgtgttaatttcctaaggctgctataacaagtaaccacaaacccggtgtctgtattagtccattctcacactactataaagaactacctgaaactgagtaagttataaagaaaagaggtttaattgactcacagttccacaggctgtataacaagacatggctagggagacctcaggaaacttacaatcatggcagaagggtgaagaggaaacaagcatgtcttcatatggcggcaggagaggaagagtgaagggagaagtgttacacacttttaagcaaccagatctcatgagaactccctcattatcatgagaactccctcactatcatgagaacagcaaggggaacatctgcccccatgatccaatccccttctaccaggtgtctcccccaacactgggaattatcaacgttgggaattatcacataaaatttgagtgaggacacagaaccaaatcatatcagtggcttaagacaatagaaatgtattatttcatagttcaggaggccagatattcaataggaaagtgatggcatgattgatttcttcaggaggctttcaggggaaatctttcttatcttctggtgttttctagcaatccctggcattccttgactttaagcagtgtaactccaatctctgcctccttgtaacatggtattctttgctttatgtgactgtgtattcatgtagccttcttacaaagataccagtctttgggtttaaggtccacattaatccagtatagtatgacatcatcttaactaagtgcatttgcggagaccctgtttccaaataagttaacttaggatctaggtggacaagactttctggaggacgcaattcagcccagtacatttgtttactgattatatatctatacacacacacacacacacacacacacacatatatataatatatattatatatacacacacagacactatatgtttatacatacaattatacatacaatatatagtataattatatatacatatagtgcattatatatgtataattgcaagtgtgtgtgtgtatatatatatatatataattttttaagggaataatgagttttgcatctgccataaaatcttttattcttcttgttagtgtaaacaaatgggagaagaaataagatttgacaaatatgccagggcaagattacagaaggacatatacattgtggtaaaaataataataataataataaaagtgattgctactttatggcaagaaggagcaataaaaatttgaaagtacttatgtagcatctactctgtggcaatactatacaagaatattctgaagagaggataaggagttaaaaagaaacatggcttgatatgtatcacagttcaaaaggaaaccattgtccattggtaaacgtagcacatttgggtttgttaagcttgaaattgaaaaaaaaaaaaaaaaaaaacaggtaaaaaaacaggtctagccaagctgaaatatacctagtgtaaataaaataataggatgaagtcccatgatatctcagtaagaaggcataaatacatgatcagggaagggattcagagctctgcaacattggcaaggtttttaccacaattatggtatttcttggcagaaataaaaaaattgggatataaaatgaaacaggcagttagagttata

SEQ ID NO: 827 - DNA, 4000 bp, Homo Sapiens
gtcttcctcctgctctgtccaggaggaagaagtgcctccttcctctttgctttctgcctgaattgtaactttcctgaggcctctccagcctgcttcctttccagcctgagaaaatgatgaaacaaagcagagaggaagaaaatcctggatctgtcttggccaatggttggagaaaaaagggtagtgctacctaagaaaatttaaagcaacatctgtcaataaaatctgttaaaagagtcaaggacactgtatttttacaaattgaaggttgtggcaaccctgcatcaagcaagactattagcaccattttttttttcacatagcctatgctcatgtgtgtctctgtgtcacattttggtaattcttgcaatatctcaagcttttgcattattgctgtatctgttatggtgatatgttatcagtgatctttgatgttactatcgtaattgttttggggggccatgaaccatcctctataagatggggacttcataaataaatgttgtgatgctttgactgctccactgacaggcagtttccccatctctctccctttcctcatgactctctattccatgagtcacaacaacattgaaactaggtcagttaataaccctattatgacccctaagtattcaagttaaataaagagttgcatgtctctcacttcaaatcaaaagctagaaattagtgagcttagtgaggaaggcaagttgaaacctgagataggctgaaagctaggtcctttatgccaaacagttaacctagttgagaatacaaaggaaatgttcttggaggaaattaaaagtgctactccaatgactacacgaatgatacaaaagcaaaaactgccttattaccaatatggggaagtttgagtggtctgggtagaagatcaaaccagccccaacattcccttaagccatagcttaattcggaaaaaaagcattatttctcttcaagtctatgaaggctgagagaggcgaggaagttgcagaagaaaatttgaaagctaacagaggttggttcatgaggtttagataaagaagccataaccataacataaaagtaaaaagggaaaccacagtgctaatgtagaagctgcagcaagttatccagaagatctagctaagataattgatgaaagtggctacaataaataacaaattttcagtgtagacaaaacaatcttctattggaaaaaggtgccatctaggactctaccagctgtagaggagaagacgttgcctggcttcaaaggacaggctgactctcttcttaagggttaatggagctggtaaatttaagctgaagcaaataactcatttaccattccaaaaatcataggactcttaagaactatactaaatctactcttcctgtgctctataaataaaacaacaaagcctagatgacagcacatctgtttacagcatactttactgaatatttcaagctcactgttgagacttactgctcagaaagaaagaatcctttcaaaatattactgttcattgccagtgcacctgggcacccaagagctctgatggagatgtacaagaaaactaatgttttcatgcctgctaacacaacatccattctataactcatggatcaaggagtatttaggctttcaagtcttgttattcaagaaaaacattttgtaaggttataactgacatggatggtgattcctctgatggatctaggcaaagtaaattgaaaactttctggaaaatattcatcattcttgaagccattaagaacattcatgattcacgggaggaggtgaaaatatcaacatttataagagtttggaaggagttgattttaattctcaggtatgaatttgagggcttcaagactagtggaggtagtggctgcagatgtaatagaaatagcaaaagaaataaaattagaagtggagcccaaaaatgtaactgaattgttgtaacctaccgataaaacttgaacagataaggagttacaaacaagtgaaggattggagaataggtcaccctacaatatgcctctttggcataagaattattttgtcctgaaggcagttgagaagaaacagatacagaaaagctctctaccttcctcctatttgcctaaaggcaggacacaaatttacaaaggtgttcctcctctactctttaccaggaagggaaaacattgatcacagaagacaaatttagactctcatcagcccaaacagatggaagctgtataataagctttactaagtagactttatccactattagttccccagttgttgccttcctacaattggccactcctagaagctcaaggcccttttcctgtgtcttgtcattttctaagaattttttgttctttgttgaagatgctatgtaagctagagttctaagccacttctataagagttactcactccctgggtatctccgacatatacatgaaatacacatattaataaataggttaggatcagaatcctgaaagacacaattctgactgccataacctcaaatattgacattcctgaagatcaaaatccctaaagtctaacatccctagcatctaagatccccaaaatcacaatcacggaatagttttatcatgttaagtagaactactaacttgttattgcctttatttggaaattaagtatggctaaaaagatgtgtatgagtgccaatttgacaagaggtggacttaattttagatgtcagcttaagtggatttaggaatacttgaaacttggtaaggcataaacttgtctgtgtgtctgtaagagtgtttccaaagaagattcatgtgtgaatctgagtggactaggtggggaagacctgccctcaacattggtggacaacatccaatttgctagagtcccagagagaacaaataccaagtaaattcattctctctgagagctgggacagacttttattctgctgtcttggacatcagagctccaggcttgccaacctttcaattccaggacttacaccaggggtcccaggggcctgaggctttcagctttgaactgagagtaacaccattggttttcctggttttcaatgtgaaaacattaaaacttcctcaataaataaagaaatgttcttatcatacacctgcatttttgaaagataaaatttctccaggtctcagctctttgggtgactgcatatgcattgatgaccctttgaggtttttgatcaatcttgtcaaaagtcttcatctgtccatcacagcatttcagataatcgcaggcataaagctgagtgcacaaaattgccaaccatactgataggcatttatacattttgttttttcacttatttctttatgaacatggttcatttgctagacactcatgtgcctgtcatttgtatacccaagtttacgtttgaaacaatatgtgttatattgccgtttctgtcgtgtaaattatgtatgacatgttctgatgtgttttatatgtttcccaaataaactgcctttttaaaatgtaaataaatgtcttttaacaaatttttaaattattttttccagagttataatttcagaaatttgatcacgtgggatttcaacattcaggattatgacattcagaattgcacctcttgggattaaataagctcctttaataaacttctatttgtttttctatttctaatatgaaagaaacagtaaaattggtgacagtaagagatttcaaagttaaagtttttaaacaggttaaatatgatacaatttcagatacaaatgaaagtaacttttttgacacaaaatagtacatataattctagactaaaattttgataatcagtataaataatgatttatataaaattatgttattcaaatacaatcaaggagatataaaaatatgaatacaacacagaaggaattacaaaagttgccagagatagaaggagatttgtacaagaatattcattactgctgtgtgtgtagtgctaaattattggtcctctagaggagactggag

SEQ ID NO: 828 - DNA, 829 bp, Homo Sapiens
ccagcttggagacaacatgtggttcttgacaactctgctcctttgggttccagttgatgggcaagtgggtgagtgatctctaactcagcttctccttctatgccactttcctacttccaaaggatgggtcctattaacctgcagaagagcatatagggaaagcagagaaagaagaaagatttataaattatgtaaaatctcccatattcagagcatgattttcataaaaactatgatttgtaagctttctttctaaagttttctgaatgagctctttcctctgagcgaaatgcctgaatgtatatataacagcaggaaagggccagaattgcacaaacactaaagtagtctgctgacactgaagtagtctgctgggtttcccaacatcccctaaaccagtcccctttacaagaaagcagagtgggttttttctcctcagaaagagccaggcaaatactgaaggcttcaaagagaggagtttgaacctccgtttccaatgtacaagctgctgaagccctgcaatgtactctcagagacagtatagctcagaggataaggaaaacagctccgcttggcttgcccaagtctaaaaccctgcttcattgctcccaacagaaaaacctacatcagtaatttaatcctcaggagccccagattcccaacacccagatgaggatttaataacaatgaacagaggtctctgcagcaggaggacactcttaaaggctggcttttgtaggtttccacttgcctatttttcaaataaatctaaatatgtatttttcccttgtgctatccacaaaagcctcaccagttgctcagagccctc

SEQ ID NO: 829 - DNA, 2056 bp, Homo Sapiens
atggcaatccaacagcagaatgggaggataaaataatcagaactagagatagctgaagcagccatcttgtgaccacaagcaacggactagtaggggaagagtcgacacactgaagagaagaaagcaagtgtttttttctagaaagaagaaagagaaaagtggattctcaactagaagcaaaaacatccactgaagtttgtgagagtgcaataggcaggtgccacagatctttctgaggaagtactaccatatgacttcaccttctcaggctgaggtatcagcttgactgtcactccacagatcaagactagaggtaaatgtaaacactatacaggtgggatgagaaacagctgttcagctgcctggctagaagaacaggcccagttctttgctacaggatggacatggaaaagttcaggcatttgaagttactggcgtcagccacatgagattgatgacgggattggcttctacaagaggtccatgtggttctcatttctgaaaacagatgtttggaaaccaatgttttcaaagataatatgaaactacaccaatatgctgcactatggagaaaaactaaccttgacagaagaaaaaagattttcttgaggcagaagatgaaggactattggtcgggacattcacagaagtctgttctgtaagttgggttatatggaagcagagatgctaggtcaacccatgttgtgccctccctcttttggtaagcaaaacactgatgcttatgacatcttccttttctttggtggtggccttgaaaattgttattccttccagaaagggctggatgtcactcgcttatgaatttgaatccttctctttttgccaaatgatagaactgagcttgctccatgagcttcatgtgtgtaaacattagtggggatccaagtggctctgcaggtagaatagacactcaggtccctcctgcccaagtccaggggcttgcttccatgaatccaatcctttagttcatatcagttcatggtgtaccagaagcctcaacacatctgcaaatttttacagaacatgtttgtgcaaggaaataaattaggtcaccaggccttcaaaggctccttccacttaggggtggtggagcccatgaagctgagaatcacccttgccagctgttggaacttgaaataatcctccaaaaacctcttgctattttaggagggtcatcctggtgggtctgtgtatgctgtaaaagagtggctcactatttaaccacccatctctactgtgctgatttagggaccacgatcacttgagcttttcttggtgcctgggatctgtctttctgcacagggataatctaggcttatttgtggcttttttcccctgcatttcctttacttgctcactttccttcttttcctcactatgtttccatttgaaatcagttttcacatatgcatttcagtgcaactctaccttcaggaacttactggattacacaggaaattccttatagtgtgtgaccatctgcactgcaaacaattttcagggaattgactagctactaataccacttacaaaaaatctaataaggggtttaacattttcataaggaaaattaatatttatattttctgttttggttgggttacatttttactattttgagaaaaaaagtattgcatttttaaaaagtgaacaaaaaaagctctcatacaattgaatggtattgccaaaagaaattaagaagtcagaatttgatgattcaatatattataaatatatttttgaccatagtcctaaactatcatctgtcaagttgtattattttgagtacataagtatttttcatgttcttatttgttttctataatgcctcataacatatatagctctgtgagtctgttctttcagaagatcttatctcttgttagttttcaaggatttccaggttcacagcagctgactttttactacacattttatgactctaaaaccattagaagaacatcaatgcttccctaaattggttttttggagaaaatgtaatatgtttgatgaattcaaataaaaagatggaaac

SEQ ID NO: 830 - DNA, 1798 bp, Homo Sapiens
acccccaatgtaattctgtataaactcatgaatattattttggatggtaaagcttcagtgagttttataatggttgattctcaactataaacatgaattatccagatcatttaaaatattaaacaaacttccttctagaatatgcttttaggcatcttctcttgaccatcaagtttgtgtatgttcaaggatacaaactttctaaaggcttaaatttttgcatttttaggaaatgatgcaaaatgaatcatatagtatactttgtaaccaaataacgtttttattatacatacttctgtcatattatttctattgctatttttttaggcaggaaatattaaaaagtgaataaactttttctgtcgtaatatattaatgatttcttcaacaaggaatatggcctatgagtaattacaaatcctcattactatgaatttgctatatttatatattgcttcacagtttagaaattacttttatatcaattgccttatttgttacttagcagcaacctaaggttattttgaataaggtgtgcaggggtcattatctctagtttgtagaagaataaactgaggttcagaaaggttgtgactttctcagggaaacaatagctattaaatggtggagagggaactaaagttctagttgtctatatttttttaattcctttttttttttttgagaccagatcttgctcttttttttgagaccggagtgcagtggcacaatcagtgcaggcttgacctcctgggctcaagtgatcctcctgcctaagcctcatgagtagctgggatcacaggtgtgtgccactatgcccagatgattttcaaaaattatttgtagaaacagggtctacctatgttgcccaaactggtctcaaactcctgggttcaagtgatccttccaccaaagcctcccaaagtgctgggattacaggtgtgagccactgcactggcttaaagctctagtttttttttcttttttttgagatggagtctcactctgtcacccaggctggagtgcagtggcgcgatcttggctcaccatggcctccgcctccccaattcaagcgcttctcctgcctcagcctcccgagtagctgggattacaggcgtgtgccaccatgcctggctaatttttctgtgtttagtagagaaggagttttgccatgttggctggtctcaaacttctggcctcaagcgatcggcccgcctcggcctcccagagtgctgagatttacaggcgtgagccactgtgcctggccaggctctagttttttaaaagacattttatcatggaaaatttcaaacatgtatagattaaacagaatactgtacacctatgtacccatcactcagccacgacaattattgatatcccaccattcttatatcatctatacatccaccaactctcagccccacgtgatgataatgatggtgatttttaaaaatttttaagaagtttacctatactgaaagcactagtcttagctatacagtcttgacaaatggttatacctatgtaactcatacgcctatcatgatagttctgtctctccaaaaaaaattcctgtatgtccttttgctgtcaactccccatcctgcccagaccagggctgttttgacttttttttttttccactggagactacttttgcttgttcttgaacttcttatgaatcaaatctctctgtatgtgttcttttgtgtgtggcttcttttattcagattcaagtctgtaaacgtctggttttttttaatcaggaatataatactatttgttgagtctggag

SEQ ID NO: 831 - DNA, 1893 bp, Homo Sapiens
ttttttatagagacatgtcttgctgtggttgcgcaggctggtcttgaactcctgggttcaagcgatcctcttgcatcagcctcccaaagtgctgggattataggcatgagccactgtatctggactcacttagaggagtctaatgtgaatggcccaatatcttccaataagaaagtcttctgtcaactctactaaaccacagatttaatcagaaaagtggcatttccaagtttttatttaataaagttcatgttgaaacttgggtagggaaaattggtaaataagtaggtagatggacaggacctggtggccagttatatttgattaatgataggaaagaagtatctaggtataatgcctgggtttttaggaaactacgagggttgatagggtcagagaaaatatatatgtagtgttagaagaaccttggtgaaaccaaccttttaggtgtaaaggattaagtagattcaaaagatactgcattttcagaagtcaaaaactagtggagagtggtaatcgcaatggaagaaaatgccaagagggaaggagaaagtgacctagatcagaaagacttaggaaggtcaatgcaaagtgtgtttattagatttgttaattgccaaagccttaagatagaatgagattgccttcattcactttcagcaaagccaagggcgttgtctttcccttttcatatctgggacctcattttatttcaattttatttgtctcaaatcaagatagtaggaataatgaattactgttcattctgattttttggtacttgcaaaagtatgtgtatgtttttaaacactcccccaacttccagacttttataagattgggaaaatagcacagataatgtaatactgattggccttagagccagtgaccctggacaactcacctaacctttctgagtttcccatatttccctttttatcttccccttcacttacatgggtgaattacaaaaaaagttttactaccctaacatcaggaaggtcattataatgtagtagcaaagagcatagactctaaagccaaactgtctctttgtgaatcttggctctgccacttacctgtgtgtcctggggaaagttaactttatgggcccctgtttcctcaactgtgatattaggatactttcagtgttcacctctaagagttgtagggagtcaacgagtaaacacatgtaaggcaccttttagaaagctgcctcctacatagtaacctttctaaatctttgctgctgttaccattatgacattatcatgataccagtatcatcctcagtcaacaaacgatagataactcagagaatgaaaaggttgttcctttatatagtttccctagaatcaccttgtaccactgctgctgagttgcaatcattcgttagtcgtatgtgacctagattccattttctaagattattcaacaatgtagaggatcagcgtagtggaaatacgtctataaacatttctaagaattgaattcattgtaattaatagcatcagagaagctgaaaatccaaagagctaatctcttaacttcatgatggaggacaaagattttatcttttggaattttaataatgtttccagcatgagattagccttcaatattgatttctggaattctgttttcccttgtttttcattgattaacctaaaacttttgagatgtagttcatatttttggtaatattgctatgattatataactgtaactgtctagaatttaatttctagcaagggaaatttaagccttttcctcagaattatttttcatgggaaaattcttactgatagattactggacttgagtcataatttattggttatcttattctgccctatctactctcagcactaattataaaaataatcaaagaaa

SEQ ID NO: 832 - DNA, 5883 bp, Homo Sapiens
gcagaagacgcggccgccacggctcaggcacacgcgggcgcccgggggctgcgcggccgcgccgcagaaggtgaaggaacagcgcgaggcacgcagccgccgcaccgtggcgcgcacgagctcagccggccggcgaccccagcgcgcccacaggacagtggcagccggaaagtgggttcctgcatggtaacaagaccttaaaattgtgtcactggagaaggacgtgcagttcccgctgaggagagacttggccactccaggacaacacaggactacaagtcaggaatttgaagatgaaaagtgctcaacagtgataaatcctaaatgtttcactgaacaacctttcagatagccttcttgaagtttgctgaattatggctataaggaccactccccacccctgctagatgaagtctcacttgcccaggttggagtgcagcgcgatctcagctcactgcaacgtccgcctcccaagttcaagtgattctcctgcctcagcctcccgagtagctgggattacaagcacatgccaccacacctggctaatttgtgtatttttagtagagatggggtttcaccatgttggccaggctggtctcaaactcctaacctcaggtgatcgtcccacctcagcctcccaacgtgctgggattacaggcgtgagccaccgcgcccggtcagactagggatttagaagcaagactttgtcatttataagaacactgcagaaaggaacaagaatgacccagctagccactgaagaccacctctgaaacccatcaacatgaccggctttctataggaaaagtctccacagactcaaaaagtctctagtttcttgcccttaggaaggcatgccctgggaataatagtttggggacaagagagagtagagtgtttactgtcctatcccccattaaatacatggcagaacttccccagggaaagcctatcatactgacattaactcagtacctgtttgaacttggagagcattcagaattctcatcagtcaaatggccagagctgagaaggatagcttgttttgtttgtttttgagacagggtcttgctatgtcacccaggctggagggcagtggtgcaatcccgactcactgcagcctcgacctcgtgggctcaagcaatcctccctcctcagtttcccaaagtgttgggattacaggcatgagccaccacacctggctaatttttgtattttttgtagagacaaggttttaccctgttgcccaggctggtttccaactcctgagctcaagccatctgcccaccttagcctcccaaagttgtgggattacaggcacatgccaccacacctggctaatttttatatttttttgtagagacaggattttgccatgttgcccaggcttgtctcgaactcctggattcaagcaatctacccgcctcggcctcccaaagtaccgggattacaagcgtgagccaccgtgcccagcctgggatactttctaagaaccaaggaactatgtagaaaatcttcgccgggcacagtggctcacgcctataatcccagcactttgggaggccaagatgggcagatcacgaggtcaggagatcgagaccatcctggctaacacagtgaaaccccgtctctattaaaaaatacaaaaaagttagccaggcgtggtggcgggcgcctgtaatcccagctactgaggaggctgaggcaggagaatggcgtgaacccaggaggcggagcttgtagtgagccaagattgcgccactgcactccagcctgggcgacagagcaagactccatctcaaaaaaaaaaaaagaaagaaaagaaaatcttgatctctattcagtaactttaatacgtatattaacatgttcttgtttttggaacaatcgtcaaatcaagcaaaaagtaattttattttgttaatcaaaataaagagaaaagtagacaatatttagagcatcaaaagaatttaaattagaacatctttaactattggaaatatgcatttgaactcatgtctttaagaggaaaataattatctttcctagctctttcactgagatggcctcagagtagccttaccccaagatgcacctgagtgctcagattcttgaatgggtgctcttctcctcattacaaggaactagaaatccttggagaaatcactgattctggtgttcaagagataccagataagctggaacatcttatgctaggaagcaggagaagcttcaaagaaaaataggtccaggcagaaggatgcaggagacaagctagaagtgccaaatcaggacgatttgagtatcaaattgaaatacacccaattatgaaggtacccaattttcaagagccggctgggcgcggtggctcacacctgtaatcctaccactctgggagactgaggcgggcagatcacctgaaatcaagagttcaagaccagcctgggcaacatggcgaaaccccatctctactaaaaatacaaaacttagccaggcgcagtggcatacacctgcagtcccacctactcaggaggctgagccaggagaatcacttgaacccaggagacagaggttgcagtgagccgagattgcaccactgcactcaagcctgggtgacagaaaaagactccatctcaaaaaaaaaaaaaaaaatgaagagccatgaaatccatggttatcctcaataaaatttaaatattcgaaaagaatgtaggataaaatgtgttactgctgagtctcgttatttggttatgtttgtattgattcatttgttgtattgataaagattagtaggtggcaaattcttcctttagaaggttgtttgtgacccaagagggcatcaatacaaagaccctaaagctgggattccgaagcacagagtcgcgggagagaaccaaagctcatcgcatctggtttaagactccttcagagttggatcagcctaaaaacaggacatggtacaagattttattcattccaaagattgtaaaaattaaattcatcctgagaatttatcagtctatgtgggagctacagacttctatgagcaagcagagtacctggcattcctgaccatgctatttctaccaatcaacaaaaactactagatactcagaggggatttaatacagagagctggctacaacatgacaaaacaccagacaagggagggcactgtggctcatgcctgtaatcccggcacttcgggaggccaaggcgggtggatcacctgaggtcaggagtttgagatcagctagccaacatggtgaaaccccgtctctactaaaaatacaaaaaattagccgggcatggtggcaggcacctgtaatcccagctacttgggaggctgaggcaggagaatcgcttgaacctgggaggcggaggttgcagtgagccaagatcatgcccttgcactccagcctgggcaacaagagtgaaactccgtctgaaataaataaataaataaacaaacggacacacaccacagaagggacagtgaggcaacccagggaatagaaagagcagaagccgcgaccctctgtagggctgagggcacacaacacaggtcaagttaccgtcgcccgggatccagggtcccctggtggaagctggaacccacagatcagtgctgtgggagatggagccacagagaaacaactgctgctggagacatcagcaggggaagaaggcggaaaaatactgtagccgctccacacctccagcccaacgccccatggcggaacttcactagaggccccacggcagaagagcctccaggaacctccttgtggaccagaggagagagatagagaggcggcaggaggcaagggtgtgtctaagacaaacaggccacagccagcccctggccttcctgaaactcctcccttgggttcttttaaaattcaatattctgcttctgttccagggttaatgggctgaactgtgtccccccaaattctaatgttgaagttctaacccccagtacctcagaatgggactgcatcaggagacaggtactttaaaatagtcattaaggtaaaatgaggtcaccacctaatctgttatgactggtatccttataaggataaaatagtcattaaggtgaaatgaggtcatcacctaatctgttatgactggtatccttataaggagaggagactagacacagacatgcacagggggacaatcctgtaaggacaaagggagaagacagccatctccaagccaaggagagaggcctcaggagaaaccaaccccgcccacaccttcatcttggacttctagcttccagaactggggaaatgaatttctgttgttgaagccccagtctgcaatacttagttatagcagcccttgcgaaccagcacatccaagttctccgtctctgtctctaacccctctctcaactgtcggccataagtgagcctctgcccccaacttctggcctcctctatgttctcttccttggtgacctctggcagtgacgctcagtcctcatggccagctctggcctctcccaggctctggcgccgcaatcatctcttccacttgtctctgcttggatagtctgtcagcatctcaaaggcaacatgaataaaaccaaatgcattttttcctcccacaaattatctctttatcctgatttctcttatctctgttcatgacttgttcaccttttcactaggacccagaattcatgcatcttggagtcccaacttctccagcccctgtgtcttgtttatttccatagcagttggtaggcgggacctctgcacagtctcacatggtcccttctttctagtccaggcccagctcagccctcaccagaacaggcactagcacgacagcctgctggatgattcccggtgcccgtcccctgtttcccacggttctgcctcatccagcacactctgcacttgactgcctaaagcacagcgctcatcccatcactcctgcttctcaaactcctgcagtgcctgcccccaccccagaaagtgcaggcagtcttgcctggcattcaagaccttccactgagcctaagcaacatagtgagaccccatctctacaaaaaatttaaaaattagccaggcatggtggcacgtgcctatagccccagctacttgggaggctgaggcgggagaactgctggagcccgggagttccaggatgtagtgatccatgttcataccactgcactccagcctgggcaacagaagagaccccatctctaaaaagaaaagaaaaagaccttccattggacccacctaaccgggtctccctcattggcagccattcacttattccacgttcattctgcacctcctgcacacgaggtgctatgccaattactggatacatttaatccctcaacaactctgcatggtgaccattattgtccccatcttgcaaaggaagaaactgaattttagaacagttgaattttagaacttgagctcccataattaggtggggaaactgatgtttgaatttgtgtccttttggccccaaagtccttctctggataaactaggcaaccaagagcaaagaatgctctatacccgacaaaaatagaaatgaaactcaagatccaagacgcaagagtggcagaaggttcaaggtgcaccactgccagccctgacagcctttgtatccaggtcagttgaacaggccgggattgtccccaacttggacacatctaaaaagctgcaggtgggatgtcatcaaaatcacctgggaaaacaacctgctctgaaaacagaggcatgatccaaaagacaaagaggtttgtgataccctttctgtacaatagctgactatcagtaagtcattactgttttaaggaagtcagtcacacacacacacacacgcatacacacacagaaa

SEQ ID NO: 833 - DNA, 1471 bp, Homo Sapiens
cggccttttacacagcacagcacccagccctcggcagcccagagcaggaaccaacagggtaggtgcccaggggccccaaaggtcagagttcctcgcacagctgccagggagcacagggaccgcagcacagggtcttctgctcagcaccgggaccccgctcgctgcagctaaagaaacagatacgtccaagggctccacggccggggccgggcacctggaacagggtggtcctggggcggccacatccactccttccagctaacacttcacagagatgtctgactgatgtccactgctcagctgcacccctgagctggtgagcattcaggtagagcacccacctctacttttctcaccccgaaaatcagagactggttctcagctggtgcagccaccgccccagcgtaccggatgcaggactttccctgcgaacactggacagtcccagcaaagcagacggtgggtcgctctgtatctctgaagaacagctgggcctgcgtgtgtcattctcaggcatctggcccagggcttctcctccaggaaggtggctgctcagctccgggcactgccaggggccacggaccccgcctcctttccaggctgttccacagcatctgccttcatactcacagccaccgcggcgtgcgtcccagggattctcagaatagaattctgtgcctctctcgcctctggaagtgaccgcgctctgtaggaaaatatcacagcacgccggcctcgaaaggccacgacgtggctctaaactgctctaagtatgtcagttacttagaacaatcagaaaggggcagaacaagctggggtgtggagtcaggggtcagggcacagacagcacctcttgtcttgcagagagaatgctagcaatttgcaagttacttgaaaaggtttgtgattttccaacgccctgagtaattctagccaaaatgcgtgactcgcctcacactagatgcttgctgtaattgtgtctctgtattaaactgaccgttctttggagcttcagaatggaccaggaggaaaaggtaaataccaacctcgctacaacctcagaggcatcaacgccctcctgctacagacgcatctgttctcgcctggctcctgccggctgccctgggagaggccacaaaatgccctccacggagacaaggcctgagaaccttcgggacgcccgctgccgctcactgtgttgaagaactgcccgttccgcaccccgggccctagacacacggctctgtggaggacgaggaagtgccgtcaggtgagacttcaccgtgaaatatcttctgagacacaacaatctccctgaattaaaactacagactctaatttataaaaactgtgtgtttcaaaagctccaagtgtttacattctccgattcatcattccttcttctaatttattttaggaaataatgcaaagtactcacaaaaatttatatagaaagatgttcattgcagaa

SEQ ID NO: 834 - DNA, 4401 bp, Homo Sapiens
ccccgcggcaaagttgcccacggagaggctctgctgcacgatctcgcgcacctccttgtcggacagcaggtagggagagcgcactgggaagctcggtgaaggaccaccacctcatccaaggggatcttgcagaagtccttgctgctcctctcaggggcagcgggggaccctcaaactcctccctgaacctctcaggattgattgcatagctcctcatgtttctacactcggggccagcacgtggaccttgcactgctgctggtaggagcgcctctgttcgtgttccagtgcaggttgcccatgaactccagggtccagacgcgattgtttttggtgcagaggtagagcaggtgcacttagtggcgaatgagcttgatgcaggacgggtccagctgcttcttgcccagggagtcgctgcagctgtactgcttgtgcaggttgtcatgggtgaagagcttggggaacaggggcaccagcaggcgcgaggtgaagttgccgatggacaggctgctctcctagatactgcgaagatgctcgttgctgagcaggcagtcggcgccgggcaactccaagttgggctggggatctccaatttgtccaagtcgataggtaccagtcagatcttcttggagcggcaccgctcgcccttgaagctgtcctccaccctgattactgagatgtcatcgggcaggctggaggagttgtagcagttgttgcgtggggggcttgccttcgctgcccgcgtccagccccaggccctggagcttgtcgttgatgcactgggcgcaccgctgcagccaggcctcctcctcctgcatgtgggggaagtagacctccgtgtagttgctgatgatctgcagcctctgcgggtccagctcctgcttgccgccgtccccgtagcagctgtcctgctcacccagcttgctgtagtggaagagctcagggaagagccagtggaggaggaagacggcaaactcaccgggtgaagaggcttcatccaggaactaggtgagggcctacatgtccaccacgtggtctgaggcgatggtgctgctcctgtccagagacaggccctcctcctcatctttgtggtccaggaagtggccggggtccactgctcagcctcaagctggcagcctggccaccaggctggctgttctccatctcccgctgggcccagaagcggctgaagaacttactcagctggggcaagcactcggcctgtcacacagccctctccttcaccgaggggtagtagacctccatgtagttgtggatgagctgcaggtgcagtgactccagcttaagcttggcctcaaagctgcaggcactgcagccttgggagaagttgactgtggctgaagagcttggggaagagctgcaccagcagccagcaggccaggaccccacctgacaggctctggtccaagatctgcttgagctccatgcccgtgagctgctatggggtggtgggggtcggctggaatttggccaccatctcagtggggttcaccttcagggagagcaggtccactttgctgtgcagctgggacctgttggacgtgagcgtgttgagcatgtagaacatctcctggatcaggaagtagatgttagggtcactgttggtggctgccccagtgctgccacagtcccatttctatggctcattcaggagcctaagcagcaaggggctgttgctggcatttgccttctggaagagctcatatgtgtttagcaggtcccctgagggagggttcttcttctccatgaccttgtgcaagatgccatacagaggcttcttgtagtaaggggtggtggcatggttgcggggctcctccttgcctgcccacacagagcctgagctcctgccttgccagcctgctctccattgccttggcagggcgagctgttcttgggttccacatgcctgctaggagcgcctctgggatcagctacctcctctccacactggggatggagtctggctggccattgctgaccagctgagtccttgagggcagtaaagacgctgtccagagggtgcttctcagaagtcctggaattcacggagcagcctagagcagcatctttggcctctgtctccactctcacttcttagaagttcttctacatcaattttttttggagatggttctgactctgtcacccaggctggagtgcagcagttgatcagagctcactgcatccttgacctcccagactcaaaagagcctagctacttaggagtagctaggactacaggccacggccaccatgcctggctaatcttttaaattttttgtagaggcagaggtctctcactgtgttgcccagacaagtctcaaattctcgggctcaagtggtcctcccaaagtgctgggattaatggcgtgagacaccgtacctggccatattttttttttttttcaaaaaattcatttgtagagtttaaaaagtatctttcgatcaagagttcttattgtatttatgtttgcaaatttcatttcccattctgttgcttgccttttcactcagtgagttattttatgattacaaatccctattttttatgttattttattactatttattaacctatttatcttatttactagccttcaatagttactttttgagtctttttttaaatcttaaggtcatagaagtgtcctctgtattactttttaaaaactgtactgttttatgttacacattggcttctatatgaaataatttttgtgtatgttgtgaggttggatgttaatattcatttttctctgtaccgatgtatgaaagacaccacaatttattgaaaatgaatcttttcctcattgtactgaagcactatttttttcacaaatcagctaaatatattgtgtggttctctttatgagctctctattctgtttcattgaaatatctatacttgcaccttttccataatgtcataattgatatacatttataaaaactttatatctaatagtgtaagtcttcacattatattttttcttcaaagttatctatacactgcattttcatttgcattttatagtcagtttttcagttgccaccaaatataatgcagacaaattatgctattactaatcacagtattgtgattttcagtgtattacaaatatagatttatttaaaatactgaatctttcttctaataccaagaatgacataggaacatggtacacctttatttctgttgaatatctttaatttctctcagtaaaatctcacaattttcagtaaagggattgcatatgctatgttatattttatattaggaattcaatgtttcttcctggaaacatttcagatttttaatattttatttgatttagactcactatatttggaaagctttaattgtaattttatttttaatagatatagagctattcggatttgctatttattcttgtgtcactgttaatgattttctagaaatgtatctatttcatcaaattatgtcaaaatttttgacttaaagttacttattacattctctttttctatcccatgactatagaatctataatgatttccttgttattattgatgatatttagaatttgtggatactctttttttttttaatttcacgcataatcatggtatatttttatcagtcttttcaaagtaactttggcttttgctgatttcatttattttatgattgtttccttttctcatgcttcttatgtatcttctcttttctaattctttggatttaatttgacatcacattttaaatttttgagattgacaattagattattaattttcaagctttaattttttaaacaagcatatgcatttatctccaagctgaggtttgcctaagcctcccatcttttaacaagcagtatttttactttcatttttattaaattcaaaatatattttaatattcattgtaattacttttttgatgcatgaataacttagaaatgtgatgcttaatttctaaacatttggttactttcaaagtcttgctatagatttgcagcttaataacattgttgtacaaaaaaacactgtcaaggatttcaaatttttggtatttattgattcttgttatgggcctaacctcagcctatatctgtctatctaacctatctatctatctatctacctacctatctatctatctatctatcatctatctacctagatagacagagatatctatagatagctatggtaaattttgaaacacgttccaaatacattataataaattgtgtgttttgctatttttgggtgcagtttttatatcaaagtatttaatcctactgctttaaatttttgtattattattgatattttgtatcctttttgctatcagttattgaaaaaggtatattaaagtctttatgatcaaag

SEQ ID NO: 835 - DNA, 1795 bp, Homo Sapiens
tgcatgaacaaaatgaaaacttcaccaaagagaaataatagaaaagaactaaacagaaattctggagctcagcaatacaatgaatgaaatgaaaaatgtgatagagagcctcaacagcagacttaagcagaagaactaatctgcaaactcaaaattaagaaggtgctgtcactcccagttgccaagtcaagccccgtcgaaggaaaagcatgcatagaaccaagcacagccaaaatttctttcccaggatcagcacctccttctgaggctgcagacaaagactgtcaagggaccccattactccctgttgaagtctcagagctcatgggtgtagcttctttggtgtcaggggctctggatgctaagccagtagagaatcctgaagatcctagccaacggattaataaaaactggaagaaggcaattgtgacatggcaggaacaaactgagagaatatttatattttgaagtagatggatccaaacaaagaaatgtgaataagatcaaggagtttggctaggggtctgagagacactgtcagaccaacctgcatttgaaatgggccagtgtctgagtcatgacaacataaaggtaaaggtgccctgaatgtgcccctagtccctgggtctgctctcgtcacctcttgtcacttcaggaagcaacagccaggagtgaaacatgtaacctgaggtgggaggaaggaatttttcagaagctcttcctggacaaggtgagtcctcatgaactgatcctgacccctatgaacccataccctatgagctcaacctcctagatgaggagcgttccacgaataagacccatatgttaagatcctggagcctgagggatcaggtggcctgatggggcagacagttctaagttgcctcctgttttggccaatcttctgggaagcataggtacctggaagggtttattgagatctgaagaagaaggcatcaatgtccaggagagccttactttcatcatgggtagcccaaacagtcagccctcaaaataacttctaaaacaaccagactattcagataagatgactgattgctcttgccacctaacctctgaggtcctggttgaatagtccgtcgtttcctaccaggaggccctgggaggtccaaagacattttccccctggcactggcgacctatacctggtttctatggaggctctggagaccctgatgggcagttgatccacatcttctgggtcccccaatccctccagtgaaagatgaccccttctgggatagcccaggtgaccccatgcagggtggcctaatattgaggggagagtcaagaaccaattcctggatcataccataaagcctgtggtggccaaaaagaaaatgaacctttcccacctcctccactctgaggggccagaggaagtctctctggagtaggacccctaaatggatgaagaaattctggtgggatcattgttagagttggtgggcatcatcaccaataagcatctctttcatgaaagtactggtggtggcataagtgggggcagtgaagatttttcatgaaggtcctggacatgggggatgctgtgaccccaagcctcatgatgtccctggtcactgaggccatgaccatcaaggtctgccctctcgtgagcactctggccatgatggccctgggccactgaggtcaagatggaagctacagccatgaaggagacagatcaacctgctctgtttgctgacatttgatgataaagggcaatgccactatgagaacaattacgtcttttaccacctgagtgtcaaagtcc

SEQ ID NO: 836 - DNA, 4335 bp, Homo Sapiens
attctgatgtcaccgcttcctaatgagaagctagaaaatgcaattctagagtgatacacctttaagtcttgaagaatgaagatgaaatattccaaactatgctgcacaagaggatgtgaacagaaacatctggacggagaagatcttttttatattcagccatgccaattgacctactaccctctccatagccaaaggaatgcccaaatttccacagaaaggcatttttatgtcttacctcaaatggtcccatggaattaggctctcaggccctggccatcacggcactatctgtgtaaggaacttctgcaaagccttcctggctccttgatggattggctttttggcttatgcctgtaatcctaccactttgggaagctgaggcaggaggattgcttgagcccaggagtgcaagaccaacctgagcaacattgtagaacgtcatctctgcaaaaacaaacaaacaaacaaaaattagctgggacaggacagtccagagagaaccaacagcctttgcctgagctctgctccagagctcctccagccccgtgatcaggcactaactataacaactgaaccgatggaagtaaatcctaccccagcggggcactggcaggattaaagcaggtagtggatagcgtcttgcacagtaccatatacagagtaggatctcctacacgtggtaggattcttgacttgaatagaaacagaacccacatagcacagcaataagaaaaataagattctgcagacaccaatgctagtctcagggctgccactaactaggtatgtgactttgaccatgccccttcacctcctgtccgtgattttctcgcgtgtaaaatgaggcactattgtttagatttctcaagggcttccagctgtaacattctacagtcctgtgcattgctggaattgcaggggaacaggggagggagggtaaacctcacatgttcatgttttaaaatttcaaatgaagaaagttgttgttttctcctcttcccttctccccagtggtagcaaacaagcaataaatatggaaatcctaaaagccagagaaaatagtgagtgttctccattttgctgacaaagtacacagaggctgcgtcacaaaatgaatgtgcttatccctcttgtgtgctgcatgaattcctcccggcccgagcatggctggaccactcacaggacagctgtcctttgttctgtcagtacagggtcccctgcttgtgtgctgaccagcgcagcactgggtgactactgcagagtgaaggtgtgtgttccttctccagggagccccgaacagatggaatccatgcttagtgcagtgactggaaggaggtagaaacaatgcaggtgaattgggagggcagtgccgggagacagcggaagaaaagagaaaaacaaaggcaaggtagagcattccagctgcaggcagccaaagcctctcctgccaagggacaggtagctggttttcaaaattgtgcagacatactcagtaattgctctgcaccatcttgtctgccttttaagcacaagcgaggattgcatctgactcccattaccagcaaatgtcccaggaaggaccttaagtaataagagccttttgaagctgatcttcagaagcctcttcccaagatggcacctgggaggaggtgtggttgtttagcggctctgtcagccccggacgcacaagttgcttataccctgcgcagctgtctattatgaagaagctcatccctgtggacctttctcttgaatgcctactatgagtcactcagcaagagaggcacccagctccctcaaggtctgcagtgcctcggaggcccacttccctccatgacacagtctctgaacatattattcctcacggatgatcaccttcttaactccatccagacgtgtgcctctgtctcactatttagcgttgtcctagaaaatactgagtaattgtttcatgcgtatacatcatgtttcctcaagtagaatctacctttatacaatcaaaagtgtcagattgatggatgagtagcagaacaagaaccctcctcctatggctgttggggtgcaagtacccatttgcctattggaactgccttagggaagatacggttaaacacagaccccaccccgcaagttattctattgaggaaaagtggaaataaggtgagtgctactacccaaccacccaacccacacctctgttacaatactggctttttgacaaggaagcattcattctttctggcaaaacattgtccactcttagcagttcttccacggatatcagacctatatgccagtggcaacacagtaagtcagtagcattctataagcactcgttcaaccatgttttcggcgtggtttctatgtgtcagtcattatcccaagcggtggccaaggagaagctacagaagcagattcgaccaggccctttctttgaatagtctgtggtcccatgagggaggcaggtgagaatcaaggctctgtgataactgttccaagggagatacacacagagcatgtggcatgctaagctcctcttggggtaattgcaatgtttgccttctttcctttgaggacttaagtgtgaagcctgtgcacctggaatgggaggggacagggattctcataagaacctttatgccatttgtatagcagttaacagactgacaagaatttcaaaatagcatcagacgaggcgatgagcataggggtccttagaaatatttgcttgttttatggtcagaggcctgcaggaagcagctaataactgatctcttcccatagcccctaatgtcctctccgtttcaatcatggaccagagtatagtgtgacatttcccatattattgatttgagttgttatttatttcttttattgccatataactgtttacacccttggctagaatttaagatgccggaagacaagatagtgccttgttcccctgcctccactagcacagcacctgactcacagtaggcaatcaatgcaccgattaattaagtcctccttctgctgagggcccatcgtcctttggctgtcccagagagctaacacctgtccccgggaccaccctagacacaatggcacgcagacgaacgagcctccttcgtctaccttccctccgcgagcagcatcaaggacctgagaggcaaactcaaggtgaattttaaaacaccttcagtggtggttgcagagcaaacctgcctgcaagaaaaggattttttccatctttcttcagcgccactggagcggctccttccattgaaaatacagggatttgtgctgcatgattgtgcagggagtgggggccgagtccacgccagtcatcaagggctcagcatgctcagaagggctttgtgctccaggcactccagcagcctggcttggccttagcacatcccccttcctgaagaggccacagtacaaccacttcagcaagtgacttttcagtaatggctctgtgtgcccaaaagggaaatcaatgtgacggttagaaaagtttctttttttcttccagtcctgtgctgtccccaaaatatcagaataaggtttgttatctgggcaaaggaacaagcgcaagattttcttttatgttgggtgaggagctaaaggactaaacatttttgaaaacctatgatgtaccagagactgtctcacatcctgccctatttaatgttaccaggagatcgttggtaaggtgttacccccatcttaaagaggaggggaccaagattcagggatgcttcacaagctaataactaaaacttaattctaaagtgtgtggggtgcgtgtgtgtgtgtgcatgtgtgtgcatgcatgtgtgcatgtgtgtctggtctgatgtcttagtgttcatatccatgagcatcaggagagcttccacttcacccatgtttcaaactctagagaggctgctccccctgctgagtagcctggtcgtggccgtggctgggtgatggctgtttggatgctctcagaaatgtcgtaagcagttcacttattattcagggaaacatccaacaaagtgatggcttctttccttgctatcactatctactgccagctgttcacttgaattgaaggatatgagggactgaatgctgaattcacgaatgcagctaaccgcccccctccagaccccagaggagccattaggatgagtgtttatggagcagcactgcctggaaatgccaaggcccagtaaggaatgagaggtgaacggagaaatacacgcgtccctggatccctccctgggtggggaagactgtgtcgtgggacagggggcttcaaatctatgggaaaacacagcaaatacacttctagttctt

SEQ ID NO: 837 - DNA, 1767 bp, Homo Sapiens
gcgagaggcattgaggcacttgagaaacaggtgaggcagagcaggagggaggacagggcagacgccggcggccaggcaggatatatcaccgttccactgccagggtcataaggggtggggttccaaaagggtggcttgtccagagaggccagcattccagtgacagggactgttgccatctcccattcccggcttcctcttccagaccttattgtggtgtggcttcatttctcagagaagagccatgaaaagatacaagcatcttctctgacgtgggtccgctggtctcctgcgggacaaagagctcctgtggggctcgtgtcctcgtctgcagtgtgttcatcttgatcctagaaaagaggctgttcaggatggggaggatatttcaattgctccgggactgaagaatctcctcacgtgggccaggccttcacacacccaaagcggaaccgcgtcggcgaaaaggattgacaaccggtctcatgacccaggcagagaggcagaaacaggctcaccaaagacaggccgccatgcgagaaacagctttgtggtgcacagggcacattcggccaaggacacacacgcacacgggcacacacacacaaaccgacagagagagggaaagaaacacacagagactgagagacagagagagaagagagaatgggagacacacacacatacacacacagacacacacacagagtcttatagcaaaggcattgaaagacacacacccaggcaacccctgaggctgtggggttctgctttcgacgagaacgacccttcggtgagagagcaccccaggggcacgcaggccgtcctgtcctcgagatcaccgcgtcacgacttttggggagactcacccccaccaacaccgtccagagaggcctgagggagggattccatgctgccttctccggactctgcgtcgggtttcctcaccctgtttggccctttgtgactcttggcatccggagactttcccctcgacccagtggagtcgtcaggccggagcctcagagccttgacacccaagcactgccacggaagtctccccctttgccaagcctcggggactggtttctaagacaaccgtgggaaccactgtgacgggagaaaccgcttgtgcttcgcgcatgcgcattggctgggccgactcctcccctcctggcagtcaggctgcgtccccttcaaagaacgccaccgctgagaactgaccctcacatctcccttcctgaatttctttagggaaagcaacaaccatccctgtaagccatgggttttcatgcggaggaaggagagggctagttgtctgagagggaaactgcttaaggctgcagactaggaaatgggattccaggtttaagatagctcctttctggacctcagtccttcacctagtcacctagtcacagggtggatcgcctctaaggatacttagtggaaaaggaaccaaattcgggatggttctccttgctttaagccttgatgggagacggggaggccaacccttctctgcagaccgtgatcctcactagacagaggagctccaaacctgcccatctcatcccatgcacctacggtgcctggcctggctccaaactcccgaaaggaactattttacaggtgccaaaaaggggacagtgttgataataataataaaatgaaacaatctgattggggcattgctggatcagaaaatgtgtgacctttttaaagttaaattgttaaaaaattttaactattaaacattttaaatattaa

SEQ ID NO: 838 - DNA, 1676 bp, Homo Sapiens
atcccggcccctcctccgccagccgcgtcctcccgggcttggtgaggaactgttcctggaggagccgcgggacgccaaaaccagccaatgggaagcggcgattcgcggagattggcactgatgatgggaagcaatgataaggaaactaaactggattaagtgctatcatcttggaggtgcaaaggcaaacaaggagaaagaagtgattgaagagcacttcagaaagcttggtacattcaaatcagcagggcttgattactcgcatcccaggacacttaaggaattggcaaatataattgcaagaccaccagcctttattttagaaaatgaaggttggacagaagaaggtcctgacaagtaaaatcagcagatggagtacctgttttttaaaagagggaaaaggacagctgtagtaattatagactattcagtttatcttggatacctgggaagatacaagagcaaatcatcaaacaatcaatttgcaaccacctagaagagtacaagctactgggtcgtaatcaacgtgattttgtgaagtgcaaattatgccacaccaatttaattttatctatgatagagtgatgagcctggcagaagaggggaaagcaatatctacaactggacttcaataaggaatattgatctcagcgttactttgaccattaatgaattatgatggcaataagcaaagattcgcacctctagcctccggggagcttaatcttctgctacaacatttgcatttggtgtctctctactgctcaggctggagtgcagtggtgcgatcatagctcactgcagcctcgacttcctgggctcaggtgaccctctcgcctgaaaccatattccccctcaagtagctgagactacaggcagtgtttaaggaggatccaggaatactttaagtgacgccagcgttagtgttgcctcctcagaagactgctttcaggggaacagtatacatctgccctgtaaattctggatggtaaatatgacaaaaactctctccttgacccagctctagtgagactgctctaagccctcttctcaacatggctcaaccttgggcttcagtgtacattttgttgggcctgcattgctcagttttagcaagagtccagttaagtgaaagagaatctcacagctttgatatcagattcttccatatctaaacaaattcctcatcccctaccttcaatatctgatcactctgccctgtttgcaccaagaatctaccctcacccttgatgtctcctcttaataattttccatccaccaatctctccccactcttcaaacctgctccttggctataagtccctaccccttcttgtcttatttgcaatagagctcagttctacactggggtctctttttcctgattgcaatagttcctgaataaaatctgtttttaccactttatccactgtctagctctggttttctttaccagaagtcacagttaacacatgcgaaaacccatttgcaaaacaaatccacaggactcggtccatgtgctgtgaagtctttgattaagggcttaaaaacaatgaaaagtaataaacggatctgaatacaattcaggcaataaaacactttcattggttttcatactcagcaaaagtatttttactgattaaaagataaataatcctcactctactaactcaatg

SEQ ID NO: 839 - DNA, 2204 bp, Homo Sapiens
ttaacagtatggttaactgttttcaattaaattatgtcatccacatccttcagttcttaatttttattcatctctaggtcctcatattttgaaagaccacctgtgctatatgtatgatctgcttgtccctgtcaaaactcaggttgaaattttgttcccgatgtggtggtgttgggaggtggagtctcgtgggaggtattttgctaaatttcttgaggtacagaataaatgaatgtcatcctcagcgtaccaacagtttgaaaaaatgagaagaaaaatggcagcagtaaaagaccccattatgaacacaggctagtaactttcttaatccaaaatttcaatttgttataatgacaagtacattttattcatgacaaatgtaaagtattgaaagagaaataatcaaatagtttatagcctatactcctctatttcctgaggatgctggctttgtaatttttgatagtcaagaaaacgatcataaacctaatacaatgcttttgtttgtgcaaatattctgtcacatttcacttggaatatggagtataattttgaccattgctttttgggtgacccatgataaagatataaattgtctagaaaggcaaatagattatataaatgggattctatataaaccaaacacaaacttctggaaagttgaagagtaaacgagatgattaaacatcacaaattaacatggtgcttgtactcaataaacgtagctattataattatttaaaaattaataaagagttaatactatactctttataaaatgaaacaccaggacaagaaaataatgcaaaggatagcttaactgtgaaaaataatttaatattaaataatgctgaaagttgttaatcccaaccaatacagtatatatctttttagtgtctcttcacataaatcttatataatactattgcacaagtttgttaaaagataaaaaactactaaaaataaatctgtgtgtgatttttagaagactacatatttatgtgttccacatattgaatcaattttcaaacttcaaatttttagagtgcttttggagtggaacacatcctgagtgtgccctttcagtccagtctcttactgatgctctcctaatggcattcacacatgcatacagctcgccgccctagaagcggcctgctttaagattgaaaatatgactgagagtggccaaaatacaactctctgtgagtgatccggttatgtcctaattaactttcaatgtgtcaaattcaagtgatagaaaatggccaaggaattaaggaggtaagctgagattttacacttttctcaattttaagcttgttattaagtggaaaataaagactacacgcttttattgctttaaaaaagacaaaaaatgacatttaatgacattcttgaagaagatgaacatttgtaattgcaaatggaactccttggaaaataagcgttcgttgcttttgttgcacagatctttcttctccagttcaacatgaatctcgaacttttaaaatccagatgggcagcacatgacaaatatgggtaaactcagccaatgaaacaaaagtatttgtttccaccctatttaatgtgttacttcctccaagtaacaatagaaaactaaaacttcttgaaaataaataaaataccaattaaataccaattattttaaaagtggtgataaattccaagaaaaatatgattatattcattgttattataccttcaatcatatttaaagggcattttggaactggataaattaaaatgtccaactaaaagtatcttagttaaccattctgtttccagaaagaacataaataaatatatctcacagcaaattcttaagctttatataactttattttcatcactttttatctctaggatttaacaaagagctgctgaaggtttcactgatgtggaagcagtgaatttatatttcagaaggaatacacagataagtgatggattcagagaatttataagcttaaaaatgaattttaaaaatataaataaaatgatatctgctttgtgatcaaatccatttgactccatgttattgttttaatgccctagtggagctacttctctgcacagctttctgggagtccagagactgctctatacattggaaaatatgatgaatgtgttcaagaggggcgtgacaattgttccgtacacagatttttccaagcattctc

SEQ ID NO: 840 - DNA, 10546 bp, Homo Sapiens
agagccgctggtgcttcccaggccgtcgcgctcctggccgcgcacccagccagggacccagaggccctcagccccgggctctgcgcgtacactgagggcgcggcgcagcaggacagcaagataaggaagcagagactgaagggaggaatccccgctttccggggatgatggcgttcgagttgggtctgtgagggatgaaataggagttggccagagggagagagggactctaggcctcgagaagagcacgtgcagaggttccgtgacacgaaaacgccaggtgggtgcggggctgggaggacaggaggcagaagggtttacggctccacatggtcgccgaaattttaggtccctgagagtaaaggggtgcagctgatttcatctagaaagcccctggccgggaggagagaacgagcttgcttgcctggggttgcaaaggagtgggtagctgagacggccagcaccccagcatcctgactcagggccagacgcttcaccccattgggcggcgtctggaggagcagacacatctcttgtgggtaccctcgaaagtgaatcatgggtcgcagggaactgtggtcaaaccgtctctagctagatgctagagagccagctctgcaggctcaggctactgtgagacacgaaaggagggactcgctgggcacagcctcaccctggggcatgccagcaggccctgccctctgagtgttggcagacttgaacatccctagggaacgagagaagttgggcaacgatgggagagcagtgcaggccctggaggtgacgagtctgttgagattctgatggggatgggtcagaggacgtagaaagcagtgaaggcctagacgcccccaggtcagtgtagcctgctctgcttccagtgagctgggctcagtcccccacatgtcattgtcttagacgcccatggcctttgcacaggccgagcctgatgtttggaacatcgtcgcctctagggggcctggctcctaatcatgcatcacctcctccaggagaactttcctgcccctacactgagttcaagcttctcagacaccagccccagttgagttcgagttataaccgtcaccagttatcacaccatcctgtaatctgtgcggtgccccttagggcaggacctgggtcctagatgtctctgtacctctagccccaaaccaggcctgacctgtctcttgaaggagtatttgtgttgaagatgggtggtaacgttcagcaaaagccatgcccaggagacaggcacagtacccatggagacccagggccagctgatgacagtgatgaattccctttagaactggcggactcttgggtgcttggagacactatataaataaggaactctggctgtgtgcatgggagagtatattaacagggcttggcctggctgtgaggtgcagagatgccgtttctctcaggtaaggagccatattggggcaggggtttcctaatccttttttgactcacaaaatacacctaggaaatgttaaataaatagtcatttttgagtagtatatgataaagaagtgattgattttgactaaaaatattcatgttctatttttagaatatgaaagattgtattataaagatcacttgaaataaaattttagataatatatggagacaaatttctgctttttacatttaacttgctgtttaatgtatctcaaattatttatgtaagagatatatgatttgaccaataaatataaaaaaatgttataccataatctggggacctaaagtacttcactttttttgttctgttttgtttttgagacagggtctctctctgttgcccaggctggagtgcagtggcccaatcatggctcactgcagcctcatcctcctgggattaaatgattcttccacctcagtctcccgagtagctgagactacaggcacatgccactatcgctggttttgttgttgttttgttttgttttgttttttgagacagagtctctgttacccaggctggagtgcagtggcacaatctcggttcattgcaaccgcctcctcccgggttcaagcgattctcatgcatccgccttccgaataggtgggattacaggcatgcgtcaccacacccagctaatttttgtacttttagtagagacagggtttcaccatgttggccaggctgatctccagctcctgacctcaagtgatccacccgcctcaagcctcccaaagtgctgggactacaggtgtgagtcaccgtgcccagccgcccagctcattttaaatttttcttgtaaagacaaggtctcactatgttgcccaggctggtctctaattcctgggctcaagcaatcctcctgccttggcatcccaagtgctagcattacaggcatgagctactgcacctggccctaaagtacttaaaatgtaatttaaaatttgcacctgggaggccagacacggtggctcacacctgtaatcccagcactttgggaggccaaggcaggtggatcacaaggtcaggagttcaagaccagcctggccagcatagtgaaaccccatctctactaaaaatacccaaaaaaaagccaggcttggtggtgggcgtctgtaatcccaactactcaggaggctaaggcagagaattgcttgaatccgggaggcagaggttgcaatgagctgagatcgcaccactgcactccagcctggtgacagagcgagactccatctcaaaaaaaaaaaaaaaaaaaaaaaaaaaagtgcacctgggttaggcatctcccagaagccagagtgattgttcaaaaacttaaatcaggccaggcacggtgtctcacacctgtaatcccagcactttgggaggccacggtgggcagatcacctgaggtcgggactttgagaccagcctgaccaacatggagaaaccccgtctctactaaaaatacaaaaattatccaggcatggtggcgcacgcctgtaatcccagctacttgggaggctgaggcaggagaatcacttgaacccaggaagcagaggtttcagtgagccaagattgcgccactgcactccagcctgagcaacagaacaagactgtctcaaaaacaaaaacaaaaatcttaagtcatctcaagttcctcttgcttaaaacccttgaaaggctctccagcatagtcaaagcaaataccaaaccctttaccatggccttcaaggccctgcttgatctggcccctgcccacatcactgatcttacctcttcctactctttagccttattcactgcactgaaatcccactgccaagcttagccccaccttggaggctttgccctggctgcacccctctcctagtgctcttcctccacaacttttagaggctagctcctacataccaggcagatttcagaagacctttcctgtcatccaatctgaaaaagctcccatcccaatcagcgtctatcacatcacccttgttcttcctttcagagcacctaatactcccagaaagaatcacatttctgtgtttgctagttgtttattatgtctcttctaccaggctgggaacttcaggaaagccaggaccaagtcaatcttgatctaggctctgtcttcagcatctagaaccaggcttggcaccaactgagtaggtaatccgtaaataaattgctgttgctgtgtatcaaaaagaaaaaaccaaagtttgcatggtccagtgcttagaagttttgaaataaaaaatgtagctattttttggctgggtatagtggctcacgcctgtaatcccagcactttgggagtccgaggcggtggatcacctgaagtcaggagttcgagaccagcctggccgacatagtgaaaccacgtctctactaaaaatacaaaaattagccgggagtggtggcaggtgcctataatcctagctgcttgggaggctgagcggggagaatcacttgaacctgggaggcagaagtggcagtgagctgagatcgtgccattgcactccagcctgggcgaaagagcaagactcagtttaaaaaaaaaaaaagtagctattttttaaattggaaaaccaatcacatgcacatagcaaagaattgaaatagtacaaaagtgagcctgtttgcctcacaccttcatattgatcaggataggacaggctggtctgtggttacagtgatttctttttttttttttttcttccagagatggagtctcgctctgtctcccagtctggagtgcagtggcatgatcttggcaatctgggctcactgcaacctccgcctcccagattcaagcaattctcctgcctcagcctcccgagtagctgggactacaggcacacgctgccacacctggctaattttttgtattttagtagagacagggtttcaccacgttgcccaggctggtctcaaactcctgagctcaggcaatctgctcgcctcagcctcccaaagtgctaggattacaggcgtgagccaccgcacctggcagtacagtgatttctaatattgcccatgactgttggctgaactcaactggtgattcttactttgaatggcttatgtgactgcgatcacaccaggactggagttacctgaagactcagctgggcaggttactgttgatggctcactcatttggctggcaggagatgccatctattggctagagggtcggagctgcaaaccaaagcacctacatgtggccccttcacatggcttaggtttctcagaacatggtggctagattctgagagggaggcatcccaaaacatgcatccaacagtatgaaagctgccagtctcttacggtttgaccctgaaattagaacacatcacttcctctgcattctattaaccaaagcagtcacggaccagcccagattgaaggagaggggacataggccccagccttcaatgaaaggaatgtcaagccaggcacgatggctcacacctgtaatcccagcactttgggaggtcaaggcgggcggatcatctgaggtcaggagtttgagaccagcctgactaacgtggtgaaaccccgtctctactaaaaatacaaaaattagccggatgtggtggcgcacgcctgtaatcccagctattcaggaggctgaggcaggagaatcgcttgaacccaggaggtggagtttgcagtgagccgagattgtgccattgcattccagcctgggtgacagaatgagactgtctcaaaaaaaaattaaaaaaggaatgtcaaaaaagtctggccatctttaatccaccacatgtggatactaaataaaactccaaatctcagtcgcttaaaacaacaaaggcttatttcttactcatcccacattagacaatgatggtgtgctgttctcccccagcagggacttaaatccttctgacatcaccataatctcagttatttgattccaactgctcagattggggtaggggagagggaaaagattgacactaacacttaattgccttggactgaagtgatacattcttctgcccaattccgactggtgacatcacatctactaggaaggttgagaaatgtagtctttccatagtccctggaaaagagaaatgggtgtggatacatcactgtggctaacacacaccactttcccagtctcctcctctaaaagcatcaccactaacactacagagtgtatacttccagaaatatttatgcatatacgacacataaaacacaaaggggaacaggcacagtggctcacgcctgtaatccctgcactttgggatgctgaggcgagcagatcacttgagcccaggagtctgagactagcctgggcaacatggcgaaaccctgtctcttctaaaaatacaaaatttagccaggcatggtggcacatgcctgtagtcccagctactccagaggctggggtgggaggatcacttgagctcaggaggcagaggttgcattgagctgtgaccatgccactgcactcagcctgggtgacagagtgagaccttgtctaaaacaaaaaaaacccacagaaaaagagtagcatttacacacttctacactttgcttcttcctctttttttttttttttttttggacagagtctcactctgctctccaggctagagtgcgatggcacaatcatagctcattgtaacctcaaactcctgggctcaaacaatcctcccacctcagcctcctgagactaaagatatgagccaccacacctggccaagcaaaggatttaagtagacatttcttcaggccagacacggtggctcatgcctgtaatcccagcacactgggaggccaaggcgggcagatcacctgaggtcaggagctgaagaccagcctggccaacatagtgaaacaccatatctactaaaaatacaaaaattagctgggtgtggtggcacttgcctgtagtcccagctacttaggaggctgaggcaggagaatcgcttgaacccgggaggcagaggttgcagtgagcagcgatcacatcactgcactccagcctgggcgatggattgagacactgtctcaaaaataaataaatagacatttcttcaaagtaaatatacaaatggccaataagcatgtgaaaaattgctcaacatcatcagtagggaagtgcaaataaaaaaccacaatgagctagcactttatatctactgagatggctgtaatttttttaaaataaaataacagtgtcagggaggaagtggagaaaatagaaccctcatgcattgctggtgggaatggctggtggtgcagctgatgtggaaaatagtttggaagtttctcaaaaggttaaacgtacaaccatcatatgatccagcaattccattcctgggttcatatccacaagatcaaaagaatcaaaagcagggacttgaacagatatttgtatgctgctatagtttggatgtttgtaccctgcaaatctcatgttgaaataggatccccagtattaggcctaatgggaggtgcttgggtcatgggggcagaaaccttatgaagacataatgccctccctgggtgggcaggagtggtgagttcttactttatcagttcccagagaactgattgtttaaaaagggcctggaggcctggagcagtggctcactcctgtaatcccagcactttgggaggctgaggcgggtggatcacttgaggtcaggagttcgagaccagcctggccaacatggtgaaaccccatctctactaaaaatacaaaaaaataaattttaaaaaaatcagccaggtgtggtggcaagtgcatgtagtcccagctacttgggaggctgaggcatgagaatcgcttgaacccaggaggtggaggttgcagtgagccaagatcacgctactgtactccagcctgggtgacagagggagactctgtctcagaaaaaaacaaaaaaagggcctggccctcccatctcactctctcttgcttcccctcttgtcatgtgatctctgcacaccctggccccccttcaccttccacagtgagtggaagcagcctgaggcctcaccagaagcagatgctagtggcatgcttcttgtacaacctgcagaactgtgaatcaaataaacctcttttctttataaattacccagcctcaggaatcagagtaagacatacacccatgttcatagcagcattattcacaatatccaaaaggtggaaacaatgtaagtgtccatcaacagatgaattgataagcaaaatgagtgtgtacatagaacaaaatattattcagccataaaaaagcatgaaattctgatacatacaacatggatgaaacttgaaaacatgctaagtgaaataagttagacataaaaggacagatttataaatccacttgtataaaatatacagaatagccaggctcagtggctcatgcctgttattccaacactttgggaggccgagacaggtggatcacctgaggtcaggagttcaagaccagcctggccaacatggtgaaaatccatctctacttaaaatacaaaaattagccaggtgtgttggtaggcacctgtagtcccagctactagggaggctgaggcaggagaattgcttgaacccagtaggcggaagttgcagtaaaccaagatcacaccattacactccagcctgggcaatggagggatacttgttctccaaaaaatagtaataataaaaataaaacaaggctgggcgcagtggctcacgcctgtaatctcagcactttgggaggccgaggtgggcagatcatgaggtcaggagttcgagaccagcctggccaacatggtgaaaccctgtccctatgaaaaatacaaaaattagccaggcatggtgatgcacgcctataatcccagctactcaggaggctgagacaggagaatcgcttgaccctgggaggcagaggttgcagtgagccgagatggtgccattgcactccagcctgggcgacagagcgagactccatctcaaaaaaaaaaaaagaaattaaaattaaaaaaaataaaatatatagaatagacaaactaatggagacagaaagtagactagcggttaccagggcttagggggaaaagaggaacgaggaaatattgcttaatgtttacagaatttctgtttggggtgatgaaaaagttttagaaatagtagtggccaggcacagtggctcatgcctataatcctagcacttggggatgctgaggtgggtggatcacttgaacccacgagtttgagagcagcctgggcaacacaggaaaaccccatatctacaaaatatataaaaattagtgggggcgtggtggcatgcgcctgtcatcccagctacttgagaggctgaagcaggagaatcacttgagcccaggaggtcgagtctgcagtgagccatggctatactactgtactctagcctggatgacagagtgagactccgtctcttaaaaataaaaaattaaagtatggttaaaaaggcaatttttgtgttacttatgttttaccacaattttttttttaaacctcactcaaaaaagaatgacatcatcttaggaggccgggcgcagtggctcacacctgtaatcccagcactttaggaggccaaggcgggtggattgcctgagtttaggagttcaagaccagcctgaccaacatggtgaaagcccgtctctactaaaaatacaaaaattagctgggcatggtggcacacgcctgtagtcccagctacttgggaggctgagacaggagaatcacttgaactcaggaggcggaagttgcagtgagtcgagatcgcaccactgcactctggcctgggcaacagtggaagactccatctcaaaacaaaaacaaaaaacaaacaaacaaaagcaaagtaggccgggcgtggtggctcatgcctgtaatcccagcactttgggaggcccaggtgggtggatcacctgaagtcaggaattcgagaccaacctggccaacatggtgaaaccccatccctactaaaaatacaaaattagccgggcatggtggtgcgctcctgtaatcccagccactcgggaggctgaggcaggagaattgcttaaatccaggaggcaaaggttgcagtgagccaagatcgctccactgcactccagcctgggcgacaagagtgagactctgtctcaaaaaacaaaaacaaaaaccagaaaaacaaagtagtaaaatccagaagatagaacttctacaaatcaaccaaactgaaaacgcaatataaaaatgagcaatggctttcatcatcagaagagaaagaaaactcactgatcttgcatgcccccaaaaaaagaaaggaaaataaaagttaaccacaaaaaattataatgtaagttaaagtacaaatgaggggtcatttttttactcatcatattggcaaaagttaagacattgcaagatataatcatgcactgcataaggatgttttagtcagcaacagacttcagataagacagcagtcccataagattataagactgtatttttactataccttttctatgttaagatacacaaatacaaaccattgtgttacagttgcctacagtattcagtgtagtacatgctgtacaggtttatagcctgggagcaaaaggttatatcatatagccaaggtgtgtgtggtgggctataccctctgtttgtgtaagtacactgtgatgttcacacaaggatgaaatcacctaacgatgcatttctcagtgcgtatcctggttgttaagtgatccatggctatattcagagttggtgagagcgtggggaaaagggagtccattgttcgttgctggtgggagtgtaaattggtttaatctcttaggacaatttggccatctacacactgatatatatgcacatccttggacccagcagttgcactccagtgtgcaacaggatgaatggttacagatatcatggtacattcataagacagaatccaatgcaattcaaagaaggagctggatctatgtgtcctgacattgtaagtatatgtctgaaatacttcataatacttcttaaaacccgacaggtttatttttgtttctaatgttatattctgt

SEQ ID NO: 841 - DNA, 2604 bp, Homo Sapiens
gacattcggagctgctcttcagggttctgggcacgtcgcatattgcgccccagccttctcagcagccaggagctgggaggtggaggggcctgtggtctggccgccacctagcaggcctgcatggccacctccagccgggtgcaggctggctggggtggggctgcccttgaccttgggctctccctcctccgccagatcctcaggcgctggctcagcctcccacggcctgggggagcctctgtctgctccttccagccgttcaaggacgaggcttccgaaagactcactgttcctgtgtggggaactgaggctgtgtgaaggctggatgaaccgctgctgtggcctgagtcctccggaggctgagagcaaacggctgcactaggaacccagcagtcagaccggcccccaccctggagtgaacacatcgccactgccaggcatcgcagggaggattaccccaatggcacctggctgggcgacgagaacaaccccgagatgcgggtgcactgcgccatcatcccctccgacatgctgcacatcagcaccaactgccgcacggccgaggagatggtgctcacgctgctggactacctcttccaccgcgaggtgcaggctgtgtccagcctctcggggcagggcaagcacgggaagaagcagctggacccgctcaccatctatggcatccggtagccgatgatgagcaccccacctcctgccagagagctcctgcagccacagctgcagccgcaggccctgcactacgcgctggccaacgtgcagcaggtgcagatccaccagatcggagaagacggacaggtgcaagtaggacacctccacatcgccaaggtgccacagggggagcaagtccagatcacgcaggacagcgagagcccgtgttctggtactacgtgaaggaggtcctcaacaagcacgagctgcaagcgcttctactccctgcgccacatcgcctcagacgtgggccggggccgcacctggctgcgctgtgccctcaacgaacactccctggagcgctacctgcacatgctcctggccgaccgctgcaggctcagtactttttatgaagactggtcttttgtgatggatgaagagaggtccagtatgcttcctaccatggcagcaggtccgaactccatactctttgcgattaacattgacaacaaggatttgaacgggcagagtaagtttgctcccaccgtttcagacctcttaaaggagtcaacgcagaatgtgaccttgctgaaggagtccacgcaaggagtgagcagcgtgttcagggagatcacagcctcctctgccatctccatcctcatcaaacctgaacaggagaccgaccccttgcccgtcgtgtccaggaatgtcagtgctgatgccaaatgcaaaaaggagcggaagaagaaaaagcaagtgaccaacattatctcatttgatgatgaggaagatgagcagaactctggggacatgtttaaaaagacacctggggcaggggagagctcagaggacaactccgaccactcctctgtcaatatcatgtccgcctttgaaagccccttcgggccaaactccaatggaagtcagagcagcaactcgtggaaaattgattccctgtctttgaacagggagtttgggtaccagaagcttgatgtgaaaagcatcgatgatgaagatgtggatgaaaacgaagatgacgtgtatggaaactcatcaggacggaagcacaggggccactcagagtcgcccgagaagtgctgccatggccacgactgttgttacactcgagctgaggaggccggctgcagccccaagacagagcgctactcctggcagtgcgtcaatcagagcgtcctgtgcgatgagtccccagcagcaccatgccacccaccccgagtatcccctgggcaccctggcatagccagatgacttccgtgcccctgttgcaataaccactgcttccaagtctctgtagaccaccccttgggtatatctcatgtaagtgatatttattttatttatattttttgagtcagagtctcactctgtcacccaggctagagtgtgctgacgtgatcttggctcactacaacctctgtctcctgggttcaagcgattctcatgcctcagcctcccaagtggctaggactacagacatgcaccatcacgcccagctaatttttgtatgtttttcagtagaggtggggtttcaccaagttggccgggctggtctcaaactccccacctcaagtggtctgcccgcctcggcctcccaaagtgctgggattacaggcatgagccatggtgtctggccctaatgtgagtgatctttaacactgagcacttgaaaaagaaaaccctgaagaaacctaattattcgatgtctggacgacaaggaagaagatagaaatggcatcagataataaacagtgtaaatgtttgtttatcagaaaggggctggtggtcgggacaagtaggaggatcgcttgagtccaggagtgcatctctacaaaaaagttaaaggattttttaacattggccaggcgtggtggcacacatctgtgatcccagctacttgggaggctgaggcaggag

SEQ ID NO: 842 - DNA, 1131 bp, Homo Sapiens
ttatatcaatccttcacatttctttgatttatgaaagaaaaaatgttgcaacatatagaagatcagaggaaggaaaggaggaagcagaagctagaaaaatctagattgtcttcatgagccagacagaggatggcagaagctggcccaagtctggagctggctgaagatgaggccaatctctttgcagcaaagcccccaaagcatgtggatcatgtggatggattttttcactttctgccttgtcatttagtctaacaactgagactcagatgagagctgagtaaaaggtctcagtcaggccacatgaaccacctccacctccactaattcaaggaagaagaggtgcaaaacccatgcccacctgtgtaaatgctgctgcaggtttgatagaaaatcatgctcagtcaccagctataggcaatacacgtgtctctgtgagctccatccccacacctcctccaccaccccttccatctcccctgtcaatgtcttcattaggagcttcagtgacttcaactgctctccaccaagacctctcccacctctgcctccacctccaaacactgccttgggaactccagcagtaccacctcctccagcgcctttccacattttccccagccatcttcacccagctcctcttccagctgctcctctacacagccctctctgccaggaattagtgctgtcccagttcatccatcccacaagacatccaaggctacctccagccccacactaccttctctggctccacttggtattcaaccatcatcatctgtcacagttgcagtcctgctcatcctctctctggctacatccaacttcacctactgctgtcccaagtccccaagctccatgaatgaccccaactcctccaacacaagttacgtctgcttatgagccgaagtgtcatctcccagctgtacctatagtctgggttgccaagagtgtacttctggaagcagtaaggaaaggtgttcggttacacaacgtagaagagcagggtgtaaagagagctcaccatgaagacattgaaaatgatgttgccaccgtcctgtcttgccatactgctgtggaatctagtgattcagaaaatgtttccaaatttgatgaagtagactggttgga

SEQ ID NO: 843 - DNA, 4661 bp, Homo Sapiens
cgcacgtacgcacggacgtcctcccgagggaggcgggaactcggttcgcgggcgcggagcggtcccggaccctcgaagccagttccttgcgtcagtgccgcggctctttaacccgaagggagattttttttttaaagccagaggccgttgacgctgggtagcctttggctggggttggttatgaactccgacacagcggtggtgcatacggaagggtggtagccgggacggttccggtccctgcgagcgtgtcccgggcgtctccgcggaagtttcacctgccgcgccgctcgatcgccgggacctcctgggtctctgctgtgcgtagaccagccgcgttcctttgggtggccgtggagcactaaagcggggcttattgtttgtttggttttggtttttttttttgttttttttttgctttttgtttttgaactgaggatctatcagaaataggctgaaaagaccgagtgaggaagaaactctttaacagctatttttggcatcttaaggtgattctcaggagttgctacgtatcagaatcaacggaggagtttttcaaagcagagatgccagggccagtccccagacctgaatcaggaagtgagggagagagccgacggagggggaaaagtcccttcagctgattcttatgtatgtcagtttggagagccacggatataaccaatactgcgtccttctgaggtcccactttaagtgtcctgggttgagctgggtgacaaatgcccttacaacaatggtagtagaagctttcaggccaagcgcagtggctcacgcctgtaatcccagcactttgggaggccgaggcgggcagatcacttgaggtcaggtcaggagttcgtgggcagcctggccaatatggtgaaaccccgtctctactaaaaatataaaaattagccgggtgtaatggcgtgcgcctgtaatccgagctactcaggaggctgaggcaggagaatggcttgaacccggcaggaggcggaggctgcagtgagccgagatagcgccactacactccagcctgggcgacagagcgaaactccgtctcaaaaaaaaaagaaaagctttcagaaagttgcctttttatttgaaaaaaaaaaaaaggtatttggaggattttatgtagtgcaacaactgttttagtgttaagatcatgaaatgctttggtctcctgttagtgttcccaagaaaggtgctgtaagtccttaaaccacgtgaaaactttttttttttttgagacctcctcgttctgtcgccctggctggagtgcagtggcgtcatcacatttcattgcagcctcgacttcccaggctcaagccgtgctcctcgcaattacctgggaccgtagatgcacgccaccatgacttagctgatcttttttttccctttgcctcgaagaggctggggtctcaccatgttgcccaggctgaaactcctgggcccgagcgattggcccgcctcagccgctggaaatgctagcattacaggcatgagccactgcgcccagcctcctgaaaactttttaaaatttattcaaaaatgtttcctgacctctttattgtcatagtgttttagagatacactgggattacaaaacagaggagctccctgcattcaaggggtttacaatctaatagagaaaaagattgagaatagatacatgccagggagtggtaagtgctgtgaagaaaagaataagtggggtaaaaggggttagaggtgattgaagaaggcccctgttgatcagatgaaggaacctgtcttggagaagagcaggagaggaacacataacaagtgcaaagggcctgagggaaacggattcttggcttgttagaggaggagtcagtgtggctggagtggcttgaacaagggagagaatagtaggacatgagataagagagttattaagggagccaggtcatgtacagaaatggtcttcaattttttttttaacttttgtgccctttgaaagaattttggaaggctgttttctttcctcaaacattgtaagttgactaaattttttcagaagtttaaatagttgcagagtttaatttgtgacattctgtaatactgacatttaaaaattatttttaatctaatagggaagtaaacactaaagtggcttaatactatccattttttaaagtatattaaaatgttatattttttaaacatggaaaagtattgggaatgttttaatgatatggctgggagtcttcccccttcccctaattatttcgagtaggcatgaatgcatataacattgctagaatgagataaggtcctgtatcaactccatttttcattgccacagtctttactgcattaaaaactatatatgtatacatgtatgtatctacacactcacatatatgatggagtaattcccttaaaactacccttacttttttatgtaccccttggaaaattttccttcactgaagtaccccaggagtactcataccctagccttaggaccactgagtcagataggaaggcttggatgggttttgagcaaagactcaaagcagaattgtgaaaagagtcactgtggctgcttcctagaggaatcacctgtaaatggtcagtggaataaggaagaccagttaaggggctaatagggtaataactcggttggttggatcaggttagaatctgtaaaggtggtgaaaaatatggagtataaatcataaacacttcttctcaaattcacttcaaaaaaataagctaatgaactgaatttctcaaccaaaagttttgcttccatgagttttcttaaccttttgatgcctgctacatttgcctttattaaaatctagaataaaagtgttgtttttgaaaactatataatttgtataggatggaaacagcccccatgaagttcactgtgtgctctgagaaggcagtgcctggagtataactcatgaaatatttaggatcattgaaacagacccagttacatccttgattttctgtgggagcccagaaatcttgcaggagaaactatgaaataagtccacagatgaggctgagatacgataatgcacaaacctgtctaatagactgcatagcatggggttcattatgccctgggacaaaatgcttggtttgaatctggttccatcacctactagctatgtgatttagggaaacttacttaggttgcctcagttccctcagtcatgaaagggtgtttgctacgggtaggacctacctcaaggttgcctcacaaacaatatttgtaaaacgttaataacagcacccagcacatggtgaacatggatgttaaagtagacccaaagttccctgaaggaaacagaactggcaggagaaacacatgccactgagagaaaatttcaagaagaggaatcatgctgtggcccaaactgagcagcaggtagaggtagaggctgtgtccagccattttcctgacctaggctactatcccttgttcctctggtttgagcattatcagaaaaaaccagttctgaaataaaggaaagagctcttaggaggttcatagcagttctgctatgaagaaaactcctctaagttgctggtaaacaatagtggaaggagttttccagttgtctaggaaagagaaagggcattggaggtgagtgacccaggtaggtaagcaatggtgagaacacgatgtgtccatcatctgggcacaggaggttggcaaaagcaaggcagtagcccaagggtagcgtgaagatttgcaaaggctggtctgcaccttctggacagagcagccatgctgaacagcaggaacagaagagtacatgagaaccggcagaaggatgctgagctgcagctgaaatctgggatatttctgtaaatgtacaatacttgcactcaccaatgggtgaggccagaggatctaaaggtgacattttatcttttaaagttcacttctcaactgggtgtggtgccttacacctgtaataccagcactttggaggaaaacaggaggatcactggaggccagtagttcaagaccagcctgggcgacatagcaagacccccatctctacaaaaaaaatttattaatacaaattttaaaaataatgtaaagtttagttctcatcattccatggtgtaccaagtacactttgacttctaggtactctgttgtctgagtgagaactattagtaccaagaaaagcaggacagatagcagagttctgagtctaattactatctattggcttttctgtgtctctaaggcctttcaggggcacgttgtaattctagtaataaacaccacatttgaacagcagtttacagttgacaaagtgctttcacacacatctcttaatttttgcaaccagtaaaatatagctcaacaataaatagacttccttatgtgaatgtactgtaatgtattatctattcatagacaataaggttttcaattttttactattataaacaatactgtgaaaagcattgtgatgcataattatttgcatatctataattatttcttctgaatattcctaaaagaattgctgattcaaagaatatgcccattgtaaaagtttttaatatgtaaatttaaagtattccatatggattattaaattgttttgatgtattttgctactataaataaaaaagtgaaattaacatgcaat

SEQ ID NO: 844 - DNA, 1020 bp, Homo Sapiens
atattcaatatgtaatcttgctgaaaactcttaggaaaatgggaattggtgaatacttactctatcgggggaccccaacccctggttgtgggggtaccggtctgcagcctgttaggaaccaggcctcagagcaggaggtgagtggtgggcgagcgagcattaccacctgagatcagcagcgccattagattcccaaaggagggcgaaccctattgggaaccttgcatgcaagggatctgggttgcatgctcctgatgagaatataatgctgatgatctgagttggaacacttccattcccaaagcatcacatcccccccactccccattcgtggaaaaattgtcttccaggaaactggtccctcatgccaaaaaggttgaggaccactgcagatgataaaatatattaaatccaccctcacacctaagaggatgcatgcatattggttcagtgcacagacttggggctaaatgtttccagattgtggcacacacagaatatgggcttctcaggctggctcagtcccactggtcaccctggggccagaggtcagtacccatttgcaactctgtggctcactgggtgggaaacgctggtataaagaatgacaaacaaacaaacaacaacaaaagaccagcaactcagcagaaaagcagacaaaggatatgaacagacaattgataaaagaaaatagaaataggctttaatatactcaagctcattaattataagagaataataaatgcaactacctatcatattgccaaaattccaaaagttgaatgacacataatgttggtcacgggtggggaaacatacatttaattcaatcccaattatattgttaacaaatttggagggagcggcaggtgcaggcaggaccaggaaatcctagagggaaatcaaactgaaacagtgtctttaggggggaaacagaatagatatcaacattatgaatgcacactcccgtgatacagaaattctacttccagaaacttactctacaaatgtttacgtaga

SEQ ID NO: 845 - DNA, 3370 bp, Homo Sapiens
ttttgagacgtttcactcttgttgcccaggctggagtgcagtaccgtgacctcagctcactgcaacctctgcctcccaggttcaagcgattctcctgcctcagcctcctaagtaacggattacaggcatgcacaaccatgccccactaatttctgtacttttagtggagacggggtttcaccctgttagtaaggctggtcacaaactcctgacctcaggtgattcacctgcctcggcctcccaaagtgctgggattacaggtgtgagccactgctcctggccaagggcagaaactcttacaccttgttcactgctgtttcctgggcacctattatagtgcctggtatatagtaggtgctcagtaagtgtttgttagggactgatgcgttggttcaagcctgtaatcctgttgctttgggagatgggggccagaggattgcttgtgcccaggaattcagggccagcctgggaaacatagtgagaccctgtctgtagaaaaaataataagctggccaggcgtggtggctcacgcctgtaatcccagcactttgggaggccaaggtctgcagatcacctgaggtcaggagttcaagaccagcctggccaacatggtgaaaccccatctctactgaaaatacaaaaattagtcgggcatggtgacacacacctgtaattcaagctactcgggaggctgaggaaagagaatcgcttgaactcaggaggcagaggttgcagtgagccgagatcatgccactgcactccattcagcctgggcgacagagcaagactccgtctgaaaaaaaaaaaaagaaaaagaaaaactaataaacttagccaggtgtggtgttacatggctgtaatcccaactacctgggaggctgaggtgggagaatcacttgagcccagttgatggaagctgtagtgagccataatcacctcgccgtacctcagcctgtgtgacttagggggactctgtctcaaaaaaagtaaaaaaaagaaaaagaaaaaagaaatattcattggggaaaagaagagtgaacaagcaaagtttcaggagagtactgtgaatgtgggtcatgtcagtaaagtgtagggacttgggcaggagcggctggacttgaagagcaggttggtggagaccaggtcatttatcctaagaagtttgccctgtagcatgtagattaaatatcccacgttggctgctggcaactgaactgggcttcctgtttctgtgtttggtttgaccatcacagtgttgaagaactgttgaagtgaataccttgcagtttgctacagtttcccccggtctcccacattactctggcctccttacctcatgtaggttgcctgaccctctgagacctgtgtttgctgttcctgcagatgggtgggtatgaggtgatttaaggaggaagatttaatatatgagttgtagaaagataaatagactgggcgcagtggctaaagcctgtaatcccagcactttgggaggccaaggcagaaggattagtttgacccaggagttcaagaccagtctgagccacatagcgagaccccctctctacaaaaaatttaaaaattagccaggcatggtggcatgcacctgtaatcccagctactcgggaggctgaagtgggaggatagctggagcccaggagttgagaaagctgcagtaagtggtgatctcgccactgcactccagtctgagtgacagagtgagaccctatctcaggaagaaaaaaaaaaaaaaaaaaaagcaagagagataaatagatccaccattagtgggagtgtgcttttgagtgctctttaggagaaaaatttattttaatattttttcttctttatattttttatattctagcaagccatttcttcaacaaggagaaattaatttcatccaaagagccctaagagcaagggcagactcagaaaatcagaggcactgtagtcagtttgagcagcttatgtcttcagactgctaagctggccagtgccaggctgggtccctttaatttctcaaacacaaatcgccctgctggaatctcaagttggatctgcagtagatcaccattaactcagcagcttgctttgttgtgagtccttatgccaggaactgtgcgggatacaaaatgtaagagaaggctggaatagagcatctcctggggaaatgagagccagagatacagcggtgccccatggagacagccagctggtgtttggtagttccttgtggaaaggctgtactttggtaaggtctccatatctgcagtgtggccttcaatattgtaggtccccaaactccaggtttttacattcgctgcatagctcagggtcgtagggagtgattcatcctagcagaactctggtttttaaggcaggcgttccatttattaattgacaaaggaggcatatttctcctttagtaacctgatgatttaggtcctttcttcagggactccctttccacataaaggttcttggaaaactaagcagagtatgaggaaaaggctgtgaacaagcttgctggtccctccctgtcctaaaaaagagcatacctcttctgtaaccagaaaacccttttcactagtcaaggctgtgcagactgagatgaaagtgtgtgtgtgtgtgtgtgtgtgtgtgtgtgtgtgtgtgtgtggacagggtctcactctgtcacccaagctggagtgcagtggtgagatcagagctcactgcagcttccacttttgcagcttccactttcctcctcccacttcagcctgcagagtagctgggactataggactgtgctaccacacccagctcattttctaatttttcgtagagatgaggtttcactgtgttgcccaggctggtcttgaacttctggccttacgggatcctcctgccttagtctcccaataggctgggattataggtatgagccacttcacctgacctgtgatgagttttcaacaatgtgattcctcttttacagaaccacctaagctaaagattcttttgagaacaagggctagcctgtggtttcatggcctttcttccatttggggttcttgccaagtggaatttaaatgacctcttatcaagatggataaacccaagtttcccagtgctggaatacagaaaatggatggacaagtaagtcccactcagcacccatagcccagacatggggacctcaacacacctgggccccagacatcacctttcattgtgggtagctcagagatgacacttttggttgttaagtgcccactggcaatagtttctataacagcaagtgaaggaataaatagtcaccaaaacattttctgttcccaattccaacattaattgggtgagataattattttatgaagaattgtca

SEQ ID NO: 846 - DNA, 9378 bp, Homo Sapiens
aaacagcacacctcttggtttatttgtattcatttcatcagtttcaaggaaaatatgttgggagttcctcgcatagagaatgtcacaaagacatgttttcaatagtagtgctatccctagggcagagaagacccagagaaagcccaagtggctgctggaacacagtcagacaccgtgccacctgtccacactccttggctctgccatcatgctgaagatcgctttaaaggactggcttccctccccccaaaatgaatagagcacagactgagaaactgaatgtgggagacagcagtggattatgctgttctcaggggtcacctcaggtttggaagcattctttcaaattaacccatctcaggccatctgcagagaagaaaggtggtacctaacttttttcttgtcagcatttggtaggggtgttttattgaccaaatatgttcccacaacctagttttttgtgagtaactaaatatagtagagttttaaattttatcatcaaaatctatagacaatttttgatgaaaatagactccatctctatgtcctgcttttcttcttcttattaattacattgctgtataaaagaacaagacttcagaatcaagaatatcttgtctcttggcattgaatttatacaaggtgctctttctttaatgctgtctcaaaggacatatttttactcattaaaaaggaagatcggaatctagttgtatgcgctgctccaacatattaataattaaaattaggaggtaaatgtggtcaaaactatagaaagactgagatgtcatttatattgattgctgtatagcattctacaaacagaaattgttaaataagtttatataaatattttgtagcatttcaaatatttgagtgcttgacgtttctcctcttctatagttcagattatcaatttgaagacttactccgctagttaaaatgtttttagtctcgttcgagtattatataaaagcaattttcagttaaatgtgttccgcttacatacaacattacaaattattgaggatttaattacttattcatgttcctgtaatatctttagaagattttcttattattacctatcaatatatgtatgctttgtcaaagaaaaatcaaacatatatatcattgaaattgaaactttttaaaagtacttattaattctattgaaaaaccacatccataggaacaattacaatataatattgtgaacatgtaaacatataccctatgtctattttatgtataagcatgtatgattaaaaatatagtgaagaatttttaaacctagtattataaagtaaaaattagttaacttctgatgattatttgttaattaagataaaattattttgatttgggtgattttaaataaagaaaaatattaaattacatgacaaaaattctttataaaatgtttatgatttttacattggttttatcactttttccactattttattttaagatgacctgccttgtttaaaacactgtattcatcttaattaaattagattccatttgtaaaataattaacaaatgatttgctctattttacagtgcggttataaactgagtcagtatctcaagatttgatccccattatcatcatctgtggccctatttgttttataaatgtattgtctttttccatgcctgtcacatctctattgctttttcatttttctctttgtcccttatagggagcattgcctatctctagattaagcaaaggttgcatcataaaaaagcacaataacctgctcaatctttctcacacagagaaatgtttgttaagtaattaaagtgtagatgatgatacaaagaccttgattaaattagataacaaagtacccttgtgattcagaatatgaatggtatttaatttctttgaaatcattaattgctgagtgacattaattaatgccaattttccagaagatgttctagttaatgaaatgtatacaacgaaaagcacaataacctgctcaatctttctcacacagagaaatgtttgttaagtaattaaactgtagatgatgatacaaagagcttgattaaataagatgccaaagtacccttgtgattcagaatatgaatggtatttaatttctttgaaatcattaattgctgagtgacattaattaatgccaatattccagaagatgttctagtgagtgaaatgtatacaacgtgcaaaagattcagaactctgaagggcaacattattctataattaagaattaagaattaattcacatcagttattggggagaaataatttttaagaattaatgactgagaaaatgttattttttacttagaaaattattttgtgcatgagcattaccgcaagttttgcaagaaacataaatttaaagaaacaattatgtgcacaagatgaatttaataacatcttgatatattccatgattgcggttttatttggtaaatctttaaatgcacaccatttaatgataataaatgaatcttggaaatcttgtaggtaagggtaaatattaggatgcatccagttacatttacacacacatacatgcatacagactgattcacgtgtgtatatatatatatatgaatttaccaattgatgttaactaatatttataagagccagttggattgatatatattgttgaacctgaaaaatatttattatatacatgtttaaaatacacacagaaataaatagcaattgcactaggtatttgaaactgtactaaaatataagctgtgaacattttgtgatcattacaaattcttacactgaataaatatgtttatttttacaatattaatatgtttgatacctgtgtacattttttacaatgtgttattttatttttgtcatagagtcatgtcatgcataataacattttagtcaaagatggattacatatacaaaagtggtcccatgagattataatatatatttttacatacttttctacgtttaagtatgtttagatacataacctcttaccactgtgctcttattgcctgcagtattcagtagagtaatgtagtacacagatttgtagcctaggagaaagaggctataccatataacctaaacgtggtaggctgtacaatctaggtgtttgtaatattctctgtgatgtttgcaaaatgatgaaattgcctatgaatacatctgttaaaacgtatccctatcattcagtgatgtgtgactgtactaaaatgctcaatgtaagtttcaatgccctccataaaattgttgtactgtgaaatacaaatctctcacccatggcctgaatatgtttgcaaactaagcagatcatgggaaggagaatgtgctggcatcgctgggatgattttctcacactacatgaataatatctacagacttcgtgaatatgagccacttgcatagagttaaagtagacgtctctttgctgggaaatttatcaaatgggagtatgaagtgtttttacaagatacttgtttgtttgtagctggtaggcctacagtggctcatggcaatggttgaggttgctaagatttggtggaagaaggcaaaatgagatggccacttatatggtatatggatcacttgtttctgttgagttacaaactcagctggctatttctccaatgttagttatttggagaaaaaaaaacgtgatggtaattttggggtaacaaatacaatatttgatgaaagcaaatttattgagggttagacaaactacaagatactttaggctgcaaagtcaacacgagacttctggcccaaattgtgaagagtttgcgtccagctgcacagttcaaaggaagaggccatgtaagaagattctcacttctgacaccaactgccagttcaggggtttcccctgaacaccctcagtttcaagagtttactagaaagactcacagaactcattgaatgccactgtactcatggtttataatagagaaagggtagaaattaggaccaatagaagagacatatcatataaggtggaatctaggagattttgaatgttaagtttccattgtcttcaggacatattacctgtcactgttgtacagcaacaaacatggagtactaccaacctggggagctcacctgatgctaacaagacactatttacaaaatgaaaagacaaatgaaaggatgagataagatgacgttccacattaaggcactggaacgattagcaaactaaacctaaagcaagcagaaggaagaaaattaaaattagagaaattaataatttataacaataatatttgttagtgttgaataattgatattacttcttgactagcttttttaaaaaagagaaatattcacttcccaatttattctgtggggccagtgttactttgatacaaaaattagtccaaatagcatagaaaaataaaactactataagtataaatgcaaacttccttaaaaaatactaacaaatcagatctagcaacatataaaagaattatacactatgacaaagtgaaatttatacaagtaatcccaggttggtttaacagcccaaaatccattaaggtaatacatcttatccatagaataagaaacgagaattgcatgatcacgtcgatagattcggaaaagacatttaacagaatccaaatgctttaatgactaaaaataaaaataaaaactcaatgaaccaggaatagagaactttctacacctgatatatggcacctgtgaaaagccaacagcaagcatgcaacttaatggtaaaggatgctttcccgctatggtgagagatatatactttgataggatatatactttgacctcttctagtcaacactgtactaaagattttatgcagggcaaatcggcaactaaaaaaataagagtcacccatactgaacaggaagaaataaaactttatttgaaaataacattcttgtatatagaaaattttaaggaatccaccgaacgatagaactcgtaaattatttcagcaatattacagcaaacaaggtaaatgtacaaaaatcaatttcacacatctgcaatgaaaaccccaaaatgaatttaagaaaacacttcaatttaaaatagcatcaaaaaaagaaataataattaatttggaaaatgtgatacaagattttcctctgaaaattaaaaattattgtttaaagaatatttaaataattagcaaacaccttacacccatgaattggactatttaatattgtagtactttacaatttgaactacagatttgatgaaatccctgcaagtatcccaacagacttctgtctagaaactgacaagctgattctaaaatacacatggaattgtaagggactcaaaatagccaaaataatcttaagaaaagaaaacatgttaggataattcacacccccatgctccaaaccttactgcaaagtatcggtaatcaagacaacacaatactgatgaaggaaaaatatatagattgatggaagataattgagagtccatatataaaactatgtgtctacagtcaatggattcttacagtggtaccatgtgcaattcaatgaggaagagacagtctttgaacaaactgggtcaacaaagtacacatggatcaccacttgcaaaataataaattcgaacccttaccccaaagcatacaaaaatattaactcaaatgaattaaagacacacatgcaagaggtagaataaagcatatgggaaagtcttcaggattttggatctagcaaagaaatagctgtaaccccaaaaacatgagcaacaaaataaaaattagatatttaaaatttcttaaaaattaaagacattggtgtttcaaaggacaaacaagcaagtcaaaaggcagctcaaaaattgtgagaagatatttgaaaaacacgtatctatatgtctgtatatatatatgtatcttgaatatagaaaaattgttttaactccgtcacaaatatcccaactcaaaactgataaatgataggaatagatgtgtttcccaagaagatacacgaacggtcaataatcccataaaaatatactcaatagcatcactcatcaggcaactacaaatcaaaaccacagttagatactctatgggtagaactggccaccttggaaaataatttgatggcttctaaatatatgaaacatagaattgtcatatgacccagaaatttattcctaggtatacacccagattattggaaagaggtgttcaaacacaaattgtacacaagtatttttagcagcagtatttaaaatagccaaaggctgaacacaactcaaatgtcaataaaaatattattggataaacaaaatgttatatccaagaaattgaatgttatacagttataaaaagaaataaagtaccaatacgtacatgaaccttgatagcattatgccaactgaaagaagccaggcagaaaaggccacctattgtatgattctatttagatgaaaacagactaggaaaatctatagagacagaaaacagatttgtggttgcttaggattgagtaggggatgggtgcataggaggttaacagctagggaaggtggggtttctttttgaagtgatgaaaatgctctaaaattcattgtgatgatggctccacttatctgtgcatatactaaaagccactgacttgtagacattaatgtgtgcactctacactatgtaaattatatctcaataaatcctttcaaaaatacacagaagagtaaggggttttggaatgctgcagctgggaggcagtttgaaatactgaataggcctcatcgagaatgtgaagtttcagtaaagacttgaggaagttgaatgagctgatcaatggatatatggagggctatctttccaagccaagaaattaactagagtcttgaccataaggcagcagcatgttggcatgtccagaggacagtgaggtggccaggaccactggtaagatcaagggtgaagatataaaagaattttggcagttaacatgtggcagatgatgatgggcttgcagatcattgtaagaaatgttgttttggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaagaaaaagaaatgttgtttttagtgtacatgaaatggggagacaaatcattatcccattatcaatattttaataaattggatccatgaaccaaatccaatgagattaaatcaattaataataatatgcaaatttgtattaaaattaaaagaattacttgcacatttgagaacaggagagacatgatttttatcagcaataataaacattattaattttaattgtgatcagctaattgagattaattgcaatacatcatgctttataatgtgactgccaaaaggaaaatatgattgtaatcttatactacatctatcaatgtcttttatacataagagtatagagtaagcccgtagttttcaaagccaacctatgaagcagtgacatcttatgcaagtttgctgctttctgccacagtgatccttggtcagcgggcacaaattgttttacaaacgccccctaggtctaaaagtagtttggatcacaatgaacacagaaacaccttcatcccttcagaaatacctatcaattacttccaatacagaatgaaaaattgacaaaggaaatatgtggattgtaaaaatgccagttagcttgcaactacatgaaagaaaaatgccatttttattacattaggtcattgtttcacatgagttttggtatagcaaaatgttgaaccaagggaaaagagacatgaattaatgaagtcttaagatatcaagaatttgaaagaaaaggcaggtcatctttgaaggttagtgacatagcattcatcttctgttgtcacctttcctgtcattccctgtatgcctgatggacaggtttcactcaagttcagagaacagcatgcaaaattagctatcaattaatctttaggaagtgagctgcatttctagccagactgagcttacgttttagcaggaagcatttttgggaaatgtttatgttagagttggcccttcttgacaaggtgagacataaatgtctactttatagacatgaattaagatgggaagatatttgggggaatcatttactcaaacgctaaataataaaggtacacaaagggcaaattatactagatttctttcccacttgttttctatgtctcatgcaattcaccttgattcccttcagtttctgtttaatgtagaaagtggcattttcattattttaagcttctagcacaatgaaagaatttctctttttcatgaacaggatcatacatgaaaaggaggaagagtgtcctatatcatatttattgttcaacaaaacactgctccacggcttaaattcagtttaagaaagagaatttgttgaacatctaacacatacataaaaggcagtaaagacacatgagaagagggcaggatattgaagtatacagacttcaatgctgagttttatatcttagggagttactccaccttacagaggctcaatttcccctgatttaggaaggcgatgctaatgggtattgcataggtgtaagtataaaaatgttgtattgaagagaatcccacaagcttggtataaggccgaaaataaattgatgtgacatgaataagtagtttattacatttgtatgctacctgcagactagaggaagcaagaaacacagccactatgcttgattagcattatagggatggtacaatgattgttgccagaagctggagggaggaagaaatggggaagtattgtttaatgggtatagagtttcagttttacaagatgaaacgaattatggagatggatggtagggacggctgcacaatgttatgactatatttagtaccactgaactgtacacttaaaatggttaaccgagtacattttatgttatgtgtattttaccacaataaaaaaataaaataccttaggaacattttcatgaaaaagcccacataaaattcattttaatgcacgtgtttatgcatagctttctatttttctcttttccctttacattcctaattctaatcagagaagggaatcccctctgtacctccaggatattcagtaaagaccactggaggttcatgccc

SEQ ID NO: 847 - DNA, 1342 bp, Homo Sapiens
atggattctgatgccctgcgagtcttccagaatgagctcatttgctgcatttgcgtgaactacttcatagaccggtcaccattgactgtgggcacagcttttgcaggccctgcctctgcctctgctcagaagaaggcagagcaccaatgcgctgcccttcgtgcagaaaaacctcagagaagcccaacttcaacaccaatgtggtactcaaaaagctgtcttccctagccagacagaccagacctcagaacatcaacagctcagacaatatctgtgtgctccatgcggagactaaggagctcttctgtgaggctgacaagagattgctctgtgggccctgctctgagtcaccagagcacatggctcacagccacacccaataggatgggctgctgaggaatgcagggtacaaacttataaaggaaatggactatttatggaaaatcaatcaagagacacgaaacaatctaaatcaggaaactagcaaattttgttcattagtggactatgtgtcattaaggaagaggataatcactattcagtatcaaaagatgcatctatttctcaatgaggaggagcaactgcatctgcaggcactggaaagagaagcaaaagagcttttccaacaactacaagacagtcaagtgagaatgacccaacatttagaaaggatgaaagacatgtacagagagctgtgggagacatgccacatgcctgacgtggagctgctccaggccattttttttgcaggactgatttggcacagatgcaaaagccccagccagtgaacccagagctcacttcatggtgcataactggagtcctagacatgctcaacaacttcagagtggataatgctctgagtacggaaatgactccttgctatataagcctttctgaggatgtgagatatgtgatatttggagatgaccatctcagtgctcccacggatccccagggagtggacagctttgctgtgtggggagcacaagcattcacctccggcaagcattactgggaggtggatgtgaccctctcctccaactggattctgggagtctgtcgagattccagaacagcagataccaatatcgttattgattctgatgaaagattttttttaatttcctcaaagaggagcaatcactatagtctctccaccaactctccacctttaattcagtatgtgcaaaggcctctgggtcgggttggggtgtttctggattatgataatggatctgtgagtttttttgatgtttctaaaggttctcttatctatggttttcctccttcctccttctcgtcccctctgaggcctttcttttgctttggttgtacatga

SEQ ID NO: 848 - DNA, 3458 bp, Homo Sapiens
actcgatgggagccactagagggaataagatgttctcctgctgtatcccgactttctgaggctctgactccaggaaagcccggcacgagggccttttccattgctgcaggctttttggctcagcactcacttttggcacctctggccatttggcaggaagtacccaaagtgatggccaggcagggccctgatgtctgatgatctggctgccgagcatcatttgtgcagagctccatgtgagagatcagtgaggagctggttgatgggttcaactcctccatcttcctagacaagggttgtctgctcgtgttcttgttgccgtgacagcccttctcgcaccctggaacctccaggcattcgcccctttgctggatctgggatcctcatagctcaggttctcaagactgcctttattgtaaaagaaagaaaattaagtgccttgctttgaagtctaaaggactctcctagggtgggtgttgtagtccattttgtgctgctgcaacaaaacaccatagactgggtaatttatattgtacagaaatttatttctcacagttttggaggctgggaagtccacagtcaagatgctggcatctggtgagggccttcttgctgcatcatcccatggcggaaggcttcacagggcagaagggcaaagagagagtgagagacagcaagagggggcagacccacctccacgatactcacattaatctacccatggtggtagagctctcatgacctaaacacctcttaaaggtcccatctcccaatatggtcacaatggcaactacacttcaacatgagttttagagaagacaaacatgcacaccatagcagtggatccacactgtaaactggtctctcaacttggtgggggcagtggggtggggaatgaggttcccccagatcctctccctccatgccagaagaagactaagcttcaggtagcttagggggaaggtgatgcggccctagctttgggcagttcttagttctgtcttgtgtgaccttgagcagccatttgacatccctaagcctctgttttccatctcaacaatggggatttttttaggacgcactagagtgatgctcttcatacaagctcttaataggggaatgctaacctctcttgctgtgggcactcacatccctcttcacacacaagtccccaaggagttggggcttcctggtctgagctctagctcacgattctcctggtggtttttggtgctgcctctgactctgtgtccttccttgtcccactcagtataaaaatgagttaaccctgcacctgggcgagatctgcacaatgtggaccctccaggtgggcactcaggagcatatggtggcatccctggaccaggcttccagagcagacacataccctacagcaccaccttcctgggaaaccactggttcttcgtctctaccccacagttcctggactgggtattcaataggtgggagcctgtcccttcgacagcacagtggggactctgccaccagctagctgtgtgtctcaggaattttgctgcacctctcttagcctcaatttgctcctctgagaagaaaggtgatacacatgcatcctgccatattctgacagagatgatggacctcaggatcaactaaaaatgtcagtggacttcaggtctagaaggacaggctcctgtttccccagaacagttgggggcatatgggagtctgtggctggggaggggctggcagaaccctggatctcatacatcttaggattcccatgagagggctgaggtctgggggcttcctctgcaggaggaaattagttagtgagagttatggataggatccaagtcccctgggaagtgaaagggaggctggggctcagagccatccccaccacagtcccatcccagctctgcccgcctccttccacatccacccctccagacccaacctctaggggacctagaacaggagctgtagtgagcaacccgctcacacttctacctcaaacctcattcctggtgcaggtagcccttcagagcaagagtcactggcaagacccagcccatgtaggttctatgcctgccctgcctgaagaccagggctgtctctgccaggacagtcacagaggggttgggtggggccgtctctggacaggcagggcaggcacaggggcccacatccaaacaaggtgccctagaagagcaatgtggaaggaaaggccaggtatgtgactctgctgccccccacccccaccccctaacactatctcttctatcctgggcacctggccagaaaagtaccctgagggcactccggggaaggagcctgctccagtgacagcccaagatagaatcagtcccagagcactcctgcccctagcctgggaccatacagaactggcccagtgaggaggtccccagcctcctgggggattctttcctatgctggtggcagagcaattgactctgatggatgcaatgagcgctgggctctcagggcagggttgggacagcctcccctctgggacctttccctgagcctcagtcgaatgatgcgggcccaatcccatctccacctcttaccaaccatatggcctggactagattcttaacctccagaccttcactgtccacatgtacagggcagagatgggacataacagcacctgccacacacagtgactgtgcagaatgagaggagagagggaaggcaggtcagggcctggtccctttgtaggtggagggtgctcactgaggagcagccaggtgcatgggttgcccacttgtgctcaggaaacctcacccacctcagcccttattaggcacctaatgtggattctaagacagacactgaaacaaagctgcccctggggaagacgacatgtatccaaatggggagacagactagatggctgatcaagaaggagacagatgccatctggggagggacaggcataagccactttctggtgcttggagttagtgaggaagggctgagtgaaaatgccactctcctgtgcctaccaatattgggtcctgggtcatcatgtgctgggtgccctcagtgaaccaccatgtgatgcagagaccagagagtgaaggcccgggccggcgcagggtggtgcaactttgaatcgaggtggccaaggtttgctgtgggaggcccagggagctcccgtctgtgtccccttccaaatctcatcttgaattcccacgtgttgtgggagggacccagtgggaggtaactgaatcatgggggcaggtctttctgtgctgttctcgtgacagtaagtctcacgagatctgatggttattataagggggagcttttcctgcacaagctctttttgcctgctgccatccatgtaagatgtgacttgcttctcgtcttccaccatgattgtgaggcttccccagccaccaaccatgtggaactgtaagtttaattaaacctctttcttttgtaaa

SEQ ID NO: 849 - DNA, 2045 bp, Homo Sapiens
ttaagcgctcaagttaaactccttgtgacccacataggttagcagaatttaaatcctaggtgattattaactctaatcatacatctaatgacctatattgaagatacactgcctgcttagttgtggcttcagcctttgctccgtcactgatagttctagcctgaaaagcaaatgagccctcatgctcacgatttcaccacagtcacataagcgggaagagcaggctcctggctgtggcgagcttgactccatttggtttgatagaaatgagaggtagatgattccctagacaaatgcaggcctttctcgaagcccctttcccaggacgacgtgacatgagtggtctgtgccttccagggcagccacgtcatgctttgcccagccagggcggtggggagggagacagccacatcctgcccggggctcctgggccccgctgcatcaagtgaaagcagggctggctccctgatgtccttggagaagtcgcccacactgctttcccccatgggagtgacaaggatgtgtcccgccagccttccacgacggaccccccactctctattaattcccaagaaaccaggccatggaggtgggtttgagggtttgtattggtgttttttaaagtcaggttgaccgagtgcggtggctcacgcttgtaatcccagcactttgggaggctgaggcgggcggatcacatgaggtcaggagttcaagaccagcctggccaacatggtgaaaccttgtctctactaaaactacaaaaaaaattacctgggcgtggtggtgggcgcctgtaatcccagctactcaggaggctgaggcaggagaaacccttgaactagggaggctgcagtgagccgagatcgcgccactccagcctgggtgacaagagtgagattctgcctcaaaataaataaagtcgggtttattaagatataatttacatacagtaattttttttttttttgagacagagtttcactcttgttgcccaggctggagtgcaatggcacgatctcagctcactgcaacctccgcttccagggttcaagccattctactgcctcagcctcctgagtagctgagattacaggtgtccaccaccatgccttgctaatttttgtatttttagtagagacaggttttcgctatgttggccaagctggtcttgaactcctgacctcaggtgatccgccagcctcggcctcccaaagtgctgggattacaggcatgagccactgcacccggccagtacatgctttcttgatttgtctgtttcccacctgtctcccctccctagaatggcagctccatgacgacagaggtgtttctctgttttctccatggctgcaccctcagctgctagaaggtggcccagcataggaggtatttaatgaagccttcctctccacttaaatctacacccttgtgcttattaaaaggtgacagttttctgtttgaaaattttattagtgttttaatgagaaagttattatttgggtaatgcctgaatatgaggaaaacattaagggtagaaatgtaattgttttcctatttcattcagtctatggattttattgaagattacagaattacttctttgtagctatggaagtaaaaaaataataagacgagtagctatttcaaaacgtagggctgataaatttgggatggtttgagaacgttaagttggggaactccatttctttttttacatttttatttattttcatttgtttatttatttatttgagacagagtttcgctctgttgcccaggctagagtgcaatgccatgatctcggctcactgcaacctctgcctccggggtataagtgattctcccatatcagcctcccgaggagctgggactacaggcgcctgccaccacacctggctaatttttgtatttttagtagagatgggatttggccatgtcagccaggctggcctcaaactcctgaccgcaggtgatccgcctgcccttggcctcccaaagtgctgggattacaggtgtgagccaccgcgcccagccagggaactgca

SEQ ID NO: 850 - DNA, 1931 bp, Homo Sapiens
gttattactatcaatttttaaaaaggccatggcaccccagaaggtacagatcctctgaatgctaagattgtgtttttacagttgtctagtataggacaggcttctcatgtggaaaagaggattcagtgtggtatcaaaaaattgattggaaggcttcctctcttactctctcatacatagacattcacaaacaccatctttgtttagtaaactgtggagactcttccaaaagaaaatagacactaatttttggagaatccattcagctttcacaggcctctaaatagcacaggtgttagaattactaaggataacgattacattaaccaggagcaaaactaaaaatacatcgttctactttcatacttggaaatatcggccttttgatattacaaaaaggccaattttgccaggtccttcgaaatttcaaagaaagattcagtaaaaataaataaataacaggactcactggagccatgatgaaatatttccacctaaaggaaacaatctttaacagctcatccttcagtacactcaaacttctcttgaaccacttaaaaactccattccagggagtcctccaaagttccacaacaccagacgcaagctacccaggacatgtgctctagcagggcatgcccagggcccccagatagatgactgaaaaatataattctttcaggtggacaaggcccagcaggaacgtagtgtgccaggtttccctgccagccctcctcgccctctcggcggggggccaaatgactcaacacagccctgttcgtacctcccttttcttcccatctcccacattataagagatcagagccaagttatccttcacccaaggtcataatctcagattggggagtggtaagtggataatgacaggctctcacagtgaactctcctcctaaacttggcacatcacaaagatttcatcttgcatgctgtccaacctaggcactggctgctggactgttgacaaagagttgagatgaaatccacccttaggagagagcagtggatggattatcagtatattctgtgggctcccaatagtatatatgtctccagtttgctgtccttgtccaaaccacccaaatcaccaagagttcattgagcaattaatatatacaaggcattgtgagagatgcttccaaacctggccaaatatcagagtctttggggagctttttaaaaatgcagatccttcacaatttttctgtaaatctaaagttattctaaaacacaaaagttattttttaaaatgcagatcctttggtttcactgaatcagaagctccccagaagactgtaatatggtcatttagagagctcagaaaccaccatttaagaggctactaagataactaatattaagaccgtcactactcttacccactactcttataaagaaaaccctgcagtcatgcaaaactgcaacacattcatgggtcatcagatcaattttatgggtcatgaccaggatatactcttaaatacaatagagaagttttaggtacattattactttgtgaatcttttctctgagacacatatatatggatatctatatctatctccatatctacaccaatatagatatagataccaatctgtgtactgcatcacaatgaaaacatgtatgttttactttgcggcaaagactaaaaatgtgaaattaaatggtctaaattaaatgcttcctactgcaatcttagtgtcttccctctcttgttttctagtggaaactaagaagcttaccatcaaccacaactctccattaaaaaattataaattgatcttctcttagccttatttctctaacttggaaatgtggaatttccttgcctttttttcatagacaaatgttgttattctttattaaacttcctccaaatggggtttattaaattttagttttaaagtgtg

SEQ ID NO: 851 - DNA, 2559 bp, Homo Sapiens
gcagattttaaaaagcgcagtgggctcccacccatcttctgctccttgctttttcactccatctggcgtgaagatcttaattctgcgtctgcacaacggcgttctgccgggcgcgccagtttgctcctagtttttttcttttcttttcttttctttttttttgagacggagtttcgctcttgttgcccaggctggagtgcaatggcgcgatctcggctcaccgcaacctccgcttcccgggttcaagcgattctcctgcctcagcctcccgagtagctgagattgaaggcgcacgccaccacgcccggttaatttttgtatttgtagtagagacagggtttcaccatgttggccaggctggtctcgaactcctgacctgaagtgatccgcccacctcggcctcccaaagtgctgggattacaggcgtgagccactgcgtccgaccttaattttttttttaagacacggggtctcgctctgtcgcccaggctggagtacagtggcaggaccacggcttgctgcagcctcgacctctctgcccgaagcgatcctccctcctcggcctccagagcagctgagaccacaggcacgtgcccccacgcccgcgggcgctcctagtttccttgccgaaaaacatcgatgccacgatcctgcttgcacatacatctagcggtgaagtggctgagggtaagggcatttaaaacggacctagggccgggggcggtggctcacgcctgtaaccccagcactttgggtggccgaggtgggaggatccgtgagcccgcttgagtccaggagagcctgggcaacacagcgagaccccgtctctacaaaaaaatacaaaaattagcggggccccttggcgtctgcctgcagtcccagctacaagggaggctgaggcaggagatcacttggggcagagaggtcgaggctgcagtgagccttggtctcaccactgcactccagcctggactacaaagtgagaccgtctcaaaacaaaaaacaaaaccaaaaaaacctggacatcagtgggggctgcatgaccatcagaggctccagtgggggcatctcccctaaactccgtggcagaagactggaggcttcttcctccattcccagggctcctcctcatccatcagcctctccagccccctctgctgagggtcaagagccttcccaaaggcctgctttggagcagacatggtacttttggttgggtcaatgcaccccttcccatgttttccctgaacagtcggcacccagagcagggtaactgacagcaacgcaaccaggctgatggatcactcttctcagcctcgctccttcttgatctcctggtctatttgtatgttaatctatacagaccaaaagggcacactgcaggtttaataaccttcattatggttcttggctgcctgcaagactttttttccatgttgggcaacatagcattagatgacaccagttagaatttcgtggttacttctttatggcttacccttgaggggttatgtgactcacccaagatcccacagagaggcaaggagctggggctcacctgggtttgtggccagagcctgcaggcaactgtatttacagtgggcagggagggttccctgggccccaggagggagtggggctgggctgttaagctttggttcatgccatgctaacagtggtggtgcctcaggacttacagcctccatcttgcaagcccccaaccttaggactagcctctttcagggctggtctccgtttgagattttgtgagccacctgtccctagggagcagtaaatcagggcagtgagtgtggctagttaaagctgagatgcccatggccaggtccccaactctcttccatagtcaaaaggcttagaaggaagttgagggactggggttcctcatggaaacagcgttttatttcttgggggtaatttataagttttcttagctggttctaggcactaagctaaaagctactggtgactttgaatccacactacgccatgaggtcgataccattacaatctgtgttttatgattaaggagactgactcaggtggtgaaacgtctttccccaggtcagtgaggcaatggcaaaaccgagaactgctgcctcagcccattcttaccttttacccttcgctaccccaggcctggcttgctccctccccaccccaaagcacagcataatcctcctccacttcctgcaaaagcaccgctagaagtgacaacacaacacgccacatcaaatgcttacctcctctgaccagctcgtttctcacggcaagtgacggggccacaggcaggcactgtgcacaaccagatgccatccgtgggaagagggtggagtgcttgatgctgccgcatttggaagatgcttcttagccacgggtttcaatcccttctctacccacacagcttctgttaaggcatttcagccgtgccactcctaatttccgtgtgaactctgtaaaattagaattctttgatctgtaggtctctctggtcaaatgaccaagaaacgagggatgtacaacctgagaaagcacgttcag

SEQ ID NO: 852 - DNA, 1649 bp, Homo Sapiens
atccgcctgcctcggcctcccaaagtgctgggattaccggcatgagccaccatttccggcaacaggcagacttttaacacattccttacctaaacttttaaaagggacaaaagatatatgcctttggtttgggagatgacgaaacatatgctttaatgactattgggttggaatcttcttgagagaggatccttcttagcctagactagagtcttcaaaagcccacagtgcttcgtaaagtttcatacgtggaagagagaaggatgttccactggaaaagcagaattgcagctgagctgtcctgaaatgcccagcactctgtggagacgcggaggaggtttcctgggacaaagtgctgaaccagctacagccacaagctgtctccaccatcagatgtggcttacctggttcctgagtcaattccatccagatggtgaagccaaggcctgaagacctttcctgcaaggtcgcagaggaagaggcagaagaaggaccagaacccagctcccctgactccctatccagtgctcttctcatagattacattgcttcagcatccacctggctattgctccatccaggggttacaggagtcactgactgttttggttgcttcttggttggaggatgttgtgcctcaccgatgagagccggaagcaaaggtaccagttcttagaggaagcataggaatgtgtcccttcctgctcgggtctctcaactgaactcaacccttccttgattgattgacaagcatgttatctctcataatccctgcccggtaagggctgatgtccccattttacagatgaggatattggagctcagagaagtgaaatgattgctgaaggtcacacagcctggcttcaagcctctcgggctccaaaaggcatcttctgttctctccgtcaggaagcctcttttggatgattaactgagattaaaaatgaaaagacacatgaaagaaaggtcctttttttcaacctgacaagaactaagaatgcctctgtattccaggcacccagaccagggtgggctggaaagccagccagagagaaagcaggagaaagaaagcatgttctaacaggaaggttaaagcaccctgggatgtgagttggggtggagaagtgaagagggcagttctcacaggggcagagcttggtttggggtaggctaggagctgggaccagaagagggacagggaagggtttattgtgggtccacggcccagctccactgcatgggccatctgacagcgcctgaccgagcagaatgccagggtgtaaagaccccactaatacccagtcaatgagaggaacgccagaggagcacccagaatgttcttgtgcagaggcaaagagcaggagtttgtgaccacagctggcagtccatgtcatcctcactgaacgacctcttagcattccaggtggacaaacatattcacaggtgcccagacaaatgaggtctgcgggagagagacaggctacatcagaggtagactatgtatttacataaagtaggaataagagtctcagaagccttccaaagcagatgtctgcttaaacctcttgagcggtgccctccttagcctggaaggaaggccttgctcaggtagtctcaacccgcatctgtggtgtgatttaacaccttcc

SEQ ID NO: 853 - DNA, 1513 bp, Homo Sapiens
ccatgatgtattgttggcattattatccccagtttaaagatgagccaatgcctaaggtcacacaactaggaagtggcagagctgtgatccacattaggtctttgtgtctaaaagcccacgtgtgctctaaactacttggccattcatttctgtgacagactgaaataggtagttcttccaggctaccccaatcatccacgaacctcttctcaactggtagagcaaatgtttagtaagcatatgccgagacaaaaataataggtgagcctgcagcaaaattgtggaagatagcagatggatacatggaaaggaacttagcagagccagtcccagccttgctctgtacacttgccctgcttgccccaactgcacatcggcagctgagtgccgagaggaacacacctggcagctggattgctgtcccatacctttccggccacacatgaacacttctccattctttacactcaggggttggtcagctttttctgtaaaggcccagagagtcagtattttaggtcttggacaccaagaggcagcattgaggatattctgtaagtacttaaaagagaggagtgtccatattattttttaattgacaaaatttgaaataattgagtacaacttttcttaatggagtctattaatgagagggatagaatgctttttaggggactgtttcacttaattggagttcaaagtaagtagttggctatgatcaaaattgattgcaaatgttcatctgttaggttttaatgtatttcatctttgaaaatgtcttttcaggccgggcgcggtggctgacgcctgtaatccctgcattttgggaggccgaggtgggcagatcacgaggtcagagctagactccgtctcaaaaaaaaaaaaaaaaggtcttttcaagcagtagatactgccaaacactgatatcagtccatgtgcgtatgattttagtcaaacatattcatcacttagaaagcatttgtacaattctactagattgttctcttgatacttacctttcagcatgttactgtgttgcagattaatcacattcagttaaaggttagatgtgatctcctcagtttcacaattaaatggattttgtagtacagaaattgccttcacacttgcattgagctctgaaaaacactgctggaactctagtttgagactggcagtgtgtctgctctcaatgtgtggggatgggaatgccattgcttgtaacttttgacagcatgagaactgcataagcagcttgatgttacttgtgattcaagcaacattagttgtcattattcactgaaccttactgcagtatgttttgcatttaagcactgttttgccttgtaattttagggtgaattcatcaagaaacattatcaagcttgcaacaaaataacttccaaagctattcagtgttgaatagtagtggttgagtgtggtttatctcattcagaacaattgcagtctttgccctgagctcaaaacatcacaataaaatttgattgctgct

SEQ ID NO: 854 - DNA, 1615 bp, Homo Sapiens
ataatttgggttttgtggaatccaaagaagagaaagcctacccagacttccaacctacggaagctgtgagataaaacattttgggttgttttaagccattaagtttgttttggcagcatagaaaagtaacatatagagatatggattctaatcagaagttctatttttaccactaaaggttaaaacatacttggggtagccttttctcaacgttttactttctttttatcaggagggtttagtcaggacaaaagaaaccattgcaggtatttcaagcaggaaagatttaacacaacatactaggcactttataaacagaaaacaaaaaaaagcgttgaggaaacaaaagtcaggaaaactgcctcacaaaatatggaagttgaaagaatcacagggaatcaccactgatgatctcagttatctgtggcatcacaataagtgatcatcagcagaatgtccggaagccactggtaaaatttcatgtctgcagtattcctgccttgccctgcgggaagaagaataatggcttcttcctcggttctgctttccaaatctcatgtgactgcctctcactggtggaagctaactcagatcccaggcttccagcccctgtactacagagaagagcacagaaggagaaatatggccccgaggggctagcatattcctctatctcattgttcccattgcattgatacccataggcagaaaattaagcaaggaaaaaaaaaggcaagaaaagaaaaggaacaccagccaccaaagcacttagcgatttcagattcagacatttacaaagtgaaattgcaaaagagtttcaattcttctttgcaagctccattctacctggatgagtgccatcaccctgtcaggatattttttctgtgtttatacagaatcatggaatgctagcagctataccttaattctttccttttcaattttgctctttttacaaaggaatggaaagtctattgaggttactgaatactccaagtcaagatagctagttagtaactaaacagggttaaggtcttttgaagtctttctcatttcccaactcactgtcaaggtctacagagtctgagatttgatactacttgcagactaacaagtttgcctgccactgttttgtggatactggcagaagacacaggactcttgggtcagagacaaaagacttcagcactcatgggattgaagttagcctgctactgttttgtggatactggcagaagacacaagactcttgggtcagagacaaaggatttcagtattcatgggacaacagtggccagagcagatactatacatcctgtaggtttgcatcacagtcaaggaagagtaagtttgaataattaactggtttttttcagcaaatggaagcaagcttgttctttgtctggtgagacaccttacctcaatcctcaaggttgctcactgcaaatataaatctcagcaatggcccaactaaagggccttgcattcttggcataacagcaagaatatgcagctgaaggacaaaggcaaattgcgtttcccgacacccaccaagaaagggaggactggagttataattaaaagttataattaaaagtatttcatatttactaca

SEQ ID NO: 855 - DNA, 1849 bp, Homo Sapiens
gtctttcgctccaggtagagcttggggttagtacatcactggcctgcgtgctccgctccaggaggtctcggtgattctgccacagcctcatcctccgtcgccctgtgacctactggtattggaacattcatagctaagactccaggacacccacaaagccgagaaatgctgagtttgcgggtcagggcgtccggagactggggaggcctcatcggagtcggccggaaatggcggtggcgggaccgagtctgtgagcctgagcccccctcagctcagccctcagtctcctctggtgcagggtacccaggcgtcctgtaccgtttcagcacagcggctttggccccagcctgtagccctctttgcgcagctctgcgcccgcatcttccccagcttgtgaggtgatgaggagaggttcaccagggaaagacgccgacttggtgtgcagggcttctgcgtggaaggagctctggtctgtggggtcaccagtccctactttaacctattcagacataaacggaggcaccattaaaacattaaagaatttatatgagcaaacagtgatgaaccagtgggacagccccagacatggtttgtcgtttgggggctaccagcgggtcttgaagaaaaggctttaaggtttgtgaagaggcaaagcaaactaaataattgattgggtacagttatgtagtcgtttcatttagagtgtccaggagaaaattttctggttatgtaatcagattaattggagatttatggttggttaagcctgaattttgttttctcctaaggtagtaacttacgagatacgcatttgagttagatcgttttgttgctgttacacaggaacctagatccctagagccacttcagtctacctgctatttaattattttaactttaatcagaagcactgtttttttcctacattttccaaatgtgtggcaagcagagtcttaaatctgttctgccagcctaacttggcttgcagtaaaatcttaaatttccagtttcttttttttttttttttttgtttgtgacggagtctcactctattggccaggctgcaacctccgtctcccaggctcaaggaattctcctgcctcagcctcccaagtagccgggattaccggcatgtgccaccacacccggctaatttttgtatttttagtagagacggggtttcaccgtgttagccaggctgctctccaactcctgacctcaggtgatccgcccgccttggcctcccaaagtgctgggattacaggcgtgagccactgcaccaggactgaaatttccagtttcttttcaacattcaccaaagccaactactcccatccaattcacaacattatcaactatttttgttttttattgtatgtttctatttgtaaatatttcaccggaggaaagcagaaaataatcccattacactccactgtcaaaaatttttctgctttttcttcttttatcttccctaggcacaaatgccttatcaggatatctttaaattcaagtttccctttggaaacttgatgggacagtgtgtcctcagccacactgcttttttttaagtcttgagttttagagctctcttgggataacccaagatacacacaacagccataccttttggaaggtttggtgaatatcagccccttggtcatctccttccagaggacacactgatgtatggaaatggagcttctcaggagagcagctgaatgtcctgaggctgagagaaatatcctggtttacccttcccataaaaagaacctttggggatcttaagattttctttccccagccccagttcttcctggtcagccaattggatggttgtatttagggg

SEQ ID NO: 856 - DNA, 3222 bp, Homo Sapiens
ggcagagattgcagtgagccgagatcatgccattgcactccagcctgggcaatagagcgagaaccagtctcaaaagaaagagttaatttttgatgtttataccaaaatatttagcaatctctaatgtattttgagaaggaattatatttgtgaaagaatatagtttttcaaaatgacatagatattgtaggaaatcggaatttttaaaacatgattgaaaacaagatgagtttcactcattagggtaaatggaaaatttctgagtatgatatcagcaaactctaagattcttttaaaataattgtgcaatagtcatttttctggcagagtcaattcattcttctggttcaatatattctagacaaatgaaagaaaaggaatgttgatctgtgtttatccttgtaatttttctaagctttatatacagttttataaatgggatgaattatgtgcacgataccatcaattctaaaaactacctttttaaaaaccttttggaaatcaggattgcagttgataactacctaaactcacttccagccctataaaaattacttttccaaactaaggagcatcacgcattatgcattgtcagccaaagttctgtagtgtcagcgtgatcattcgttgtgtctgtagtgtcagcgtgatcattcgttgtgtctgtagtgtcagcgtgaacattgtgtctgtagtgtcagcgtgatcatttgttgtgtctttagtgtcagcgtgatcattcgttgtgtctgtagtgtcagcgtgatcattcgttgtgtctgtagtgtcagcgtgatcattcattgtgtctgtagtgtcagcgtcatcattgtgtctgtagtgtcagcgtgatcatttgttgtgtctttagtgtcagcgtgatcattcattgtgtctgtagtgtcagtgtgatcattcgttgtgatctacatgctcatatcccttttgtccacaaaggaaataattcgcctttaaatattaacatcatttcccctatgcaattttaagttttgataatgaaataaaacacaatgcagaatgattttgctataggttagatgaccactgtacttgataattgaaaaatggtttatgttcttagacaagccaatgaagcaatctcctgctcttggaacaaacaaaaaccacatgattaacctctcacaagattgacgtgcactgtggtgtagaaagtttgtttgcctttccataacccagtgtatctaagaattacctcggaacttccatttctattaatattacctactaacacttaagtctgagtgtggtggctcatgcctgtaatcccagcactttgggtaaggccgaggtggtcggatcacttgaggtcaggagttgaagaccagcctggccaacatggtgaaaccccatctctactaaaaatacaaaaatgagccaggtgtggtggcgcatgcctgtaatcccagctgctctggagcctgaggcaggagaatcacttgaacccggagcataggctgcagtgagccgagattgtgccactgcattccagcctgggtgacagagtgagactctgtctcaaaaaaaaaaaaaaaaaaaaaatcgggacatgaaaccataagctgaaatgctgccaagacctaaaggaatgaccctcaaactggaatttcagcattttgtcatgtgattaatccccgggagaatgcagtcagctcacatgatgataggcaagtaaccacctttttctgtactcgtactactgttacttttctacaaaatgaaaaacctaaatgtttttttgttttgttttgttttttgggttttttttgttgttgttgttgtttttgagacggagttttgctcttgttgcccaggctggagtgcaatggtccgatcttgactcactgcaacctctgcctcccaggttcaagcgattctcctgcctcagcctcctgagtagctgggattacaggcacgcatcaccacgcctgcctaattttttttatacttttagtagagacagggtttctccatgttggtcaggctggtctcgaactctcgacctcaggtgatccacctgcctcggcctcccaaagtgttgggattacaggtgtgcgcccccacgcctggcctaaatgtttttaaactctcatcctgatcagtatttaggttatagataattttttaaaactctacttagaatattgtttcagaggagtctgtaaataacaaaactctataattgcagtcatagctgatgtatctatacttggatcttttccaaatgctcttctactcttgtaatttctagtctggtcagctggaaataaaagtatccagtaactccacttgtccatctaaaaatataattatttttttaactaacccattaagtattttttatatgtatttattagccaatcatgttatttactgtgactttcctgtttgtttcttttgctcattttctcaacctgctgatttatgaatacacacacatactctagatcttgattcttctgttattttatatataatatccttttcctggagagtagctgtttaaagtgcattcatgatttttctgatactgatagttttcccacatactatcatattatatttggatgttgccattatcactctaaccataaactggtaatctatttatatttttaatagtatgtgagatttctgtgtattcagtcagattatctatgaatggaaatgaattttcttttaaaatcattattatttctttacttttattaaaataaatacgattatgtcaagtattggggtaatagccagtgtcttagttgtttaaacagtttaatggaaatcagtacaatattttaccattcaactaatatttactttgttgtatgcaagtatgctctataattagggctaacttcttatattttttcaaatcctatcacttcttttgctttgttcatatatcattctcctctgctattttaatgttataattcattctgatttcttgttttaaaccatttctgaaatataatatgcttagctgtggtatattattgttttgataagctgcttaatttatcttatgaatattttgtttgggatttttgtccaaatattcaaaattgatattaatattattagcattcatatattaacattcaaaattaagaattttttaaatttttgttattgccattatttgtttattaaaggttagataaaatttggctttaaacccat

SEQ ID NO: 857 - DNA, 5662 bp, Homo Sapiens
gctcactacaacctctgtctcccgggttcaagtgattcttctgcctcaggctcccgagtagctgggtctacaggtgcgtgccgccatgcctggctaattttttttgtatttttaatagagacggggtttcaccgtgttagccaggatggtctcgatttcctgacctcgtgttctgcccgccttggcctcccaaatttctgggattacaggtgtgagccaccatgcctggcgccatatagattttatcaatacaaaatacaggatattttgacaggccactttatttagaattggaaacaaaagtttccaaattgtttgaatgtgctaaatgcttttagctttatttttctagtctgaacctttccagtagcctttcagtaagatgtaaatattgaaattaaatgtaatatttactgtggtatataaaaccagaaactccagaactacttgtgttagtcatgaaatcactggcctagagtttggtagcttctaacttctattgccagtactgctaaatcttctttttttttctttttcttttttttttgtgagtcatttggtgaggctcttgatcagtaattttcatcttcagtttgtagatatcttaagtctcaggtgtgcaattagttatacttgaattaataaatttaaggattgaaggaaaaatcacccactgccagctgttacttgtctgattcagtgttttctgaaaaaaaaaaaaaaaaaaaaaaaaaaccaggaaagccttttccttaaaacatttagtttataagtttgcatcttttccatgtctcatcttttactatactaattagtatcacacttaattctcaaattgttacatgtaagttacctttgcctccctaaattgtaaattattagaaccggtgattcttacttattttgcagtcttctttttcccagtgccttgcacaggataagtcaaatttggggtgcttattacatgccagttactattccatatacattgcatgtatttactcattcaatcttgtgagcagctacatgagatagatgcgattatccctcttttacctgaaaacaggattgaataacttcctaggctatcaaagtatgcgataaatactgtgactacactatatttcctcatatgtagtagggttttgaggaatactttttgactgattatcttcaatgtgaaggttttcatttgctggcatttatttccaaaacaaagattcctttaatctatattgcttgtctaaatgcagagtaggagtattatttcatattgtattctacttgtaattatatctcgaattgcttatttagtgatttataacatcttggagaaaaatacagaatattcatgtaaaacaatatttcataaagataattgggtaacatatgtaacaatttatatcaaatctcttgaactcaccacaatctctagtctttttcccctcctgtttatgacaccattgtgcttttagtgtcagagacagtctttgtttcatatgttcaatttcttgccacatctggatgtagcgtatctgtagtgttttctgtttctgctgctgctgttaggttctctttacctaacctttcactaattttaatcttatttctctgctttaatatttgttgcctatttatgacattaaaattttcttaaagtacaactttcatgtgcagaactttcagtggtgttgcattacctccaaaataaaatccagatttcataatctgccattcatcgccacctagtttgatccactcactttcacacattgtttggtacaatcatctactaagtaggctttctctttatcctgtacttacttagacctctgttttatgcccacgtatccaaacttaatttttggccaggcgcagtggctatctcctataatcccagcactttgggaggccgaggcgggcggatcacaaggtcaggagttcaagaccagcctggccaacatggtgaaaccccgtctctacaaaaacaaaaattaactgggcgtggtggcatgttcctgaagtcccagctactctgtaggctgaggcaggagaattgcttgaactggcacccaggaggcagaggttgcagtgagctgagatcgtgccattgcactccagccggggctacagagtgagactcagtctcaaaaaaaaaaaaaaaaatatttatttttattttttattacaggcagttggataatatattgtagaaagaaaagaactatgattcaaacagtttaataatgaaatttcttcaataaatcaagcattattcctctgcaggagttttgtgtacattgtctagaataatctttcccaagctttttgcatggctgcttcattttcacctttgaggctgcctgccttttatcttggattaaatgtattctcttatctaaattctcagtatttatcagagcaccttgtttgtttgagtctagcactttagatattatttggtaatttactaatttattatgtatctcccccagtaaattttaagctgagaacagggactgtaactgttttactcacattatatttgtattgctttgcacagagactagatattaaatatttattaaagatagaaataaggaagtgatgctactttgtattcaaagctttatatattcctagacctttgcttatctgttaaaaacaagacctagcatataacatatattagatgctcagtaaatatgtttaatgaataaaaccaaagttatcttctggaatcataatacatgagttctaatacaccctggtagatagaattatctagttcttatacttttatttgttgttgagatggagtttcactcttgttgcccaggctggagtgcagtgacacgacctcagctcactcctgggttcaagtgattctcctgcctcagcctcccgagtagctgggattacaggcgcccaccacaacgcccggctaattttttgtatttttagtagagatggggtttcaacatattggccaggctggtcttgaactcctgatctcaggtgtttcacccgcctcggcctcccaaagtgctgggatcacaggcgtgagccaccacgcctgtcctagttcttatactttttttttttttttttgagaccaagtcacgctctgtcacccaggctggagtgcagtagtgtgatctcggctcactgcaagctctgcctcccaggtccgcgccattctcctgcctcagccttccgagtagctgggactacaggcgcctgccaccatgcccggctaattttttctattttttagtagagatggggtttcgccatcttagccaggatggtctcgatctcctgacctcgtgatctgcccgctcagcttcccaaagtgctaggatcacaggcctgagccaccacgcctggcccctagttcttatacttttatgaaagacaaagaaggtgaagtgctcccctgaccccccaaccccgaaaaaagcttagtaacatgctgaaggtcacatagttttgttgtggtgacctggcctgttttgtttttaacagcaaagcccatgtgtttttcttgcactttgtttaccgtctgactactgccatttccttaatttcaaagattttcaacttgaatcctcaatttcttcacatgaaaaaatggaccatctagattagatggtttctaaggtctgctgtgattttaaagttatgtagcattgtggctgtatgtcttcacagcagttcaagaatattgcttttaaaggaatttgtagttctttgttgggaaaattttctattattttgcttcctcataagtgatgctcatcttttcaaagaaatacatatacatttttaagtgtatgtatgagtagtatgtgtatttctgtctacaaaattataaaatgatgaaactattctgtcatacctagaatataaaagggaaaaaagtgtgaattctttaaatatttttctatgtcctaatcactggaagtcctatagttgtttcaaactgttctgtaaaatttgtcttgttgcttatgttcaaaatatatttccatgttttagtgaagaaaagtacaaagtggcttgacagaaagtgaaattaagactgctggtaatcctttgaagagacttagtaataggagttggcaaatatttaagagtggcattggagacaaatggcagattcaggataggctgtttctgtaggaagcatggttctggatgagtgctgctcataaagtcattgaaagttattccagatagtttaatagaagtgtttgtttagcaaagacaacagattttgctattttgactgcattgattgtattagttcagatttatgaaagaaagagcccggaatacagaaataagataacaatagaaaatttaagcatgtcaagaactctaatgctggaattgtcacagcaaccacaaaattactgggcatcaatagactcctaagaattaagagaaattgcagaatgtaagccataattgtcattttaggaacattatgctagagcacaagtttaggattgggcaaaagagttgatttttaagattgcattggtgttctctctctctcttttttttttttttttggagacggattcttgttccgtcacccaggctggagtgcagtggcacaagctcggctcactgcaacctccgcctcccaggatcaagcgattctcctgcctcagcctcctgagtagctgggattacaggcatgctccaccatgcccggctaatttttgtatttttagtagagacagggtttcaccatgttggccaggctggtctcaaactcctgaccttgtgatccacccgccttggcctcccagagtgctgtgattacagctgtgagcctccgtgcccaggccagtgttctctcttaaatgtgtttcaatatggtggacatttattgagcacttgtgttgggcgtttcaacaggaggcactggtacgaaaagtagcttgttctagttcatatatcatttgcactttgcttaacttgtataagtactttttactgtttaataaatattttattagaaaatacttctctgatctctcattgatgcccttcttactattttaaccattgtcatctttggacatctgtctgaattgtgggtaagaccttaacctttggagtagagagcaatgctgcttacaaaataatgattgttggtagtctgttcaacagatttgcaatttcaaaaagaaaaaaatgcaactttttcccacatctttcacatatattttgcaaatcttatgcacataattcacatattttgcacattttaaatgtaagatgatttgcatgacaatccccttaagtttttaagtgttagtttattgtagatgcttatgtacacagtgaagactgtaggtcagttttaacctcagccaacatgaggttaaccggatgttcaccttactaatgttctttcgtattaattttaatgcttgttaaatttacattttatatttgatactcattttcccaattcacaaaattggcttattgaaaaatgatgaaaatagtaacaaatatcattcgtaaaaatgctccaatggaaataacttcagtgtgaatacagaatgagaaaatgtatgtgcttttggccgggcacgtggctcacacctgtaatcccagcacttggggaggcctaggtgag

SEQ ID NO: 858 - DNA, 1436 bp, Homo Sapiens
tgcccaaaggccagagtcagagcacaattttgaagattacagaaaactccaaagagattgaagagatggaataaaggatcccagcccccgaaaagagaaagctttgtgtctgtagccatagcccttggcaatcagacatcctcctcactaatgtgaggtcaggaggggactagaagtgctcagaggatggactgcctctggccagtgcaggggagaggcaggggtgttgaggcacaggagccagatgagaggaacgtcagcagcaaagcagtaagaagaacatgagagtttcttgatagtaatagaacttcctacacagactgggaaccgggttgtagcttgaggggatgtgacaacatagtggcccggaattttcactttggaaattaactgctttggaccaggaagaagcgctgagcctagaaaggcaggaggcacaggactgtgtgggcttctgtctggcagggacctatgagcttcatagggcgaatgaatcggggcaggataaagcagaggcctccaccctcacagtgctcttagccatctcaggcttcccggaacactgctaccaggctgcctgctggagccctttacactcacaggccttcctgcttgggttctcttctgcaggctgcgtaaaccagtcctgttgtagcccttgtagcatctgctgtagtgatctggtttgggtttcagtattacttgcaatggtttggaaggaaatgggaagtttgccttctaactacattttctttttgattcaagaaccctagcagttctacaaccactgggcctaaaactaaaataaaggaaaaataaataaaaggaagcaaaaacatctaactgggatggcctggcagcattgccagagagagtcctcaggggcccatgcttgttctgtcttttgctctgccatccctagggtggacagcacggaagaggcagtacatcttaacaaaatcagggttctggatgaagggaggggtggtgaatggttgctgcaatcaacagttcatacttcaatggaaagaaggtgggatttgattcctggctgcaaatcttcactctgtcacctgctatctgtgtgccctcagtctcccatcaaggagtgatgtctgtttctccacttcttgaatctgggctggccttgccaatagcatatggcagaagtgacatcgttccatttctgagtcaaagcctgaggaggccttgcatgcttctactctctcttgcaaccctgcactgccacatatcaacaagacttatcaacaagcctgggatagcctgctagatgatgaaagaaatatggcccgcttgctcccatcactccagctgatagccaggcaaccctaagaagcaaagtcacctagctgattagtagctgaccactgacacaaaagtaagatcatctgagaccagaagacagcccatctgag

SEQ ID NO: 859 - DNA, 10870 bp, Homo Sapiens
attatgggttaggtgaggaacctcgccctcttctattacggtacgcgcgatgggtattccctgatgccatgaacttacacgtttcacacacgggaccagacgcttgctttagttgacgcatgaagaccggtccggtcttttgcggagaaaagtggttaaaagctgacttgtgggccgagaaactgtggcaccctaatgagctagggctagacgcttcgaccaccacgccaagtgattctgaagatctctaattctgtcaaggcgagagcgctccaacacgtgttcatcggctgttgctttttaaagagaaggcaaggaggaagtcttgcttttcttgtactttttttcctagaagcagcattaaagatttactccttatgttgaggaagcggaaagcctcttcactttaaaagtgtttatgatcgggcctggcgcggtgactcaccgcgcccggcctgctacaccttttaaaattcacagcaatgataaatgtattagactcattgccaggataaagatttaatctatttttctagtagtgccgtcctatgtggttctgtagttgcttattccaactggtatatttccataggatggggttgaataagaaaaacttgcaaactttcagaaacagtaagttatttttatatttttgaaggcttgctgagtaacgcttctcttggtagcactaccttatctacccttcagagactgttatttcttaggagtggccctgggcaattaaaagcaaaaacttctggccgggcatagtggctcatgcctgtaatcccagcactttgggaggccgaggcgggcagattacgaggtcaggagatcgagaccatcctggctaacacggtgaaacccagtctctactaaaaatagaataaattaaccgggcgtggtggcgggtgcctatactcccagctactccggaggctgaggcagaagaatggcgtgaacccgggaggcggaggttgcagtgagcggagatcgcgcccctgcactccagcctgggcgacagagcgagactgtcttaaaaaaacaaacaacaacaacaaaaaaaccccaaaaacttctttactcagaagtaccctcctttgcattggagatacatgtaaagagttgcttagcagttgaataactcaaaattgcattttggaagcttgctaagtgacaagaccttcttgtatccttttgtgaacccccaaaatatgagacaggcctcagttaatttagaaagttaattttgccaaagttgaggacacgcgtccatgacatagcctcaggaggtcttgtagacatgtgcccaaggtgatcagagcacggtttggttttatacattctagggagaaatgagacatcaatcaatatatgtaagatgaacattggttcattctggaaagactggacaactcaaagcaaaggcaggaagactctgagtggggagggagcttccagggcatagatagataagagacaaatggttgcattcctttgagtttctgattagcctctccaaaggaggcagtcagatatgcgtttatctcagtgagcagaggggtgactttttaaagaatgggaggcaggttggccctaagcagttcccagcttgacttttctctttagcttagtgaggtggaggccccaagatttattttcctttcacactttaggccttatgtctgtttttagttttatatagtagaattccttaaaacaatcttcaactaattcttagggtcttcttaaattcaaaagacaaaccgtatgagccctcctccctgtaacttattccaaatcttaatccatgttttctgtttagttatgcaaaataaatcgaaagaattctgttctccatctctagcctccaaaacctgaaccaaaacaaaagttgtcaaaacagatttttcagtaagaatacactacacatcaagtggctaatgtaaattacaaaacaggatgttaatggcagactgtaatatctctattgtacagataaaaataatcagggtcagagagattaaatattctgcccaaggtcacacagctaaaagcagtggaacagctataagaacccatttcttctggtattaactggtatttacactctttttttttttttttttttaataaataagtggattctggctatgttgcccaggcctgtctggaactcctgggcccaagcaatccttccacctcagcctccaaagtgttgggattacaggtgtgagccagtgcacccagccattaacactcttaaccactacactatactaccttcttacatttatttatttatttatttgagacagggtctcactttgtcacccaagctgaagtacagtggcatcatctcggcttactcaacctcctgggatcaagtgatcctcccacctcagcccccaaagtagctgggactacaggtacaccaccacattggctaagtagtgttattttttgtagagacagggttttgctatgttgccaaggctggtctcaaactcctgagctcaaccaatctgtctgccttggcctcccaaagtactgggattatgggcctgagccactgttcccggccaaattcttttcttttctcttttctttttctttctttcctttcttttctttctttctctttcttttctttccttcatccttccctccccttcctttcctttcccttttcccctcccttcccccttctgttcccttttcccttcccttttccctcctctcccttcccctcccctccctttttcctcctgcctcagcctcccaagtagctgggaccacagacatattccaccatgcccagctattttatgtatttttggtagagttggcgttttgtagagaccagcatgttgcccaagctggtatccagctgctgagctcaggcgatctactcgccttggcctcccaaagtgttggtagtagaggtgtgagccaccgtgcccagaccccaaatttatttttattttattttatttttctaggtcaggcatggtggctcacacctgtaatcccagcatgttgggaggccaagatgggagactcacttgagcccagaagttccagaccagccttggcaatatagtgagatgccatttctattttaaaaaatattttaaaaataaaatatttttctattcacctttcatcaatacaaacccagaagagaatctttcttatttttaaaaatgaggaaattgagccctacaagaaaaattgctatagtttattgatcacttgctaagccatgtacttcatttaatcatcgcttttgaacacagtgttgtataaagttgcccaggctcaaaagcatgtactcataacatactacactaggtagtatgttttcctcatctctggttattttattttatttttttttgctctgtcacctaggctggagtgcagtggggcgatcttggctcactgtagcctctgcctcctgggttccagcgattctcctgtatcagcctccggggtagctggaattacaggcacatgccactgcgcccggctaatttttgtatttttagcagagagggggtttcaccatgttggccaggctggtctcgaactcctgacctaggtggtccacccacctcggcctcccaaaatgctgggattacaggtgtgagccaccgcgcccagcctctgactatttttcttagtgagatctttttagtcacaaatatgtatatggaatttacattccagtcccttgggtttaataatgtacagacagcagaccccctgtatcttcaggtttcaaacccacagattcagccaatagcagatgtggaacctgcagatgcagaatggcaactgtaagggccttgagcatctgcagattttggtatcacggggatcctggaaccaatctccccaaatacccaggtacaactataattatttttgctgattgttatgtctcattagaatgcaagcttattaaggaaaccatatctcttccttttttctttccttctttttttttttttttttttttgagacagtctcgctgtgtcacccaggctggagtgcagtggcgctatctcagctcactgcaatctctgcctcctgggttcaggtgattctcctgcctcagctgcccaagtagctgggactacaggtgcacaccaccacacccggctaatttttttttttttttgtatttttagtagagatggggtttcactgtgttgaccaggctggtcttgaatgcctgacctcaagtgatctgcccacctcggcctcccagagtgctgggattacaggtgtgagccaccatgcatggcctgcctttgaattttttaaaacatttgagcagatatattctataaatagcggtactatttaatagcaataagtggttactgagcacttacaatatgccattgtacttaatgtgcattatcccatttaatcctctcaacagtttaatccatgccactcaccttgttctctgcgagactgattcaattctgttgtagtccccttattcattacatgacagtataatttttgccatttcctcctaacctttgtaaactctactttgatctcatctgactgtaattcaccactgctcttgtttaaagttcacattctctaaacacttatttatctgcacagtacaagaatatctgtgcttctacagagagtcttgtccacccactttcccttccagaaggggattggtatgtgaattctgagtgtttggatcgtttggcccaccctattacctctcaacaactcaagctctctgccatgaagttaaaaaccttcccttactctcagtgccctttattgtctcctctttttttgttttttgagccagagtctcgctctgctgcccaggctggaatgcagtggcacgatcttggctcactgcaccctccgtctcctgggttcaagcgattctcctgcctcagcctcccgagtagctgggactacaggcgtgcgccactacgcctggctagtttttgtagttttagtagagacggtgtttcaccatgttggccaggctggtctccaactcctgacctcaggtaatccacccgcctcggtctcccagagggctgagattacaggcgtgagccaccacgtccggcctaccatttagcatttataaaagtttcccagttaggccaggtgcagtggctcatgcctgtaatcccagcactttgggaggccaaggtgggagtttgagaccaacctggccaacatggtgaaaccccgtctctactaaaaatacaaaaattagccaggcatggtggcgggcgcctgtaatcccaactactcagcaggctgaggcaggagaattgcttgaacccgggaggcggaggttgcagtgagccaagatcgtgccactgcactctagcctgggcaacacagcgagactccgtctcaaaaaaaaaaaggggtttcaaagttaaagaaattaggtagcttaaagctaaatatccaagactatttaccaggtaccactgcaacattaataaggttatttcacaaaatctccctccccttgcccaaatctccatccttcctgactgtacaaatattttcatgtttattttttatttatttattttttttaagacagagtcttgttctgtcaccaggctggagtgcagtggcatgactttggctcactacaacctctccctcccaggttcaagtgattcttgtgcctcagcctcaagagtagctgggactacaggcatgagccaccacgcctggctaatttttgtatttttagtagagacagggtttcacatgttggctaggctggtcttgaactcctggcctcaagtgatctgtgctgggattataagcatgagccaccatggccggccagaaattttttttttttttttttgagatgaagtttcgctcttattgcccaggctggagtgcaatggcgcgatctcagctcaccaccacccccgcctcccagtttcaagtgattctcctgcctcagcctcccaggtagctgggattacaggcatgcaccaccctacccagctaattttgtatttttagtagagatgggttttctccatgttggtcaggctggtctcaaactcctgacctcaggtgatccacccatctcagcctcccaaagtgctgggattacaggcgtgagccactgcacccagcccagaattttttttttttttttgagatggagtctcactctgttgcccaggctagaatgcagtggcacgacctcagcttactgcagcctctgcctcccaagttcaagcagttctctgcctcagcctcccaagtagctgagattacaggcgcctgccaccacgcctggctaatttttgtatttttagtagagacagggtttcaccttattggccaggctgttcttgaactcctgaccttgtgatccacccaccttggcctcccaaagtgctgggatacaggcatgagccaccacacccagcagaaattttttttaatgtatcacagttacttaaatatcttctaagctacaaaacatagaaacgagagaattaatctacaaattttttttctctaaaaattagatttactgattcatgtaatactgtcttcatggtaaatggtggttgatagtgttaacaaaataatcacctaatgttaaattcatgtatctatatggttctcaaattttaacagaattctcaaacttaagcctgaggtttgttaaaactggaatgctaaaagctgggcatggtggcccacacttgtagtcccagctacttaggaggctcattggagcctaggagttagagtctagcctggacaacaaagcaagacctcctctcatgtctttctttttctttcttttttttttttttttggggggggtgggtgggacagagtctcactctgttacccaggctggaatgcagtggtatgatcgtggctcactgcaacctctagctcttgggctcaagtgatcctcttcccttagtctcctgagcagcttggactataagcatgtgcccccatgcctggctaatttttaaaatttttttagagatggggtcttgctttgttgcctaggctggtcttgaacccctggcttcaagcaatcctcccacctcagcctcccgaagtattgtgattaaaggtgtgagccaccatgccagccaagactccatcttttaaaacaaaataactaactaaattgctgggactctcacttctagccaagaccaagtaacaaaaaccagatttacccactcacctaaaataaaaagaaacaaactaggcagcaaatatgaaataatggtttttgaagacactggataccaggcatcaaaggacaatgattcctaaaagagaaggcacaaatgcagggagctgggagattgtcccagtttattgccttgggaatgtgtccaagttgcagcacagaaacggaacagagtaagcctggtggagtctttgagccgagagtctaggaaaaccaaaccttaggacagaattccagagaggagagagcagcacagaaagagagagagctgcagaagtttccttagaatattcagcagagtaattattagcacatgaatctgagcaaactacccaaaaccaaggggaaaatcaacagataaggttagaggaaacattgtccagggttggttgggaacaatgcctggttctatcaatcagccagattgaaaaaaactcataacctgtgggacagtgggtagagtactcaaaaaggtcttgcctcactgatgaagaataattaattctaaattgagtactactctggacctacctaaaaaattataaaaaacctgaaaagatcaaattatttcccagtcatttaactacatcctagaacaaaccgcacaaggatttaaagtaaaacgaaaatacacaatatcaaacaaggtaaaattctggcatctaatacaaaattattgggcatgcaaagaggaaggaatacatgaccatcatgagagtaattgatcaattgaaaccaacacagaactgacagagatgttattttaaataagtaaagacatgtaagatatttttaaaagacttgagcatctagaaataaaaacaatgtctgagatgaaaagtacactagatggaattaacagtagattaaactacacagaagaaaagattaataaacttaaactcatagaaataggaactattcaaaatgaaacagaaaagagtcaaaaaggaaaaatgaagagcattagtgagctgtgaaatagcctcaagtagcctaatacatgggtaactgaagtccctaaaagaagggaagagggacagaaaaaaatatgttaagaaataatgaccaatgacccacattttcccaaatttggttaaaccacacgtatagatgctttactaagtccaagcacaagaaacatggagaaaattatatcaaagtgtattgctatcaaataagttgaaaccagtgataaagaggaaatcttaaaagcagtcagagaaaaagagacttaggaaccatataggaacaaagataagggtgacatcgtatttctcactggaaacattgcagacaagaagtggagtaacatcttaaaatagggaaagtaaaaaaggtcagcctagaaatctatgtccagcaaaaatatcttataaaaagaaggaaaaataaagatgctttcagacatgcaaaagttgaaagaattccttgacagtaaacctatactaccagaaatgttaaaggcagtttttcaggcaaaagaaaaatgacaccatatggatctatccaacgaaatagcatgggaaaagattaagtataatagtgtatatgtaaactttttaatttaaaactttttttaaaaacagataactgtttaaacaaaaataacatactgtgagatttataacataaaagcaaaatttatgaactataatataaagactggaagaaaaaaatggaaacattattgtaaggttcctattctatacacaaagtggtataatatcactgaaggtagactagtaaattaaagatgtatataatagcggggcagttccaagatggccgaataggaacagctccagtctacagctcccagtgtgagtgacacagaagacaggtgagttctgcatttccaactgagctttgaagagagtagtggttctcccagcatggagtctgagatctgagaacggacagactgcctactcaagtgggtccctgacccccgagtagcctaactcggaggcatcccccagtaggggcagactgacaccccacacagccgggtacccctctgagacgaagcttccagaggaacaatcaggcagcaacatttgctgtttagcaatattcatggttctgcagcctccgctgctgatacctaggcaaacagggtctggagtggacctccagcaaactccaacagacctgcagctgagggtcctgactgttagaaggaaaactaacaaacaggacatttgcaccaaaaccccacctgtacatcaccatcatcaaagaccaaaggtagataaaaccacaaagatggggaaaaacacagcagaaaagctgaaaattctaaaaatcagagcgcgtctccccctccgaaggaacgcagctcctcaccagcaacagaacaaagctggatggagaatgactttgatgagttgggagaagaaggcttcagacgatcaaacttctccaagctaaaggaggaagttcaaacccacgcaaagaagtaaaaaaccttgaaaaaagattagatgaatggctaactagaataaccagtgtagagaagtccttaagtgacctgatggagctgaaaaccacagcacaagaactatgtgacgaatgcacaagcttcagtagccgattcgatcaactggaagaaagggtatcagtaatggaagatcacatgaatgaaatgaatcaagaagtttagagaaaagagtaaaaataaatgacaaagcctcgaagaaatatgggactatgtgaaaagaccaaatctacgtctgattggtgtacctgaaagtgatggggagaatggaatggagccacgttggaaaacactctaaaggatattatccaggagaacttccccaacctagcaaggcaggccaacattcaaattcaggaaatacacagaacgccacaaagatactcctcaagaagagcaactccaagacacataattgtcagattcaccaaagttgaaatgaaggaaaaaatattaagggcagccagagagaaaggtcgggttactcacaaagggaagcccatcagactaacagctgagctctcggcagaaactctacaagccagaagagagtgggggccaatattcaacattctcaaagaaaagaattttcaacccagaatttcatatgcagccaaactaagcttcataagcaaaggagaaataaaatcctttacagacaagcaaatgctgagagattttgtcaccaccaggcctgccctacaagagctcctgaaggaagcactaaacatggaaaggaacaagcagtaccagccactgcaaaaacatgccaaattgtaaagaccattgatgctaggaagaaactgcatcaagtaatgagcaaaataaccagctaacatcataatgacaggatcaaattcacacataacaatattaaccttaaatgtaaatgggctaaatgctccaattaaaagacacagactggcaagttggataaagagtcaagacccatcagtgtgctgtattcaggagacccatctcatgtgcagagacacacataggctcaaaataaaggcatggaggaagatctgccaagcaaatggaaaacaaaaaaaggcaggggttgcaatcctagtctctgataaaacagactt

SEQ ID NO: 860 - DNA, 1484 bp, Homo Sapiens
ggcaaagttcagcatcatcctctctgctgaaataaccaacatggtgctcattaattggtcatgtgagcactaaggataaccaccctcccctcctcaatcaggatcacaaatgctagctttcatatggatttcaagctgggtgaaatgactttttttgcttgtaaagaagaaatgatgatggaggtctcatcaggaagtgatgcagaagactgggacagacgggggtttcaccatgttggccaggatggtctcaaactcctaacctcgcgatccacccacctcggcctcccaaagtgctaggattacaggcgtgaggcactgcacccagcccatcataagtattttcatgtatcatcatgtattttagaaaatggtattattgactatatatcagttcattgtgtgcacacattttatttaattaatttgctcttttcagttatttagttttctttttttgttattataaatttcatagtaatatatgtccttatacataaatctgagtatgaatctaggattatttacttaaaatgaatttccagacacaaattgtggggttaaagtgggaggagcatttttaaagcttttgatatataccgctaaattgtcttataggaatgtataaattatgaaacaaccagctgtccatgtgagaccatgcatttccttatccaaatgaagttaaagaaattatttgtcagcttttttggtggtatgtggtaactccttttcctgatttgaatgtttttctagtactagtgactttttacaggtttttcttatgtttgttggttgagtttttttttttaatgtctatgcctatcttagtatctatgcctattttaattttttaatgtctatgtactttcttttggagcatgttgtatgatattttataaataaaaggtgttaactctgtcattatagtgtaaatatatttcccaatatgtttttaaattttcatttatgatatatagaaattttaacttttatatattaaaaatatctatatttaaatgactttgtccagatgtagtgactcatgcctgtaatcacagaattttgagaggctatgtcaagaggattgcttgaggccaggagttcctggccagcctggacgacacagtgagacccctatctctaaaaaagttttttttcaaacaatcctgccacctcagcttcctaaagtgctgggattacaggcatgaaccattgagcccaggttctttgtaatatcttcctccacgtttttacgtatcaatcctgcattcaaacatttactcattctgaaacaaattttagtatatgttataaggtattgatccaaatttttacgtttataaatagttaacatctccaaaccatttattgatattaatttcaccttcatcatattgtaaattatagttttgattttcctttttgacaatgaattatctaagaggatactttagaattttcaaacttaataaaaaactttt

SEQ ID NO: 861 - DNA, 2023 bp, Homo Sapiens
gcgcacgcgggaactgggatctcaaccccagggctaggtgcctcctcccgctgctttccgccagctgcggggtgtgagattaatccccgccgattagcgccaggtgtactaagcgctggatggttccctgaccagatgaaacatcagccgatgttctaatgccggtcccctgggcgctgtccccgagagggaaaacctgttttctgaccccggctctagtcggcctctggaggtctgcagctgggttattttacctttgaaacggacgacacctgccccgtgcaccccagcggctcctccacacggagagatggtgtcagtcaaaggccgtctagatgacgagtttatgaaattgttcctggcccgtgccgggcacgaccttgcagagagcccagaagatgaaaccccagccctgccaggagctcacctgctaattaggaggacaacgaatcacctcacctccctagactttgcttctcctttattcagtgagggattggactagctggtccttgaggacttttcagaaagtctggttctgggagatgaccaatgggatcatcttatgctatgagctttcctggaatgacaggtaattggtgcgccttcccagcagggtcagggagagttgctgggacttgaaggaaaggcttttggggagaggagccagtgttacaaactatcgaaaagcttggaggtgggaaatttacaaaaggtgattccagggtcagcttttttgtcacctgcttccgacttcggcagtttggagagggcgagtaagtaatacccttcagggtcttgggatgtggcccagcaaaatccttagagggactttgaagtcttagttttaagtttagaattaatgggcagagtacttaaatagccatttctccaaagatgtatacaaatggcccacaggcccataaaaatgttgcattccaccctataacatgtttttgcataaaaaagttttaaaataactgttgtctggtaaattgacacctctggaatagaatgtatgctaggttttttaccctactgcttcaaaccccatcctacacacacactcctagggtgtgcatcatccagtttaagaagcacccttggagaaacaaagttgatagtgtgtccagaattgatgggttcttggtctcactaacgcaagactgaagctgcagaccctcgcggtgttagtttttaaaggcggtgtgtctggagtttgttccctcagatgttccgatgggtttggagttttttccttctggtgggtttgtggtcttgctggctcaggagtgaagctgcagaccttcgcctgagtgttacagcttttaagacggcatgtactggagttgctagttcaccccggtgggttcgtgtatctcactagcttcaggagtgaagctgcagacatttgcagtgagtgttacagctcataaaggcagtgcagacctaaaaaacaaaaagaacaaagcttccatactgtggtaagaaaatcctagtgagttactgctgctgtcttagggcagcctgtgtttattctcttctctggccccacccacatcctgctgattggtccattttagagagagctgattggtctgttttacagagagctgattgagccgttttgacagggtgctgattggtgcgtttataatccctgagctagacacaaaagttctccaggtcaccactagattagcgagatacacagtgtcgattggtgtatttacaaaccgtgagctagacacagagtgctgattggtgcatttacaaactttgagctagatacagagtgccgattggtgcattcacaatcccttagctagacaaaggttctccaagtccccaccagattaactagatacacagtgccgattggttcattcacaaaccctgagctagacacagggtgctgattggtgtgtttgcaaaccttgagctagatacagagtgcccattggtgtatttacaatcccttagctagacataaaggttctccaagtccccactagacttagga

SEQ ID NO: 862 - DNA, 22622 bp, Homo Sapiens
gttccttccggcgtctccaaccgccgcctgctcccgccgtccacccgcgcgggccgcctgggacggggagggccgggctgcgggcttttctcccttccagagtcctgcgcccgcccaaagcccccccgcagaggctgggcagcggctccgggaagtggacgccgtttgcccagacggtgggctcgactgaagcggcgcggtcccgggtggggccgcccgggaagaaagtctcccagttaagctgccgtgcaattaagatggttgggtttggattgttgtacttttttttttgttcgttgcatttttaggaacaaaaaaaaaagcccaacccttcacaccacttcatccgcatctcaagaccagaagccgaccccagcggcttggggaaatggagccccgcaccccacaagggggagggtgggacgggcacctccgcactgcgcggcctgcggagtcaccgattcgcgttgggagcgcgccaggagcgccagggctctagccgggggctccgggcaaggcgcaaccagaaaagggttcagtatcccccatcacccccacccccaaccgtaccctctttctttgcgggctttaggcaggacaccagagacccaattctatttaaaattctcttttaagaaaaggaacgcctgtttttgcctttgggggaaaggatgaactttcaaattggctttaaattatccaccactaacagttactcagtcgataacctgactattctgacgtccacctcccgtttgaggaccttgcccaatagcaaacgtactaagcacttaaccagtgaacggtgtgaaggatgcaaacatggatgatgaaggaatggctcctccagaatttacgatcttgggagaagtgaggcgagtatagaatctcagaacacgctgtaggattgagttcgatcccagttgaggaagtttgggtttggggaggaaataggttattttggagaaacggtattcaaaacctaccataaatagcagtacagcccgttgactaataatgcttagcccaacccccgtaaaaagcccctggccacatccgtctcctgagattcccacttctctgtgtgcatctcccttcctgctataagaaacctaactttgccttcgtagaacacttcttttaatttctgtcattcagtctcataacactgtgtaaaagaaattatgatcttcatcctatatagatgagaaaacaggtgaagtgacttttccaaggtacaaaagcaagaggcagagctgaggctaaaggcagcttccagatatgggctctttctacagcaccataactgtcagtgacaaaactgcaccccagtaccttactaaatttagtgtttttaggccaggcacggtggctcacgcctgtaatcccagcactttgggaggtcgaggcgggcagatcacctgaggtcaggagttccagaccggactgaccaacatggtgaaacctggtctctactaaaaatacaaaaattagccggtcatggtgccgtatgcctgtagtcccagctacttgagaggctgaggcaggagaatagcttgaacccgggagatggaggttgcagtgagccgagatcctaccactgcactccagcctgggcaacagagcaagactccgtctcaataactaaattaattaattaatttagtgtttctaaaaaaacaaagtgatctgtagaaacatctcatttatttgttgtcattgtgtgttgattgattttgagacagggtctatctctgtcccccaggctggagtgcagtagcatgatcatggctcactacagcctcaagcccctgggcccaagttatcctcctcccttagcctcccaagtagctgggaccacagacatgcgccaccacgcctggctaattttattttttgtaaagatagagtctcactatgttgcccaggctggtgtcaaactcctgggctcaagtgttcctcaggcctcagcctcccaaagtgctgggattacaggcgtgagccaccacacccagccatatggaaacatttcagatatcctaatattaaaatgatatttcacaagactggacagttattaactcatgtgaaaggaaaatcttggggccccaaaatcactaagctaaaggaaaaagtcaagcttcggagaactgcttagggcaaacctgcctcccattctattcaaagtcatccctctgctcactgagataaatgaatatctgattgcctcctttggaaagggtaaccagaaactcaaaagaatgcagtgatttgcctcttatctccctaaaacctggaagcccgccccctgttttgagttgtcccacctttgcttcaagtcgtcccaccttttctggactgaaccagtgttcatcttacacacgctgattgatgtctcgtgtcttcctaaaatgtacaaaaccaaactgctctgaccacctcgggttctgacctcctgaagctgtatcatgggcacgcatcctcaaccgtggcaaaataaactttctaaattaactgggacatggctcagatttttagggttcacacgcaaaacccacaaattatccttaatataattatataatatatatttatgtagttagatctggttggtggtagatactaatacacttttgcccaactaagtgtaaaacacattaaatctgtatagcaatctctagactattacacaaaattaactactaactagaaaacacagtatattaaattctcttaagtgtggaaaaatggagaaggaagaataaccttttctctcctcccgtggtcctaatacacagaacagcgactgggaaactgccactagaaaaagatgactgtccaactaaaacctgcatacacagctacatccttccctggaagagcacagtggaactagatcctagtacagatagcacagggattgtcaacattcttgtcacactgaaatttccttctactgatctccaaagatggtgttttgccatgttgcctaggctagtctcaaactcacagactccaatgatccacccgctttggccaatcaaagtgctggaattacaggtatgagccactgtgccaaaccaagaaatttattttcatattttgagatttgttattgaaaattacagatttttaaaaatgcaataacatataaaagtacatcatatatggttcagtcttactgaaccatttaatataatattttgtcaaagtactcaatttataaataaaatataaaaatcattaattgtgacaaatattttcctaaaatcttccaaaaggaaactatatatgtgtgaatacatataatttgcttgtatatcaatcatatgtataatttatctttctttttttctcagacagagtcttgctctgtcacccaggctggagtgtaatggtgcaatcttggctcactgcaacccccgtctcccaggttcacgcgattctcctgcctcagcctgccaaggtttacaggtgcctgccaccacccctggataattatttgtatttttagtagagatgggatttcgacatgttggccaggctggtcttgaactcctgacctcaggtgatccacccaccttggcctcccaaagtgctgggattacaggcatgagtcactgcgcccagccaatttatcttgttagaatgattgtaactgtattctgtaaaaggccggtgttaatagattgcttagctacattttagagtatgcttcactagagccttaaaaatcattacatatatatcctctgaaatgtattattgctttgatattttaacaatgattaattacattcaattatgacaattaaatgtttttctaaattcccatatatgtagaattttattttttacaaacagtaactttatgagggccttaagaaatgattaatttaggctgagtgtgatggctcacgctggtaatcccagcactttgggaggctgaggtgggcggatcacctgaggtcaggagttcgagaccagcctgacaacatggagaaaccccgtccctactaaaaatacaaaaaagttagctgggtgtggtggcgcatgcctgtaatcccagctactcgggaggctgaggcaggagaatcacttgaacctgggaggcggaggttgtggtgagccgagatcactccactgcactccagcctgggcaacaagagcgaaactccatctcaaaaataaaaataaaaataaaaaataaatgattaattcagctaaagactaatagatactgtatatttgcaattgttggagagctcgatttgtataaattgtttattttgaatctttctgagctcactcaccattatgtgctaatttttaccctgagaagtgtcaattatgataacattttggattagaaaactactttcatcctgttttatgggagatttttagagcatttttagagcattctataaataaggatacatcatggataggggttctgcagttttcagtagctggtagatacctgtaccttaagcacactctttgtcttaaataaagacaatagaccaatgcatagaatttttgttctgaggatctagactttatcagatacttcctatacagcattgcataagacatagatgcttcattgtttttaacatgagcccagttgagtctctctaatattaaagcattgggtaataaatgccttgttaaaatgtgtttatcttataatggtcttgtttgtaacactatctggattgttgctagaatgcccccagatctccagaagtgtggaatttgatctaaagcaacccacacccctcccagtcaggcaaaagacacagataattcagaagatggttgaaactaattatacaatatcagtgcattttaagcattttgtgaatgtcattggcctccatgttgctaactccaacagatattttttcagttctcattttccttgatcttttggtagccttcaactctgagtaccactgcctcctttttaaaaggccctcttttcctctgccattagtaacactaaactcactcctggcttttcttcttcagactcaggaatacttgctgggtcatccttttctacccagcatttaaattctggaattcaaacgctcagttttaggaccctcctaggagttcagtgatcatttattgactcttacaatccctgtcaaaaacacaaactgtttgcctattgttactctatttttaaatgatgaaaactgaattttaatacttgagaggcatgtcacttcttcctctcccacaatccttactctgtgtaggcatttgggttagcccttgtgttacccgaggctcatactgcttccagcagcagggctcctgcacccttagttccttccctaacgaggccctcaccagccacctcccatccccatcctccaaccatagcacaactgacagtctcaggtgagctttcccagatgtttctggccaattaacagaccctgttaatcatctcataccatctaatactgctcttccatcatgcactctgcagtttgttaaatttatttgtgtaattatttgattaatgtttgtctccccacttgactgtaaaccccataagagctgggattgtgtgtgtgtgtttgtgtgtgtgtgtgttttctcatcattgcattactagcacctaacccagtgatttcatgaatgtcttaaggaagtaagagtctcctatttcacggtattgatgtatttcagacttctaaaaatttgctgttgagaccagctgaaatggtaagtactctgaattttaatttactcaaaataggcacttcaatacattttactttatcaaaacaaagtagctttccatcctttctttacacagcaagtattaccatactcctatagtcaaactcttcctagagtttacacagaagtgctggtagtcttcattttcacagaacaacatagcataactcttaaaatgaggagaatttcctgaagagtcatcagagaattattattattattgttattattttaagacagagtctcgctctgtcaccaggctggagtgcagtggtgagatctcagctcactgcagcctccacctcccgggttaaagcgattctccagcttcagtctcccaagtagctgggattacaggcacgcaccaccacacttggctaatgtctgatgtgctctcactaaggtaagagtctatttatgcctgggagatagaggaagcctacagtctggaagcccaaagcagtgctcaggcccagtttactggagtatttgtagcaaagtgatgcttaattctcatttgctagtgttctctattcatccgttttccttgggggatcttgggtttggttgtgtgtggctacagcgtagggatgagattctatcatctttgtgttaggcggctgtagtgcctttgttttcgtttttgttttgttttttgtttttgtttttatttttgttttgagacaaagtctccctctgttgcccagactggagtgtagtggtgcaatctcggctcactgcaacctccgcctcccaagggcaagtgattctcctgcttcagcctccgaagtagctgggattataggtgtatcccaccatgcctggctaatttttgcatttttagtagagacagggtttcaccatgttggccagggtggtcttgaactcctgatcccaggtgatctgcccgccttggcctcccaaagtgctgggattacagacctgagccaccatgcctggcctatagtgccttcttttttttttttttaacacagagtctcgctctgtcacccaggctggagtgcagtggcacaatctcagcttactgcaacctccgcctcctgggttcaagcgattctcctgcctcagcctcccaagtagctgggattacaggcatgtgccaccatacctggctaattttttgtatttttagtagagacggggtttcaccatgttagccaatatggtctcaatctcctgacctcgtgatccacccacctcagcctcccaaagtgctgggattacaggcatgagccactgcacctggcctttatggtgtcttcttaaggtgaatagcacctcaccctgatttttaacatgtagcattttgcattgcactatatctactgaagatgttaatcacttctgcatctttccatagctttcaacatgatacttttcaatggctgcataatttcattaatacacctaaatgtaaggtgtatgtaaaggaaaaagacagtgaaatccttgtgtggttattcatacaagtccctatttagggagcaaatgattatgtggggccaggatatcatggctgttaaatgactgcccatgtgacactgggcagggagtgcctctgatactaggcaggctagagatgatgtttttggaaccaggagggaaaagctagaaaaagtggcataaatataggaaaagaataggaatttcaagaattgagtatagtcttaaatgttgaccaaaaaaaagtaaattgagccctgaaaaatgatagaattttccaattaggttactaatgattttaccagcctggccaacatggtgaaaccccatctctactaaaaatacaaaaacattaacgaagtgttggcacacgcctgtaatcccagctactcaggaggcgaggcaaaaaagtcacttgaacctgggaggcagaggtgatagtaagccgagattgcgccactgcactctagaccgggtgacagagcaagactctgtttcaaaaaaaaaaagaaaaaaaaatcaattatgttactaatgattttaggaaaagaaattttatctctgttttggggccagaggtagggaaagggaaagggttaaaattaagtatttactggccagacgaggtagctcacatctgtaatcccagcagtttgggaggctgaggtgggcagatcacaaggtcaggagttcgagaccagcctggccaatatggtgaaacccccgtctctactaaaaatacaaaaattagccaggcatggtgtcacatgcctgtagtcctagctactcgggaggctgaggcaggagaatcacttgaacccgggaggcggaggttgcagtgagccaagatcgtgccaccgcactccagcctgggcaacagagcgagactccacctcaaaaaaataaaaataaaaaaaataagtatttactatctgccagggactatgttggaaatttttcttgcattacctcattttacaagtcacagtggggaaactgagggttggagtagttcattaacctgcccacagtcacatagggcaggttacccaggtcagtcttcattccactgcagtcagaagtgaatgaagattaaggaagcagagacaaggagtatgaacaattctttctggaagaatgatggggaaagaagagaaaggattgataaagtatagtgacagataatctctgcttttataataaaaataaagctcagctcctctgaggttgacactgaaaaagagtaactgcaggggccagaagcagagagaccaacaaaccctggcccctgccctggagattcatctttctcccgagactctccctctgatgattttggctccatcgaagcctccttgggtcatttcttccttcatatctgaggtacaggcaatgggatgacaaaaggcatttttcaacatctctccacaactaagtcaaagctgaaaagtttaaaggacttttctgaacatgagggcaatgtttcccaaccttttgaggtcatagaaactgctctggacaccagtttaaatatacagaatcttgggggacatggattttgaaggtctgcagtgggagcctgggaaaaggtattttaaagtaataccggttacccttaaatttctgcaagttctagtatcactgtgctggcaagtaacaaagagaaataaacacagtagcataaagcctggcatgtagcctggctcacaaaaaaaaaagacctgcttataaccccattctggagtcctcacctgcccctgcaggtttgatgctatcttgacacatgctggctatttttatctcctagaaaacaatctaggccccacagatggaggccctttgccaaattataaggtggtgggggaggaagggaagaggcttcttcactcaataatttttccttttctttttctttttcttttttcctttttttttttttttatggagtttcactgttgtcgcccaggctggagtgcaatggcccaatctcagctcactgcaacctccacctcccgggttcaagcgattctcctgcctcagcctcccgagtagccaggattataggcacccaccaccacaccctaattttttgtatttttagtagagatggggtttcaccatgttgaccaggctggtcttgaactcctgacctcaagtgattcactcgccttggcttcccaaagcattgggattataggcatgggccaccgtgcctggccactcaatatttttcaaagaccaggttgttagtctttttattttttgagacagtgtcttgctcagttgcccaggctggagtgcagtggtgcagtcatagctcactgcagcttctaactcctgggctcaagtgatccaccttcctcagcctcctgagtagctgggactacaggtgcatgtcaccaggaccagctaatttttttttaacttttttttttttttttttgtagagacaaggtctcactaggtggtccaggctggtctcaaacttctggcctcaagcaatcctcccaccttggcctcccaaagtgctgggattataggcatgagccactgtgcccagcagttgttagttctttaccagcacatgatgtaagtcttcccgacacagacaaggtctagcttggcccgccagactgcttctgccttgttgtccctccagcagtgagtggcagaatgatggcagccagctttctcccacaggctgctcagtctgactacgcattagtattagggaaggtgaccatacatgttcaggtttgcctgggaagagtcctgaccacacctttgagcccagactctcctccacttagtctttcattttcatttattaattcccagtttggatgataaattacatagtcaccccgtctgtgaacaaaagagctagaacaaaaatacaactccacaaaagcaagaagtggactgccaacaacttaataacttccatggatcaaggaaatcatgctgtgacaccacacacatcatttcaactcatcctcacagcaaccccacaagggaattttggagacatgaattttgcagataaggaaagtaacagggtgaagtgagttggccagggtcatccaactatgaggaacagaggtagggtcaaagatccatctgcatgagcccagctcctgctctagatgggcctacctgcctcctcagggcatgtggtcacctcacccaccaattactgactgcgttaagaaatagaattttaccaagaaagttgcttgatttcaacatgaaagaaatactctcaatattcatatttttcatcttaaatttgaaagtagaaatctgctttctgcagctgtctaattcagctcttgtttctgtaacctagtttgaaagaagcaactaaagaaagaaactttgaaagaagcttccaaaagaagcaaccaagtctacaaaggcacagtttgactcaaatggatccaactgattagcaaatggaaaataacatggaggaatatattttgcatgacaagcatagcagctccaagtcatccctaatgaagccaaaaatttaagtgcaacccagagaatggatggttcagaatcttttttttttttgagatggagtctcgctctgtcacctaggctggagtgcggtggcatgatctcggctcactgcaagctccgcctcctgggttcacgccattctcctgcctcagccttccgggtagctgggactacaggtgcctgccaccacgcccggctaattttttgtatttttagtagagacggggtttcaccgtgttagctaggatggtctcaatctcctgacctcgtgatctgcccgcctcagcctcccaaagtgctggaattacaggcgtgagccaccgcgcccggcccagaatcttttttaaattttttattattattattttttctgagatggagtccggctctgtggccaggctggagtgcagtggcacaatctcagctcactgcaacctctgactcccaggtacaagtgattctcctgcctcagcctcctgagtagctgggataacaggcacgtgccaccacgcccagctaatttttgtatttttagtagagacggggtttcaccatgttggccaggatggtctcgatctgcctaccttggcctcccaatgtactgggattacaggcgtgagccaccgtacccggcccagaatctttgccttttgtttgcatagtttaatcttctaaaccagttgctttcccagaaaaggtgacttaaagtcatagcctttgtgttcatcaccatactctccatagttttacaaattattcagtttatttttaaaaggggtaatttttaaaatttttatttttaattccgaagcattccttttaatacattctcttgagggaaaaaaaaaatcacacatagtgattgtgtgtggtagtgattatgtgtggcctaagtggcaattgatcaataccccaatctcaagcctgtacattgttactggttgactggttggttgcctggtgggctttttgtccttccagatgtttttctaccttctgccttttccaataaagcttccattataggcgtattttccttcttccctgcataccccacagaaggaaagctgctaaaatctcagagccggaaagttccaagggggctgcagcagcccctctctcctagtttttgttcacccttactaagagcaaggcagctcaagtcagattgctgcatgtgcattttgactccatcattgagcaagttcatttattcactattcattcagcaacatttgagcacttctctcttcctccatggccaccattctagcccatgccaccatgatttattgtttctgtctttgatgctgagcctgtctccctacagccacatggtccttctacacaatcatatcactgctctgcttacatcccttccccagcttcccacccacttagtccaagtccaagtcccttggttgggagccaacagattcctacaggtctgccatctccccaacccatggccaagccatctctgacttctgcctgtgcgctctactctagccacatcggcctccttgctattcctcaaacatgccaaactcgcctcttccttagcaacttggcatttttttttccctctgcctagaatgttcttcctccaaagtctacctggctcactccttcctctccttcagttgttctgctcagatgtcaccttcacgggaaagtcttcctggccatcctattacaaatggtggcctctcactgcctcacagcactccctggtctcctttcctgcttcatttttctccatgccacttatcgccacctgacatactttgtatttctttgattactgtctcctcccactagaatgtgagctctgtacagaagcaatatgctagcagctataagagtgtctggcacatggcaggccctcagtaaatattagttgaatgaatgaatgaagagtttgcatgcagcaatggggagccagatcaggtacggccttgtaagtcctggaaaagactttgggttttattttaaatatgaagagaagccattggagagcacatcatctgatatacagtttagaaagatcactctgggctaggagtggtggctcatgcctgtaatttcaacgctatgggagactgaggcaggaggatcactataggccagtagttcaaggccagcctagcagccatgcacggtggctcacacctgtaatcccagcactttgggaggccaaggtgggcagatcacctgaggtcagaagttcgagaccagcctgggcaacatggtgaaaccccaactctactaaaaatacaaaaattagccaggcatagtggtgggcgctggtagtcccagctactcaggaggctgaagcaggaaaatcacttgaacccgggaggcagaggttgcagtgagccaagatcacaccactgcactccagcctgggcaaaagagcaagactccatctcagaaaacaaaacaaaacaaaacaaaaaaccagcctaggaaacatagcgggactgcatctctacaaaaaattaaaaattagccaggtgtggtggtatgcacctgtagcctaagctgcttgaaaggctaaagtgagaggaccacttgagcccaggagattgaagctgcaatgagctatgaccacaccactgcactgcagcctgggcaatagacttagaccctgtctcaaaaaacaaacaaacaacaacaactaaaaaaacccaccctgcccattgtgtggaaggaagatggtactaagggtaagagtggccccgggggacagtttggaggctaatgcgacatctaagcaagaaagataatgaggacttgagctagggtaggaaaaaaggtcatattttaaaaatatattttggagttatagctgacagaacttgttaataaattggaggaggggccaaagaggaaaagagaaatggaggataacttccaggcttggggcctcaatactgaatctccctgagcctgtttactgttctgtaaaatgagggtaactgggcccccccaccatgggatctctgtgaggaaggaggtagaggatatagactgcccatactgacaggcacatggtaaaccctcagtgcacagtagctcttatcattgccccagtgatgactgtatttcccctgcttcatccataaataggattacagaaataaccaccccatagagactggggaaaaaaacttcttgtagagtgtaccctcccctcctaagggatagacttgtactttaacagaatacttaacagtagtgttgaaacatgttatttgcacacagataaataaaaggattcctcatatttcaaaagaagtgtaacactgttttaagtagtgtttgtccattcaatacttaatagcaggagtaactaaaagctgaaattacaaacccctgctgattaaaaataaatcaaaacataagatataaagcacatgtgaaataataatgatttttttttttttttttgagacggagtctcgctcttgtcaccaggcaggagtgcagtagcacgatcttggctcactgcaacctccacctcccaggttcaagcgattctcctgactcagcctcccgagtagctgggactacaggcaccgtggcaccatgcccaactaatttttgtatttttagtggagacagggtttcaccatgttggacaggatggtctcgatttcttgacctcatgatccacccacctcagcctcccaaagtgccaggattacaggcatgagcccccgcgcctggccataataacgattttttttttttagatggagtttcgcacttgttgcccaggctggagtgcaatggcataatctcagctcaccacaacctctgcatcctgggttcaagtgattctcctgcctcagcctcctgagtaactgggattacaggcatgcaccaccattcctggcttttttttttttttttttttttttttttttttgtatttttagtagagacagggtttctccatgttggtcagggtggtcttgaactcctgaccttaggtgatccgcccaccttggcctcccaaagtgctgggattgcaggggtaagccaccgcgccccgccgcaacaatgacttttttaaaaaacaggcatttactgcattttcgtacactagaagctaaaataccatgctgtccagttcaaaacaggacacctggcaaccctgttcctaacagctttctgcaaagccaacacccagtgctttctggctgcattggcctgtcctcatttccccctggaaaacttgttttaaacagtacagataacattctgcctctattacaattagcagcttctctcaccaggttatctagtgtggcaagtgctagtgcggagtcacttagtatcttctttcaaaacctcccagtggctgccttcaggtagcatgtgaaaagctgctcatggggaattcagcagctgcttcaggccctccagggcatttcttgctggcatcttctgcctcaccagatcgccctgattattagtgatctgggccccctacctaatggaaaaccagccactcttcttcccagccccaatggatattgatgaggggtccttaaatctgggatcctttcccctccttgcccaataattgaactcctaaaatccttttactacctgggaatctgcaaagacaaccttgaatttgaactggagctagaaggacttcctccgaacgaatttgcccatagatgactctctggtacatggtctctgttgttcaactttctctattctgaagtctagaagacacccttgcttctgaaagtggggcctaagaacctgcagcctcaccagggagcttggtagaaatccagaatctgaggcaggattctagacttattggatcagattctgcatttcaacaagattccccagtgacccccaggcatcttcaaatttgagaggccaggaaagtgctcaggccctgcccttcccttcccgttggctggggagaattcctgtaatttgccctgtttacgggtccttaatctccaacttcactgtcctcgctttccaaagaatcctgagtggcttccttccaacaccttatctgtcttcccccacgcccctgaagccagggcctcttttcttcaaggccaccccccaactcatctcaggctgaggctcctctcttgaggccatatcccatggtagcatttctttgagggctgcttttctgccgtttttctccccaggtagggcctctaaaaccgatggaagtgaagtgctacacctcagagctgctttagcccttagagctggccagggtctgagtgggcctctcacagggccacaggactgccctttcccccagcatgcctagaagctgagaccactcacaccacatgaacatgctatccttgttcctctttcctgccagcctcaacacaaccagaatacagcccaataatggctgcctacaaatgggaggcacccagggaagggagggggtgctgattaagaaccagcctggaggaggatcatggtttctctgaaacaagaaggaggtgagggttgatgcggaaggtatattagaaatgcttcaagcacttgatgctttgagggtttggggatttgagtttgggtttgttttttaagcttaacaatgtgaaaaagatgtcaaataacttttctgaactgtggcaatcagagccttgtccagaatcataacttaatggctttttggctctcaatttgatggtcagtttggctaaccaacactttttaattctgtgttatttattactcagttgatcccccccataatatgttaaaagcctacttccaacctgttaaaatgtacccttggagtgctgtccagattcaccattaaaatagtgtctttccagtcttatgtattttattcagcagttactacagtacttttttttttttttttgacaggatctcattctgttgcccaggctggagtccagtggtgtgatcacagctcactgaagctttgacctcctaggctcaagctatcttcctgcctcaggctcctgagtagctgggactataggcacatgccactatacctggctaatttttaattttttgtagaaactgggtctcgctatgttgcccaggctggtctcgaactcctgggttcaagcattcctgacactttggcctcccaaagtgctgggattacaggcatgagatgccatgcctggccatatttttatttttaaatctttctatttaaataaggagagggagagagagagaaagctctaggtgcattttttccaaatggacaccttgccatgttttcaacacacatctaaagcctgaattgagagtataatttttctgtagatacatcaccttgaggaattttataaacttcagtttcctcatctgagaaatgaggtagttggattagatgaactggctcatcaagtgagtataaggagccttccaaatttaagaattattaacatttcccggaagactaaccaggcaatttttcttctttaggtttgactttctgagatgtcatggcttagtattctttaagcaaattctggaatgttcttgtccctttggaataattgtaatgtggatttgttctgtgcaactgatgatattctaatgtgtttgggcaggtttaagtctaaatttccaaagtctcacacctgtggttttaccaaaaaggtactgctcaaggaaaccagtgatgggcaaaggatgcatggtatagctatgatgcaagagcgccctctgcaggccatgcgaagatgagtctctttcttaaagggtagcttttccgctctttgtgtagagtacaacccttcccttcctcctgtagcattctcatcaagaaacatttgtttagtgcttaccctgagctaggcacagtgtgcttagggctgggaacacaaaaataaaagcatcctaggcttaaaggatctcacggtctaatggggtacatcccaatcagatcattataatgcaacctgagaggtgtgtcactggagctgtgcctcatgtccccattagtttgcaatcacaagttgcacacaagagccgaaatcaaactgtacagtacaatgcttttttgttaggagagaaggactggtgactcaccctagcattttctctttgcacagaaacagatgccctgcccagaagcaacacggctaatgggtgccaccgtggagacccaggcaacctgagagtagtcctgacagccagacctccagggtggaaatgggaaggtctacagagaaagtgggagacatgaaactaaacaggaatgatacattgacaataaagaacatgaagagatggttcctggacactacaagaaacctgtggtcccagctactcgaagactgaagtgagaggatcacttgagcccagaaggtcgatgctacagtgagccatgatcatgccactatactccagcctaggtgacagagcgagactccatctcagaaaaaaaaaaaaaaaaaaaaggaaaggaaagaaggaaggaagggaaggaaaggaagggaaggaagggaaggagggaaggagagagggaaggagggagggaaggagggagggactggaagaggagaaggaggagaaggagagggagaaggagaggaaagaagaaagaagaagaaagaggaaggaaggaggaggagggaagaggaggagaaggaagaaggagaagaaatgagacaaaggagaagaaaggagaagaaaaaggaagaagaggaagaggaagaagaggaagcagaagcagcagcagcagcaagaagcagcagcaccagcagaagcagatgcagaagcaacagcagcagaagcagcagctgaagaagcagcagcaagaaaggaggaggaggaggaaggggaggagggggaggggaatggggaggaggaggaggagaaggcagcggcggcagcaagaggggactggtcccagcagggtaggaatctttagatggttattaagaaatggaatgaataaaatggaaattgatgcggttggctgcacatggtggctcacacctgtaatcccagcaatttgggaggctgaggtaggaggatcgtttgagcctaggagttcaagactagcctggccaacatattgagacccccatctgtaaaaaataacaacaataaaaaggaaattgatggagttaaaacaaaggtcttaacgtaacactaccctgaaggttgggtgaaccaaagggagccccttttggtcctccaacattaaagggccccaaaccagtttgctgtatttctcccagtttggagaaatttaaaaagctaaaaggcagcagttacaatgaaaaatctgatctgaatttgcctggggcaatagtcgagcagactaaccaagataaagattaacaagagggccagggtcctttgggtcaccccttggctgggtacccaaagacttttacacaagagagggtaaatggtctaggggtggagaagaaaagttcctgaaactaaaacagaaaaatgtaggggtcgataggactatgaaagttggtatatttgaacacttcatgtgaagtagttgcattttttatctgattttatcatgggaatgaacattgtatctgtgtgggggactgttttccctacctggtactgtaaaagagaaggcatgtaaatcgtcccttcaagcaatattatttggacatgctaagctggaaccagggagactgcccaggcccacacagtgcagagtagaagctacggtgctggtagggacaaattctccacttgataaccctctatggagcatttcctggagcttatggcaaaagcctgtgggcacctcccagcaacaaccactgggactttggactagagaatttccacttgaagggcatttactgactcgcaatgaaacatttactgaagccaccccactgatacctgaaataggcatgctgtctcagatgatgtcagaggaacattctaatggggatggcagtgcccagaagagttccatgacacaatggaaatggtttatagaggatcatgctactcaaggcatgcagagaatttcttttcccctaggactgactctggaactgtgtgagaaactgctggattctacagtgccaaataaacaactttcaactgaccaaacaagagcttcttggtttatggatggcaattccaaggcacaaaatgctaggaagaactgttctgtttctcagtaagagagacagaaactggctatgggaaagatttcctggtgggaaggccctgaacatagctggcaagtgagactgatgctggcagccctgggggactacaaatggaataggaattcttgataggaatagacactgactctagtgcaggctttgcttatccaatggaagatgaaagtgttcagagtgccataaaaaaaaaattaaaaaaaataaacaacagaagatatttcaaggatttggatggctgaccatcatttcttcttcagacaaaggaacacactgtacagcccataatgcccaacaatgggcagagagatatcctccttagagtaatagtttgatagataagtagaatgggcaattaaaatattggttgtctaaaaccagggaagataaaagcatgaaagcctggcttatactcaacgtggttgaaactagagtgctcctgttagattttttctctgtttttctggttgatctgggaaaagggagtggggagaatgctgagatgactacgcaggtctcaccaagaaaggagtacactggtaaaatgacaatacatttttctttcttctcaaaatcacctcaaaaaattttttctcggccgggcacagtggctcagcctgtaatccccgcacttcaggaagccgaggcaggcagatcatgaggtcaggagatcgagaccatcccagctaacctggtgaaaccccgtctctactaaaaatacaaaaaattagccgggcgtggtagcgggcgcctgtagtcccagccactcgggaggctgaggcaggagaatggcgtgaaccgaggaggcagagcttgcagtgagccgagatgatgccactgcactccagcctgggcgacagagtgagacactgtctcaaaaagaaaaaaaaaaatttttttttctctcccctacctgatgcggtggtcccaagaccacagctgcaactacaagtgctagaacagcaagggtgagttctaggcaaaaaagcctatgtttttaaagctatgtcaaaatttctaagggcagatgggggtggattgtgccttcaccccatctagcaaaattggggctaagagtgaatgcagctatattgcctggtgttgaaaagagctcactagttctgtacctgtgtaaccttaccctatgtgaatgggagtgagatacttgctagacctgtattgaggaggagatacttgctagacttgtattgctacctgcaatctagaccagcatagtggtgattctaatgtcccttccaaaggtgaaaaggtttgggtattaatggacagaaggaaaaataatagctgagagtaaataaataaataaagctgggcacattggctcatgcctctaatcccgaaaccttgggacatcaaggcaggaggactgcttgagcccaggagtttaagaccagcctgggcaacactgggagaccttatctctacaggaaaaaaaaacaaaaacaaaaagtagccaggcatggtagtgcatacctgtggtcccagctactcaggaggctgaggtgggaggatcacttgagcctgggaggttgaagctgcagtaagcagagatcatgccactgcactccagcctatgtgacagagccagaacctctctcaaataaataaatgagttattaattgaggaaaattcaatatcacattaacaagtcaaaagagtctcagggcaagagatgacattttctcgtagctcaattattccagatgcctgaaaaggtgaagctgtgtatttaccgaggccacttctgcttttggaacctgacaagattgagaggaaacctgtaaacccgagtggcctcatcctgggaatcattcgaacagtataatgggctggattgattattaatgattgtgtatgtatgtatacataatcattaataaaacatatattttatgtaaaggatccatggttgaaaaccagaggatggcgtgtggtgttacgctatatattggtttttgtccacagttcctggctccaactcccatagtgcttgttacagttttttgttagaatattgggtgggttagggctgggcacggtggatcacacctgtaatcccagcactttgggaggccgaggcaggtggatcacttgaggtcaagagttcgagaccagcctggccaacatggataaaccccatctgtactaaaaatacaaagttagctgggcatggtggcacgcacttataatcccagttacttgggaggctgaggcaggagaattgcttgaaccctgggggtggaggttgcagtgagccaagattgtgccactgcactccagcttgggcaacagagtgggactccatctcaaaatatatatatatatatatatatttatatatgtgtgtgtgtgtgtgtgtgtatatatatacacacacacacacacatatatggtgggttaagactcaggggcaggcctctgacctcccaccctccttccactctaatgttccccaacctgtctgattatagatcttaagaccttctcatgagagagtaccaccctataccctgggggaaggaatgctgatgtcatgaagcttccattacaacccaagaggacaaggttcagtgagtttctggatagctggaggtttctggagggtggtgcatccagggaggtgcatccatagaagctccgcaccccttccc

SEQ ID NO: 863 - DNA, 8948 bp, Homo Sapiens
aaggttgaccatactctacagttgtgttttaatgtatattaatgttactaatgtgttttcagttttattgatagtcttttcagtattattgataatcttgttatttttagtatgattctgtaaaaatgaattaatactaatttttcagatgtatcatctcttaaaatactgtaattgcaatttaataattgtattgaatgccatcaagtttttttaaaaagcttatgcagcattagaggaatttattttaatgcacatttatattcaacatagacattaattcagatttttacttgggataaaacaaattctagttttccctttgttttgaaattacttttaaaatatgtctttacagataaatataaaatatattaagcattttgaacagagcttagaagacaatatttagtactgtttctgaatatttctttatatctgaaggggaaaagccatcaaaatatgtgaattaaatacctaaaattctggttgtcaaaacgtcacacttaaccataactttaaaggtagaaaaacccttacaagtgaccaacccactcattggatagctaaggaaacacaaaactcaaataatttgctacacatcacagattggggtcttagtcttatgtcttctaactttataatggtatactatttttttcatgtttttattaaaatgttttcttaaatccttagccaaagatttttgtttgataagtcaaaaataaggtcttgtttactttgtttacttttttgtattcaagatttaactcagagtaagaccaaattatcattgtagttttattgatataaaatgtcaacataatttaatttttttttttacttttttgtatttttaaaattttttattaaaaataaaagtagacagccaggtgcggtggctcacgcactttgggaagccgaggcaggcggatcaccaggtcaggagatcaagaccatcctggctaacacggtgaaaccccatctctattaaaaatacaaaaaaaatagccaggcgtggtggcgggcgcctgtagtcccagctactcgggaggctgaggcaggagaatggcatgaacctgggaggcggagcttccagtgagctgagatcgcaccactgcactccagcctgggtgacagagggagactctgtctcaacaaaaaaaaaaaaagaaaagaaaagtagagctgggcacagtggctcaagcctgtaatcccagcactttgggaggccgaggagggtggatgacgtgaggtcaggagttcgagaccaacctgaccgacatggtgaaaccccatctctactaaaaatacaaaaaattagccgggcgtggtggcacatgcctgtagtcccagctactcgggagactaaagcaggagaattgtttgaaccggggaggcggaggttgtaatgagcccagatcgcgccattgcaatccagcctggacaacaagagtgaaactccatctcaaaaaaataaattaaaatgtaaaaattaaaactaaataaataaataaaaatagagacagggtctcactatgctgcccaggctggtttcaaactcctgggctcaagcagtcttgccttagccttccactgtgctgggattataggcatgagccaccacccctggcctaatttaattaaaatctgaacaaaaggccgggcacggtggtggcttatgcctgtaatctcaggccaaggcaggtggatcatgtgaggtcaggagttcgagaccagcctgggcaatgtggtgaaaccctgtctctactaaaaataaaaaattagccaggtgtggtggcgggcgtctgtaatcccagctacttgggaggctggggcaggagaatcacttgaacccgggagaatcacttgaattccagtctgggcaacagagcgagactccatcttaacggcaacaacaacaaaaatctgaacagaaatgctctatttacgttcttttccttatctgtagtgttttaaagtcattaaacttaaaaatgatgttcaggagaagatgagtgtatttgcatagtctgtcataactctggtattattttgtacaaggagtgtgttagggttttcagttgtaaccatgcagaaaatctacaaaataaaagcagttgttaattagtcctttacaatcagaattgtctattttggaaatttatgaagtacttcagatgtaatttaagaaattgtatttgagccaagcgtggtggctcacacctgttatcccagcactttaggagcctgaggcaggtggatcacaaggtcaagagttcgagaccagcctgaccaacatggtgaaaccccatctcaactaaaaatacaaaacttagctgggcgtggtggcgcgcgcctgtaatcccagctactcaggaggctgagtcaggagaattacttgaatctaggaggtggaggttgcagtgagccgagatcacgccactgcactccagcctggaaaggaggggaaagggaaaggaaaggggaaagggaaagggaaaggggattgtattcgaggctgggcacggtggctcacgcctgtaatcccagcactttgggaggccgaggcgggtggatcctctgaggtcaggagttctagaccagcttggcgaacatggcaaaaccccgtctccactaaaaatgcaaaaattagccaggcatggtggccggggcctgtaatcccagctacatgggaggctgaggcagcagaatcgccttaaccctggaggcagaggttgtaatgagccgagatcatgccactgcactccagactaggcgacacagtgagactgtctcaacaacaacaaaaaagaaattgtattcaaaagcttaaggacctttttgtttaaattctaatttgaagatcaaatattatattaaagttctcattttttatccagcaatattttgttcccaatataccatacatagtggatagaactaaatgccagcgtttgcatggaaacactgtcttggtgcttttaaaaatcatttatcaatctcttaacttgttttatttcctttcaaccattgcatgaaagacttcaccaaatatataatttttgattccactaaaaatattccaggacttaacacaaatgcttagaatatttattgaatgaattacaaagtttacccaatactgtctaatattttttagaacaacccaggagttaggtgttttttgtttctttttctttgtattcctaaatgtatctgaagtcaggttttagaaaattatattcaatctgtcttctaaatgacaagaaaaaatttgcattttacatttaccagatgattctttatatctttaagtgctcttaagtgtgatgaaggatcatttgcagcttttatagctaaatgaagacttttcttatttttaatcctgacaatgaattaaaggaaaattgaaatatttgagaagtaagaaaatataggaaaagtgttgcattaaaacttatagtatgtacattccagtctcttcttagagaagaggaggtggcctgtcgatatctaatgaaaaataacatttaggaaactctcaacagtgctggatgttttatttgtagagttataattttgaaacacataaggagccagcagtaaaatgaaagtttataccttttagtgttaatcttattttggctttttgttttgcaaaacaaactgcacatagttatataggggtatatattaagttttcattttttcttgtttggaaaaaaatactaatctttttcatttaggtttcttttttaattgatgccaaagagttccaatattgaacatcttaagtctgttacttggattacggattgagtttggagcttactcagaggactacaggagagtatccaggaagtagcaagaaatgtggataattactgtaccttcctcatggaaaaagttttatttaaagtgttatttctcattgaatactatcaaaaaggaaaaaaaaatgacctaaacttttgagatagatttggctctagtaagtatttagttatatcacttgcatatctgggagaagaaataagagactatcatcagtacattcccatctactaaaaaaatttattttacacatgtcaagggattacttataacttccattttattactaatagcttgaacccttttaatgaagacctaactcctccaccagaaatttaagtttatgttcttactttgtttacttataaaatacatctcaggtatttcggatgtcttttttttttctaagcctatatgaaatgaaaaatatattggcaaaataaatgtttaaaccttttacgttaaaattactttgaaagatgaaaagttagtgctgtttttgtctacgttatactgaaattaaatgtttataatttatattttgggtttatgtataaatcatggaatttatgcaaaaatatgagtagtacagattctcctctaattctgtaggactttgaataatgtgatatttttcttataattggacccttgtgttttgaagaaatgccaactgcttgaagaatctccttgttatttgtattatttgctatagggttagatgttgagaaattctgctgacaaaaaattttaagccagttttacactaaatgttcctcagtctgattaatttgttattggatgtattctgtatctttcttttgtaatttgtaacttttatccacttagcacgaatgattctattaaagaaaatcattaggaagtggtagaaactttaaatcgccccagagtttgcctgtttccatattttattatcttataatcttcgggagtgcttacacttatggagctaacattttcagagatacagcttcttatagtaacactaaaactttcttcctctttggactgaatacctataattataactatatggtagtttaagtttccttgtgattagtcaaaaataccattttagtatgaagcaatgaagtctattatttgttgtcccataattgagaaagcttaaatacaccttttattaagagtttgtaaattctagcttagtctacacagatttttatatcaatttgtttatatttttattaatgtcatttctggaagtgtgaaaatgttaatgttcaacaagcaacattaaaaatagatttgaaacatttatatatagagaggtacacatttatttactgtttaggtactgaagattatcacttaataaaaaatatatatcccagcccccttgaagcttattaatcttgggggtagaggagtgagtgatggaatgaatggacaaaaaagctggtaggtactatatttggtatgtcagagagtgacaagttctgtggagaaaataaagcagggaaagtgagaatgatgtgataaaggtgtttgtaaggcagaagagagatatttttaaatagtatggtcaggaactaccctacagagaggacatttgaacaaagacctagaaacaataagggagcaaaccatgtaggtacctgggagaagacccttctgagcagatgaaatagcaaatacaaagaccctgaggctgaagcattttttgtgtgtacatggaacagcaaagaggcacatgtagctgtgatcaaatataaacaggaagaatagtagcttataggatcagagagttgataggggccatatcttgtagctgtttaagctacaagatatctgagctacagattcagtttttcatactttgttttgagtgagtgtcgctctgttgcccgtgctagagtgcaatggcatgattctcggctcactgcaacctccgcctcctgggtccaagcaattctcctgcttcaccctcccgagtagctgggattgcaggcacccaccaccatgtccagctaatttttttgtatttttagtagagatggggtttcgccatattggccaggctggtctctagaactcctgacctcgtgattcgcccacctcggcctcccaaagtgctggaattacatgtgtgagccaccaagcccggcccagtttttcatacttctttaagatagttttgacaggtatatgtgccttagcctatttgatgtcggcagataggacagaatatttttatgaatctgatttgagattagaccccccatcagaccaacttagaatacaaacagtgtttaagtggggggttaataggtattgtgtgatgatcaggactttgcaaattttgcattgatggctttgaaagtgttttctgcgtgatcaatttaggtggatccaaaactaatgactccaagaaacactgaatttgctcatgtttgtcatatacccaaatgaaccacagtgtttttgattacttcatccttgaaatttctactataattaagtacttcgttgtttttcacttatttctatttagcagcattttaactagttctttgcctctagctgtttttgttgttgtttttgagagtctcactcggttgctcaaactggagtgcagtggtaccatctcagctcaccgcaacctctgcctcccgggttcaagcgattctcctgcctcagtctcctgcatagctgggattacaggcatctgccaccacacccagctaatttttgtatttttagtagagacggtgtttcactgtgttagccaggctgatctcaaactcctgacctcgtgatccacccacctcggctcccaaactgctgggattacaggcgtgagccaccgtgcccgggtcacctctagctgttttaaactaacaatttcatcttctatatagtatacactacttttttaatcttcctaactttttttttcctatagtatacaatttaaatttctttctttgatgtcttgtggtcttgtcccaacattttctatgttgtttaatttttcttcaaatgaactagtcctaatccatttttctttctctttgcctttatttatgccatttcatcactccagttctcccccaactaatgcctgtacattttttttagtaaggcagaatttctcatgtgcactgtttcttgaccttaacagtctaatattaaccatccttccaatggaatgaacatatgatacctgtagctcataacctttttctctactttcgcacacctgaggtatataacgtttctatcattgtttctcatttattcatataggttaaccttttaaatgtattagcaatatgaaaaaaaagttaaatttaagaaacttcaaaacagtagcctaaacatcaggtcccaaggttcagatattaattttatgctgacaagttatatagttgactttttaaattcttcaaatagttatgtatgaaccagttacaatatatccttaagatttataaacattaaaagaataattatctcagttttccaatattgtaaaagcaattaacagatacactttttaaagaagtaatccatatgtttgttatggtattgtttataaagcattcaataataaaaggctgatgaaataacatgttcagtaggatactgtgcagctacttaaaatagcaagtgaatatttaatgagctaaaaagctgttcattattgaataagtaaaagattatcaaatagttgaatagattcaccagaataattcatatgctaaactgttttactggtttactctgggtgagagataaatcttataggggtgggaggaatcttcttgattataaataagcatgtatgatttctgtgatgggcaaactttgttttttgaaaaggagagagagaaatccttgaaaaataaaagtgattatttgaagcaaccttacatccatataatgatttacttttggaaacctataaaagggaatcctactgtgttgaggaactttagacatgataatgaattaactgtcatggaagaaaaatttcaaaatcagataagtttaaaatcagcttcagaggaacagcgtgctttaagttctcaaagtaatattgaaaaggaattcaagaattacttcttgagttcgtggttgagagatttcactgtcatttccccactcttcaagcccccccagacctcaaaaaaaggtaagtgtaagaaaagggatatttaaatctcttttaatttgaaactatattagtaaacaaactaaagaaatacaaatctggtttattttatagtgataaagatttgataatgcaatgaaacttccatatacaaaaattaagcatttttctgttaagtttaatttttcgtagcataaaagtactatatagacatagaaacctcaggaagagcaaaaaaaaattatttaaaaatcatttttatcatccaaaagcagttgttattagccttatatatacacccttctagttgcatatttggattagtgaatttatttctcaatccaattcgttactgtgccagggactagaaagattatatttcctctagagaagaggtttagtgctatgcttctggctcagaaatattttctttagatttgagttttatctaaaaattaccactaactttatatctattccatagtattgtaatgtaaaaatgcctaggattagaatttttcctcaagattgaggatacaggaagatgcatcttgtttactctggattcctcctctaccatatccgcatgtcatccccaaggataccttttcatagtgaaaacaatttgaggcaagggaggtcatgaagtattctgagcaggagagtaagaaaaataacttctgaaatacgtgtactggtcagaatttgcttaaagagagaaatctggccgtggtggctcacacctgtaatcccagcactttgggaggctgaggctggcgaatcaccagagttcaagagttcaagaccagcctgggcaacatggcgagaccccatctctactaaaaatacaaaaattagccgtgcatggtggtgcacgcctgtagtccctgctacgtggtggggggctgaggcaggagaattgcttgaacctgggaggtggaggttgcagtgggct

SEQ ID NO: 864 - DNA, 4967 bp, Homo Sapiens
tgtttcccggacttctcagataaaccctctgcaatctcttgggttcctttctccgttccttctttaagaacattctcaaagctttcgtctattggcatcggcttggtctccacatctgcttttgttatttcttggtcttcaatttcaatttctaaggattcctcaattggaagtgacacctccccatcctgacttgatgatttcttcatggagcagtggaaagaacgtagtccagaaattagaaggttttggtccatggcacagctgagcactgacaacacatccttccctgggcttattccatctgagagggagatgcacatgtatgatttcttctacggtcattctgaagatcggtgtcatcaataatttgggcttgggactatccagtttcacaggggcattcagttgattgaaaatccaatatcaatattgtttatagtatcaaaacaatctaccgatcaaagtctctaaaattactacaaaaacctatttgatatcctatggcattgcccaatttaaattatttataaaatatgcagtaaatgtgtatgccagaaaatcaatgtcctaggcattgactcctaattaattgtttgaaatattttcataatagtgaatgagcacagtgtttgcctgacctctacgaggaagaggaggaagtagaagcagaacaaaggaaaggaggaagaggaagagaaataagaaaggctgagagggttgaaagactttaaggggggctagtaagaaaattgtaggcctctagaattgtacacaggccagcctttccttctcatctacttcactttcctaaaaatcaattttaagctagacaaaaaatgtgcagagaccaactttaagtggatccaaggcagtaatttgagctgattccatcaaattatagatgcatgagaagcatgcattttctaaagaataacaacgctgcaacaaacatttttgaaggaactactaaaatatttccatctctaaactcatcctcttccacttcagatgatttcttttccatttcattctattctctgaagcaaaaaccagaggaaagaaatctgatggaatgaaattctgctagcaaccatctgaaagtataaatgagggagaaagtccaagatttaaaaattcaagcaaattttcttgcctgttggaaggaagagctctcaaataaagagataatcaagagacatattacagggcatcaagagccatgaaagtaaatcagcaaactggataatttcttgcagattagaaacatctccctgaatcacagttgaagcaaaggggatgatgccaggtctgactcctacttggaaaatcataatcccatgtttcctcttgcctgggcaactgtggagctgtgacatgcctgtgtgcagcccactgcacaatcagcagacctcaggcaaatccagctccaagctgcacctagcacctttaatgaagtgactgattaaataaaagcatcccccttttgttaagcaatactttctgaagcagcatggatttagaggcagccctgtgagtttgtaggcgataagcactatataaatactaggtaatagtgggattagagtcagggaaagacctgtgtcctgtgtatgaaatgagaaactggaaggagaaacttttaaagagaaaaatacaggaaaaggcagccctttatccttttcatttcctcttattcatatttctttctgctaaagcttatttctgatggtaaaatctcttttctcttgggtctcattatttcattctctttttaaaaaatattccctaattattgcaaccaagtaaattttttctaacaaacagaaggcccaagtgacagctcgtgattaaatatacacactaggaaacaaacagtagtttctttcaattgactgaactgcctctatacttaccatcttgcaaagatataatgaccagagacaaatgaaactttaataaggtttctcggccctttctgctatcctcaagtaagtatcaaaaccttccatgaaaattcagttccatttgaagaacaggaacaaggcctcatgcccctgcataactaaagctcttctttctgatttccttcaccagttgcttatgactttccttctcatttcttttcagatttctcaggcaagtacaactgagctgataaagaaacagcaagcccattgagtggttaacccatcagtcattatatatttgcaacatttagcattgaattgatatactaagttttcactgaaatctcttttatccatgcccacacaaacagtatagtgtcaaagggcctgttcttgttgatagtgttgggtaataactcctctccatcttcttcacgaagccctggtgaattctggacatcaagtagggtgaccatgaaatttatcatccaaacttggacacatagtgaaagaagtgttactaaaaattaggaaatgggggggaaaggggcagaattttgaactattccaggaaaactgagaagtatggtcgccctacgaattagtctccccacttctagtctgatatccctcaaaatctccctcctgttggaaatcagagtgatctattgttattaaacagatcatgtgactctcctgcttaaagccctccagtgattcccattatccatgggataagttccaacattccccaggcaacataaaatgtgttatattttctaatacctactatctcccagtgattgcaatttctcatgctacatttaaatgtctggcaacggaactgattgtagtggcccaaacactatcaactacttttaatctccaggcctctacaactgtatgagtcacatgatattggaactattcccttgtattatctctctctcagtagataaggatgacgtcctagtgatcttcatgcccccagtaacttgccagtgctgatgcttagtaaggacctaattaacattgatccaactggacacagacatggaacaattaggcattccatattctgtcctttccatattctgataaagctacagtaggttggttctaccctatataggaagcttgctacatttatagaaactcaatagttaccagaacaggaaaactgattcacagtgtcttgttaaaccaaacaccaattttggttactattccttgataaagattgatacaaaaccagcctgaccataaaaagtggcaatccccatgttgatgctggtggccctagagagagaaagtctgacacaagccagaggaagagtgttcatatcccaaagacttaggaagcagctggttgtatgaaaacctcacagcactacattacacatgttcttccctttctcttctctttctctctggttttgcctcccagtttgcttttagtatagttactcttttcattttcttttgggccatttttcttactactgtgtaaactttacctcatgcttattcctaatgtgcccagaaacacctcaatccttacagaggcatcagagctctagattttcaggatctctctcacctgttccttcccacagaaatgataataagggttcctgctcacatttcctcccccactccctctgcttcctaacctactctggtgcttccttgtgtagctctgcatggtgtggtgtaagagttattaacattattgaagatggggtcttgctgtgttgcctaggctggagtgcagtggtgcaatcatagtggtgcaatcactacagccttaaactcctgggcccaagccaacctcctgcctcagcctccttgatagctgggattacaggtgttagagattgggtcttgtatgttggccagtctggtatcaaactcctgacctcaagtgatcctcttgcctcagcctttcaagtcactaggattacagatgtgagccactgcacctgatcttgtgatggttaattttacctattaatttagccggactccaatgcccagattggtaaacattattctggatggatccctgaccaatgcatgtggtgtgtcccctcctcttgggaactgtgagtaacaatctatctttttgatggcaattgtctcttaatctgtaagtttcaccatacctgaataatttttaaaaacccacattttaaaatagccatgcagaacaatatacctactttcattaagaaagggccaactagtgaaggtttcaagcagtagaggagcatgttgagagtttttccataaagtttaatttagcaccattatgtagaatctaataaaaccgagatgaattttgcttattcctttttcccctttctgcttttcaatctcagttccctggttctatctgctaacttcctactgatcattcaaagcccatttcaaatgccaccttctctaggaggcattctctaatctcctcggtcaaaactaatatttctttcctctatgtttctattgtgctttatttatatcacaattatagtactcatcacaatatatcatggttaattgtatatatatatatctgtctctcttgctagactgcagtctttctgagagaaacagtttagtcttacccatcttggtaacctcaggacctagcatatcatttgccattatcaacaaaaactggactgagctatattctcatttagaggcaggacaagtatatagatgattgcaatagttccattaaaagattagttatcaagcccctgaactagagatgtagcagtaaggatgaaaaaggattatcaggtacatgagccactgttcaggtggcatctagagctgtgccatccaggacagcagccacttctcccatttggatgctgggcatttgaaaggtagctcatttgctgtaagtataaaatattcattgaatatcaaagacatagtataagaaaatacatcatacttaattaaaatttttcatattgattacaggtggaaatgatattttagatatacttgattaaataaaatatattaaagtcttaaaattta

SEQ ID NO: 865 - DNA, 4493 bp, Homo Sapiens
gcgctgtggaaccgcctcctgctagagcagcgggctggcgacggtcctcgccggggcgggaagcggctcaggctgccctcgctggcctgcggcggcgcggctggaagcgcgggccactcgtgcgtgggtcactcaggactgcgcctcgcgcgactgtgtgtgcaggaaacaagcaggaaataccctaaaagagaatgaagcgccatgttgagggtcgcggacgtcgcgagtgctgtgggaatgtgggctgaggtggagagttatggtagcccgtgttacaggctcaggggtctgaaagaagcctaatcgtggaggcggcatctgaggagggtcttgaaggctgggcaggcatttgcccgacagagatggaggaagctagtcctgtctgatggaggaaacagggcggaggcgtggagggagccgtgcagcgctggtgtgaggagcagcgagcaggccaggcctgtaaagcagagtgagggaaccaggatagagaaggcaagtcggggtcctgtggtcgctgaagaatttgaatgaaatcagtaaacaggtgagagggatccatcgcaagagcatgggatgaaaggaggagtagtccacggtgattcctctgcagcggtgggtgttattaatcgcgtatgtgacaccaaaaccaccccactcaagctgtggctctttccctaaagtagaaaaccgagaccagttgggttccaagcatccacgaagatcttattaaattcgtgatccctggtggcaccatggagtcaggattggctcatctcaaacctgactcagaaacaaaaccgtcacaatgtgcagagatgagcgtccttaccgctatcaacgtattttctggtgttttcacagtgctgcgcttcctaatccccattccatggcaatccacatgccatgatgcccggagtcattaacaaaggagacacacaggggctcctcacgttggctttccagggttttgatgaaaatctgtttcctcgtctcatacaatgtggttagtaatagtatcatttagggttgaagaattaaatggtacgagttatatagggtgcttattataacctacatggaaaatgcctaggatatgttagctatgctcatcaccaacatcgttatatgatggtaataatcagatagtcaggaagcctgacaccaagaaaatggatacatgctctgaaggaatgaatgtggagagatcagaaggtcaagaacaaagtcgtacaatatgtctacagtaaagggatagagaaaagaaaggctataaaagaaggaatgaaacagagttaaattatagaaatcaaagctaaggagaatttccagaaagggtagtatcatttaatatcatagaagtttaggagcccaagatggaaaaaaggcctctgggtaactgacattgaggcagtctttggggaagctccatttccgatagagaagtagactgaaagtcagcttgaagcagggactaggtgaagaagctgttggctggtcgcatggggaaataaataagggatggcatatgccgtatttctggatttctttctttcttgcccagcctctatatatgcacagagtttggcgaaaacttacaaaaaataaaaatgaaaccaatttcgtttgtagacccaaatacaatgctttctgttagaatcaagataaattcatgcctctcccttctattcaaaccgtcagttttgaaattaaacatcagcttttcttcttcattaaaatcattttcagctcttcccattgatggtttgggggagttgcataagcagtcaggtcttgatgagtagaggaggagggaacaaacactttcagcaaaggcagaattctgaaattctgctcatatttttttccagtaactttcctatgtttgtgaggttattcagtcataaagatcctagtgaaatgtttttcaagctttactaatcataatcactgtggacatttgtttaaaatgtgtattcccaggcctctcacctggtgattctgattcaggagatcatggatgggactcagcatacatgtgtttgacaagtatcacaagtggttcttatggtcaggcaaatttgggaaactaaccaggaatttatgtttttatgactggcagctagaaaagattcctagagtctttgctttttgaaaataaaatatttcttttttaaaaggaaaattgtatgactagatacagcatttatacatgtgataaatgtactatactgtgtgcttttgtcatatttacagttaaagatgtgtaagaacactctgagaaaaattgtatattaaatgaaaagaggggtaagtcagggtgggggagaaatgagaagggtgtgcttattgttgctaaaagttagaaaagccagaatgatagcatctaaggttgcaaatagcacactgtaagttgagggagcttcacaatcatgtctgaagccttctttgatatgctgagttgtaaacagtggctttggacaagatttgagggagaaaccaactatgctttaaagtgttcatttaaaagtctttaattaaaggaaagtctttgcatttacttgagctaatttaacttcaggactttaagaaattactagcccttaacctcttaaaaattgtctttcatttcaaatgaaagtttaaggtggcctttatgttcgattggtatacttgtgcgaagacttaacagcaaggtactgtacaattctaaatgtttacttcttaattttgctggaagaaatatactactcaattgattatttttaaagcaaagtaaaacaatttattttgacaagtgacactgtattttcctagttttttggtggcaaagattagtcttaacatcactaatcatcagagaaatgcaaatcaaaaccaaaacgagataccatcctacaccagtcagaatagctactattcaaaaattgaaaaacaacagatcttgggaggctgtggagaaaggggaacatttacacataattggtgcaaatgtaaattagttcagccactgttcaaagcggtttggaaatttctcaaagcatttaaaatagaattaccattcaagccaacaattccattactggtatataacccaaagagaatcagttattctaccaaaaagacatatgcacttgcatgttcatcgcagcactattcacaatagcaaagacatggagtcagcctaggtgcccatcgacagtggattggatcaataaaatgtggtacatctacacagtatgattaggccattcttgcattgctatgaagaaatacctgaggctgggtaatttataaggaaaagagatttaattggctcacatctctgcaggctgtacaggaagcatggtgatggcatctgcatggcgcctgtggaggccccagggagcttttactcatgatggaaggcacagagggagtaggcacatcacatggtccgaggaggagcaagagaaaatgggagtggggcatgcctcgggcggttcagctctgttgacactcatggtgctgcttgtgggctgatgcaggagtctactgtgaagggactcagtatggtggaaaaaaatattcaacttctgctcactttattcagtgtaagaactgtaaggaggactttctgcatataataccattatggcctgggggaggagtatcacagtcacagagtactggttcccttactgtccaagcatggttctactctttgcagtccaaaggggcttcatagactgactcatgtattcagggttcgttagctcttgtaaaggtaattttatatgtggatagttgttcatatagatgtgtccgtaggggtaagattactggagagatcgactccactaccttgctctgcccaaatccttcccctttccaacaagagtttgccacctcctagttttcttttttcttaaccaaactaagtttagccttttaatccttaactctcctccacttctaatgccattgcttctttgtatgcttattgtattttccatgctatatgactttcagctggttatttacagtatgtaagttttaatatcctgtaaaagggggataataatagcatccatttgatagggatgttaaagatattaaatgacactgtccatgttaaataactttttaagatatattgagatgtttctgtacttccttgttctggccttcttgttgaaccagagaaatctattgccatgaaaagcaataaaattgtgatagtagaaattaaaagtgagtaggaacttatttaaaaatcatcattctccttttcaatgcaaaaataagaactagaaacttttaataaggcaatagtctgaagaaataacttatggaagagaacatgggttttttaatcctaaagggttcttttatatattcaagggtcgagattgcctgccttgtatcctactaaaatttcaatgcaagtttcagagagggaggaaagagtcaaagaaaaaattgcactggaaaaagttaaataagtaaggaag

SEQ ID NO: 866 - DNA, 3503 bp, Homo Sapiens
ggggagcccagacttgccaatgggtaagtgagtctagtcaagatgtaggatttcagaaaactcactcagaagagcaggatgaagataaaggaggcatcattcagcagcaataaccaactcatttccttctctagaaagcaatgaaacaagaatctggtcatgggattttaccagtgcaaaggattaatccacccaattgatggccaagaaaccaaccagtgagagcaggaagcaagaacacctcgagacaggaggcatggctgggaggcctcaggaaacgtataatcatggcagaaggcaaaggggaagctgtatcttgtaataagttaaatatttgctgaaggaagagagctgtaatagaaaatggaagtgccagtggtgagactttatttttttttctgaggaatggttgaaatacatgaagatacatagagaagaaaacaattcttaataagtgctaagtgtcatcaaatactatgtttaaatgaactcctactgaagagagattagatttttttcatctattttgttaagaaaacaattgaagatcaacaagtagaagtaaggagtagactcttcagatacatggatttctaatagtagagttgctccagctggactcactcaaataaaatgagttccaaattcccagggatgtgcaaacattgaataaacaatgaactgccaagattaggtagtacaaagctcatagatgattcctgttcccatattgcataggtctcctttggattcagaaagacaatgaactgccaagattaggtagtacaaagctcatagatgattcctgttcccatattacataggtctcctttggattcagaaagacactgggcttcccccaaaccaaaggagaatagtgcccctcccactcacatccagaggcgtacatctactgcataggagttgctttcattttcctctttataaattgttttgtcttattctaaattcactaaagaatgatgattttcagaaatgtaacaatatcaggtggaagtatagttatgtagtagtatagcacaagttaagctaattaaaagatatcactgatatatatcaaaatagaaacacatgcaaaaatgacaatacttatttttgttggggatgcagagaaaatagtactctaaaaactcctagagtgaatatgcattgttatatctttaatttttaagccatgataaagagggtattaaaatttaatgtacatacactttttcatcaagcaatactttatatctagaaatgtatgttatagaaaccaaagggttactagtagagacctatgaataaataattttcttgcattagatattagaaaaatacccaaacatgataaagtagttattcaaattatggtacatctataccatggatgttcatgaatgcaaccattagatacaaccccgtcataaaaccatcagatctcatgagacttattcattatcaagagaacagcatgagaaaaacccatccccgtgattcagttacctcctaccaagtccctaccatgacacatggggattatgggagctacagttcaaaatgagattggactagggacacagccaaaccataacagacatcaaactatttatcttcacaaatgatataatttcacacctagaaaacctcatagtctctgcaaaaaggctcctaggcctaataacttcagcaaagtttcaaaatataaaatcaatgtacaaaaatcagtagcatttctatacaccaataacatccaagctgacagcaaaatcaaaaatgaaatcccattcactatagccacatacaaaaaatacctaggaatatggctcaccagggagatgaaacatctctagaataagaattataaaactctgctgaaagaaatcagagatggcataaagaaatggaaaaacattccatgctcttcgatagaaagaatcagtattttttaaatggccatactgcccaaagcaatttcacagattcaatgctatttctatcaaactaccaattacatttttcacagaattagaataaactatttcaaatgtcatatagaaccaaaaaaaagcttgaatagctaaagcaatcctaaggaaaaaaaaatgaaacaaagatgaaggcctcatgatacctaactttaaaatacattacagggctacagtaaccaaaacagcatagtactggtacaaaaacagacacatagactaatacaacaggttagagatcccagaaagaaagccataaacctacaaccatctgatctttgacaaaactgacaaaaacaagcaacaggtaaaagactccatattcaacaaatgatgctgggataactggctaatcatatgcagaagattgaaattagattctttcctttcaccatttataaaaatcaactcaagatagattaaagacctaaatggaaaacctcaaactgtaaaaactctaaaaggaaacctaggaaatatcaccttggacagaggccctgacaaagattttatgacaaagctttcaaaagcctttgcaacaaaaacaaaaattgacaaatgggacctaattaaactaaagagcttctgcacaacaacaaaaattgagtaaacagataatctacagaatgggagaaaatatttgcaaattttgcatcccacaaaggtctaatatgaagaatatataaagaacttcaacaaattaacaaacaaggagtgaacaaccctatccaaaaatgtgcaaagaagacgaacagacacttctcaaaggaagacatatgtggccaaaaaacatatgagaaaaaaatgcttatcatcacaaatatttagagaaatgcaagtcaaaaccacagtgagataccatctcataccagtcagaatggctattactgaaaagtcaaaaataacattctggtgaggtcctgaagaaaagggaaaactgatacactgctagtaggaatgtacattaatttagccacagtgtaaagaagtttggagatctttcaaagaacttcctcaaagaacacacatatattcattgcgacactattcacagtagcaaagacagcaaagacatgggatcaaccttgatgctgatcaatggtggactggataaggaaaatgtggtacttatacaccatgcaatactatgcagccataaaaaaagaacaaaagcatgtcctttgcagggacatggatagagccagaggccattatcctaagtcaattaacacaggaacagaaaaccaaatactgcatgttctcactgctaagcaggagttaaacattgagaacacttggacaaaaagaaaggaacagtagacgtcgggcctactggagggtggagggtaggaggagagtgagaactgaaaaactacctatctgatactatgttcattacctgggtgatgaaataatctgtacacaaaactcccatgacaggcagtttacccatgtagcaaacctgcatatgtactccttgaacctaaaataaaaattgaaaaaaaaaagcca

SEQ ID NO: 867 - DNA, 1436 bp, Homo Sapiens
gtcccatcgagaagcctcgggtgaggggcccggtgggcgcccggaggccgctggagggctgtgggagggacggtggctccccactcccgtggcgaagggcaggcaaaccagaagcctcttttgagagccgtttgggattgagacgacttcccagagaccgtgacaaaagacatcattctacgctgcacaaaagcagccagaggcggcctctcccacgctccgggagcgaagggaatgatctggctagagagcagcactccagggtgactccgtcctgctgtctaaccggcctccggcagagtggcagatcatctgactctctgaaccactctgaacatcagtctcttcatctctaaatgagggtgctggccgtgtggatccgcaggggtatcctgaggtttgccacgtacaaaaagcttaggacagtaaatactaataggctggtgcaaaataaattgcgtttttgtcactaaaaaaaagtagcaaaacccgcaattattttccaccaacctaatattaaatgtgagtgactgggtcaacttgatgcagctttctgatccctgctcaacctgcgaccagcttctagaaggacaggagtggcctgtggccgtgggtcttaagggcaagagaacaacagagagatgtttctggcccctcttgtgtgaaatgaagactttttaatgtgaatgtagaagtaagtcttgggagcaaaaacaaaatcagaccctggagaatggcagaaactccaaaggagttgaatgctggagaaccccaggcgaagttaaatcaactcgacagaagagcacagacatgtgatggggcaccaggtgggggtgacaggacggcacaagctgccttctggggtgatggaatgctctgtagcttgctcaggatgtggggtactcacaaacgagcactggtcagaactcattgaatggtagcacttgagatctgaccagttcaatacatgctcactagacctcactctaaaaaaggaaaaggagaaaaaaaaaaagagttagaaactaagggctagaggaaatatgtgacagacaaggaaaggcttctgtaagcagaatgtgtcttttccatggggaaatatgaacgatatgtctatacacatgtgcacatatgaacatgaatctgtgaatgtgcacacacatgcatacacatgtacatgcacacatacgcacaaatgcatgtgtgtacacccgcgtgggagcgtatacacatgtacatgagcacgtatgcacaaatgcatgtgtgtacacccacgtaggagcatatacataagtacatacacatgtacacacaaatgcatgtgtgtgcacccgcatgagagtgtatacatatgtacatgcacaaatgcatgtgtgtacacccgtgtgggagtatatacagatgtacatgcacaaatgcatgtgtgtacacccgca

SEQ ID NO: 868 - DNA, 2779 bp, Homo Sapiens
agaaatcctccagccctgttagaaatgcctcagccagggggactcatctcctcaaacctgggggaccgagacctatgagaggtcacagcatgagccaggacatcggaggtacccagacattgttatgaaactccgcatgtgcccctggtggacgctgctggacccagcatgcacacttctcggctaagagtcaccctggatgaaccaccattgccagcggggagcatgttgcagctttcccacgcagtggatgagaacgaaggttacgaccattgtgtgggaggcgtctgtgtagcaattgctggaatcacttgtggcattgtagaaagactgagcgtgggaaagaagacgcattctgaagtcaccccgatttatgttaaattatcaccttgactactgctatagaacgaatgtttatgtcccccacccaaattcgtatgctaagacctaatagccaataagatagtattaatagatggggcctttgggaggtgagtggctcatgagggcagagtcctcaaaaccagataagtgcccgaataaaaggggccccagagagatcccttgcaccgtctaccatgtgaagtgtagaacacagcgagaaggccacctatgagccagaacgtgggccctcaccagaacccagttgtgctggcaccctgatcctggacttccagcctccaaaatgacgacaaagaagtttgtttttcctgagccatccacttcaaagtattctgtcatagctccccaaatagactaagacatctacttaaccttggtcaaacgtttaaccttggagtccacgcctctgaaatggtgacaataacactgtgtatttcctactttatgatcaggattaataaatgtaatttattaatcagaaattagtaatttctgattattaattctatggtgcttgatacttgattgaggcttatttaatatttggatctcttttaatttttttcttttttgctctttctttctgcttttcctcttccccttttcctattgaaatagaatgcagaggataaagcaagcaaacaaaaaaacttccagaagaatcacagagttttagacctagaaaaaaactgaaaaatcatccattccactctcctcattttacagatgagggcatcgagcctcagagaaatgaaacttgcccaagaccacacagcaaagagacgtattttaaagaattggctcgtgggattgtggggcctggaaatctgaaatctgcagagaaagccagcaggctggaaattcaggaagtggcgaggaaagaagaatgaagacaaagaatatggagtttccattgatttagccaagtccataacagaagaaaagtgccttccttcggaacttccaatacaatgtgtgagaatggacctgttacaacttgtattactcgcagggttcccccactaccaagaataggggtggccttagaaggcactctgaagcaagaatcagcaagtgactgaatctatgagactcgtattgatcagcctcaaaagaaatgagtcctaccttctcggtctcttaagaaattcattctcttgaaaagcaattcaaaaagagctttccctaatacacattagataaacaatgagatatcctcctagctttctcttgggaaactttcactttatatcttttcaatttattctcatctttttttttgttccttccttccctacttttaggctttgtcgttcaaaagctagctcgtagaatttttttaaatctttgtattcatatatccctaactagagcatgatctttttctggctggtggatcctccccagaatgtttgcatgtattagggctccagtgaataggtgttggtcatgaggaaggatgaccagctaagggagctaatggcttagacagacactgtagaattgcaaggaatagagatgtgctcaagataccttggttggcgaggtttattgttgcagaaacacactgggtggtagccagtcaaccaagacggcggccatcaattccttacctttctttgtgtacatgctgcaccccatgaccaaaggtagggccttttttctcctcccttgtatttcgactggcctcataccttgctttcaacagtgaaatgtaacagtggtgaagttggacttgttccaagcctagactttaagccttctgtttcctacttcttagaagccagtcaccatgcaagaagcctgcctacccagtaaccagctgtgagaagtccaagctggctacacaaagggggggacactgaggtgccagacaggtgggtaaggcctgcctgaaccttccagctctgcccaacactcagctgaatgcagtgaatcagccagcccagctgagaacacagtgagcagaggttctgatcctgcctggattccagacccacagaatccagagaaatcatgtgactttaagccactaacttttgcaatagattaatgtacaacaatagataaaacacacagaaaagtcaagaaaatgtttttgaagaaaagtgatctccgtaggttaactgcagttggttaatactaatttattgtatatttcaaaatagctagaagataataattagaatgttcctagcataaagaaaagacaatttaaggtgatggatatgccaattacactgatttgatctttacacattatatgaatgtattcaattatcacatgtaccctgaaaatatgtacatctattatgtgtaataaaaataaatcaaaactttttaaagaataaaaagcggtcgcacatctaaacagggc

SEQ ID NO: 869 - DNA, 7970 bp, Homo Sapiens
ttttgcaactacaaagggcccagagtttcccttgtgaatgagctcagcatcctcacgtttccaagaggaatcaacactgcaattcctcggaccacggtggctctcttcccagcacacctttgctgtgacctgcacccctgcattgtcctcaaagacacactaagaaaacacatttcagaaggaaggacgtaacggagctcatgatcctatgctccccagttggactccatgggatactgtttcatatcttgttctaataggctcttcttttccagagttttttattttccctggcattttgtgttttggtaattgcctacaagaatagttctataacagaaatcaacaatgaaaaccaaattacccctgcccacatcctttcattcctttttcatctctaatgatattttctgtatgatgactaacccagactgacgtaatttatcaattgatcttgacgatgtacattagaaaatgcattctgcaggccccagcaggccatcttccatgtgcgccacgtagctttagaaaacctattagtgcaacagaaatatctaaagcccagcctttttgctaagaatattagaactggtgctaattactttattaatcataaagtgaaacagccgtgctatgtcaccacagccgtaaaataagtggttttatggcaaaagtagttaaagagaaaggacagattggatttatatcatgtttatctaccatttattaagtatcttaatcatatctcctccacagagaagcaaacatccccctattcaaggttaaaagaagcgtttgtctttgaagccccactagagcagttatctctagtgaactagggtttttaatggcctttcacaataattacaaatttaattaacctctctgctttgatcagtcacggctgtttctcattaccttccccaatgcctgtttctgagtcaagagctattcctgggccttccctttccagctataaagtactgtttaggtttaatttagtctggcacagctgtaaagaaagcaactctcctgctcaacagcctccaatgactccccgttgaccactgaattaagtacaaactccttagcccggcatttgggccttccacagtctggccccagacccccttctaatctcatcccaactcttttttaagcaatcctatctttccttaccatctttcaaatttattaaattcttacatacatcaagacttacttctaacttgtctattctcttcagttgaactgtcagtttcagtgccagtcccatgctgttttacatattataactttataatatattttaatgcctgatgaggctaatgctagtatctcctcattacttttattttgccaaaatatttgtcagtatacttacccatttatttttttcagatgaacttcagatctcctttgttacatttcaaaagaatatctcttgatatcttagttatgattggggaagaactggcatcttcctttgtacaaacccctggactatatgaatgaaatgaagatgagtaatctgccaggaagatttggagatcaaatcctagacttctaactcttggaagtctatgtgacaaggaaggtaaacaaatggaaaactttagtaggaatatttttctcctcactctttttcttacatgtcactgatctctaagacttcatgacttgccttttcttgatgcttcccgcacagctgttttctttttcctcaccaccagcccccgagcacgcacagtggaggaatgagagaagcttacataaaaataactttctggaggctgaagtccaaggtcaaggtcaaagagccacatctggtgagggccttcctgctggtggggactctgcagaaccctgaagcattgcagggcatcacatggtgggggagcttgagcacaccaaactggcttttactagagacccactctcatgataactaacccactcctgtgataacccattaattaattaacccttaatagattaatccattgaatgggaagatgtgcctacttcccctttgccttccaccgtgactgtacatttcctgaggactccctagccatgctttctgtacagcctgctgaactgcaaggacctggaaatcagacacacctgggttcctggtgagcttcactgcttcctggtctctgatatcagctctgcccaaatttcagctgtcacagaatgagtgatcctcatagtataatggaaatgcatcatctcagtttccccatggcctgaatgtccatacaaaatgagagccagtagagaaaaacagaggacgtgaggagtttttaaaaattgaggaaaagtggaaggaaaagtaaggatgaaggtgaagatgaaggaatatgtcagagatgctagcactggcatcccccaccacacagtaccatgtactgctaaagaactctagaacatacagggtgtagacggcagtcttcttggggaaaaagaggcttcaggattgcaagatttcagctactgtctctcctcggagcaggattccatcttttccatggctggggcccttgacacatgtcactgtgcactgctcttctcgctggggaaaaggaaactgaggcccagagagggcaagtgaatttcccaagagtgtccagatgatacggagctgagctggaaagtgagcctggatctctctggttctgaaagctttgctcgaaagcacaggatgacacctccattgacttgaatcttgctttctgacatgctggctgtggcttgcttgggacctgaataagagcttgcttactcccggtgttcaccacagcggaaccatgggtgcagaaatgtaattctctgcactatctttctggaattgggaggggcacagaagcaggaaaagtgaattccaggaaagttgttgcatgttggaagctgtgttgtggggaagtgacaagttgcttgctatctgaatggggatgggatcctttgtgaaggcagcatgaatcaccaacaggtaggattagatggatgatggttgtatttggaattgtagccacacccttgggactgcagccctgtgaagactgaggttctgacgaaagtcaagaaaaatctgcattgcaactcttcgaagagaagaatgtgacatcttgagtgggtgaattttactttcttcttgatagtgttttaaaatttttagaaatgttttgcaatgtcttaaaagtgaccttctacccagaatttggttaatgttcagttttatttccttcttatttttctgagtatttactttttcaattcagctgaaacttttcaagaataccatgacctttctctccttttaaaaaaaaagtttcaaacagacaatgttaaaacagaagaagttttggaaatcaactacttaatctattatgatatggaaactgtaaactaaaactgttcatatccactccccaagattacatcaagagtggcagggctgggacaccagagtttccggaatggctcctcagggctccagctgcaacaaactcgctgtgccaatgtgcatgcagttcctgattctaatcaaataagtatcataaccgagttcacccgaaatagagtatactgcacagaaacttaataatgggtgagaaagacacattcgtgacattagcaattattaccatacgtggtcaaatccatttttattttctgttttctcattttgtgagtcctctgggatctacacacaggtaccaattttttgcctattcctggcaccgcgcactgcttaatcatcctccccacactgactttgttgaccatgctcgattgtcaataccaatagttctccaggggtggctcagatacccacaggggtccctgagatcctttaaggggtctgcgagatcaaaacaattttcataatatgtcgttttccagaggcagctgcataaatcacaggagactgaatacaggagaagatgtaagaatccagtcagcttctatcaaaccagacataaaagacatttgcagatatgtaaaacaatgccactcttcacattgcatttttaaaaaatattatttcccagaaaatatatcatctatgttaatatggaatggggtttgttagaaacctctttaaatttcaagtaattaacaatttaaaaggcagatatctagagctataggagtacaattaatgaggactcagtcttcaaagtccaaagcgagagcagatggagaaacagttctcagcatttggtgttctgcgagccctcatgggaggaagaatttgttccagcataaagagacgtaagaacgagtactaggaggcaaaggagacagcattgataaaccaagataaagacatctaaatagggctgagcatggagactcatgctcgtaatgctagtgctttgggatgccaaggcaggagaatcacttgaggctgggagtttgagactgacctgggcaacatagtgagacgctgtctctacaaaaaataaatataattagccagggatgatggtatgttgcagaagtggaatttattcataatttatgcaacaaatactcatgatgttcaaggttctggtgtgcaacagtaaacttacattccctcactttaggttagtgagaatgaaagataataaaaaacaaaaaatatatataattcaagtggatgtaagtgttgtgaagaaaatacaccagtgatcataatagaaatgcaatctattctcggcttgtcattatattttaatctttttatggccttttgttctgatattggtacataaaagtttaaatcctaatgtattaaaaaagtttaatatcactataatttcagaactttatatcatgcttatcataccatcccatagtatgggggactacaggtgtgcaccatcatggccagctaactttgtactgtctgtagagacggaattttgctatgttacccaggctggtctcaaacccgagggctcaagcaatcctcctgcctcagcctcccaaagtcctgggattaaaggcatgagtcaccatgcccagccagtggttgaaactcttattatggccattctgcggatgagaagactgagtcatcaggaggcagggcttgccaaggtcactgtgttggggaaacacagtcaggatatgaactcaggctcttggggtccctgctggtcactgtcaccccgtggcccttctgaagaatgtcacaggaaagcaaagctgagagggcctcgtgaactcatccatgcctgtctcccacactgacctgcacctttggtcccagaggtgcttatgaaagacagatgctcagatccctccttagagagtcagattcaggaggtctgatgtgaatcccagagacctggaattttactgatggcccagataatttttatggtcagatactgacctaattccacccagtttcccactaaattttgtaagtgaggaaagcaatgcagaagagttacaggaaggcccagtgttacatgcccaggtcatggcccagggccaagccagccccaaaggtgggaccctggttctcttagccttccctgacacctgtcaccctggctgctgctccagggaaccctctctcgggagaagcttgagcaaatgttgatcttcccagaacaggggtctacagaatccagaggtgtggaaacagtgggatgctaatagctgttagaattttggttcatccatagatccaaactttgaagcattgagacaaaagatagctgtgctttgatagagaaaatagataagaaaagggtgtgaaatctgagtgtcacagaagaaaaaggaagagatgacaaaagaacccggcagttcctaggagcccagccccgggcaagctctttctccatgtgttatttcatttaatcctgaaaacaacgttattaattcctatcattggtgctttacagatgagaaaaccacagctttgactgattaaatcatagcctttcttaacaccatgaattatactttgggaaatagtactccagagaagttcttctcaaccaaagagtcaggatccaggggaatagggggctaagcgtggactggaggaatgaagacacttggcttccagctttttgtatgtcagtctccttggtccacaccacagagctcctttggacatcattatatccgcaagatgtaatcattacatcttctcaggccaagcaaggtacaaagtgccaaaatcttaaaagagggggcattggatagaaaatattggacaacctcttttcctaagagaagaagatctttagaagaaaataaagctatttatacctctgtttctaaatacaaccatttttatacctgccctggagttggttcccagaagaggatacccattccatggctttctttgaattggcatttctaacttcaaactagaggaattagtcaaagttctttaacacactaaaccacccataggaatggaactcaccaatataggggacaggcaagcgggtttctgggttctttagtcattgacaagggttaacagcttaaaggttattggggtttctggctacacgctaagagtcctgcttcctaatgtaagctcccctcccccacattctttaaacacattacttcctcaagcacttcctctggcttaggggcggggttggggggagaaggatgcaaatttatctaatctctaaaaaaaacctctggtatttgtgcagtgagtttcaggctgaagagaagagagagacctgcggctgtttccgcccactcgtcccagcacagccaccagagaacgccgcgtggtttgttgtttggaccctcccagagcctcttccagatgctgttggaaaaaaagaaaagaaaagctgggcagccagtgtcacagcccagatgccatctcggtctatccgcggaaatgcaagcacgcagcgccaagcccaacccagtaggtgccaggccctgggtgcaggcttcagcttcacgccacatcctctctctcttttcagtctctgagtgacttgactcagccagggagaggagatacctacacatccgcatgaaggcgcgtgggaggaagccgagaaatgacggatggcgcagggcctactgcagccgcacgtagactagctccttctttacgggcaaaaccccctacttgtctgcagtgggaaaggagtccgttcagggcaagctctgatcgctgagctatggatgaagaagtgggcagagcaggttccttcctcaccagcgtcacctgcttttctcttccaagttcaaactcggcttaggtccccgcctagggaaaaggacatcagattccaggactggcctgctgtaccaggcggagagcacgagaaaccttcctgctgtatggtgttttggcatagatattctggatgtgacttgagactgcttgctgtttccggaccatttacacccattgttgtcttgtgagcccagtcacggcctgacacggaacgcctctcatgtaatcttctcataggaatctaactaatgcagagtgctgtggcattgtcagccctcatcttacacactgctcaggatgcaaaggtggctagtatagtaacatctgcctctttagcaagagcctcagttgctccaatttaaatacggggagggagctgggtgcagtggcttatgcctgtaatcccagcgttttgggagccaaggcaggaagatcgcttgagccaaggagttcaagaccagcctgggcaaattagcaagacctcctctctacgaaatttttttagaaaacttagacaggaggccaggcccagtggctcatgcctgtaatctcagcactttgggaggccaagggggacggatcacttgaggtcaggagttcgagatcagcctagccatgatggtgaaaccccttctctaccaaaaaaatacaattacaggcacgtggtggcgcatgcctgtaatcccagctactcaggaggctggggtgggagtatcacttgaacctggga

SEQ ID NO: 870 - DNA, 12880 bp, Homo Sapiens
agtcgcgcctgccacatctacctccccagccatcctactctctatgctgctgcaaactagacattccttcctggagggacctctcgcttcccatcttcagatcaggacgcacggtctcttctccgcagctgcttcctctggtgttcctgtgctcctgtcggcccgctgctcccacacacatgcccattcttctcgggctggcttgtatctcagggttacgctccccaggtcccttgctccaggaggatggcaccgggtcagagtgttcagacttgttgacgtccctccccccactcaattcgtcactgagccagaagactgagccttgggaatgtctctgagcccaccccacctctcctctctggcagcagccttgggcgagtcctgccctggtcaaccccagcagcctcccaccaaggccagcccagcagcccaccctcccacggctgctcaagcccaccaggccatgctttagacgaggctctgtaactttgcaaatcaagcatgcaccgtaggaccagcctttccactctgctcccaagctgccttccagccctgtgccatcctctacacacccctccccccgctgtacaccccacaccccattaccaggctaccagtcacttcccaaacacaccctgcacactggtctgctcgctgtctgctttgccttgtcagtttttgtaccacctatatctatgcagccagtcccctggattaaattccctctgtttgcaatactagtgggcttcctgttgtgctggacccctggtgatatatttccttctaggaggatggcagcaggtcctctgcctgctcgttcatgctgttccctctgcctgaactgcctccccctcttttttttttctgagatgaagtctccctctgttgcccaggttggagtgcagtggcttgatctcagctccctgcaacctctgcatcccaggttcaagcaattctcttgcctcagcctctgagtaactgggattacaggtgcccaccactatgctcaactaatttttgtatttttagtagagatggggtttcaccatgttggcccagctggtttcaaactcctgacctcaattgatccgcccacctcagcctcccaaggtgctgggattacaggtgtgagccaccatgcccagttggccctctcttttttactagtaaaaagtctattgattcttttgattctttaagacctacagcaattgctgcgtcctctaggatgaaacacatcactacccattctgctttccttggccgtctgtccctgcctctgtgagggcccttctcacaggcgatgtgaatgtctccaggactgggaccctgtctcagccctcgtgtacccagattcctagcaccgaggccagccctcacacaggaactcaggaaatgttgactggagtggaaagtgcaccttgaaatcacctcacccccgaccccagtcccttggagacggggcgtgctcccaggctccttttctgtttgaacagccaaccagagaatgaggggcctcccctgtcctaaccccagggctgtgcatttctgtgacattctcaatgatcctggttaatgtttaattccagtttctttgttttctgtaaagttgataacagagtggtgtagcagagaatgtaaaagaccaagacccacagcaggaaaacaaatacgcaccccgtttttacttaataattaaaagttagtcatttcccagagctttttgggaatgaatggaaatgaattcagaatgttaaaatccagccctgcaaaatgctataaccatataaagagcattcatgatgcttgcatcacaggccccagggctggttttgcacaccagccatgtgctggcctctacaaagattctgtcttcctgaaacttccatcagtgtctgactcctgcatcacaacacagatggcttttctgcgggatcctggataaagcctgagctcatcaaccttaacttcaacaccctccctcctggcccttttcaaccttttcaaccttggctgtctccgtgggaaccctcttttccagccagacatcctgtttacagatctcagatgggccatggggcgggtctcactcctgccctctttgaggacagggtaaaggagtggttaggagtatgaggtccaaattcgggcaggccagggttcatgtccaagctccatcatatctaggctgggatagccacaccacctccaggaagcctgctctggttttcctgacccatggccatgcatttctccagtgtctgcctgctccaagtgtcatcactgcctccgtggcattgaaacctcgtcagtcttgtgatatctatttctctgtcccttattcatgtgtttgtctagtttctccatctggactctaaatgctgtgcccacaacaggctattatgggtctctgtgtgtcccagactgcccgcatgaataatggctgatatggcttggatttttgtcctctccaaatctcatgttgcaatgtgattcccagtgttggaagtggggcctgctgggaggtgagtggatcatgggggaagatcccttaagagtaggttagcaccatcctcttggtgatatgagttcttgctcagttagttcatgtgagatctcgttgtttaagcatctgggacctcccctttctctctctcttgctcccactctcaccatgtgatgtgcctgctcccctttcttcttccaccatgagtggaagcttcctgaggtctttagcagaaccagatgctggcaccatgcttcttttacagcctgcagaattgtgacccaattaaacctcttttctttataaatttcccagtctcaggcatttttaatagcaatgcacaaacggactaacacagaaaattggtatagtgaatagagtatcgccataaaaatacctaaagatgtggaactgagtaacgggcagagggtggaagagactggagagctcagaagaagacaggaagatgagggaacgtctggaacatctatggttgtgacaaaaatgctgatagagatatggacagtgaagtccaagctgacaaagtctcagatggaaatgagaaagttattgggagctgaagcaaagatcacctgtgttattccctagcaaagagcctggatggattgtgttcatgtcctaggggtttgtggaaggttgaacttatttggtggcagctggcagaagaaatttctaagtatcaagaagtgacgtggctgcttctaacagcctacgatcagatatgggtgtaaagaaatgacttaaagttggaacttatacatgaaaggaagcagggcataaaagttcgtagcctagccatgcagcagggaaagaagaagcattttcaggagcggaatccaagcagccagtgtagcaatcatttgctagagacattagcatgactaaaagggagccaaatgctaatatccaatacaatggggaaaagttctcaaaggcatttcagaggtcttggagatagctcttcccatctcatgctcaggggcctaggaggaaagaatgggttcaggggccaggtatggggcactgttgtccagttcagcctcaggacactgcttgccacatctctgctggctcaaaagaccccaggcccaggtacagctccagttgctgctttggagaacgcaagctgccataagccttggcagtttccacttggtgttaagcctgcaggcacacagaatgtaagtgtgaaggaggcttggcaacttccacctaaatttcagaggatgaatcagcaagcctaaggtggctgcccaggcagaagcctgctgcaggggtggagcccccaccagagaaactctactagggcagtgtggaggggaaatgggggttggatcccccacacagaccccccaccaggacactgcctagtggagctgtgggaaggtggctgatgtcctccagaccccagaatgatagagccactgacagcttgcatactgagcatggaaaagccacaggcactcaactccaacccatgagagcagccacagggctagacccagaaaagccacaggggcagtgctgctcaaggccttgggggcccatcccttgaaccagtgcacccaggatgcaggacatgggatcaaggatcattttggagctttaaggtttaatgactgccccaatgggtttcagacttgggtgggtctggtagccccttcctttgggtcaatttctcccttttagaatgggaatatctacccaatgcctgtgccaccattgtatcttggaagtaaataacttgttttgattttacaggcatataggtggaaggaacatgccttgggtctcagatgagacttggacttttggattaattctggaacaagttaagacttagggggactattgcaaaggcatgattgtattttgaaatgtgaaaaagacatgatatttgggtcctgggcggggaataacgtggtttggatatttgtccccttcgattatcatgttgaaaggtgattcccattttgggggtggggcctggtaggaggtgagtggatcatgggggaaggcccctcgtgaatggttaagcacaccccttggtgataagtgagttcttggtcagttagttcatgtgagatctggttgtttaaaagagtctgggacctcccccaaccccttgctcctactcttgccatgtgatgtgcctgctccccttttgccttccacctttcaccatgagtggaagcttcccaaggttcttaccaggaccagatgctgacgccatgcttcttgaacagtctgcagaattgtgagccaattaaaccttgtttccttataaattaccagcctcaggcatttccttatagcaatgcacaaatatactaacacaatggccatagacagcgcttaccattagctcatttaacttgtctacgagggcagcacaacttggggtccacatactcatgcccaacttcattggccattcaactccagccaagtaacaggacgaaaagacagaaacccaccataagctgcggctgaaggtggccatccagcccactgttgggacagaatgcttagtgtgtacagatttgcttcggtgtccctaagataggcttctgacctgtctattttccctgagaattcagaataatcatgaacaagatgggagtatgaatctcagcatggaggcccagtggctgacacctagctttcaaacctaaacatcttgcacaggtttccttgtaccatgttctctgatgcgatgtcctgtgtctctgctcactgcttcagtgccctcccaagcagccgggatggagcccgggccgccacagcccccctggagtgcgtgccgcctgataggtggatcaagagcagaactcacatgctgcctcctggggaggaagggggttgtttatgaccatatgagctttgaggtacccaggatgacaggccaccctagaacccagggagcttgggcaagttcatccccttctctgggcctcagtttccctcatctgtcctgcaaaagaattggatcagataatctgggacattctatccagctctctgatccagagatcaggtttggggccgggtgggggatgtgaagtggtcttccaagctgtcaacatagcctgattgtgtaaggcctgcacaaatggtgtttagagcaatactttcaaaccttaatgttgggtgaatcacctgcgtctagagaaaatgaagattctagcaggagagagtggaagagtggttaccagaggctgggagcagggttggatggggaaagattggtcaacaagtacaaagttgcagcgaggaggaagttcttgtgttctatggcacagcaaggtgactgtggttaacagtaccgtattgtacattgcaaagtaggtagaaaagatttacaatttctttagcaaagatgagatgatggataggctaaataccttgatttgatttttacacaatgcatacatgtatcaaaacatcacattgtaccccagaaatacgtacaattatgggtcaataaaaagcaaaataaaatatgtagattctctctcaatggttctgaggcggggtctctaaacctgcatttctaacaagctccctggtgatcccgcggtgccggctgagtcggtgccttgattaggagggtttggcactaggtctccaggtgtgatcccggagcggcagcatcggcatcacctgggaaccttgtaagagcgagtagggccaagctacagaagtattgggtcagaaactctggggtagcgcccagcaatatgtgatgtaacaagccctccaggcgactcccatgagctcaattctgagaaccactgctttaagacaacagcttctaaactgggcggtgcataggaagcaccgagagagtttttaaaaatactggggcctggggcccgcttgtcggggttctaatgtaatcggaataggtgcctcccgggcatcgggatttttacagtctccccaagtgattctaatgtgaagtcaatgagccttagggcggacagaagatgagggctgcggggctcccaggctgcgagcctgcgattcttctgacggcgctttccggacgacggccactagggcgcgctgtggcaccgctgggaggccggctgcggttcagcctcctctcgccagcggctggaggagctccgggctgggaggcggcgcgaagccccgggggtcggagcctccgggagcggcttctggcccaggccggcccgcccccgtgcatcggcacctaattaatgctggccgcggcctcgccgcgcttgacgtcagtgatgtgctccgtgctggggagacgcggcctttgcagccgctcggcacaggttgcttcaccctggccagccctgctgcccgccccctccaggcagaacgccgggctcacctctgggaccgagcccttgctcatgctgctctgatgacactcacgcgagagtttctcccccatttccacccggcaggacaccagtttccttttccatcttccctggctgttctctgcccctcccctgccttttcagaacacggagggtcccggaaaatcccacaggcctggggctttgccaagtcagccgcaagaaccacctctcacctttccctttctgggtctctcctctgctcagttcctttcctgttcctgctcctcctttttctctcatctgagccgtgtggatcagatacttcctgcctatgcgttctcatgcacagaagtggaagagatgggatggtgaaggggggattgccttctttagcagcacagataggactgcgtttgtaaggagcgttttgtatgttgggggtgacgaggttgctgatgaaactctagtgttctgtcccccacagccacattactccctttaagcagcgatgggagttgattctggagaggagaactcagccgagtagagcaacgctgtcttgtctagctgccccagctggctggaagggtcttccatggctggaggagtttccccaaccaggacgccagaactgtctttttttttttttttttttttttgagacagggtcttgctctgtcacccaggctggaagtgcagtggcgtgaccgcagctcactgcatccttgacctcccaggctcaagcgattgtcccacctcagcctcctgagaggctggaattacaggcatgcgccaccacgcccagctaatttttttttattttttgtagagacggagtcccactgtgtagcccaggctggtctcaagcaatcctcctgctttggcttcccaaaatgctgggattacaggtgtgaaccaccccgtgcctggcccagagctgtctttatcataaatgttccacgccatatttcatctctgcccatccccttatccccattcccaaacctccaatctgatatttgtgtgagatttcatttggaggaaggccatgtacataatggtttggatgatgcctgatagcctccctggctttgccagcccataattctaagatgggaagagatgttgctggggagaagaggcggaggcttctcttctgattcctgcctggagccctgactgcaagggttgctcctggcttcccccatttgaaccccacccctggctggccagtgaggggagcattccctacagccccagggagggagaggctgccagcggccagacagggcattgggcagatggcacagagccagcccagccaggtggggaaattgagacccagagagggtaagggacttgctcaaggtcacacaaccagaccctggcagatccctttccacgctaattcctcagaagctcctgctggggtctctagtgggatactttggacagccctgtgggagtggcggctgggttccaccgggagtggggttactttgaagaacagtagtctctccttgaatccagatgagcagatacggttccagggctcagcctgaccctgaggctgtcacagctggggcaggggctgagggtggaaactgcctctaagagctcagagggcgtttagcctgccaggcacagagcctccaccggggacagaaagccaggaaaaaggtgtgggacgtcagtacgaatcctgctccttccatcgtagactctgaaagtaaaggtccaagctttgaattggatctcagctggggctgggggctggccaagaagattggggtggccacacatttgggcaagtttccctactgcctccgcaatgcgcctggccagggcccaactggaaatcagagacccatgaaacatcagctcagggagcatcagggatgcatgctcgtgcttcaagaggaagaaaccccgagaggaggctgggagagagactggtccaaggtcactggacagtgagtggtggagctggagcttggacgtgggctctggactctggattgtgtgtccccgccactgtcctgacatccatgtggacagatgccctgatccccctctgcaggggctgttctcttttcctctctttggggtgtataatgtgtttgtctttgtgtgtgtgtgtgtgtgtgtgtgtgtgtgtgtgtgtgtacattttttattttgtctctttacctccaaatcctatctgcttcataaaactcagagaaaaagtctataagctcagtcacccattccaggatcgctgtcaggaaatcctcgttcccatctcacccgcatcccccacgctggagcttaagtccttccaggtggggctggcaagagtctgcgggacttactccaagagccccggggaagcgggctgggctgtttggggaggaatgctcacccggcagtgtgcaggcctggcagggctgcctctaaacccaaattgcagtccccaagcacgtgcgcttgctctgcctgagatctccaatgatgctgctttggcgggagtactgattctagccagtgatttatcatctgtttactcagagaaactgcttgttcatttctgctggtgggaagggaaggagggagggagggaggtgaacgtgtgtcctgtgagctgcagaggtagccggcagggatgacttatacactcccctcgatgggtgacctccattcactcttcctccccgcctctccgcctgatgagaaacagaatgtgctccctcccccctgggaggcttcagattcattttctgctcagacaccgttgcttgcaaaattccacccagaagataagggagggagtatcgctgcagcgtcctgctctgtgcctggttatattactggatccttgtgttgcagccctaagatagaaggattgtctccatttcacagatgagagagaactgatgcgcaggaggctgaaattgtctgaagtcacacagcaggtgggtagagctgggacccaacccccgtcaggctggtgccaacttcatgctcttggagcagtgtttctccaagtgtgcatctcgaaccacctgcattaattatagttacttcttccttcagtctctgttgttttcaacagggagttactgacctaggcatggctccaggctcatgggattcagcaatgaggaagacaggtcctggccaaaggaggccaagaacaaacaagtataagcaataagtcagccgggtgctgtggctcatgcttgtaatcccaacactttgggagtctgaggtggaaggatcacttgagcccaggagttcgagaccagcctgggcaacatggtgaaaccacatctctaccaaaatatacaaaaattagctgagtgtggtggtgcacctgtagccccaactgcttgagagcctgaggtaggaggattgtcttagcccaggaggttgacactgcagtgagccgtaattgtgccactgcactccagcctgggcgacagagagagaccctgtctcaaaaaaaaaaaaattaaaaagaaacaagtcaatatctaacaggtgagagcactagggggaaaaggagagcagggtgaggtgctggggagtgacgaggttgtatgtgtgttgcaattttagatagagtggtcaggataaaccttacacaggtgacatttggactgagacttcaaagaggttaagtgttttgctattgaacctgtatttcctgcacctgcttcagacctcctcattcagaacctggcagggaaatgaggcccaggaatacgtattttaacaaatcctttatccacaccgcaatttggaaatcgctgctgtttaccctggtgcttcttcttctacctaacgggtcaggaaatatgtgttcaaatccaggaatggctttagggattcaagaatgaagctggaatcccgagtcctggtgacgattcccttcatgacttgataattggccaatacttagtaactaaaccaggcaaaatgcacctatgactgtgactgagtctggaaagctctgtgccagggcaggacatggatatgcagtcacagcgtgacacagattactgaagtacaagttggtgtcttgaggagtgcataacttagaaggcttgggttctacgtcaggctcacctgtggtaagcttgggccagtcatttgctttgtggaatttcagcttccaggtttgggaaatggagctgttagacctttccctacttagcttataacactgccactacttctactaccagccaatctatgtatccatccatctatccatgcatccatccatccatccatgcatccatccatgcatccatctatccatccatccatccatccatctatccatccattcttccatgcatgcatccatccatccatccatgcatccatccatccatgcatccatccatccatccatccatgcatgcatccatccatccatctatccatcgatccacgcatccatccatccatcctcaccaccaccatcagtatcctcatttcattttatcagcatttctggcatggcctatattcaaaccaacaaaattccagtccaataaaataatttggacatgcctaacacttactgtaaaggaatttggcctgagaaaataatgaagaaaaactgtatagagagtaattaattctccatacattggatatcaaaatctttaatcttggaagattaaatcttggaagttcttttcaatgaagtccaaaggtgggttcatgccactggcttgggggagccagaaaagtgtcttgtaacttcagttgcggtgaaagctgctgtgaaaggcagcttcagatttcccctgatggcgggcagccctgcctctgtgcccagccctattaactgttggcctcccagttgctgaagccagccaacaacatcccctgccatttgaagtgcttattggaaaagcagatttcatcttggctggagctctgagcagttccttgtgtggggtactccccagggctgtaattgaacacaagaaagcgtcggcctacttttggcattcctgctttcatctcaaagacacatttaaaaatttatatttaaaaaatgtcagggaaaggggccagcatggctcgtgtggccactggtgccagaacacccaacacagccgctccaggagcaaaggctgcggaggatgagacaggagaattaggaccataccgtgtggcagtgctccatgcccagcttccgggagcttgcctgtgtggcctgaacagtgaggtgcttttgaggctgggcctctgtctgatctaggctttgcagagcaggagtttgagggttcagatcaggtccccctcacagcagtccaattgggtgagaattttctaaaagctgggggaagagggtagtccaagacctacttggacactcaccccagggtctgggcagcctggctagcaggagatgcactgtcttcccaagccccacctgttgtgctgctgcggaacgtggttccaagggcttctatctacactggtgactgtgggtgggagaaaaccactgaggaaaaagacctactgctcctctggcaggattctgaaaacagtaggtgtctaacggatgtatgttagcttgctctcacatgtgaaaggattgcagttaagcacaacgcaacctttttctacagctcttagtaagatcttctctaggggccattgtaaagctaaaccacgaagcttcatggagggctgaaataagatagcatacactcagaagcctggtctcttagggaccacccgcttccctgcacagggttactgttgcactgtcagcttgtggcccactatgaccctcttaatcttattcaggaatttttgtttatagggaatcatcattctgtatgcaattggctttccctctgagtgcaggatcctgcacttattttacactaagatcattgatagcttgtgttttctaaaaaagaaaaaaaaattgcatgccttacaacaaagaaaatacattcagtaagattattaaaatagttatcttattttcagg

SEQ ID NO: 871 - DNA, 4906 bp, Homo Sapiens
gcggcgctcgcgaaacccgaagacttgcagggtaagaactgaagccaccaaaaggcttactataccacacaacacccaagccttcctttggggcatggggacagtggatctatggctcctcagggtgccaaccaattgaagaaggaagccagctccactcaacagcttctacaaaggaagggccacaggagaggggcttcagtggttccaggcagctgcttcattcacaacagaatggccattttctccagcatggccaactatccctagtctttttgtcatgacagcctagaaggcagaagctagggccaaggcggctgctaaggaattcctactcctactggggcctaatgtcaggctttccttatattgtggagtgggccctggaagatagttagagacccttcctgctgggcaccctgaagaggagcaagaggatctggtgagcaaaatgaagcaaaagtgcagtgctggagctgacagccctgttccctactgcacgcagttggctcagggctgtcccccactttggagcttcttgccactcacgggctaccctgcacacactacttactgcccaggcctgtctgccaccacagtaccctgtgcctgagacctttcctggcctctgctggatcccaggcctagtatcattcctagggactccagaggcaagtccaggctaatatgctctgggaaaacaatgtacaatgtacatgtttgccttttgacgtagataaatgatacctggatcccaggtctggctctggggcaggggagcttcaggcctggctatggcagaacactgaaggaggtactttgggttttcacaacctcttaaatcatctcagagagagagtgaacaacttactttcacatgcacaagctgccgctggctctgtcacaagaagatggactacaagtaataaaatcaagatgaagttctgtgtacatctttccagcttacaagaattgtagaaagttgaagatgaaagggatattaaagagcatctcattctacctcctcattttgcagctgtaagaaccgaggcccagggagggggactggggaagccaccatcacacagctgctccgtggcaggagttgtgctaactttctgtggctgttgccattacacccagcatcttttgacttttgaaaacagcgaaggagaaatcagtcctcccagcatcttcacctcccacgacgtttattgtttccagctgttaaaaattggccctttaaaaatgggtcgtcttgccagtcattgagggtcaccgcggtggggagtgctgatttagagggcggcagaacagggaggtgattggaggcataattgccagtctcctccttggcacctggggatttctgtcattcaagtctcagggtgtgtgccctcagcaaatactaacccacagagtcaattgctaactgcagtcatctgtgcatttgccctctggggatggaaagccataagaaatgccatttcctaatctagttggccttggatgagaagatgtttttgcctaatggaagcctttggagagtgaataatgtgaataatgtgtatttaggacctacagtgctccccaggatgctgtaagggacctggttataaagaaaaaaacctcactgatggtcttggctttgtccttgtctgagttaagtccttttggttggaagtaatcaacttgagctgacgtaagcattaagggacatagaagagtatagcagtatctcatgaagtccaagggcagatggcctcaaggtagcccgagaagctgctaggaacctagacagtccaccttctccagctttcttctctgcttcgtgtctccctctgcaatccactttcttctctgtgagtagctgggcagaggataatccctcaacaactatcacatctacatcttctctcctaaagagattagccaaaggtgagtggctgtcctcagtccaataccagattcctgggagagggaatttggttgtcccagcctgggtcaggtgcacagcttgatccaatcaggtgtgcccaggagagggtgccctgagacaggcacatctggggacactcatcctcatgaatgaccggacagttctccaggaaagaagagagaagagtggaggtcagacatttcaaatgtatattataggcatcaaattagttactgatacagaaaaatggcaatgtctaagtagggggcttgagaaacagttcaaacactgtatagattttgattatttgcttaacttccaggatgataaattgtctattatggagctgtattttttttttggagacagagtcttgctgtttggctggagtgcagtggcgtgatctcggctcaccacaacctccacctccaggttcaagcaattctcctgcctcagcctcccgagtagctgggattacaggtgcccaccaccagccctggctaatttttgtatttttagtagaaacggggtttcaccatgttggccaggctggtctagaactcctgacctcaagtgatccgcccttctcggcctcccaaagtgccaggattacaggcgtgagccaccatgcccaggtggagctgaatttttttttttttttttgaggtgggaggatggagtctcgctttttcgcccaggctggagtgcaatggcacgatcttggctcactgcaacctccgcctcccaggtccaagcaattcttctgcctcagcctccccagtagctgggattacaggcatgtgccaccacacccgggtaatttttgtatttttagtagagacaaggtttcaccatgttggccaggctggtctcgaactcctgacctcaagtgatccacccatcgcagcctcccaaagtgctaggattacaggcatgagccaccgcgcccagccaatctttttatatagtagatttcttgcaatgtaacccctatcctctgggctttgtgtaaaaagtgcattcagacaatctgaggagtgtcttaattttttgtgtgactatcatatatattttcatcctgttgaggtgtgtttgctaggtggatattgaacatgaaatcaaagtataattttaaacttgtgttgaaatatatgtgtataagcatatgtgcacaattacctatattgtcaaacacccaacctgctttccaaaggatttgaagcaaggtctaataaaaacacagaaaaagtatggccaagagctgtaaacaccaaaaaaagaagtaaagggcaagtcgcaaacagactgcagttgagcaaagctgcaaaggactataataccaggcctgaagtggttgctaaatgtagctctgagctttctgacattcaaagccaaaaataggtatattttattatttaaacagtgtctactctgaggtcctcaaaactctttcagggggcccacagatcaaaactattttcataataacaccaagacattgtttgcatctttcattgtcattctcttaggagtgtacagtggagttttccagaaggcatatgccatgtgcatcaccacagcttaaatgcagaaacagacatgaggatctagctgtgtcctactaagccagacattcaggacatctaaaagtgtaaaacaatgccactcttctcactaacttttttgttttggaaaatatatctttcataaaatattgattatgttgatatattacgggtttgttgttattattttaaatgaattaataaataattttctgatttaatttctattactgtaaatattgatggatatatcctgtataagcaaaaactctctggggttctcaactatttttaagagtgtaaaggggtcattagagaactgctcaagaatgttagtattatttaaagagcttctgcacagaaaaactatcaacagagtaaacaaacaaactacagaatgggagaaaatcttcacaagctgtgcatctgacaggggctaacatccagactctatagggaacttaaacatttcaatgagtaaacaataattaaccccattaaaaagtgggcaaaggacatgaacagacacttctcaaaagaagacatacaagcagccaacagacatgaaaaaatgttccacatcactactcagagaaatgcaaatttaaaccacagggagataccatctcactctagtcagaatggctattattaaaaagtcaaaaaaataataacagatgctgttgaggctgtagagaaaatgtaatgcttatacattgttgatgggaacataaattagtccagccactgtggaaagcagtttggagatgcctcagagaacttagaactaccatttgacccagcagtcccattacttggtacatacccaaaagaaaacaaatgtttccaccaaaaagacgcgtgtgctcatatgttcactgcagcactattcacaatagcaaagacatggaatcaatctaggggtccatcagtggtgggttagataaagaccatgtggtacacatacaccatgaaatactgcccagccataaaaaagaacgaaatcatgtcctttgcagcaacatggatgcagctggaagctgttagcccaagtgaattaatgcaggaacagaaaaccaaatcctgcattttctcacttataagtgtgagctaaacattgagtacacgtggacgtaaagatggaaacagcagacactggagactaccagaggaagaagaaagggagggaggagaaagggagggaggaaaaagggagggagtcaagggctgaaaaactacctattaggtactatgctcagaacctcagtgatgggattaattgaacctcaaacctcagtgtcacacaatatactcatgtaacaagcctgcatatgtgccctctgaatctaaaataaaagttgaaattattttttaaaaaaagaatattactattatttaatca

SEQ ID NO: 872 - DNA, 1480 bp, Homo Sapiens
ggtcctttcattttataaattagacctgatattccctgtgttcttcaaaatgaaacttaccataattggagacatttttcctaaaatgcatttgaaatggctttatttttttgcatgccacaaaaataccagatttccttgtcagttatatgttattcttgtcatgaagtctcatcagaccttctaatttgaaagttatcagtaattgatttaatcacagccatattaagtctctgtcacctacagataagttttgttttactctcaggcttccatggaagttctgcaatcaaccagcaggagaaccgcttaaacccaggaggcggaggttgcagtgagccaagtatgcatcactgcactccagcctggaagacagagtgagaccctgtctcaacaaaataaattaaaataaaaaataatatatttttctaactatcatcccttttccaaatcaggaattccccttaagttttcctcaatttccatggcaatatctttgcatagattcattaagaatttgtcctttttaaataaaaaatataaagggaactattcattaggcaacaaatgccttgtctgaaatatcacatttgagaatgctgctcatttaatcagaaaggtacgctactttaaagaactgaggtccactttctggagccaaaaactcataaatccctctcagaaaaacctgatttgctttgtagggtctcaggtttagagatgctgaaaaagatattttcgttgcagacaaaggacctcagagtatttggagaactttgagaagagaggaattctcccaaatgtataggtgtcacaggtaaaatacagtcgagagattttcttggactttaattccttaaatcaggatagcaaataataggggcttttacaaattcaatctgtttccttacaaaaattttcagcaaagtaatttcagcaaattaattttcagcaaagtaaatgtaagaagacttatgtgaaaaattaacattctccatgtatctatgaagccaaacctaataaaaccagctttaatttgtgctcaagaatattatttcactgagttttcttaaatcacaaaggggagactgttatgaaaactgatataaaataaaaaaaacaaggaagaaaagtctactagatgtctctaatggaagactgcatttttagaacatatccttataggcgattctagcctttctctgctatttggctctcacactctttaccgtgcagataattcacagcaatgcaaaagaatcctcatctatagccatgaaaataagttatttgttatttctggtaaaggttcaattgacctccccttccaggatgaagaaagtttcatgtctttctgcatcatttcaactattccttactacatataaatctgcacttgttaacttctattttgaattgattgtggcatctgcctgcttccccattaaaactgaataaaatctttaacacataaaaatgt

SEQ ID NO: 873 - DNA, 6936 bp, Homo Sapiens
actctcactatgcccccgtaacagagtcagtttttaggcggagggtgagaatggcttgaaaatttgctgaatgctatccatctcccagcccccagagaaaagggctttagttcctccccctgcctgtgaagtctgcaggccagattcgcgccctcccctgagttctggccaggaggcttcttgccctgttcaaatggttacaaagttcagctagagaattccttctccctgtagagttttaccccctgctcctctggccgccctccggatggatctttgtgttgccaggcaggaatgggctgcttggggacccagtgagctccgagggcctttctgctgcttcctgtacccctgtatttcgctcagctctctgacttgactcagctccagacatctacccctggagaaagagcccaatgagaagtaatctctgaagcccagatttcctaaggatgaagcttcaggagaggccttatcaatcctgacaacaaacttttctcgtcaatttagtttcatttaatggaagttttaaatgtgtaaagttcagaaggctattaaaattggttccagctatctaagatacacacacaaccacacacgcgcacacacggtagagataaatatgttcgaaaatccagctcaatgttactagaaaatttgatcagaatctggtgaaataaatagtaaacttactaaaaatgccaaatatcccagaagctgcttaacatttgatcaaaagctctgtccagtcaattcctgcttctttcaaaaatactctgctgaaaagccaaaggagaaatggggctggtaccttcaatatagagaattccaagtaagattagatcccagaaggcttagtgtggctttctaggactctcactattaggcagtaacctaccattcacctctgtttcccagattcaccttgttataccttataacttaaaatataaattccaacaatgtactgcactcaaaaaaattatttctcaatttgtttgctcatactattgatttttttctagaatctaaataattgtgaattaactatgatagcagtatgcacaaacagtaagtgaaatcagacctattaattctgagaggaaggaggtgtcaggattttcacagaagaagagcactaaggccaggcgcagtggctcatgcctgtaatcccagcactttgggaggctgaggcaggcggatcaggaggtcaggagttctagaccagccagacaaacatggtgaaaccccgtctctactaaaaatacaaaaattacacgcctgtaatcccagctactcaggaggctgaggcagaagaatcgcttaaacccgggaggcggaggttgcagtgagctgagatcgcgcgactgcactccagcttgggcgacagagcaagactccatcaaaaaaaaaaaaaaaaaaaaaaaagcaaagcactaaatctcgtatgtgaaagatgagtagatttttcctaacaggagcaataaaaattagagctaaaaataatttcatgaagcaaaatattcaaagaagatgaagaatgaataaagacaattgatctggtaattcacaagccaagcttcagtaagtggtaggatagacgctgatttttaagtgtaaaatgagcaaattatgctgaataaagaaaattatttaaaaattgtcaagaaataactagagacccagggaagacaattttcattttaaggcttaataatgtttgcagactgaaggaaaagatgcagtggaggatgagagaccttagcaggggattaaaatagtggagcatttttgtggcaatgccattcaataagaagacagcattggaaagaagagagacatttattcctcctaggtaggaagcaaaaagtagaaatttgtaaagaaaaaagtattgggagataaagaagaatcacaggtgtaatcctgaacatcctaaatcaaaattattgtttatgtatttctccttccagaaatgaaacttgtaatagacgatctgtggcttaataaccttctatctccagcacctgacgtatggcaggtctctcaatatataattaagatatggatctatggaggtacaataattcttgttatatgaatcactattcctgaagttggagtatattggctcatctgggaatagggaaattggcagttagttgagagaccattggaacacctgctgaaagaaacgtgataatgattcaaggggaggaaaaaaaaaaaaaagaaaaccaagtgaggaatgaccacaataacactaacttgaagtggatgcagtcggcatatttttgaaaatgttttaaatcaacaacttctatttggagagcagatgtaattacaccagacagcagagataataaataaatatcagtgcagtcacagtggtgtggccggagtatcagtgcctcggttgctatgggcagcagaagacacagatgcctctggcatcctagctggcaatgaagaaaaataaacacagaattaggcttcaggttagagaataacagaataatagaggttaggatttagacagaaaaaaacaggcttgctggagttatggaagtgggagagacgaaacaagtgaaaaagaacttctcttcttgtaatttctcatgttcaaggaaaggaaatgtcagcattcaaaattgcagagaatgagaaaacaaatgtgatgattttgatcaaggtcatgtttatgccggtgattaacagataaaatgaagagtccttggcatcataggagggactctgagccagagtgctaaaaggaccatctacttaaatgatggagttcataataagattggagtggagaaaaattatgaagcaagtactcagaaaatgagaatgttaggaggttacaggttgatggctttaaggatggagagaatatacgttatgataaacataaaaaagtggatggtggaacaaaagttgcctgaaattggcagctgtgagtaattaatctttaacatctcttccttacttaagtagaaaaagggcctccatcaaaatggtagtgagaattttatccatcagagacaacacactttcagttgcagatgagacatggaaaatattctcacacaaaatgtggtcaagaaaaggagtaatagtacttatttttctaattgaatacataataatattaatatacattatctgtaaatattcatattgatcatgggagaggtaatcagaatatataatattgacagctgaattgaaattaatatatttttctaaaaaaatgagattatgggtaatgaaccaatattggctaggtgaaaattgtctagtttttacaactagaaatgcttcctctcaaacacttatcaaaatcacaggtgtattttaggctgctatatttgccaaatgaaaacaggatactgacattcatacacacaaacatgcaagcatatgctgaaattttcattccagatgtctacaaaagagaacagataatacgaagttcgttacctatttcaagttacctctgagattccttacgctgaagacaaatattctattaaaaaagagtccttaaataggccataagaacccgaatcctttcataaagagtgaaagagtatggttatttttgataacaattattatcaaaataaattatttttacttctaaattagtactgattacatctgaaggtttttgtttctctgataccaggatttaaaattatttcagaaagcatgattagttttagtgtctgtagatctttgctgtcagtgaattaaagtatttttgaaaaaggaatatgtattcctgaaaagtgatctatactttatagaaaattacctatttgtgtaaatataggaaaacagctctaacattaaaatatgtgcatcaattggattcagagtgttgcatgaggtttcaactttaaagaagtatttataacatttggagaaacaaaattaacaagaaaaagtaaaaccaaaatattaaaaataaaggtaatattcctcatcagaaaataagaaaaaaataccaacaattgtggtaataccaaagtgattttaaaaatacattttttttttttgttcattggttgtcttgttcaattcagtcaaacataagccaacaagataagactccacatagatctttttaagttaccaagtgttgtgtgtgccgctctaactgtccatggtttctgttttttctactaaaattctagcatactaaattctgtatggtattttttctagcattatctctggaaaattagaccagtgactaatacaattactcttttagttttcatagatttgactatatgtctgagcctggagttgtttgcgtttattctatttcggagtcactcagtttcctgagtctatagattagtttttcaccaaatttgggaagttttcagtcattatttcctcaagtaattgttaagccccatatcctttttcctctcattctaggactgcagtgacacaaacattaactatgtcattattgctccagaagtctttgaggctcagtttttttttttcttatctgttttctctcgttgtttagattgggtaatctctactaatctaccttaaatcttactgatcctttcctctgtcatttccattttgtgattttgtccatatgctgagattgctatttggaatatttttacagtaccttgtttaacattcttgctcaataattttaacatttgtatcatcttagtgttatagtctattgattgtcgtttcttacttgatttgagattctcctagtccttagtatgtcaagtgactttggactataatttggacactacatgtattatgacgtaagactaaagttattacttcgatcttttacttaagtgggtattccacctgtttagtttcaaaatacatgtcctagctcacttttgttagctattgttcaaatttcaatttggtttctaaatcccctggagtccagtatcccccagtcacagttgtatgtgactcaggtgacaggactctgccccacaatcttctcatcatggactggggagacagaggaaaattacttcactgccacagaggatggtggaattcagagttccaggcacatgtccatagggaaatggcacttacacattaaaactggtcagaaatgaatggcagagtgacacccacaggcttcagtagatagcggtgcctcctgatactgggatggggtggagaacaggcttacgccccatatctctgcagggatggtgagactgcctgaataccatggaagagggagatggaagtctgagctgtgcacataagctccactggggagaggtacaacccagttactgcagaagaagggagaaagtcagaggggtcatagtctctacggggaaggaaggccatctcattcctgcagaaggtgggtagatgtgagttccacccacaacctccatggtggggggatgctacctccttactccaggaagagggtggaagacagggttctatccccagtcccacagttatagcactcattgaggtggagatagaacacattttttttcatagtattcctcttgaagaaagataagtatggttaaaatatttctgctatgctgggttaccctttttcctggtactttcactagagacagatgatacagaagagaaagggtgggagggggggagagatatagaccacaaagaaaaatagaaaggtgaataattcctgataatattagatgaggttatttattaagacctactttacacatttactacaaggtataattgacaaaaggtaaagatcatttgtaatgagaaactttctgccgcttgtataatacagtgtctgtactttcaccaatagcttctctatttaacattatgtggttctaaataatctttcaaaacacatactaacctgtttctctgtaatatcatctcacagacagatttaaggataagttaagtgttttaaaaatctatttatattaaattatataagaatggaggcaggaagacagagcttggaacattatctacaattagtgtcttatattgccatggtcagaatgtttgtgtcctcccccaaatgtatatgttgaaacctaattcctaaatttgatggggtttagggaagtgatttggttataaaggtagcaactgtcatgaatggaattagtgcctttatatggggctgaagataccagagttcttcccttctactctgtcaggagatagcaacaagctggctatctgcaacccagaagaaggccttcaccaaaactcaaccatgctggcattctaatctagaacttccagcctccagagctgtgacaaataaatttctattatttataggtcatccagtctatggcattttgttataacagtccaaactgactaaaacaaccacaaaggcagaaaatgctagttttctactaaatggtcataaagaattgaataagtgatcaaaaaaacatgagacagctgtctgtaaatttctgtacccccttcctccatcgtaataaaaatttttagctctacatacagatacaggaaataaaaaatactttccaaatttgcacctgggcatagccaagcaactaacacttgcattaggatgtgggtaatgggtatgcatctgcattccgggagatgccctttgataaggtgtgccatcctttttttctcttcctcttctcacttgttcatattgaacactgaaggggcagtatagcatcttgggaagcagcagagttaccatatagacaagtagagaaaacttttgactttgcagagtggggctgtgttgactgcttgacattttacaaaagagaaaaaatgaacttctatcatgttaattctactcacatttgggattgtctcgtgcttaaactcatagccgaactaatacagaaaggaagagagcatgaagaagtataacatttc

SEQ ID NO: 874 - DNA, 16942 bp, Homo Sapiens
atgcactattaccactgagcatttactatgttccaggccctgtgctaagcgcattgcctgctgcgtctcacccttcagtaggagtagttacctccaactcccgccagacccaattcagagctgccatcaggtcagacctttgcctgctcttggcaacacgtccccctgtcctgctcctctgcaacctgcccctctttttcttcatgtgctgtgaaggcaccatgtggatgggtgttcaacttctggattggggatgcacagagcctgagggacacactttgcaaacctgcaccttgcacttttgggttctggcctgcaaggtctcctttattcttttggaccaaggctgtccctgggagagggcagccgccggcctgtcagagcaaatcagcctcaggcggtttctgcggctctggtatttgagctttgttttccctctctcccgggaagaactcattgaaatagtttctctgggaaagacaaagcgtctcgcccagatgctgaaggatcacttggtaactgcctgtcttggtttcccgttgtgcccatgaaggcgccatcagctctaaagctgacctgtggttccgtctccaaacagctaacccagacgtcacccccttgcagccagccgcacagcctgagttggagttctggcctctcctagcagtgagtgacagtgttggaggggccttggacaccttgggtaattgctaactaaatatgagcagtaggggaaggtcttctggtccacggcagagccaacggggcacttcctcttctcttttctagtcagggtagaaagctagaaagaatcctaaaaatcactatccaagtccccattgtgtggggacagaggcctggcctgaagcctaggctggagggttcagtcggaagcagaagccgggagactgcatgagagggttccttccagcttcaccaagcccgtgctgcgcgggatgaagaaagtcaagcctgtcttccagtggggccctgaggtgggggagctggaggatagggtggcagcttttttatcagctgtccccaaaagaggcccttctcccagttgccacggaccaaagctcctcctgggagctccagcctgtctgttcaatgtttgccttgcgccttttcctggtgaggccacccccggcaccatctcaggcctcagaaggacgacctcactgaaacagcccttaggttgggaaagaagcaagccctccgcgccccgtccaagtctctcaactgggcacgagcacacacagacgcccaggccctgtccctgcgccagaatggccgctcgcgtttccaggcacgatgcccctttccatgagtgcacagagccctgggctgagctgggggccgagctccacgctctctgagcagctctgagcggcacgccaaagaaggtctttcagatgggctctgggatgtggaaccatggcgtccagccctagcgtcgactccacactagaggcaccctgactttcgcccccttcttacctgagtatcagcttacttccatctggggactgaatatggggcagattccagaaaaaggaggttggggcaccaaaaccaacaccaactctgccaacggagccagcacagctatttgtctccaaccacaggccgcaagggaagttcacgggctcggcacccccaggtcccggatgtaaggatattgcccgttagacaaaggaaaggccccaagtccacaactcatgtttgtgagcttaaccttgtcctataaagcactttggaacaggcccaggttctcccaccatgtacagctgccattgacctggacagtcccgcaaggtccttcagtggaaacccagaagggagagtcactgcatgtgaaccctaagggttctggaggtcaaagttgctgtgggtgacaggcaaccaagactaagggcaaacttgaaacataaatgagttaaaacccacaaaaataagacagttttaaataactaaactgttttctcattcttcctttttcatctgaggacgttttaggcaaatgaagctttagagtttttctcctttcattgggttgacagtgtttaaaattatatccagagctgtctaatttgcctattgctctaggcatactgatcctcaggaggtaagattggatgggttaaagtggacaggctcaggggctgagactgtccatctctctgagagtcgggggcagcatttatcaggggcctgtggtcagccaagcttggcttgggctctgtgggaagataaaaccaactggcccagatggacttctgtggggcctggatactgttgggaagataaagcacataagcccggtaagaaaaaaaaaaaaaaaaaaaaaaaaaagcccaggagaaggaatgcaagtgattccaatgcaattgaattaagtacaaactcactaggaatgggggggggggtttgattggcgaaggggttagtcaggggtggttaaccacagaagattgaggaggtgaactttaagttggacttggaggtagaagagagaagttaggggaagcatttgttttatatttgggtggggtgcgtgggagtgtggataagtgaagtgtcacacacacacacacacacaactttgagtaggaagagggtcaagatgaccaggttggcctagacaagtcagtactagcttaaaaagtcacactcaggattcctgcagcacctcccccatacccacccccaccccaatgggcacagcactccctcttctctccaacgcaggcctcctgtctggggtgctatgatcatttccatagcaaccaattgctctgtgacagagacataattctgactccaggtaggttatgaacagaagaaacatatgaaaccagtaagtgacagagatctagttttccagtaagtgccctgctaataaagaagagaaaatgcacaaactaaaagataaatggaacaggaatgagcaaatgctaaattttctatgaggcatcagctgtttgtttgctaaaaacaatagcaacctaatagtttcaacaagaatggtgctggcaaggacagctcagaacagcctctgtcagtctgcagagtaggggcgatggcagagcccgggtatgcacagtgtcagggttgtgaggcagaaagatgccttaaacgcatcacctcaatcctgcacacatccctagtgcctttattggaaaagctgcactgctgctgctgtgaatccagcatgacctcgccttcattcattcattcacttatacatgcatgcatgcatgcatatattcaagaactcatcagtgctaggtaggttactaattagaaataattgggagaaaagtctgaattactaggtattttagaagcaaagctttcttactctgaaagcatggctgagatggtgccttcagcagggactcagagagtctgatccagtctgggtctgccactcacactctgtataaccttgtgcaagccacttaccagtcttggtcttcatcttgtagatgaggtgattggtgatctatgtgatgcttccagatctgtctagttcagaggcctgctttaagtgtctaaacggttaatgtcagagtgagttgatgtgttcggtattttcatagagcagaaccaagactgtttactcatttaccatttatttccaccttctgttgatattgattgaccacttactatgtgacagtcacagatctaggcatcagaaataaaggtaagacgtgatggtggcttcagggccctcatggccaggttgggggacaggcaggcccaggctcagacccatagggcacaagctggtctccaagtgtggacagagctcatcaggtgtggggaagggcacctccacctgtggtcaagagctctctccacaccctggatggggctggaaggaaaggcaggaggcagactcagagaggaggagctgcatggagagggggtgctgaggaagccccacatgacccaggaatcttgcggggagcggagagtagagagatgcagacaggccatgccaaggcccgtgctctgacatcatggtcatccttctcaaagatctggagattaacagaccacatagaagaaggggcaataagttaaggagaaagaaaataagcagaatcccaggagagaagagcataaggtctgggctttgtgcaggcatatttgcctccaggggagataccagttgctgcctagtgctgtcatcactaaggcctggggtgaggctaagaggtggacacctggggaggagctgggagtgagtgcccagactgggaaaagactaagggaacatactaggctgccagaaagcctggagctttctgaactcacctgaaccttctgagctttgggcagggtgctttagtctgccctaaaaccggcagagggcttaacgcatggtttcagtgcagagcaatgtccatcttctctaaaacacccagaaagatttggtgagtgaattacagactgtggtgctaaggggagtcttagccaaagagacaactacttgcctttgagttttccatgcttgtctacttaacagaatcatgaggactcccatatcctctcctaaaaattaaccagttaattattcaacacgcattttgcagcagctagttggtattattcgttatgctacaaattctcagggctcaacagaggcattgttcatgtccttgaggagtttatagtacagctgggagtttgcgtatgcaagtgaaagtttatatgcactaagttatatctattaagggctaaaccaggagtgcaagcagagaggattacagaggtagaagagagagagcgcgtgtgagactgtacatagtctcttgggacgggctgatcaggaagtcttcatggagaaggtggaatttgtgtgggttttgaggacagctagatggaaagaggtcagaacagagatgtgtttgggagagacaatgctctgcagtagcatttagcagctgctacttgtctgagaggaaacctgggcactagcatggaaagaggacattttctgacattggaaatacacttcaatgtcaacctcgatccaagtttgaatcctgtgtctgccacttagtagcagataggcctgggcaaattccttaacttgccttatctaaattgccccatttatacattgagagtggggataatgttgatctcaaaaagctattgggaggatagaattaatgtgacaacaggtaaaacacttccaggaatacttatcccttctccctttcctggcccatcaggaaagctgcatttaagaccaaaaggaataattattccagaagtcctctgagtgcccttgtagaagtagataaacagattgatcagtgagaaaaaaaatatgttctcatccagcctgtggggtgagttaaccatgcatgcttttctccggatgtttgacttcctgaatctttcctgaacaatgccatctctgtcctggcacccctggcaagcagtcccatgtgagacaggttcttgtcacatgtccttttcctgaaatgagtcactagagagtgggctgtagtcataaccttcaccagttaagggaggtgaatgtggattggaatgaacacaaacacggtactacttggtgcttaatgttcctttccatcaacattttgccccaggccttaaccttgcaactcaaaaaagtagggtcgcataatgaatgggataaactgaatgaccgcttgtaatccacaaacaaagggcctttcaacagcctatggtcggaggccttatctattccaatcaaatctagccagttgcaaactggagaaaaaaatgggtgatcccagtgagaattagtcccagaagaaaattgaaaaagacattttgttacctcctcaggaaaagtgataatgagcagagaagggaaaaatctaaataactgatgcaaagacaaagaactgaaactgagagaattggatgcatgtcttccccctttagttgtataagcataaactggttttatgacggcaagcataaaattaagatcagcagtgcacaaatctctgtgtaaccttcaagaccttttatttccccaaattagaagtgaccttaagaactgatggtgtcttcaccctgggcagctatggtggtggagcagaaaatagtagactgggattgggacaggctaagtcccacccttcaccctggctgggtgaccttgggcatactcacccttgcttttctgggactgagggtcttcatctgagaaatgaatcatttttcttgataatttacagttttctttcaaatccctccacacccccacccccaccaaggtttttatttttatggcaactcagatcttgaaccttaaaaaaaaaaataaagtagagaggacagcaatccttaccagtgtcactctatcaccctatacagctcctcaaacacaagcccagaaggggcttcattttggtggaagtcctgggcctacatttgtatatttaagtggaacccgaatacttgctcccagagtggtgtcagtggtcaccccaactttccaaattctggcaggcacagcaggtcattctgtgagctgttctcattcacatcctatttccaactggttctgttccacggagccccagctgtactctgcaattcagttctaccaacgctcattgcatgttgctgatatggcaggcactaatgtgagatgctgtgagcaagcaagcatagcccagccccactctagtagggaacacagaaatacttgtaatgtgagccgaatggaagcataatgccctgtggcaacacttaggagggtgacggtcattctagcttgggcaaagcttcatgggggaggaggcctttgtcctgagctttgtgagatgggtaggatttaggcaggctgagacaaaggaagagcatgccaagcagaaagaagagcaggaaggaaggcatggaggcagaagtgttcaagtcatatttaaggagtggcacttgctggatctccaagtgtcttcagagtgatgagcttaggaattcagggaaaggccttgtcatagaaagccttcaggattctaaggaatttagactttagggcagaaaatgggaaaccatggacattcttgagcagggatatatcatggtgggacttgtgcctcaggaagagcaatccatcagcagaaaggcttggagagtgagtagaggcagaagaacaatgagggcattattgcaaaagtccagaccagtggtcacggaggtctgaagtttagtgatgagaccaaaattggaaaggagggaactttggacaggtgctgtagcagcaacagaatggaggctctggggcttatggggtatggggattaaattcacactgaggcaggagagtgttgagagggaatccagccatcttctcttcctgggctcacagggtggtttatcctgggggttgttgtgcagcagttctctgatgtcaaaaatgagcaggcttagggaaattgatctactttggtagagattgtgggctgtccaccaatatctagctaccttactttattaaaaatagaatccttaatttttagctaggcaaatgcctcctacccctagttggaataaagacatttttcagttttcttgcatcagaatgggtttgcatgagtacacctgggcagtgatttgtcagactttgggaaaatatgatttttttgttggcaagaaagcagcctggatggagctccagtgaccatcttaaaccactagacaaaaactcatgttgaagataatggagctataagatagtgactgatgatgactgtagagttgccatacttgtcccaggctgccaacatctggatttcattgacatgggagagaaataaatgtacattttatttatgctactgttttgtctgttttatgcaaccaaatctaacctaatctttgtccatataacaaaagtcaaaagagtataatgcaaactcatttataactttttaacaatggaaatatatgtatctcatctaaggacacatcttccaaggattttagcacccaagaagccaaagtattcattcaaagattgaggggtgaccagagtcttggatggggcaagtccatcaggtcagttcttgggctttagtccatcaggctctatagaaacttcaccaactctctttactgcacaaccaagccctccactctcatgagaggggagctcatgtcctctaagccccatgtctctttccactgaaagagcactgctctcagattcccattttccccaattctattcaatttgtgtcttgttaacataatcttcctttaaatcagatgcaatacaactgaggatgactcaggtcttggagttggaatcggatctgagtcctgccctttctatacttgacctcttaactggccagtgactcatttacacaaaatattttgggttggtttggcaagtgttcactgcttagatactttacattcaggatgtactttatcatattaagagtataggggatacattttcttacatactaactgtaggggacaagtacaaatgaatagcccaaaccgaggctgatgttaaaggttagctgccggggaggatggaagaaccagtcttcattccccaaccctgtaaaagacatctagaggtgaaactggttttaccaggaagatgtcaagatcagtttaagcctgctgaagtggaggttctaatcaatatctgataatatctaagatgtattgagcacttgctttctgcctggcaatgttctaagcacttagattcatcaaacgcatcacctcacaactacatgaggcaactactcccaatacccccacttgcagacagggaaactggaagctagagatgaagcaatttgaccagcatcattcagttagcaagtagaagagctgctacttgaatccatgtgtttctcatcgcagagcccttaactattaccttagttgttcttagggagcttaacaaaatttccttcctcacaatctccctcttatcagaatgtatttcttctctatgatgccaattccatacttgatgctttatctgagaaacctttacaaacaggctggtacttgccccttctcaggtgacaacattttaagtttgatagaggttttgcaaaggtgtactgataaatccactggaggaagagttacgggtggagaaaactcttaatctgtagcctttgccaatttccatggtgtaaatactcccaccatgaccagtgcagctggtaaatttcctgaatatttgatgattgcctcctgcccagcagctccagcacaccactgggccgagggttctattatagctaagagtgcccacgctggctgggaattctgggaatccatggccagcctgagagagttctggcatgagagagccttgcagtccccttcaaggcatacctgttaggggggtccccagcttcttttcttcagctatctggcccagggcatgctgggaggtggtgctgtggcccacagagaggctacagacctgggctcatggcccagtctccctcctgaggctccagctccccttctggaagcagcgctgtgaccagcaggtggcagcactctcacgttcaagagtctgtgcctcagcaaaatgaggggcctttgttctgagccagaggctgtgtcaccaagagaaaggccctgaggggccagctaatcagcctgtccttagctgacctccatcaatgtgagccaagtggacagtctctggcagcgtgataccatgagaacaaccttagcaaacagcagagacagcacagtctcaacccacccctgcccatcctgagggcttggcctggggaggcctcataaaaacaggtggggctccattcaggaagggaggtaaatgccaagagtggcgcttccagtgctaaggaggaaaagactcctgcttgctcccaccaccagctatgctgtggtgccgccttccttctctgctgactccatgggtgctcagttcccaccaggtgaccagctgttccagcttgcccaggactgtcctggttttagtactgaaagtctcaggtcctgggaaaccccctgtccccagacagcaggccagctggccatctgaactcccagtccctgtccatgtgcaacgcctgcctagcacacagtaagcactttcgaaggcgttgctgttgcaggagaaggcaaagcagaattcaggtgggactataagagctgactgaccccgatagacaggttggttagttagttaattggtattgattgattgatttaatttatttagaggcagggtctcactctgtcacccaggctagagtgcagtgtcacgatcatggcttgctgtagccttgacctcctgggctcaagagatcctcaaacctcagcctccaagtagctagtaccacaggcacatgccaccatgcctgccaattaaaaaaaaaattttgtagagatggggtctcgctatcttgcccaggctggttttgaactcctgagctcaactgatcctcttaccttggcctccccaaagtgctaggattatgggtgtaagccaacacaccctggcctcattccattggtaaaagctgctccctttgctttcggtcagaggtaggagccagaatgtgtgaggggaaatcctcaaaacagtccgtttcttctccagctcaccttgtatctttgacctccctccctcttccttccctctcatgctcgcccgcctgcctcaacaatctcaccctccccagagtccagaggcagagaactccgtgttccaaggaagggtggagcctcttagagtgggcaggtggcagggctggtaaacaggacaggccagaggaggggttgaggcaggccaggaggcgcttcagccacctagacatggagcagcgggatttaggcagcccaaagaatctgtgcgaggtttcctggagccctccccctcctgcccccacatccaagcagggatgtgcacattcctctttcctcctctagctcaatgtgctgtggcttatctgctcacgtcactgttgacccctccagatggttcacttggactcccagtgcctagcttggggagtcaggcacggcaaacgccaccctgtgctatggcttgaaggaggccagcaagctttgcttaagccaaggcatgtgtgagaaacttgcaaatccttcttccctgctctggacatggggagaaaaggcagacttcttgccatggccctcaggttctgcacagaccggcccttgtcaattctccaggcttatcttgtgctgtgtttcccagcactcagtgtggccatcatcctggccttctgccaggccctgctaatgccatgctcactcctgcctcagagtcttcactcaggctgttctctctgtctggtcaagaatagcaggcagggtctggtttagacatggtcgtccaagaagccactgtgagcaggggaaagtgaagctttgatctggaggatgtgaagggtcatggtgtccacctggggaggaggtctgctctgacaagcacactccctgtggtggcaccagctctctgtcaccctgttaggaaggagttaatgggcatttccaaaggcaaacttctcatgggctttctgttttaaattttctatataactgaccactcctcatatcaaactatcatactcagcgggtttgtattttcattccactggtgacaaattaatgcaggcatagccctattctggataaaaattgaccatctcagtgaaatcctgctgactcctgtctcccagccagcacttggatttggtggagcctgcattaaccccagggtctcaatagagattcttaggtcttggagatttctactaaaaggcccactcttccaccttacagaatataggtcagaagtttgggctacttcagctgccagatcatagtaaataaatattgagtttattgaagaaatactgattttatgacatagagtttgccaagtaagccaaatcctagatacagtgcacagcaactctggttattaagatatagatggaaacccaggctggcaactatagtcccagctactcaggaggctgaggcaggaaaattgcttgaacccaggagttcaagaccagtctgagcaacacagcaagaccccatctctaaaaaacaaaacagttcaaagctttgaggaggtggtgaaagcctttattggtgttaaatactccatctcaagagctatagaaagatcttaactcttccagagaggccatagcctctgtgtaaagcacactgtgtaagctccatgaaggacacccaggaggcacgcatgcccagagaggagcggcacctgctcctcccctaccctggaaagagccaggccatgattcctgtggaaagtgctgcacctcacccagctgtgagcaacctcttcctgggtccttgggggtggggaaaccaaatccctgggtttgagtagtatttggtcttttccaagagcctgtgtctatgtctgcttgctttttgggttagctccagccaatccctgttatctttcacagaggaagaagtatccagctgttggggaaagtcccaggatctggggccccgggccagttacagggatgttgggttatggctgctcttttctttcacctatttgtctagaaatgcaaactattcaggttgcccatagcaaagaggccaaggttgggaagctaaggcatggatgtggtgaaggagagttggaggaaaaggctcaaagaacctctgttggtttttggggggtgtgacttcaatcttgttccttcattcctacgtggccgaagagtccccttgagtgacctcaccttcacccaacccccacccaacctgcttattcacctacactgacacctgcccttcagtaagaagccccaccctccccagaacacaaagttctccctagagtctgggaggaagatctggggtgtgaagggatgaggggagggcagtcagggctggaagtgagaggaagaaagggatggttttattgctcctctctcgtactctggctcctgccagagctaaggtagcaggttttaaaaatgaaatgaaagcagctcttgcttgttagagttggtcatcctctgtaggcccctttgactcgcctctctccttcaataacaccaactcctgcggcaacatttattgtgtgctcacgggggccaggcattttgtgaggctcggggctgggagttgatgctgtgttggggtcaacagtcaaggggacagctaaattccagcacagtgaggtttgggccacagtgagtggtggaaatataaaagctcccctctgagaattggaaagcatcatatttttaaacaactgttgctggagtttaccttccttcttaaaggaaccccagctgcctgttcccatgatgccactgctggagtctcagccctgaggttgggcaagccgggggttgagactgtaccttctctgtttactgaaggtgttcctgtctatcttactgcctatgcactgtggtccccacagctgaaagtcagtaggcagaacagctggcccggtaggacccatttcttcaatgaaacagcctatggcccagacaaaagcccctgcatgggtgggtggaggctaggatgctctggtgagccccttggacgccattcctgtagtggtcacattggaatcaagtccattcaccgatggtcttaatgtggacagaaaattgaatttattaatggtagatgtaaaaatataatcaaacatttccatccatatcattgagtcctatccaacaataaaaaggaataaactattgatacatgcaacaacgtgggtggatctcgaggcagttatgtggtgaacaaagcctatctcaaaaggttacatactgtatgacttcattttgtaacattttttaagtgaaacaattatagagatgaggcacaggttagttgtcaggaaggagcaagtgtggccacagaggacagcacaaagagtggcttgtgatgaaacagcgccacacaggtgataaaattgcatagagctacacacacacacacacacatacacacgcacacacgcgcacacacacgagtacttgtgaagtctgaatgagtctgggttgtaccaatgtcagttccctggttttgataatgtattatagtcatgcaagctgttacactggattggcctagtgaagtgtctgtgggactttcttgtcaatttttgattgtggtaaaatatacataacataaaatgtaccattgtaactatttttacaggcgcagtttgttggctttaaatatattcacattattatgcaacaaacaccaccatccatctccagaggactttttatatcttcccatactgaaagttcataccaatgaaacaactcctcattcccctcacctcccagcccctgacagacaccattcaaattttcgtctctttgaatttgactactcgtataagtgcctcatctaagtggaatcacagagtttttatctttgtgtaactggcttatttctcttagcatagtgtcttcagggttcatccatgtcatagaaacatatcagaatttccttcctttttaaggctgaatactattccattatctgtatgtatagtagcccatccctgcttatccacaattttactttccttagtttcaattacccacagtcaacagcaatacaaaaatattaaatgaaaaattccagaaataaacaattcataccttttgaactgtgagtagttctgagaggtataataaaatcttgctgaatcctgctaagggcatgaaccctccctttgcccatcgtgtccactctgtctacactctccacccagtagtgacttaatagccatctttgttgccaggttgtctgccccagtatcgcagtgcttgtgttcaagtaacccttattttacttaataatggccccaaagcacaagtgtagtgatgctggcaactcaaatataccaaagagaaaccataaagtgcttcctttaagtgaaaaggtgaaaattctcggcttcaggaaagaaaaaaaatgatatgctgaggctgctaagatctatagttaggaatgaatcttctatctgtgaaattgtgaagggaaaaaagaaattcgtgctagttttgctgtcacacctcaaaccgcaagttacgaccacaatactggtaagtgtttagttaagctggaaaaggcgttaaattgtaggtggaatatgtgaacagaaatgtgttcccactgacagcagttgggttcggtactatccacagtttcaggtatccactgggggatcctggaatgtatccccccaggataaggggggaccactgtaccacatttatccatttatccatcgatggacatttgagttgtttccaccttttagcaaccttctgtggatttataattctttgaaaataaaatgttaaaaaatacaatcagaaatgaaatctatgaattggctcactctttcacctactgagtatgtaaactagtgtttgttgttgacctgttgacttttgtacagttcccatcacagagacgatttaagcttggtaggccatatagaacctgattttttctttcctgcttttaaagaagcaacacgtatgattgttcagaggatagtatgtgatattcagtgagctttaattaacctggcccatgacactatatacatgcttagatcaagaaataagaaaggaaattcagaggtctcttgcactgacaggtgatttcaggagagacaatgacattaacattgagccagctcctgactatacagaatatgaagccattctttttttttttttgagatggagtctcactctgtcaccaggctgcagtgcaatggcgcgatcttggctcactgcaacctctgcctcctgggttcaagtgattctcctgcctcagcctcccgagtagctgggactacaggcgtgtgccactatgcctgactaatttttgtacttttagaagagacggggtttcaccatgttggccaggatttctaatgcaaccaggtaaaagtaattagcaggagaggggaatgcttggctttggaggactcatttgcattgcaaagtatttcccattggtggcttggccaggcattcctttgtccagccgtgtaatggtctcaagactgcggagcatgttcacgcacagcatggacaccacttcatgtaggggcactggactgcctagagttggaggaagggaccctgtgagtaagcatgacctcatcctgggagctgcatggcggtgggcctgcaggtggggaggagagggtgggcgctcacagggcaagacagaggctcagcaaacagaatgtgtattgtggctgacgccattgtcatctttccaaacttgtttctgaaaggcatcacatggagaggggatgctgacagggatgacacagtcccagctccagaaacaccgtcagctgaacccagggttttttcatttttgtgttttctcatggaggtttaggggcttagtaaacccctttatgtgtattttttttctagggataaaccccatacctttcctcaaatcttcaaggtccatgacctcccgacatgtagaaccttatgctaataactgctcctgggagacctctcctcaggaactgacttgacccaccttcctaccaatgtggcaggaggaagtccctaaatgtgctcgagcctgtttgatccaacccctgtgggagtccgtgttcctctctccccactttgccctgtccttcccttgttcttctcttccttccctgtccttctttggctttgctacctctcttcccttcccattgtttttcctcccccctcctaggttctcacatcgctttcctgtttccctctcctgcaatatggatttgacatattaatcattacagcaactgctaaaattccactgtgcttcattaatccggaggaaaataccatgtcagctg

SEQ ID NO: 875 - DNA, 5267 bp, Homo Sapiens
ggttcacaattctaacaagaaaagattcatttacgtttctttgaatgactttcagcttacaaggttctttataattactattacagatgaggacagctctgtgccagagaatgagctgggatctgccctgacaagtggagcctcgtttgaaagtgtcggtaacaggctctgtgtctgaaccaaagtttcccttgcaacctggtgtggctgcatgatggagtttgggccgtgacatatggtgggtttgacgtgtgccactcttagggccaacttctaaagcctccaagacacagccccatgccctgtgcccttctgcagctcagagcagatgagcccagtgaccttgaggcccttgaagatggtggaaccaggagacatgaggggccttggcctggaaacacaactcgaagggaaatcactcatctggaaaacgtgtttggacccataccacaccgtggcaaatacctggtaaaactgtcatctgaaattgcttggaaataggacactaccacctaaacccacagctcgtaggccagggcacctcaactgtagtccccagaccagcagcatcggtgttacctggaaaattaaaaatgcaaagttttgggcccacttcagaccccaggtcagaaattgtgggttgcagaaatctgtgttttaataacccttcagatgactgtggtgcccgacaaagttgaaatgcctgctcccatgtgtgctgggtttagtttgtgctttagcaaagcgggataagaaagaaaggaggccaggatggaattcgctggtttccaactagaagtgacagaaaatagaaagagtccagtaatgtgaggtcttgaagtgttgggagaattcattcatcacttctagattccagacaatcagaaataaaattttaaaagtctttcaatgacaaactaagacttctcagttgggaaaaaaaaaaaaaaaggactcagtcttgttgcagacatgagatgaagagtgtggtcttttcacaaatgcctgtgcaagggagtcaaggacagaagccatccggtgggctccttggcacgggggcggctgaagcaaaccaaccaggagcccacgcagctgtcaagggcttgtgtcagcaagtaaagcctagactgcttgtgactgtgaagtgtaaaagtgcccctgggtcctcaggcctgtggacaggacaaagccaaagccgcccagcgccgtgtgatgcggccacagagaacacgagcctcgggagagaggagcctggggctggaaaacaagggtgaaggacgctcccctctggctgcaggagaggggctgctgagggcaagatccatcatttcttgggaccaatgatgctgcttcctactctctgctttctgcctgggagttttgtctgggacgcctgtgtctgccccactcactgtgtggtgcaagctccatttccagtgaggacaaccgtggctgccgagagcaccttacaagccaggcatcctcctctgagctcaaggcagccttgagaagtgggacgaagacttccttcacgggaagaggagcggctcagagaaaggaagaggctagtccagaaccaccacgtggacatcttctgtgaaggcaagggctcaccctcaccctgacgccagccacctgcccctcttaataggagggcgggccctccccgcacagcaggcacttcactgcaggctctgctgcctttgggaaatgtgcctcccttgtagagctctgtggtgcagattcggctatcaaaggagtagaacccccccctcccccccgccaccgtcccacccccacagagcagctaagaaagctgtttgatttaacccgtggtttcccaaatactttagaccactaattaattttgttttctgaaacattcgttaatatgttcacagaaaattgtggcattcactttggaaaatatatctgtttaagaacagataatgaatacataacaaatttagaactgtgttaagattccataactaaaaccactctaaactttctgaaatggctgaaaacgtttccctaacttttctgaaagtacttgctgggcttcttggagactgaatcatcccttttgagcccacttaggggaaagttcaaaagacctcagagaagacaaaaagcagggcaagagagacggcccagtcttctagctctccactggagaaaatgcatgtgggaaaggctgggggtttccatcctcaatatttagtaaaagataaagtaaaaattacaactgccttctgaatggctcccctcccctgacttcatgggagtgatgactcagccctctgttttgtaactgcggagattgaaagtggagacgggacctttggcatttcagaaaatgtcgacgccgctttcttctgctttctccgggacccctctggggcctcgcctcctcccctcccgctgaaagcctgctgtgaaaggagcaaggatgtgaaaaagatgtacgactctttgcttccttatgctcggcccaagtttatcaaaagctgtggagtttgctaaaataatccagggaattcgcctggaaatggtttttttttttttttttggttgttgtttgtcttcacttgttccaaagaagcaaaataagacaggggctgccccttgtcctgtctcattcatttttgacacccttgtttctccacacaggccctggggtgaagggcacaggtgggattcagaatagaaatgactcgagggacgcaaggagttgggatcagaagaagcagcagaaactcctgctctgcagacacagcagacattactgggaaagacaccagagacccaggagttcacccaagtcctctgcacactgtcttcccagccctctctcctggatctgagatgatttcacttaaaaacacaagcctttgcttaaagggagatataagtgacagccacctggtggtcaggagaacaaactgccgccgtgtctccacaccctgtgtgtcctgaacaccgctgggaagccgtcagcagacgctccgcaggccaccggggcgatcggggcactaaaggccaagcaggcttcacacactgccaaagtccaggtgaccagagagtatgaccggacacaaaggtgggacaagccgtttctcattgttactgagaagcaactgtgagtgaacaaagcttacagagagatccgagatcagatgggtacccatggcaggaggggaggcgtttatgagagtccccggtgggcacatattaaaaaaagctaagtagaaaaatcactgagaactcataactggtcaatgagttcaggtagacaatgagggagggtttggaggatggcgaaagatcaaaggggccctgatggagtgggaggttcagagggaggagacgctgccatgttcagcctccaggagccaccacaggttgtgcataggtgctgtgttgacttctgctgaggaaattcacaaaatatacttcccccagagaaggaggaatgtggagcaggcgttaaaaagcagcctgcactcaccttcggaggccctcggtgggatgtcctcttcccagccctttcctttctctccctcgggtgccttttcctgcctggtttccttggttattgtgtttggaatgcaactttgactagttgttgaatggtgaagtggcaaatggtaggtggattctggcttgccgcacccatcccacaggtggaggtcttgtgagaacgactccagcagcctccagacaaatgactgttgactaaagtgaaatgttatgcacatgaaatgcaagagatgactagacacgcactggatggaattccacagcaggtgggagacttgggaaagatccttgttttcgtaagaaaacacaatctcagctgggtgcggtggctcacgcctgtagtcctggcactttgggaggtcgaggtgggcagatcacctgaggccaggagtttgagaccagcctggataacatggtgaaaccccgtctctactaaaaaatatgaaaattagctgggcctggcggcacctgtggtcccacttactcgggagtctgaggcaggagaatcgcttgagcccgggaggcagaggttgcagtgagccaaggttgtgcctgtgcactccagcctgggcaacagcgtgagatcctgtctcaaaaaaaaaaaaaaaaaaaaaaaaagaagagaaagaaaaagaaaacacggtcttcaaatcccataacctgagcacaaaagactcttggctcgctgattcgtctcccacctcctcctccccgcacagggacagatactgaccgggtgtgagagtaaggccccgtgaagacgaaccttggggagctcactggggtccctacttggaattttaaagcaaaaccatgttgctggaagtgaaatcctcttcagatttacgaattatggggctccattggaggaaacaatccctatgggccaatgacctcgtttcatcccaaattatcctctggttttacaactggttagtttcttgtatttccaggatttataaattgcaagtttgcttgtgaagtggtagaatccatttttgaatttgtttcttaactattgatagggctagtaaaattcaaatgattgcataaaccttagaaactaaggtcagttcagtgaacattcttggtgctatttcaacaatccttgaaggtttaacacgtctgtgatattactgtgtgatttcgtgttatcactgtcttatgtgcattctaagcatgaaactgtgtccagtagctgtttttgaggaccctactaattatacagctgatggtagcatcagccgtttgttcaatgttaaattattttgtattttctaaacaactgacattttctcctagcaaactactgataggaaattgtatgtgccatgttttcttccaacagtcttgaatatgccactgcattcctgcctgggtaaaagagtgagaccctctctcaaaaaaaaactaaaatgaaaaggcccaggatgaaatagagtgtttcaaaacccacagctactccccatcctttttctatcccaagagctgtgcctcagggatgtaataaaataaacatacaaactttctaaaggctgattttacaatttttaattaaataaatactactcagaaccttttcatggggtataactcaagttgtttttcagtgtttgaagaagatcaggttcacatttaagtcagctaattattaattatcagcaaaggcataaaatacacctggtggttatttacttattctcttagctttacttacatctttc

SEQ ID NO: 876 - DNA, 9270 bp, Homo Sapiens
cttttctttaagaacaaaggttggagcccaagccttgcggcgcggtgcaggaaagtacacggcgtgtgttgagagaaaaaaaatacacacacgcaatgacccacgagaaagggaaaggggaaaacaccaactacccgggcgctgggctttttcgacttttcctttaaaaagaaaaaagtttttcaagctggtcgcacgttcgcaggcgcgggcttcctgtgcgcggccgagcccgggcccagcgccgcctgcagcctcgggaagggagcggatagcggagccccgagccgcccgcagagcaagcgcggggaaccaaggagacgctcctggcactgcagataacttgtctgcatttcaagaacaacctaccagagaccttacctgtcaccttggctctcccacccaatggagatggctctaatggtggcacaaaccaggaaggggaaatctgtggtttaaattctttatgcctcatcctctgagtgctgaaggcttgctgtaggctgtatgctgttaatgctaatcgtgataggggtttttgcctccaactgactcctacatattagcattaacagtgtatgatgcctgttactagcattcacatggaacaaattgctgccgtgggaggatgacaaagaagcatgagtcaccctgctggataaacttagacttcaggctttatcatttttcaatctgttaatcataatctggtcactgggatgttcaaccttaaactaagttttgaaagtaaggttatttaaaagatttatcagtagtatcctaaatgcaaacattttcatttaaatgtcaagcccatgtttgtttttatcattaacagaaaatatattcatgtcattcttaattgcaggttttggcttgttcattataatgttcataaacacctttgattcaactgttagaaatgtgggctaaacacaaatttctataatatttttgtagttaaaaattagaaggactactaacctccagttatatcatggattgtctggcaacgttttttaaaagatttagaaactggtactttcccccaggtaacgattttctgttcaggcaacttcagtttaaaattaatacttttatttgactcttaaagggaaactgaaaggctatgaagctgaatttttttaatgaaatatttttaacagttagcagggtaaataacatctgacagctaatgagatattttttccatacaagataaaaagatttaatcaaaaaatttcatatttgaaatgaagtcccaaatctaggttcaagttcaatagcttagccacataatacggttgtgcgagcagagaatctacctttccacttctaagcctgtttcttcctccatatggggataatactttacaaggttgttgtgaggcttagatgagatagagaattattccataagataatcaagtgctacattaatgttatagttagattaatccaagaactagtcaccctactttattagagaagagaaaagctaatgatttgatttgcagaatatttaaggtttggatttctatgcagtttttctaaataaccatcacttacaaatatgtaaccaaacgtaattgttagtatatttaatgtaaacttgttttaacaactcttctcaacattttgtccaggttattcactgtaaccaaataaatctcatgagtctttagttgatttaaaataatttttatggcccattttcttttgcaaagtacaaattataattccagaagctatctgccaaaaaaagacaatggaagaaaattatgaggacactaaagggaacattcctgactcctaggacacagtattctcatgtaagaatacccatttggctttgccccactttctgttcaagttgtatgtgctgccaagacaaatttcttctcctcactttctgttcaagttgtatgtgctgccaacacaaatttcttctcctaacacctggaatgagcttgtggctccacggagctcccatgtaggtagaacacattcaagagtgtttcttcaggccaggcacagtggctcacgcctataattccaacactttgggaggccaaggcgggtggttcacttgaggtcaggagttctacactaccctggccaacatagtgaaacctcgtctctactaaaaatacaaaaattagctaggcatggtggtgcgtgcctgtaatcccagatactcaggaggctggggcagaagaatcacttgaacccaggaggtggagttcacagtgaacgaagatcgtgccactgccctccagcctgggtgacagagtgagactccatctcaaaaaaaaaaaaaagtgtctgttcaattcattttatctgccactgtatatctacaagaggactccttgctttgagtcccagttcttcaaaatcctgcttgctgcctaaagacacaaagtcatagaacattaggactggaataaactattgtagtataaccttcctgctgttacaataaaaagctataaacattacaaaggcacttaaagaaaagctgtgctgggaaatgccttatttgaagagcatttgggtacactcacatgaagctttggaaagttacttaatcttcctctaagcctcaatttcttcatcaataaaatgatgaatatatttcatatttcataagatgtaggcttaaatgaaatcatgcatgtgaaaagcacaatgtctattatgcattaagtgttaaacacaaactttcaaacttttacatttcagtcatttaaatcaaatgatctaccatagcagatctccccaaagacactctagctccaaactaactataatcaatcccgtggtgacgacccaaagaaccagggttcctgggttttctctcacgcccagcccacctaggcttctgactgcctatctcctcatcttagagggattcctcctgaccagtcattacaaaaattcttggagcatgagcaagactgagtctgtgtttggattggaggaaggggtaagtaacaaggtatatatatgtatatgtgtgtgtgtgtgtgtgtgtgtgtgtgtgtgtgtgtgcgcgcgcgtttgtgtttaagttacaaactaaggatggttttaaaaaattgcaaaatgttaagagatttatctaggatctgacccacttccccagaaatttacggaattcaagaccaagcctttcgtattcactgtcatcagttagatggacccagtagctaaaaaattaaggagaaaaaaaatagaggaatatgagggaaaaagtcaagtcagaggactgaagaatatatacagaacatagaatattagaaattttctgaaaatagatgatagcaaatacctcaagaaagtgaggaaacgtgaaaagggagcttaaagaaaaataatagagtccatacatgggacacaagcacaaaaagctgactgagcatgtggttctctactaataataactggaaaacagtgaaaccagcaggaaaaacttgcacataagagtttaactttccactttgggtttcaaattctcccatagcaataagagtaagtgaaataatgttcacataaggattttttttttttctattactgtagtgttttgttttgttttgttttggttttggtttttggtggtttttttttttttgagacaaagtctcgctcttgtcccccagtctggagtgcaatgtcatgatcttggctcactgcaacctccgcctcccgggttcaagtgattctcctgcctcagcctcccaagtggctgggattacaggtgcgtaccaccacgcccagctaattttttgtattttaagcagagacggggtttcaccatgttggccaggctggtctcgaactcctgacctcaggtgatccatccatctcagcctcccaaagtgctgggattacaggtgtgagccaccgcacccggcctgttactgtagtgttttaacaaatctaagtgtaatagtattagtcttcattcatctaagacatacaagtactggaattttttaggtgggttcctcaaatgtcatcacagtggtgtcttctctacattcagtcactcttccgcccttctctgtaatgctcagggatttcccagttcactagcacttaacatagtatgtccttacttactttggggtataaatgactgcaatagaagaagtgatatccttgagggatgaaacacgatcttgcatattcatatccctttcaaatgtttactgacttaatcacaccattagttttctaagtccaagtctaaaaacagaaatgagtttaaatacagtgaacatttcattttcactataccactaagctgaaagaaatgatttttggtaaataaaagttcatcacagtgaaaagttctacatataactgaagatcaaaggattctcacctgggaagcttgtcaagatgcatgttcccaagctcccaggctcccactcccagagattctaatactgtaatggagctgaggacactacatttttaacaggctgaccaggtagttcagattcaggtggttcctaaaccaactctgaggaagtagtggttttatatacgatgctactgttgatgtggctactaggaatggtgctcagcagaaatcctgcaacatatggatctgtttacacactattcactgtgtaatgagagtctgcaacataggctaagtaataagagatgtcttgtggttgacctctctggagataagcagcaatgaaattccaatgaagtttcatcatctctcatcaccaaaaccatcctaaccacctcaataaaatacacctgacttcccccgctcccccgacccaccaccccaaaaccagctgccctatgttctaccaaaagctgcaaccaaccaatgacctgatactaaccccaatctatcagctgctgcctagtgcaacagagagggaaagtcaatgagaaggaattgggtgccagttcttgctttgcaaggagtgggttgactaatgagacagccacaaatgtcactgccatcccatctcaccctttcacctgtgctgcaaggcttcaacaatcatacccagtctccacttaggaaaattctgtcctttctcaaatgctggccactcagcaatgtgctcccttaatccaggccaagcacatagtaaaagaactccaaaaagggttacagccaaaagtgatctttctcctccatactcccaaagcagattatagctcctccataaacgtgcttcgcattgtgccccacgtttggtttgttacttgtgtatacattatcgtctcttctagattgagcttctgtaggaaaggagaatccttttcaattttttggtattacacccagctcaggaccttgctcagttgcttaaattgaatgagaaaatgtatctaagtacccactgatgttggaaattcaacttgttccaatattgaggactgcctatacctggcatatgcgtgtcccaatttgagaaattgtttttcaagttgacttgtatggattccttacagacgctcaagcatcagtttggttttccctaaatcctgcagatcaggaaggcagtatccatgtttgctttaagaaatttcattactataaatatatgaaatattataaatataaaaattcatatattataaatatatgaaattttgtctgcagaatttttttctcaacaggcaatcctgacataataaccaattttgagatgcttcaaaaataacactgcagtagtagccactcctaaaacaaaatatttcccctttccttcaatatatgtaatcacatatgacatataaaatctgcttattggataaatttatctttaaaagactatctatatttattaaaagttaaaatacatatactctttgacctggaatcaagtacaacaatgtattttacagagctaccagcacacgtgtggaattatatatgtacaaggctactaactgaagtattagtatagtaacaaaaattaaaaatcaaccataaatagggaataaataatggtacacctatgaatgaaatactaacttctaaaacacaaagtaaaaagaaagggaaaataaggaaaactggattaatccaacatatgacaggaaaggagaaaaaaataatgcaaagaaatgataatcacagtaaagtgaatacaaattaaaatttatctactaaaagacagtaattcaaagactagatttaaaaggaaaataagttttatgctatttacaaaagacagacttaaaacctaacaacataaaaatgctgaaagtaatataccaggtaaacactaaaaaaaaaaaaaaaaaaaaaaaaaactagtattaacaatagaacctgattttctaaaaaatagattaagaaaactagattaaaggagaaaatcattattaccgagatagagaggatcattacttaaatgataaaaagaagcaatttatcagcacgtttaaaaatcccaaaacagaatacacagtgctaacaaaatcatcttaaaataaaataagcaaatgctgatttagccataggagaaaccgccaaatccacaatcattttaggagaatgggtttaagaaaggaaaaaaaaaaaaaagatttctgtatgctcttaagagaaaatctaaaaaataatgacatgaaaaagttgaaaggaatggaaaaatatgtaccattaaaaggaaacccgacgtatgaatgccattatcagacaaaacagatttttttctttttgagatggagtctcactctgtggcccaggctggagtgcagtggcacaatctctgctcacagcaagctccgcctcccaggttcatgccattctcctgcctcagcctcccaagtagctgggactacaggcacccaccaccacaccaggctagtatttgtatttttagtagagacggggtttcatcgtgttagccaggatggtctcaatcttctgacctcgtgatctgcccacctcagcctcccaaagtgctgggattacaggcatgagccaccgcgcccagccagacaaaacagattttaagacaactaagaagttaacaagctgaccctacaataagcatgaaaattttgaaaaagaataggaaaggagaactcaccataagagaaattgaaacttgttataaagctatagttgttaaaacggtgttactacagtggtacatggacagataaatggaccaatgaagcagacccaggcactgaaaggaaccttttatatgacagcatggcacaatcagtaagaatagagaggaaataggccaggcacggtggctcacgcctgtaatcccagtactttgggaggccaaggcaggcagatcacctgaggtcaggagttcgagaccagcctggtcaacatggtgaaaccgcgtctctactaaaaatacaaaaattagctggtcgtggtggcaggcacctgtaatcccagctactcgggaggctgaggcaggagaatcacttgaacccggctagcggaggctgcagtgagccgagatcacgccattgcactccagcctaggcaacaagagtgaaactccatcacaaaaaaaaaagaaaaagagtagacaggaaataaatggtccagaataactgcctatccttgtggaggagagggtgattcaaaattaggtccctttcctcactctatatgcaaaaaacaaacttcaaataaattatacaattaaatgtgaaaatcaagactttaaaataaacaatgcagtaggctgctttataatatcaagttagggaaggctttcttaaatttcataaacataaatcatagaggaaaagatgaactgtctaccttaaaattaaagacgatataaacaaaattaaaaggtaagccagacaaaagaaatatttgtagtgacaacggtttaactttctttctttctttttttttttttgagacggaatctcactctgtcacccaggctggagtacactggtgcaatctcagctcactgcaacctccacctcccaggttcaagcgattcttgtgcctcagcctcccaagtagctgggatgacaggtacgcaccaccacacccagctaattttttgtatttttagcagagacggggtttcaccatgttggccaggctggtctcgaattcctgacctcaggtgatccatctgcctcagcctcccaaagtgctgggattacaggagtgagccactgcacctggcccacaagggtttcactttctaaaaatataaagaactggccaggtgcaatggctcacacttgtaatcctagcactttgggagggcaaggagagcagatcgctagaggccagaagctggagaacagcctggccaacatggtgaaaccccatctctactttaaaaatataaaaattagttgggtgtggtggcacttgcctataatcccagctacttggctactcaggaggccgaggcaggggaatcgcttgaatccagtaggcagaggctacagtgagccaagatcatgccactgcactacagcttgggcaacagagtgagacttggtctcaaaaaaaaaaaaaattatatatatatatcttatatatatacactattatatatatacacacacacacacacacacacacacacacacacacacacaattaatatgagatgcccaaaaatccaattgtaaaaaggggcaaaggttgtaaactggtaattcataaaaacaaatgaagagatgcttattggtactatatgctcagtattaagcaaattaaatgagataggatcgtgcatattcaaccaacaaaatatctgaatgtctgaaaataataaatgttaatgagggagtggagaaaatgggaatgctcatactgctgatagagagtaaactggtacaactattgtggcagccaattaatatttagtaaagctgaagatgcatggtccactgtggtacaggccctggagatattatcaaatgtgtacacaaagaaacacgcacaaggatattttctgcgatactgtaatactcaaaagccaatgacatcctcagtggtcatcaataagaaaatgaattaatgatgggattaatcatataatgaaatactatatagcagttgaaatgaatgtactctttacatgtatcaacatgctatacataaaaaacaatgatgagcaataaaagcaaattgcaaaaggatatatattatgaaaccaattatgtttagttttaaaacacagagaatactatggattgtagtaaaaaaaaatataaaatcatgaagagtaaggacaggtacaaacaggatagtggttcttc

SEQ ID NO: 877 - DNA, 3446 bp, Homo Sapiens
ggtactccattgtctggtaaagttcatatgactgcattctttttgcaaggggggtggagggagagcggggaaggagggggtgtcagctcaactgtaaaagctgcacagattttttttctttctctctctctgcctctccatagattgtttctgtttcatgccctgtctcatttcgcatagctaaaaaagaatgctaattaagatcccttgtcttaacctgaaaaataatgactcggctgtaattagaaatctggtgagagtttaaaaattctggtaggggaccaaaaacatcagttacggtgcttaggaagaaaatgaagaattatttttctgaaatcaagatggatctgagaacgctgtctgggcttggtaccaagagctggtatttcacagcagcgaccgcctcacagacgagctgtgggaagcaggagggagactctctcttagggtgccactactatggagacacagctgggctgaacaagatttgcttcaaacgacaacaagagagacagaaagtatctggttcaaccgctgcccgagcaggcaggcaccagaagagctagcagccaatccggccatgctcgaagccagctctgcagctcagccaatcagtgacatcattgctttctttagcttgcccatggtgatgtgaagatgagaagaaatagcaaggcccaaccagttcttcatctggagacagttcaacgttctgcaaaccagatcttcaggaattttactgggataattatccaaataaattgcaagcattctatccaaatggagctctttctgagatgaagagaattctcaatgtcaagatttgaacaagaagagaatggaatacacaatatggacatccataaaaattcatcagagagcattttactactgagctgcaaaggtaaaaataaaaaacaaagagcaaataagatttactgtttttaaagaaaaacaacattcttttgactgtgttttgttataagaattaatttcatattctttatgagtgtaactgttgaaattttattgatggttttcatttgaaaatgtgtgctatgacctacctttgtgaaaaatttcttgtggtcaattgggcagtttgtgtcccattgaatatatgtctgtgtatccatacgcttaagataggtgcaatacggtttactagaaagctttataggaaaagaaaaaaattatattttcttatttgttgtaccatataaaaggaagtgaaatcaggaggaggggaataaggtcatgctttttcatcttttttacatgacctgataagacaatgaaaccaaaacatgctttcttatagttatggtaaaactaaacccaatgctgcctcttatttcacatttgcatttataaatatatgttgaaatatttttactacaactgaatgtatgattgttgattatttactatagtttttaataattatgaggacaatttaagaataaataatggtttaaaattatgtagaacacatgatctatataaaggctataaaacgtatttatttcaaaatatgcaaaatcactaagcaattagtatgtagtattattttacacaataaagatataattaggaaatgctaagtgattatagatgtgaaatgattaatgattgtacaacttatcattttgttgcagttgagtttacaatcttaaaaaaacgtgtatgtggctggctttatgtttactcgtttgtgtgtttgcttgttgtctggtggtttaaaacattttttagtaatattttatttttgcccaacctgttgaccagatgagagttgtatgtagccatgcattttaagtgtatcttttttgaacaataagtttaaatatattttatttaggaaagaagatatcctatgtcatgtaatacatctggagtataaatgttagtgtggagtattagtaatcatgccattatcgtgccatttagtttagttttatattaactcatccaaatattgtaaattttagcaccattccgactatagacacagatgtatatatttaaggctgataataacttcctgtattctctagctagtgaacaagatcttactgttttatgagaaagttataatgttaccaattccttgaaaccagtaactaaactagttttataaaaattaaaataagcacggtctaactcatacacaattaacttaatagttaatttggttttaattataggctcgtaatactacattcatgcctcacaattatataattcatacatgcatgtatggattcttttttcttttaaaactcaattagaatagtttaattccaaaatatttactattgaaacaaaagcagttcgtgaaaaatttttcaataaactactttttaaattctcatgcatataaatttgtatttagttttgaatatttatgaaggcctttaatggagaatatgcatccttagaactcagcatttaaaacatttatactaaaggatcaatattatttttgactcttaattgcatcagatatttacaacaaattctatattaatagggggcccatgcaagatgttgcccattggcataaacccgtagatccgatcttgtggtgaagtggaccgcacaagctcgcttctatgggtctgtgtcagtgtggtaatctgacaaaatgctatacacagtgccgttcaacaatagttcagtaaaatcctgttaaactccagttgattatatacttttgaagtcattatattttcctttgtttttaatgtttattttaatcattgtctgtcttacaaggcaggcttcaattctcaacaacttggaagcgtttatatcacacccattcaagttcgattccatgtacagtaaattgcataagaaagttgaacctttatagcagggtttggaccaggatctgaatagattctgttcagaaacttcagtgcatactgtagtgcttagtgtacctcttcaacttcagtaagaaaattaaagactaccattggatttatatgtttttattgagcctatttctcctgaaaaaatgaggctgaatgcaattgacttttactattaattgcgactagaactatggcaggttagatggtcagaagacattttacgtgacctatgctggaaacccaagtgtttaggttagtcctatgagaaacagttagcagcaaagtttactggtaaaatgttagaatattatatctatatccttgccaagcccttaggtgtatggctgccatatttggaggagctgactgaagatatgataaggagtttgaagcaacattggaagctgtgtgcatccgggttgaggtagtaggttgtatggtttagagttacaccctgggagttaactgtacaaccttctagctttccttggagcacacttgagccgtcgaggaattcttcatcactttaacctgattgagccaatttgtgtgcaagaaggtaat

SEQ ID NO: 878 - DNA, 4625 bp, Homo Sapiens
cctgtctcccggacgaggacctcaaccccttcccccgctcggggaccccggccacccgcagcccggccgcgctgcgcccagaaacccatgagtcttcctcagcagctgtcgaaacttgccggcggttgcttgctcacctttgctgtctccccttcagaaaaggctggaggggagggcgaggaaggcttggcgtggggacgcccgtcgagtctctcagtgaggaatgagaggccagcttctcctgcggggtatgaaggaggaactgtatctcctatatatattaagtttcatttataaagacatcagagagcacctgagaatgtttcaaggtcaccaaaagctttctgaaaatgcctttctgcaaagaaggtttccagagatagaagataactcaggaagcttagaagaggtcaacctgggaagacaggattctttctccccacccgtggctctgcaggaagcaataccctcccctctgggcaaggtcgaccctccaagtccagatgagaagagttccctctgtctgctctttcctctgcctgatgacccagaggctttgcagctgtgatcctggcagcccctggccacctcagggagctgcagaattcaaaccctggaaatggagctctgcttgcagctgcacctggggcctgacctgcttaggacaggcctgtctggacctaagagaaccccactgccacccactcagctactccctaacagactgcagagaccaagtctttttcatttctttatatccattgatttctcgagttattgaaactcaatatttactgagcacctacaatgtgccaggcactgtgataggcactgaagaaagggcaaaggacgagcagataaatttcctacttgcagggaacaccgtggtagtgagtaaaatgagacattgcaaataaacacataaatatataatatgtcaactggcaataattgatgcgaagaatgattaagcaaaacaaggaaatgcagagacagggaaggagcatctatctggtatgaagtagtcagagaaggcctctctggtcagatgacatttgggcagaacctggggcctgtctcagcaccacctgttccttcctcggccacttgctccctgcagccaccaaaggcccctgtggttttcccgcctgaggctcaccagccacaggcctagaatatctggcttctctccccacgtccaaactcagctgaaatgccaaactgcaggaccttgtttcctgagcaactgccaatggggctgaatgatgcaactcggaaaggaagaggatttcattccccctgaatggactttgcaccagtgggagacaggaaacaggagattggaggatactgggcagctgaactgcctcaccctttccccctgccccgtctggtgcacaatttctccacacagcctgctgtgtgtggccaagcctgtgcgccgactgagtgttatgggttgaactatgttcctcagaaagatatgtcgaagtcctaacccccagtaactgtgaatgtggctttatagtatttggaaacagggtctttgctgatgcaatcaagttaagatgaagtcattaagggggtaggggcctaatccaatctcttgtccttagaaggagaaagacagagacacatcaggggaagatggtgaggtgacaatggaggcagagattggagcaatttatctaaatgctaggcaacgccacagagagctgcaaacaccaaggctagaagaggcagggaaggagcctcccctacaggtttcagagggagcatggcctcaccatacctttacttcagacttctagcatccagaactgtgacacaacacatttctgttgttctgagtgacaacagtgtgtggtgtgttattacagctgctctagaaactaacatatcgagcagccagctgtgtgggattgtacctcccaagtaaccctctaagacttaacctttgcccagggctctgtctctagagaactgtgacaatgataggtagacctgaataaagcgaaggatgatatctgcagggatatttgaggacagggagtgctgacaagggaggagccagtgcaaaggccccgaggtggcagtatgcttggtgtgttggaggagcaggaaggtgaccagggtgtttggggagtgaataaggggaagagtgctcagaggagaagtcagaggaggggccaaagacatgttctctagggccagaaaggcctttggatcttttcgacattatcttcttgacatgtaatttatatagtagtaaaatgaacaaaatgggtgactattttgtgaattttttagatacataaaaccacgtgatcactatccagatcaaatgttgaacatttccatcaccccagagagttcactcctgctaccttccagtcaatacaacttaccaatcctgaggcaaccagtactctctcttttatcatcataaatttgttttaacctgttccttaatggcatataaatgaaactacatagcatgcttttgctcaaaatagtgcttgtgaggttcatccaggttgctgtatgtatacttcaattattattattgctgagtagtattccattgcctggatatatcacaaattatttatccattcttctgctgaatatttgagttatttgcagtttaggcctataataaatgaagccgctaggaacatttatgtgttcctcttattttggttgcatgcaatcatttctcttggtataaacctagcagtgtattttctgggtcaactggcttaggtttaggttaactgtattcgtttacaccattttatactcccgtcagcaatatatgagttccaggtattctgcatcctcaccaacacttggagcctttctggtaggtgtgtagtggcattgcattgtgctttcaatatgcatttttctgctgactaatgcactcctttttatatgcctattattcacatatctccttttatgaagtaggtattcaagtcttttattcacattttatgttttgttatggccacatctcacttccagaatctgtattggttatctatcgcgcattaaaaaagtactctaaagcttgacagctaaaaacaacaaacattcattctctcacacagtctctgcaggtcaggaacctgggtgcagcttcatggggtggttctggctcagggtctcaggttgcatttgagctgctgtctgaggttacagccctacctatcaaagctgaaccagagccagactccatgtctaaactcacttatgtgagcttcagtgtgagaaatgtatgaattttgtttgatgaaatattgaaaagcttaacaacttcctcctactctcattggcctcttggtgcccagtatctgagtctgaaaaatctcatctataggaatcaatggcagcaaagacagaaccaaggtcccacggctattggggaggttggcagatgagtgaggaaaaaggggtgtcagcaatctaaaaatattcaggctcacagaaatataactgtttgaaatgactcacttttattaagatcctgccatctcacttaccagcttaaaaaaaaatagatcacagcagaatgtttcaaattctccataaatggccatttgatccagcaacctacctgtggaaatttatgccaagattagaatctacaaaatacatacagagatgcacattgaagtattatttattaggaatctaaattgtggaatcattaaagagaatacatattccctcaaaagaataccatggtgttattaaaagtagtcattatgagtggttaggatataatataatattacaggaaattcttaggatataccatcaagtagaaaaacttttcttcccagcttttcaatgtgaaaatgtttaaacctacaggaaagttgtaaggccagaacaataaatgcttgtatagccttcatctagattctccaacagtgaccacagttgccacatctctttaagtgtaatgctcatcctttgagagtaagtgcagacattttgataccatgctctaagtactacaacacctatctaaaattgtagaaggaaactcttctatgattttcacactcaagacatttaacactgatataaagtttatattcaaatttctccaaaagatttaaaactatctctttggcttgtgttatccaggactcaatggaggattgagcattgcatttagttgttgtgcctctttagttttttttgatctaaaacaatccctcaaccatttttaaaaattctttcatgacattgacatttttaaaagactctggaacagtcattttacagaatatccttcaatttggatgtgtctgtttcctcaagattagaaattacatgaacttcttggctaacttctccattttattttgtgttcaaaatatattactctttcccatgtcctgtgaaaataaaaaatctctaatgtgtttgtgaaaaagattaagctaagattttgtttggatgcagtgtgatttggacttaggtgtgtgtatctgaacttcatcctttgtcatcaaaagaatagtataataactaagaacatgtagcttaagaaatccaggcacttgagagccactgtaagtaaactctaattcccacagcagaaagaa

SEQ ID NO: 879 - DNA, 5970 bp, Homo Sapiens
agtctgtactggcagcgaatcatacatagcttagtttatcagacaagctgcttttcttgagcaaagaaagaactaggagagaaacggggctttggaaccctgatgcggcaatgctgaaagaggagaaatatcccaaggaagggaaaggtgtgttgcagaacgatgaaaaataggcggcttctcacagctgttctcaggggacgagacggggtgggatgcagctccgccggtgcctaacactaagggccctcatcctgccgattcagttgtgtcgggaccgccagtgctgtctcctcgtcagatgctgcttctggtctccccgcagaagatgccactggagttgccttttcaaggatggggacatttgaaggccctggacgctcagctctgaggctggctgggatctcactagcaccccctggtggaggccggagccaggctgacgcgggaaagtggggcacggaagcgctgcggattggaccggcggcagctaggccgaaacgcctgtatttaaagggatagtaactcggactcgttctgcaatatccccacaagggcctgactgagcgagcgagcatggacggccgcggggctttctggacagtggccattcccagagccaggcaggaaggcctcgggaggctggggctcccgttcccggtgaagcggacgccgccagcgccccagaacccaggaggaagcacacaggccccacagagagtggttggcaagagtcactcggggattaggatgccggccaaatcgcggaatttgaggctggaatccaagcccaacaggactgctgtgtgtgaagcactcaagagggcccctacaaccaacctgccaggagtcggctcctgaaaacagggtcggaaaaggtcagtgcccatcagaatcgagctgtcggcaaaaagctggagaggttaggagctttgtctatctcaagggtaacaaactgctttgaccctgagggctctgaagacgactttccctcaccgcagctctcaagacaacagggatcagactcagaaagacactgcctgtataaggctcttgtttgtcttgtttttaattcctgccctctgcctccagatctcagtcctctatctgtgaaacggaattcggccttgcctgtccacgaaatgaagacaaggcatctcgtgtgtgttaagatgaaacaagatcttagcaagagagtaatgatttcttttttaaaacattttttactgtagtaaaatgtactataacgtaaaattaccatttcaatcatttgtaagttcagtggcattaagtacattcacattgtcgggcagctgtcagaggtgttcgaaccagagcgactccatcttgaacaggtgctgcgcaaaatgaggctgagacctgctgggctgcattcccaggaggttaggcattcttcgtcacaggatgagtcagtggctgccagggaggcaggttggttaccccaggaaccaatgaattgcatctcaggggaggttttgccagatacaggtcacaaagaccctgctgataaaacaagatgcggtaaagaagctggccaaaacctaccaaaaccagatggtgacaaaagcaacctctgctcgtcctcactgctcattatacactaattataatgtattagcatggcaaaagacactcccgctagtgccatggcagcttacaaatgccatgacaacatctacttagttaaatttgcatactatgaatatgagtatgcaaatacctgttggagtccccgctttcaaagctttggggtacacatccagaaacggaattgctggatcatagggtaaatctattttggaggaatagtcgtactgttttccacagtgactgtaccattttacattcccacaaaattatttctttctatctgccttcccccactagatagaacacagggaagttactttttcgtttctaaatccccagcaccaggaacagtgtctagttcataacagagctctatagagaactgtggggaaagaagtgcaatttatatgctgctgcctcttcatttggcatctcagtacgtggcacacagaaagtaggcactgaagaagggttgaaggacctaatgagtacataaatgaatgcagttaccattgctttttccttggtctagactgaggacagacatttttgtaaattaagctacttagttaaatgtagacctctggccagttttgctcatccagaagtttcactttaatgccacttcaaagatactgttttctgtaaatcagatcataattgtgatgagaatgatgtggggatgtgtcctggactctccccatcccccacctcacagcctaatgtataacgcacattttattcaggaccattttggatgtgtaggatctgctccagaacacaggataatgggcctcttttctggggatggtgtggttccatcattagatagcaggtgtgtcatctgcaggtactggtctcactattcaaccactggttgaaagattggttcaagatcaactctttgaaaaatcaaagtattacttttacaaatgcttttttgatatttctcaaccaattaaccttgaaaagttcaccatgaagttgaattgcctaaacttatacattgtatgggcactgagatgcaatttttagggctgtgtgggcatcagcgatgcctgttttcaatacattgtagctatgctcagtgtcatgggccttgtagggctgacctctttttgtccaagcattgaagccaatctaaaactcttttccaaaaagaaaatgttttctttgctaataagtcaccatcaactgcagcagaggcagctgtttgggcttcacaatttgcggaagcacatgccagcctggctctgttttgtgcttgttcacagtatatggctttggccttgttcagcatcagggagtagctgttccttgggtcatgcatggagttggatttaaccctggctttcagctggccagtcctcatcaggagcttgggcaggagaaatagtactctggtgaatggtctgaagacattagatcatagatgaccttggctgcaagcaactaaatccagaccacaacagtttatccaaatagggttaaccaaacaagtacaatgtgtacccaaatgatatcagtgtcccatgatccttccatcatccactggatgatttcttaattcaaagtcaaacaaaaacaaaagcagatttgaaacattctcatccatccttgaaactggatcacatgccatggtctcgctctttgaagtggtcaactgaacagctggatacatggtctggagctgggaggaggagtgccttagtccattcctgctgctatgacaaaatagcttagacttggtaatttataaataatagacatttatttctcattgttctggtggctgggaagtccaaggtcaaggtgccggcagattcagtgtctggtaagctctctgtgtccaggatgacaccttgttgctgcatcttctgaagaggacaaatgctgtgtcctcatatggcagaagagatgcagggcaaaagggccaagaagccctcttgagcctctttaatgagggcattaattccattcatgagggcagagccctcatgactttgggccttaacccaaaaggctccacctcttaataccagcacaatgaggtaagtttcaccatgaattttggagggacataaacattcaaaccgcggcaaagagtctggaccaggggatgactctgtgaagtgcgtgcttgtccactgccaaaagaaagggataagatgaggaatgcgaagctgagaaggggagggttcgagatcagcactgcattgagagaaaggggagttgggcagaggagtgtagtagcaatggtgggcatggcgatggctcaaatgaagaaggtgattgcagatttccctgttgcatgcttggctccagtggtgttcagagctcaaccacatgctcagtgagagtagagagttgagtttacccaggcctgtagttctgcatgacaactgcagtgaaaagggataggggagggtgctgagcatattggcaagagtgttttcagagtcatggggcctggaatgcaagctggatatggaggcaagtgaagagaggctggtgggttgggagatgcagactgagagaccttctgaggtaggagcatttggacgagcatgctgggaggacaagaagctgtggtcagaggtggatgttcaagttttggaaggtggaacagctaggggtgatgacaaggtgtagggtgtgaatttgagagtggacagttggggcagcatagcacagaaggtcactgaaggaggaaattgaggagcccagagcccagggtgggggatgggagttgtctatatgtgtgtctgttaggggtcgagtttggctgcatataacagacaacccaaatagcaacagcttaaaagagacaagagtatattttttttctgatatagcaaaaagtgcagaagtagacagctcaggtctggcatggtgactccaagatgtcatcagcaacccagagttcattgatctttttgcttcccaggggtctggcactcttcctcatgcttacgagatggctgctggaattccaggaatcacatgcaaattctagtcaggagcaaagaggaagagacacagtgaaaaggggtatacagcggcagaaggaagctcctcaaatgaactctgctagaactctagccagtagcttctccttctatcacagtggccagaactgtgacaagtgaccatccttaggggaaaaaagatgctgagaaatgtgaattttgttgccaccttacattttcaaaggagttccattcgtaagtacagaacgctcagagaagaggcagcagatctaggatatggagcagcagctcttaagggcacagtgggaaggtttcaagactgaggaggatcttggatttgggtaggggaaggcagttcacagtattgtggaggaaatgctgtgaaagagaaagtggaaggcatggaagcttaaacttttaatatgactggtgaatacaaggatgaagggcaaagggaattcagactcatggtggtcagattaagaccttcagcggctctgtctcccagccccacatacccacttccatgttctgctctttactgaagctgaaagtctgcaaccttcattctctgactcccttacattttcttaggcttcttgctagcttctgccaaaaagaggccctggcaggagattagatggcaggaggcagaggtaaggattccatgttaacaggtgctggaagttgctggtgtggcaatgagaactgggccccggtcaaggcagcactactttggtagatccagaatcaaccatgataaccgtgacagtgtcttcaacagtgcagcagtagacacaggcccctggtgctggaatccaatacagggacaggagcagcacggagtcacggaacaccgtcttgccttcatgtcactttaccatttcttctttctccctcttactctaccagctacctgtggagatgttgaaccttttatctgtcgctgtctgcttaggaacagaagaaaaggcagctgattgcttgactcagctttcagcttgatttttttcctttggcagagtgaattggggtcccaggtgttcattttccttttgtagtacctttcctcagcatgcaattaatacaaaaagaacaataaaccttaacaaagtttggcttgtattattccagactttcctcttggattttatgtacacttatctgaatccatgcagatcatgtcatgtgtgtctgtgtgtttatacacatttttttttcggtgtgcctcattctgcaacttgattttttaaaaaattcgataactgatcttggagatctgtccatgttgttacatatatgagatttttgtatttcctttaattaatggtgttcaagtagccgtttatgtaacgatgaacattcaggt

SEQ ID NO: 880 - DNA, 1805 bp, Homo Sapiens
agacccttgccatcagcagaggctgccgctgcgcgtcccctaggcgcggaagaggcggctggtggtccctgacggttttatacattacgaataaagctggcacgtttccatttctcctgggcaaatatttagaagaaaagttgctgggtaattggtggagacaaggtttcgccacattgactgggctggtctggaactcctgagctcaagcaaccggccctccttgacctcccaaagtgctaggattacagaagcactgagaccacagaggcaagagctggggaaggaaaactgcccatgagatgagatgtgcctctcagcttccaaaatcggggagggttgcaaagggatgacaccatccacaccagaactgcatgaatggcatcaggaatgatcagagaccataaattccagtgagaccaataacaccatttctggtcctgcatgctcttccaaactttgccactaaccccttcaagagatgccccccatggaatccagccatcatgctgtgaggaatccaagcagctacatagaaaggccacaactagatattccagctgtagtcagctgaagctccagccaacagccaacatcaaccaccacacgtgaaaacgagcaagccttcagatgattccgactcccaacctccaagccacctcagctgaagccaagtagagcagagactagctgtcccccaatgctctaatatgcagattcataattaaaaagaatgttattgttctaagccatgaagttttggggtggtttgtcatgcagcaactggaactgcctgatcacaccacacacacaaaagcagaaaacaatgccatttcaaaatggcattgggccacatggaatcctgcctcccagccaacccaactgcttctagctcagcacttcctatttcttttttcttttttcttttttttttttgagatggagtcttgctctgtcacccgggctggagtgcagtggcacaatatcggctcactgcaacctccgcctcctgggttcaagtgattctcccgcctcagcctcctgagtagctgggattacaggcatgcaccaccatgcctggctgatttttgtatttttaatagagacggggtttcaccctgttggtcaggatggtctcgaactcctgattttgtgatccacgcgccttggcctgccaaagtgctgggattacaggcgtgagccaccatgcccggcctcctatttctcaatcacaatcactacacaacttccttcagtagcattggtcactacctcttttctcagtatccaagttgaagaagagtgaatttatgacctctgcagcttgacaatatttacaaagaactctcttgagaagtgctttataaaccttgtcatttaatcctcatgcagctctataatttaatatattatttccattcaacagagcaagacacaaaaggtaaagaaagcaagtaagccaggtgcagtgactcatgcctgtaaccccagcactttgggaggccaaggtgggaggactgaggccaagagttcgcgatcagcctagacaacatagcaagatcctgtccctacaacaaaacattaaaaaattagccaggtgtggtagtgtgcatctgtagtcctagcttcttggaggttgagctacttgaacacctgagcccaggagtttgagactgcagtgagcctcatgattgtgccactgcactccagcctggacgacagagcaagactctgtctcaaaaaacaaaaaacaaagagggcaagtaatttgcctaaatttcagtaagtgtcagacttatattctc

SEQ ID NO: 881 - DNA, 1733 bp, Homo Sapiens
ggtcttaactgagtgaagttgtgtcagactcttgagccacagaaatgcaaggtcttacattttacgttgttttaagccactacgtttttggtaatttgttatgactgcctagaatcctaatataccaccaaaatgtgtggcaaaaataattattctattgacatttaagaaagggatgggaaggatacaatttttaggaaagagttctactgaagtgaaatttgaactagctttgaaggactccggaatatgaacagggtttaggaggaaatagtcattccttccaagcaaagttcacagagaagaatctgaggagaggcctctgactaaagcagaaggcttgtgtggggaaggagttggaatgaactctggattagaaatgtgttctggagggctttgcctacaacatgagaaatttgagctatcggaggaaattcttatttcagctcacccctatagagaagctatatgagtttatctgcttgctgcctaacatgcactgacatcattgcatcttgctgccttctcacacgcctcttcagcaacatcaaggacaacaaccaacaaaaagaattcacatttattgagtgatgactgaatactatgcactatactaggaactgtattcatgttatatactaaatcctcaaatcctgtttttaaatgaattcattgaggcttagagagattcagttaactcacattaggacacagaactaccagggacaaatccagtgttcaaatctagagcccagagtcccagctgttttatgcaaggccatctatgaacatcagatttgcatttcatttttcttgcctggagaatattttattcacgtgtgttttattaggcatctctagatacaataaagattatgcatgctgacatatgtataatcaactgttttaaaaatgaaactgaaaaatagatccagtcattcagaccagagagaggcttataatgaccacagcatgattcatccaaaaattgttaatacgttatggccaaaaactccagctggttacaaaaatgattcaaggatcaaatataaacctaagcaaatttgcatctgagtctaaaaaaacacctggcgtttatgcaactatagagactactatccccacagttttatctgtagtgaagtgcagctgggaccccagcgttgaataggttaatagaattgcttttgttttattccgttgaaatatctctctttgctcccatcattctccatagattgtcatgaccggaggtaaactgaacatctgaaaaggacctaattaacattgtgcgcaagtgaaagaataaatgaataaatgaataaaagaatgaatgagtacggatgctgagaactgagatgtggcatttccatactggcagaagctccgaaagaaacagtcatcacttcctgtcctactgcacgcaatgtgttaggcagtgctttgctgaaatccagaatataaagttaaactttatgagttaaaagtttgaacttttgagcgagatgtaattaagcacaaattagtttgtagaatcctaaatgtcagtgcatctaaacaaagtacatctatgtttatttgaaagcaaaaaacgatgacacatttttagagaattaaaataaactgatcattgaaattgaattaatttttaatggtaaaattaatttgagtgaagtagaaagaatgcggctcataatgttttattgatgatgcataaaaatgatcacaagtca

SEQ ID NO: 882 - DNA, 2603 bp, Homo Sapiens
gcccactcacacacatagagtagcatgttatggcacttacactaataaagccactgctatcaaagttctggacttgatttccagcagtattagctctgttttaccctcaagcttctgggttagtgggttattgctcaccaaagaagttctggttggaagaagaggtaagatatctccagagccgctgagaagaatgagtaaggtaaaactggtggcattcctgactgaatacccttcactcacaggaggcagtgtggaacagtgggaatgaggagtgctatgggactttgtatatctggtctggaagcctgtttctggtacgtacagctagggatttgtagaagacttcaggactccagatgactctgaaatacttagcaacagtagaagataactacataagaggagcttggaactttggctcaccatggggaagagcaccactgaaggctgactatatctgcactgaacttgatggagcaagaataaattttactctccactaacatctagggggttgtattttacagcaattgccaccatcatcaatatagctgatactgtgagacagaaggtaaagtctgaacaagtttatagcctcagtgcaagtagctgaagaacaaaaccactaactctgtgtgaagaaggatatcaaggttttttaaaaacaataaaaaatgatagtgttgtagacctagttacgcatcatataaaatcctcccatacctaccagcttatgtattcatcctgtctttgatcctggcccttgcctattttctaagggacagacgtaacgataactcagggacttcccaggtccagactactccccctgctctaccaccaacagaagtttggcaccctcatgcgatgcattggctgacaaggaaagacttaccttcacatggtcatgctggacccacgggtatctgcttctctctacccagaggggccaaattacacatcctctatgtgaaatgtgaatgagtcaatgctccatggggcacacttataccaatgagaaaccaacgagaaacagaatatgagattttctctttctacaaaattttagaaataaaataagaaaaaaatagttcacctaaattaagcaaatattttcctataaagcacccacattttcttgcaataaatacattaacctggagaaatgtcactaacatgtcaaattaacttctcaattaataaaggccaattttgatgtatttctagcactttcaagctagaaataatgtgaatagttttaaactgaagtgttttacactttagttttacagttttacagttctggtaaatatttggcttctgtgcttttaagttactgttgtaactctgaagccatattttgatttaatcctgaaaggtttcagaaagaaatcatggactacaaaacttgtatagagtaactcttttgttttaagcaaataaatacaacgttaaaaaattctgcattggacaaaagtaaagcagtttagcttactcaaataaaacacagctgaatgatgatcagtgtattcttctatatgttattgtatcttcaacctcaccagacttttggctggtagtcccaacaatgtgtcctaaacttcatattacctgttttgatgttgattttcactgcaactgaccataaacacttcaagttagagactgttattgatattatttctctttttaattattaatgttatgtgaagtaacaagcatatagtagggaatcaataaggattagagaaattaacttaagaggaaaaatacacatctgaagctgaaataaaatactcagaagggaagtattacgggagatattttaaggacttgacatttcattgattaagatttctttttttcctcattgtgtagtatcaaagatctttcaaaaattacagggatatcaacatagaagaacatatttagaaacatcacataatgattccaaaatattgtctttacttttaagattttttagaaatctctctaacataaacttccttgggaatgggatcacttaaggataaggaactttggattgctgcagagccataaattacaaattccaaccagctgacagattgaactttgaaaataaagaaaaatgcaaacccacaagtttaaaatgtaaacatgttgcccaaaaccattaaaaagtcagtttgcatgatactctcaaggttgttttttaaaaagcctgtctgttaagtaaagacagtattgttcaccctttgaagctgattctcaagaaggggtgcccttctgctactctctatgaaaataaaaatgaaaataaaatataaggttttatttcctgcttagagttgtcctaggcctgtgctaatgctttctactgctttatttctaaaattttgtatatgaagctattgctacaggaaatcttttttttcttaagactttaatacctggtaatcacactactgtagaattacttctctataaggaccttatcagtaggatttagtaggcaattcaagaagataacaagccatgaaaagatttggaatttttctggctatgagataatcaatgatgttctataaaattctgggaattatatcattttggaacta

SEQ ID NO: 883 - DNA, 1866 bp, Homo Sapiens
cagtgatcgagtttcacctttgtaatgaaattcattgcaaaaggagaaaacaaatggaaaattatcaagttcagtgatttaatttgtactggacaaactttaggcccaaggaaggtaactgaattggccacatagctgatagtattcttcctgtcatgatgaaccatttgaacatagttgtggttctttaaactataatcttaaatgtacaatttttaaatttcatccacacttgctcataaatatggtgtgtatcttttatgatgattctttggaagtatatgataagtaaactaatggaaattcaagatactcatacagttttaacaattgtaaaatttcttgttaatcagtctggttatatgagatttgtgttgattctgaacattcattttgtagtaataggcttaaaacacaatggttcaggtgttcattagtttatgcatttgcatgtaagtaacagtagtaaatttttaaaaatgaaaatactttataaatcatactataagtgtcagtagtttaggcatagataggtactaagcttaaatattacatagataacaagtttaaatattacaataaaagaaaaagtgggttttcaaatggatgcttgctacttgggatttcttttatgggtcattttgtgtgaaatgagacaatccatgtgcaatgcagcaaatttttttttgttgttgttgtttttgagacggagtctcgctctgtcacccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccacgcccggccgcaaattttaaagatacagattaacataaaggatataaaataatactgccactgagaggtagcatcactgttaacatactgacatacattgttggtattgagctggatggggtgttgattatcctctcccaataccaatacccctaacacataacattgtggtacgagttgttattgatgaaagtatactttataagtgaataaaagtggcatactttttttctgtggacagcattgtctaatttttaaaccaaattaagaccatatttactgtttcctctgttttggtgatgaatatattttaccatttttttcttatggatttttaaagtgaaatggtaaatacctgattagtgttttaatgatttaatttgctgtctttttaagactgtttttcctcccctactttactgctcagcaccttaagaattcctgagctcattctggtttccttatgggctgtcattagatgcgtcttcttctattgttttcatatctttatttgagcatttatattttattcagtgatttctgcatattgtgaaattgtaaaaacatcatatttatcataggatctttgaaatctccagtgtttctctgtatactgtgtttttctatttccattataatcacataaggaacaaacttccagtttaactcccaaataaaagcctcattactgtataaaaaactttggaggcttaatttgctcttgtgcattcaagcaatatttcagataaatatgacaaatctattgttttttaaactgaggttatatcaggcttaagatttttttttttaatagagcaccgatggttgattgttgattggttttggttaggtttcctaaaggctgttaggattggttttaaaattagtact

SEQ ID NO: 884 - DNA, 4926 bp, Homo Sapiens
gagtaacttctctactcttttattaaaaatggctaacggactaaatgtcagttacataagaaagatttaggtttgtctgtgaaggtcatatctaccggtaccatgaaatactgagaaaccacgttgttactctttttatctttcatttgcttttaactacactgctttctttatgcggggcattttatataatgtacctaacatgccaacagaaattgtatgttcttcataaactccagaccaatgtgcttttgcagtgatagaagtgacctgtgaaatctgtgtcaacctcagagccagggtaagataccgtcatcacactgccagcctgcctgcttctctgggtccttgtggcaggggaaggagatgagacagggagtaggagagagactgactgctacaaagggacctgtgcagcttcactcttatagccactgtctgtgtggatctcttttgacaatcatcttttatcaagcaacataaaaatatcagtactattaagtatccataagaaggcaccaatcatgagtggatatttccatatataaaacctaggtttctttcctttcaatatgtgcattgagttcaattctcatctggaaacagggaatgaaagccgcttgtatggatagttgtcaggaagacatatacaggatataagttaaaagcacagacaagcatgttctgtgtttacagggggcaggaactctctcagcaagaagtcctggtacgacaagacagttaaaggcattccaggaatatactgttttcatttggctgtgagtcttcctagaaaatgtaaaagaaagttttccctgttaagataacacattttctctttatggtttcatgagggcagaaggaagctctcagctgttcttacataaagccttgtctgagaggtatgggatgcctgatattttttatgcttagatttatataacattatagctcttcttctctttgaagaggcaatatggttgaataagatcataaatttaaatttactattaaaaagtattaagtattatgtgtaatacacactgatttttctaaaatgcaagtctgatcttgtcatctctttctaccttaaaatttattataggtctcctattttttagaacattaaaatccaagcttcttatgggatgcaaagcacttggtggcctcatctcattgttcttctttgtacttgagcatcatagagttagttacttgtagctttgaattcgtattatttttccacacctctgtgacttggtgcataggctttaataagcctgaaatgtcttccctctcttcctatgtgattgattcctatttatcctcaacacaaaattcagatatcgcctgctgtcttgagtcttcactgacttaaaagcagttcttatgtaggacctctactcctgttcatatttatgatgttgcctttataatgctatattttgtctgtttcatcctgtgtgcctgtattttttctttttttatactgcataattcctgggatccagattcatatttccaaaaaaacatcattgtatttccagcattttacacagtccctggcatatggtagttgtttataactttttgttaaagatcttccattttgcaccttatgataattgttagataaaaatctaaaataatgcatcactagaaaatgtaacatagtaaataaacattgcatatgtgtgccttataatgccatgtagaaaagagtgtgctcaaaattccttattggataaagaagcaaaaggtcatcgtgacataagtctgatgcacgtaaattaaagagttatttgttcaacaaagaacagcaataacaaagtctcccaaaatctgatgtcaggattagctggtgaaaagattaagatgtgttttttttttctctcattgtcccaatacctctcaatggaaccaacaaatatctgctgcaatgtctgtttcttaaaaattacctgttgggcaccatgtacactattcaagttgatgggtagactaaaagcccagacttcaccactatacaattcattcatgtaaccaaaaaccgctagtatcacagaagctattgaaattttaaaaaaaattagcctgcttcttagccaatcactactgaagttctgcaacaggcctatcaaccaagacgtatgagataaattgctcattccacctactgtttctttgtcagggtactcgcaaagctatggacccaagtctttgagaagccctatcactaggaataaaggataagcatgaattaacagggacagaagtatacgagaaattttattttgaagcaagatttatactaccccacttctgtaagatctgaagtatcagcactatttgacttgctgcagaggaaatcagaactagtgtgaggacctgtaaacttatatcagcaacttggaccttgcctggccaaagctgttagagcagtatgttgagacacctggagctacagaaggagtcacgctcactaaaaagatgccaggacatactgagaaagctaaggcagaaatagcacaattgagtcaagtgctggattagggccagaaaatgaagaaaaatcacgctgagatataattggggaatagaaggatctttgaacaagcatcgggaatactaagtagtttttgagtggtgtgtagacaggtaatcttggaataaaatgttttgtaaataataaaaaacaccctctatttcctctatgggataaacattttcttcaaagagaagaaagtagagagcttatctgtgccaggaattctaaggcctcagtggagttactgcttggaatttctacccaatcccctggtagcaggcctcctggccaactccatggagcctgggttttcacaaagctggagccttacagaaagcacaaggtaagactgagaaatagaaggctgactttaagaaaaggagtacaatactctattgaaagttgtcatctagatgttcttctacctgagtgttttctggacaacatccttgttcatttggcagtcaagtctctcaagaacgcttagagggatgattgatgacctgggctggatcccaattctggaacaagatggcatatcctcgcttttctctgttcctcagtggccctctccaggttgcccaatgacagtaggtagcccaaggaagtaccttccacttccacagatgacaccagaacattgattgagcagtaagcccaacagcatgcgaaaaatgaagaaccattcaaccagaataacattgcaagagctcagaaaactaaactttcattggaactaaagccaataaaagtaggacagacctgacaagcagaacctaaacaggacaactgcctgctaaaacagaaggtgtaaataggatcaagtgtctcctaacataagaactaaaatgtccaggatgtaacagaaaatcattcatcaagaaccaggcaagctacaatctgaatgaggaaagacaatccactggtgccaataataacaagataaattagatgttggaatatctgacaaagattttaaagcagctgtcataaaacacaccaaaaatcaattacaaatcctcttaaaacaaataaaaatatagaaaatctgagcaaagaaataaaatgatggaaaatacttgggatagcttgcatagcaccatttccaggccaacttctatgaccctggctgcttttcaactaatcataactattagacatgttaggaacagttctggattggaataccccctgggacaaacaaggatatgtagtgactcttaagtttccttatctgtacttcaaatttcacccctcttccctcttttcctaattttcctcagtaaatttaactctttaggaaaggtcagtggttcactcagctcctggacatgattatagtattctaagaactaaaaataacatgtattcatgctctgttcagggactacccaacccgacctgacttgttgctgtcaaaattggcaggtacctacaatactgattggggtggggagggtacccttttgttaaaagttcctggttttactgtctctaagtctatacctagtttgaagatagatggttttagtgaggtcacatatactaatggaaacagagtagcagctgatgaccaagattgcctttagagtttagaaacactgccttgaattgggcttatcctaagccccaaattttagcctgcactagccaagttgattttattattagaacactttaagttcatatctgtcatgtagcaagcagtggaaagtaacagccagacacccaagaatgttatcaaggtctccaagcactggcaaaggcattatgcccagaaagatccttgcgatgagacattttcagccattcaaatgtagttacaactgaccaaggcaaaatggggaaataatagtacctgcttcatcaggttgttatgagtattacatgagacagcacattagttataatgatgatggtcatggtgatgacttttctggaaaccaaagaagggatgctattctgcagggcttagaagtagaggagcataaccccctaaaaacagtaagagaagctaagactaaaggggtgggttaagacagagcccataatgcccaaatgccaaaagagtggaaaaaaagcaacaaatccgtaagagaaagacaaaacagagggatacgcgctggatgtcaagtcaagaaagcagaaccagagggtgaaaacagcttaagatcaaatggactggtggctgaggggtctcaaacaatgtccttcaatgttgtcgctatctgaagctgacttttatgatgcaatgttaaggagtatgacctgccttataggcccaaaagtgggaaggcagttgagaggccatcacaacaaataattattcaaaaccagtttttgtattctagttttggtggtggaaagctgaaatgctt

SEQ ID NO: 885 - DNA, 2406 bp, Homo Sapiens
acagactagccaagtggctgagacgagtgtggggtgcgtgactctgcctgcgcgcgcgccagccccgcagctctcgccagagccttgggatcaagggagaaagagaaccggcagctggcctcggactctaagcggtgcgcagctccagcccgagcggatcggccctgaacccacaaaggactcctcgctccttcaagcctccaccacctcgcagccggggaggcaactggagcgaaaccagcgacagatgcagccatggacaagacaaggagagcttcgtccctcccgcccctcgggttccttcctgctggggtctgaccgcgtcttctgtgcgtgtgggatggaggcccggctcgctcgggctccgagctgtcccccggctccgctttcggagcagcccttgggcgctggagaggtttcccattgcggtctccaggtcatggccaaggaggagaagcaattagaatgggggaaagggtcccaagacaaaggagagggaagcattctgcaatcccatcctatttgagccccgcgcaggagctggactgtccgccgtggctgggggacaaggtctcagcccgaagctcatgaggtaccagacagtgcctgggcttcgccacctaactcacaatgggtcctgaaccgcccgggcagtccccggggtcgtagactggggaccgctgcacccctccccgcccgcaatgtcccttggagtccgcacctgaggtcccaggcaatcgccgctaacttgtagctctcggacacggacaggtgcggtccatgcctggtgccggtagacgcgcagaaattccacctgtgcgcgctgcccggcgcccctggggcccctcacggggtaagtagagactcatctgggagaggtgaaaattccccagaattattgacacacacggcggcacaccctttgcctccgtccgcctccagcatccgcatccctttctctatcttcctgcccattgccgtcctcgaggctgccctgagatacagaattgtcccaggctgagtccaccgacccgccagtccctggcgatgatgccaaggctcttgcatgtacggaaataccagcagggaggttcgccaggggcagagaggctggaggagaacagagaattggaggtaaacgcgtaaagccagcagaactgtcggtggacatttcacccaggccgccctcccgcgtctttaagtcagttcaccgccacagcacgtctgtgactgcggccacccagggctccaagtctgccagcccaggcgccgcgagccaagaagagcgcggcgcctcccactcctcaagctccggaatcccccacatcgactttctatttccctgtcttcttttcttttttgtttgttttgcttttcctgctcttttcttagcgctgggtggcagtgggtatgcggcagccgtgtgatttgcccatcccctagtacacgcagccagcgacacaagcacacagcgaccagtccccacgctgtgccacacaccctccagcggtccggcgcgcagcccctgctccacagcccgggacgcctgcagccaccgccagggtcatggccatggcccacgcagggctctgcgggtggagaggggaagtcagcctagactccagagagaaaccctggggcaacccgaaaggcctgaggaaaactggaattggggttaggcatgaggggagggagtctctggggaaaacgggccgggctgtgcggagccctgagggctcctgcggctgcagcgctgcaggccgcccgcgtctcgccccgccccgccgctgggcgtccccgccaggagcccacccgcgggcggcagcttttctccatgctgcccagggaagttcgatgcctggtgctgggatgcgccagcgcttctgttcgcttctggcaatcctggcgtctcccaatgagagggctctcaaaatgaagcttttaataaactccagagtaaggaactcgggattgtgcggcaaaggccgcgcattgcactttgtgagcaatcggtaaatatgcgcaaccatatgataggaaatatatgcattttcattgataagaaaaaaagagatgatggtatttttaaacagaagccacaaacaggcatacctgtgccattgttggggagctaataataaaggcactgatgatcacaggagtaagaacaattgacttggccaagagacaattttaagctgggaactgtattcggctgcagttcagaaagtggacttttgagacttgtcaaacgaatggaagaattttgtgccaacaatgtcccagctttgcaggcttggcagctgaggactcagaagtaacaaattaatgccaggtgaattattattgttactactattatcaaaatgtgttccagttgcagcaatacaatggataagcaacttc

SEQ ID NO: 886 - DNA, 7999 bp, Homo Sapiens
agtgacgccatcagccgtcgcctgagccgtggcgcgcgggtggccgaaaggcgaaagtgagatttcaagggccgggtctggggccccgcgggcgcgcagtgctgcggcgtgtggggagtacggggaggctggagaggagccggccccgggcagtgtgaggtgcggaagcgcggtccagacactttgctgacgggaggccggtccgccagatccgggaggtggggcctcgttctggactgctgtacgtagttttattcctggtcatttttttccaccgccaaatcgagagatagagctttggatcatgagagatggcgtcgtgttgggaaaagagccttctttacctgagtttaagctcggctcatagacatcctctacctgagtttacacgtgtgtaatatgaaggcagtcgattaggagatgtctaagatcattacttacacctcaagtttccaaggggaggaagacacgggaaggatgcgtggtctgtgccagactttgtagacgattcactgaatgaccctgatttagctcttccggccctcttcgattcagcttggaagcaagcataaatagtgattgttgtctgtatacttctctcggaaggaatgctgttatgggagttgtgggttcatttttaggtgtctgaagaagtttcaggacttttgaaatgatagtggagcccattgaactcagaattatccctttctggtctagtaggagtatagtggcatacggaaaatgaagcaaacatcaaagacagatgtactggcacaagattaaaagtatgtctcagctgacatagttgccattttaagactgcttagtttagctgaatatgcctggattttttttttttttagcattttttttctttttagcattggcataccatatgaaatgtgggcagttgccagtactctacagagtaccaaggcagaattggcaatgactaaatcaattcattcaaacaaaaattcatcatgtgcctactgtgcgcataatttgtggaatcaaagtctcttgtttccaggggctttacagtgtaataagtgctatagtaaatatatatacggagtggtaaccatctgcctattcctctcctacagtcgttgctgagttccagtgtagaacagagcactgcattgtgtatctcaccactactgatttagattttataatttcagctgcatccctccctcctactttgtatattcttcagcatctttttctccctttccacttgaatacttttcgcaatctttaaatcccagcccattttattatatgacttttaacttagacttcacaattttccaagtgctagaaatttcctgagattgccttttctccagtatcaacgaatgagagactccctgttcatatatgagataaactcttcatacatattctagttccaatacccctctttctcatgcatttattatcttttctgttgtcaaccttctacaaattctggttccttagctaattcttctgtagctttcaattatttccttcacaagcaaactttctttctttaaaaagtattctatactcaggaggctgaagcaggagaatcgcttgaacctgcgaggcggagtttgcagtgagctgagatcctgctactgcactctagcttgggcgacagagcgagactccatctcaaaaaaaaagtgtctacaatcagtgtcttttttgttttctgaaattgacttgtcagccctctgcagtctagtctctgtgtctatcgtgctgtgctaccaaaaatgctctctttaaagtaatctcattgtttggaagaaaatgagttttttgttctttaatataatagtgaaatgatgatcctgtttcactagtaggataaggttcaaaactattaaaatggacaaggcatgtaaagtcactttcttttatttttatctttttttccccccgttagaacctctggcagggactgactagcccatgaaacttatttcttcttcccgggcacacagctaaactaaatttcacagctttccttgtagttggttatagtcatgtgatgaacttctttttttgagacagagtttagctcttgttgctcaggctggaatgcaatggcacaatctcagctcaccgcaacctccgcctcccgtgttcaagcgattctcctgcctcagcctcccaagtagctgggattacaggcatgtgccatcacacccggctaattttgtatttttagtagagacacggtttctccatgttggtcaggctggtctcgaactcccgacctcaggtgattcccccacctcggctttcaaagtgctgggattacgggcgtgagccaccgagcctggccgtgattaacttctagccaattaaatatgaatggaaatgatgtgctcatttttagggttaatgaagtcctcctattctcccttactctttcttcgtcaacttgatgcctttgagcatggtgaccttcaaaactatgtattggagatgccaaagccagaaaagagaagaatgagtggctgaaacagtacttggaagacagccaccccaattagaaacacccctttttgcacttactgtaagagaaaaaattgagatttgagaatttatatgtataggagctagaatgaccatagctagtccagaaattggtacaagaagtggagtactgctaaaacaataacctaaaatatgttacatcagcttatttatgatgcagcaggtggtagagaatgtgatttggaggctagaaaaaggaggcccatgtttgcagtggcaaagtaattagtaaaactgtcacctgaaataattcaaaatcagatcacctatctgtttagattagctccagaggaaatgattgaaaagagcaaaagtaatactgtgttgaattttacattttacttttagtaaggttttactaaagagagaaactcaggaaatacttcacagaagtgagagtgtacaggaatatttctcaggaagggttggaaaagttgacttttataagacttctaataaaaaaaaaaaaaaaactagaagaggtcttgagtatagttacccttgagattaagtcctgcaacaaagatcaggaaaagggtttggtctttccattcaaagtcattattttagatggcttcaagatagctacgataaaggtctaaaggaactggcataggagcaaggcagcaaagcagtaaattaggcttgataattatgtaagaaagaactttgggtgtagttaccagaagcaaatcaatcagaagactacatttttagaggaattttattaatcatactaaatctggctcaaatatcattgttcgggtgttaaaacagagggtaactgtccaaccccaagcttgcataagtagaaaaatagagcataaaaccttaacagctccccagtacccacacaggatgtggccatggagaatgatggacaaaaaaagaacatttcagaagctcgtataaggagctgtactaaagactggacagggagtttctcctgaagactagaattggagtttcatcagaactttcttcagtttcaaggagatgggccgcaaaatgtttatgcagtatttcatcattattatacatgaatagtattgctcagtatcacattttttttctgaatgagagaatgtattatagttatctgtccctgagttaccactatatattgggtttgcagggatgggggtgacaataaagataatttgtctttttagttcttaggtcacatctgtacctaatgaagagaactgcacattttctgaaaatcctagactttgagcctgttccagtaactggttaaaactttagattgtctcctttgggacagggtatgttctgtgtgtggaaagacaggtaaaatacatgtttagtgatcagaatagtagattcttgcaaatgctaaattcttctggccacacagctatatttccatgcctctcttgcaattaggtatatgggttaggtgtgctgattaggttctaaccagtggaatgtgagaagtgatgcactcctattccagctctggcctatggaaacatcacatgagcaatccaatatatcccactccccatcaacttgaggcagatgagcaaatttgcactggaaactatgtgttaaagatggcaaagccgcaagataggactcctggtttcctgaatcttcacttggaggatacttgcttcccaattagagacacttgtgctagagtttcctgactcttcactgggaggatacttgcttgccaattagggacacttgtgctacagctcatacgcattcttttgtgttaggccactgagatttcagagcgtgccctaataaagacctgtccctctttctccagatgcaatcgttcattacctaattctaatttttataccacaggagtaggcccacaaatcaggctagccaaagtatcctatcattcagccatagtgattagttcaggaatgggcagattaacaaaactgaagttaatcagagatagtcttatcatttgggctagcactatcaagaaaaagacacctgcttctggaataagcaaaaaaaaaaaaaaaaaaaaacacaagctacatctggcctttggtcatcatgtcgagtgaacctgcctaagaatgaaatcttacagggaaacagaggcagtctcaatgatactgcagaaggggaagatatcccatgaattgagaaatatttcctgggtttctactcgattgaaattccaagaggtaagggatagatactgccaggaagacttgggaattcaaaagaggagctctctgagactagagtcacatcctgacacggctcttctccaatgtgctggagtcctcagcatctgctggtcttgattcactgatgggggcaaccagtgtccccttaagtgtccgggcagaaacatactgtaccttggttttagaaagtaggttggcaggcatctttcctcattcccatcaaggagttggtaccttccacagtgtaagttattttctctgttctagagctactacaaagtgctagggaaggaaaatctcctaaagcagtctgtcatcatgaaggccaaattatgtagcagaagagcttggaaaaagattaagacggtggtggggaggacctttgtcctggtggcttgaagccatagggaaagaggttcactaaatgccaacaaatgctaaaaaataaaaaaatagacaaaacagcgagccagtggcttgtgctctgctttccacctgaaagtttgcccaacataagcaattataatcaagtagaaattgaagcatatgtttaagcagagaggaccaggtaacattgataaccactgtcctcccagccactgccttaattaggctttcatgagttttcacccacattattgcaatagtcaatctccctgcctctgatcctattatactctactttatcctccacattgacacctgagttacttctctaccttgtaaaaacaatttatttctgagtacaaaaacactacatgttcattgtaaaatactaagaaaatacaaaaaagcacacataccagaacatgcaattctatcatctagagatatccactgttgacattttagtacaaacctttacacagttgttttctctgtgtatttttaaatgagaatgccactgttgtatttagcatgctttttaaaattttttatttatttttatttttcaatccaccagtaagatatcccggagcatgcttttttttttttttaaacttagtatatgtgagcattttctcatggaattaaatgccctctacaatattatatataattaatatatcaatttacttaagacaggtgttgcaaactggcagcctatagccaaatgtgatatatgaacatgctatatactttgtcattacagcatttcagagttgtttgacttttgaatgcctttatacaatgcatgctgtcttcaattctctacagtttccataaattcctattatgcccagtccttattcactcatgtcacctatctttttttgttgttgttactgtttcggtgtgggcttttaagaaatttttgacatttgagttgaaaacagcaatttagccagaataagcatggatgttcattcacttagtatttgttgcctacctgctacataccaggcactgggttaggtgagaaaatggttagcaaaacaaacacggttctttctatcttgaagcttatggtctagcatgagagacacacaaatgaaataactgctgcaagggaaacctgagctagaaacttttgttttgttttggggcttccctgaggaagtaatatgtgaacagagatctatagtaggaaataggccaaaaagcagagaagaatcttcctagccaaaggaatgtatatgcaaaaggcctaaaaaaggaggtatcaaactgtgccaaaagagctgaaacactgaaagtgagaatgtttgcaagatgaggctggagaagtaagtggaagacagatgattcagggcctgtggaccatgctaagggttttgagatacatgttgataaagaatctaccctagtcttcttttccttagggaaacatccttctctttttaatcactccttatatggcatgatttcgaaatccccttcaccctcttactacccttctctagcattaataattttcttagtccactgctctggaaccagagcccagtaaaaattagttaagctgaaggctggggatggcagtctagcacaaatagtaattaactactgggcacattagtagaacagagctgctacctaaataaatccatttaaagtcaactaaatgttatttgggtaatatgtccctcatgttaaatttgcccaaatatatatctcacctcttaaaattcgtttagtttgaaattaaaattagtattgtttttctgcatgtactcctaggttgggtaaagaagggaacaagggaatggggaaacgtagagattcctggataacagagaaagacagcttgagaataaaagtatgcaaaagataatctacaacaaaataatgcacttaactcttgttactaaacaaataagctacccacattttagttttctgttttgttttatgtttgtcagtttagcaatttttgtcactgtttggaagacttagagtggttattgcatagaacaactccttacacagagatttgcaagtttctgaattttgtactttcaaattgaaaatcaggagaaacattttcaaggttcatattcagaccaagttagtatattaacaactaataacaatattaaaagttagaacaattcctttcctctatctttctcaggacaaatcgagtttattagaaaactagggagtgatctggtgaaactggaaagaatccaaggagttccagggaaatctttcattcattcatttgtagattattccacaaatgtttattaagtatctatggtatttatacagcacctacagtactatttagggcactgggtatagcttacaaactgcttaactctgaatatcttttgtgcaaggaataagtagtataatagtcccttgaaatacaggaattcacctagagatcttctcagatcctcagatgtgcacgttttatatcatgtaacttaatccagaaaataaagcataagcaaactgatatttttacacagcaatgaattttgaaagcaggcagagcttctagtctcatataaggggcttagaacttgccactgcatcctaataacaagtaaaaagctgaacaaacaaaaatcaacaactcttcttaacttcatcagaaatgaggacacagggaaaactgctgccctcaaaattggagagacagataggaagatacaggaaatcataaccagagcagaaacctctgggaaccagtgctggggtaggaaaacctgaactgtaattgatgaaatgctgaaggctcactgtggacaagcctgagagtcaaaaactccagggaaacccagtcatagaggagccct

SEQ ID NO: 887 - DNA, 5082 bp, Homo Sapiens
gtcaagcgtgcggcggcggccgtggaagggaactccctccactagaatatgagctccttgtggtcaagactgggtcccctgttcccttccccccagtgccagcggagcaaaggtcagtcagcggcataagttgtacctgctgggagaactgtctgcttcctccgggtgacttttctggccaagaaggaatatgagtatgtgcctccctgagcactggcctggagcccactcaggaaacaccatctcttcataaatggttttgattgcaggcattgttccttctgctctctggatgatggaaattgcttcaggtcactgcactatcttccaacgtttttgtggttgccatgagctgttgtacagaccacagtttggggcctgagacaagctgggcatggtgttgcatgcctataatctcagctactttggagggtgaggcaggagaatagcttgggcccaggaggtctaggctgcagtgagccatgatcataccactgcacttctgtctgcgtgacagagaccctgtatcttacataaaaccccagcccatatttgtaccacatctagatacgaggtcagagttcagatgcctaaatattgtagcttgtgttttgtccactgttgggggaagagtgaagagatttgacataccataatgttgattagcttgtgatggtttggcggcagcttaggccagagcataaagtaaaaaggaaaagtgttcacagacaatgaaaactgggaccaagtggtgaatactcaaggcacacagaccaggcaaggatcccagtggccgtggatgagtctcaggctggctctgggccagtggaacacacctcagtgtgggtgaaggcctagccagggtagcagagggcagggctacagaacagcagcccaggtggctgtggccgacctgacattctcctgtgaaaatcaggtgcccaaccagcactaatctagatagatggcagcattttttttctttaaagacaggatcttgctatgttgctcaggctggtcttgaactcctgacctcaaaggatcctcccctcttcagcttcccaaagcactggggttacagatgtgagccagcacgcccagccgaatcacagtatcttagacagatgccatggctgcccatagggtcctctcaaggtgcctctgcccttggactggcttcctacaccaacctgacaggtgcagcaaaggtggactttctggtaaggctggaggaggaagcctggtctgcgatggcctgagacgccctctatgggggttgttgagtggatggaaatgtgcagggcatgggtcctgcccccaagaatgcaggctggttccgctgggcacctgcagagggctgatgtccttttcctgaggcctgctcctgtgccttctaaccctagggtgagaagatgggctgtgttcacctcatgcccaggcccttcgaggagtgtgcccttgggggtcagagccctcctgtggctggtatttctttggatcatcacaggtgctccagacatcctttagggagtctcaggcttggtgaagggatccattaaatgttgcttagttggtttttgtttgttttttgttttttcgagacagagtctccctctgttgcccaggctggagtgtggtggcgtgatcttggctcactgcaacctccacctcccaggttcaagcgattctcctgcaacctctgcctcccaggttcaagcgattctcctgccttggcctcctgagtagctgggattataagcgtgtaccaccaaccctggatgatttttgtatttttagtagaggcagggtttcaccatgtttgtcaggctggtctcgaactcctgacctcgtgatcctcctgcctcggcctcccaaagtgctgggattacaggcgtgagccatcatgcccagccaactggtttgtgattaaatgttttgattgatgcagtttttgaaatgtactgtgtgtacaatattactcttttgagacagggtctcactctgtcacctaggctggagcacagtggtgcagtcatggcccactgcagcctctgccttgtagcctcaagtgatcctcctgcttcagcctcctgagtagctgggactacagttgtgcaccaccatgcccacctaatttttatttttttaaagatggggtctcctgtgttgcccaggctggttttgaactgctgagctcaagtgatctgcttctggccagctactactcttaaaagtagagttctcagagcaaaacagctccctttcaaccttcagtccggtcgaaggtgtggtgggggtaacaacagcaggctcatggatacctgggcagtgctccgaggtccctcctgtgttcccactgagcagcagcctgctgtgcccggagtggaggtgagaaatccagcagcagcgcggtggtgagtgtgggccctgcggagtgtggcaggcgctcattatggtgcagggcagtgttgggcacagagaaggttctcagaaaccacagtaacccatggttagttggtcacatcccagaccctgacctagcactggctggcactgtgacttgtcactctcctgaatggaagaagtgtccacctgggggtggctgaggaggtggatgctaggggactgctgggagccacggacctgtggaggttgggagaggagactgcaggcgcaggctgctggaggcgaggaggcctctctggagcgccaggccatacaaacaggtcccaggtggggccacgaggatcaggttagacttgggacccgagagacacgtcatgcccactgtgcaggtgccacctcatgttatcctgcaccaggggaggggccagcccaaagtcctggctgctggcagcatgcccgtacagcttggcacctgggtctgagttcacatgtctagcaaagctgggaaaatccaggagcaagaaggtgaagccctttggctcagcccaagctcagaaggcccttgcccgatgagccgaactgctgacaacaccctggcactgggcttggggactcccctggagcatgtaagaagtgaactgggagcgtgggagaaactgtctggcaggggctgctgcctcggagctcatcctccctggctgtgctggtgtctgtccagtgggattagcctccatcctgtggtttcaccaccccaccgcctctctcccccacagcacaggcagaagcagcaacgcaacacgagaccacctcgcttggggctagtagcagttctgggaaaggctcggtagggtctttgctccctgcggaatcaagggctgggggctgacccaggctttctctatagctgcttccagatctgggtctggaccagcttctgcaggaaggcaccattctgttggggtgtctgacacggtcagctctaggctcagcctctgcggcccccacaaaggcctagcaaggatggggcaaggtggcagtggtgcccgcacgcactgccctggcacaggtgtgtagttagtgacctgaagcatgagggcatctccctgcccaccccagctggagataagccccttgcggggcccaccctgctgataaaccccagagcagtatggcctgtgtcagaatgaccagtaggagggccccggggtagcagctgcccagcccagctgcgtgtgtgtgtgaagtattttcctcaacaccttataccacagaaggcagattttgaaactcgcatcaggccagaaaaagaatttctgaatggacacttctaaggggtgcctggttactcatctgcctcttccccctgcagggtagaggggcatgggtttgaagttcccgggggctcttggagactgcagacacggacgagctggggttcctggatgctgcagcagttggggcccctggctgagcgcacctgccccaggaggccctgcgtggttcccccagtagccccttcacaccacaccgcagtgaggatgccctgtctcctgccgatcccatcacaccaagccttttcgctgttgggctcctggcactgcccgatcctggagggcacttggctgcggctgtggctgtgaagggctggtgctctaggcgcctccgtggcccccgttgcctgggcacctacttcctgcctcagccacagctgcatccacgtgcgccaggggccacaaggccgaccctggcttgggcctgttcctccctgggtttccttgggatccagtcattggagggcccgcgcacagctgggccaactcgacacctccaagcccggccagggaatcaagcagctctccctctggcagcatgagctacacaagccaggcccgtcttcccattcccttagcaaggaggggcaaccccagccaaggccttctgcactgttctagactgttgctgcctagggctactgtagctgggagtcacattcctttctccccagatagttgcaaggggcccagcagccacagcacttcaagggggccctgcccttcccctcccaccaccccaccagggtccccatcttcccctttgtctcctaaagcccgtgaggcagtagaggagccaggccctcccctgccacaccctggagaagccaagcagcagacacccccagctccttcaggggcatttatttcccggtcagaaaagaagcagggacaggcgcctctgcctgagcctggcagacacaacacgaagaccggggatggggcgggggaggcacaggagacggctctcagcaatgtgtgcacttggtcccttgtttgttcctggctgggtcagggaaggcctgccgggggtggtggcactgagagcctgggggaacaggcgccaggccagtggcccagggacggcacggacggaggcaataaatactgatggccaggcggggctcctggctggccaggcactggtgggctggggagcagcagcagcacaccccacgtgtccctgggtcactgggttcgccaccggggaagggacggggaggccacatgctcatgcagacacagggagttagaggctagtgaggccccacggtacactccacatgttaaggcatcatggttagacgggaccgacagcgacaagggggctggccagggagcagcg

SEQ ID NO: 888 - DNA, 3591 bp, Homo Sapiens
agtctggtcttgtggggtttaggggctggaaatggggaagagctagagcacagcatttaggattgagttttatactattcggtactccaattatgaaaacaacgatgatgatgcttctgacctgccctgttgggctgtttcttccccatccttttggagaaatttggatacagagacagatgcacacagagggaagatgatgggaagggacacggggagaagatggtcatccccatgccaaggaaggaggcctggaacaaattccccttcacagcactcagaagaaaccagccctgctgacacttcgagttcagacttttagcttccagaactgtgagactatacggttttgttgtttaagacccccggtttgtagtactttgttacagcagtcctagccaatgaatacaggtaactttgggctacttcatgatggcccagatgtctctgatcctgtagtgtggtgccctagcctggtcaacgcttggagttttataaccctccatagcttcagtttcttcatctataaaataatcatggagcgtctactaggtcttgcaattaatctggtaaaacctttttcttcaacaaacaccaataaagaggatcaaaaatagcttgcttttttttcaggctggagagtggcacatatccactgttttatctagggttagttcccaggaatatctcctgttctctgttacaatgaagtccaaagggccttgatcatattgacattccggagagcatcattcagttcctcatattgattgaacttaataagtgggaagtggcaagtagtttggacactgtagtaaaaatacatgtataccagagggagggagctacatcccaaggagattcagatactctccacattggtctagtttttgggtccaacagtctgagtcatgctgagaaatcccatccaaggtaaaggacaagttgtactttgcttctcctaccactaagaacaggcacagcactaaataggcttccttggattctggaggcagcatataccatacttgggactaattctcaacacatttattgagtgactcagaatgcttccagctttcagtgggaccagagcaagagaatctgcagcagattcaggctgtgatgcagtgaaaagtgttctgtcattcaggacatatgactcatcagatcagtagtgctaaagatagctatggcagatacaaattctgtgtggagtctctgccaaggttcaacagaagagtcacatcacagacccaagggttctggagtaaggccatgccatctatggcagagagatagttaccatttgcaaagcagcatctggtgtagttctgggccttagcagaggtgaagtacctgagcatgggacataaaattacagatcatgagatgggtattatcagattcaccacttcatgagatcaggcaatccattgtacaatagaaatggtacatttagacttggatccaagcagacccaaaaggtacaaataagtttacatgaatagattacacagaccttcatgttacctagctctattgcacagattcctcgacctcagttctcacctatgacctcatggagattcccctgcaatcaactgacagaggaaagaaaaatctccagcctggcatagagatggatatctgagtaagtacagctatcacatttcagaaatactcagaggtagtcccaaaggacagtgcaaaaggaaaatcctcccagtcagcaagactttcagcagtgtaattggtcattcagtttaaataaagcaaaaaacagcttgaggtacagacatacacagaacctagagaagtgaaaaatggcttggctggctagtagggatcctgggaagagaaagattgaaagaccagataaaagaaagtttgcgaaagagtcatggaaatgggagcaacacacctgtatctttgaagaggaggcactgaacaggtaggcaggatgagttgtcctatggatctaagccagcatctcctctcagccacctcagtacttgggcaatgggcccatgagtggccattgttgtagggatggtgctatcaatgagcccaagattatggcattcctcttgttatggttcttccagccactggcattcatgaatgcccttcctgacagctacagagactgacactaggcacttgctatggcactattattgtaatgaaaccagccagccacaaggtagcatttattattgatcacgtgattactatattactagaaggggaggtttggatcataatcttgcaagacacagtctggaacgctgtaatcccaaatgttgaaatcacgaaaaatcaaaatccctaaagtctaaaatccctgatgcctaaaattctgaagatcacaatcacagaatagttgcatcatgttagaactattaccttgttgttgtctttatttggaaattaagtacggcttaagaagatgtctatgggtgccaagttaacaaggggcagatttgtgggcttcattttaggtgtcaacttgactggattggaaaatacagagaaacctggtaaagcattatttcgggtgttgctgttcaatcaccagtattgtttgcaccaaatttgtgacctgtatatgaatgcatgcagtatggacttccaagtacccaaaacaacacagaagcatgacacagaatattggacaatttaatagggaacgttcatgtcggtgactcatagaaaaagttcagagccatgccacgtagaaaatgaatatgaatgtattctccaagaagagccatatccaaaaagaaaaatagcagctattcatcatgatgcaagatttcaacatatagttgatgatcgtgaaagttagctaggtcttatgaatgatcgccatgcaaatgcccataatctattcctgtaatatactttttcatatgttaaattttctttttatgttgtttcttttcttttttagctttttttcactactttaaattgtgaacattattttttacaattttttatgctatgtgtttcatcttcgcgtcatttctgatatgggaggtagacattgtgtagagattttttgagagttctaatttgtcttacgcattattacaaacttgacctcataaaagttcattatcacaactttgtgtgtgagcattatgtgtatacataaaaacattgaaactttctcaataaattaagggaccttcttttcgtacatctgcatttgtgaaagatgaaatttctcgaaacctcagctctttgggtaaccccatatgcagtggtgacccatggcgatttttgattgatcttgtcaaaagacttaggttgttcatcacagtacttcagatgaccacaattataaagctgagtgcacacaattaccaaccatagtgacatttgtttatacatttccctttttgacctatttctttaccatacagtttacctactcatacctgttatatctgtgtgactgtcattagcatacctgagtatttatgcttgcaaaaatatgtgtgttattattgtccattttattgcttaaagtggcccatgaaatgttcagatgtgtttttatgtgtttcttaaataaatccc

SEQ ID NO: 889 - DNA, 3616 bp, Homo Sapiens
ctgtagaacttctcatcctccgtaactgcatgagccaattctataataaatctcctaatgtatctctatatatatcctattgggtctgtttctctggagaactctaataatatactacctaatcaaattgttgcgaggattaaataaaatgatatatgtcatagtgccaaataacaagccctcaacaaatggccattatctttattactagtgggatttagatcatgtgcttcttactaaaataataaataatatttattgtttgtttcagctatgaaaagaaaacatttggaagatcactgattccttcatggagaggctggcttgggaatagatgacgtgtcaaagattgacatcaaccttgagtgcttatttgtggacttgagatacagataaaaaaaaaaaaaaaaaaacctccctagagtgagggctacttgggatacatgctatatcccaaggagttctcagtttgaggtcagccccagctctacaactcaccaggagagtgcgcgaggatgagggagagacagcctgctctggttctcttcaaggtgacaatgacacctgttgacagatgagaattccagccaggaatacagatttaggaatcatgtttctcactctcatgatgacatagaagagatgcgtctgaatctttctgccagtgtgttaaagttattctgatattgactgtagttctgagctttgtctctatcccaccaaaccactaacttctggaaattacttgtagaccaagatgggaggactccgtgtgtggctccgtgagtatgtctgttacttctcctcttatataattttgaagatagctatttttctctcttggcagatatgaatgacttatcgtgcctgtccagagtcagggaaaggagaaacaatcttatttgagaagggaggatatcactgcagtggttgtgaaatcgtgtttggaagctagattgctctagaccactaaggtatgatttcacagaaattcccaagatccctgcaggggaaataacaaaggtcctgggtggcatggcaacaatagagatgacagaattgggaataatatcaggctaaacctgtcctgggaggcagggaggaaaagcagcagcaagtacaacatttgggacagagagcttgagcttgaacagaatgtaccggtgctgttgggtggcagccaggcccaacaatttagcattgggctttctctcttcatgtgacaaagaaacttcctaaaatactaaaagctaaaggagattgttatctaagcttgagatggaaggttgccagcggaaacttggaggatcacagccagtcgcctgggattgaccacagggagtggcagaggcagaaagcaaaagaccagttgcaattatccaggtaaaagatggaggctgttgcaataatccagtcctttttagaatcctgaattgagcctgtgttcccagttcctagaaaccctcaaggttattggtttcctcctcgcttaatagaccagtggaagaaatctacctccagttctatcttcacatgagcaactgtttacagtttacaatattactctgaaaatcagttcttttcaagttttatctaacacccaccagaagaaacagaagattatgaaaatggaatttgtcaaagttcctctcccaacaatatgatatttaattttgctaacatttttttttgaacacttactatattgcagacaatggtctaagtaaagcattttatgtgcatcctatcatgtcatcatcacacagccctgtgaggtagatactattattattaaccacatttcacattcaaaaaaactgaggcttagagagactaagtaaattgtccaaggtcacacagccatgaagtggcagagctgtggttaaaacctatgtctgtctgatgtttaagattttgctgttagcattactttgaaatgacaatatgagggcattttatgtattttttttgccccaatatgatctgcagaaactatgtattttaagtactacatttcttttatttaccaaattattgtcagataagaaaccgaaataaaagtttacagggtctaggattcctccataatgaatgaactttggggtatttcagtgacaaattggctttaacgcgatcaaattccatcctacaatgaaagtgtgttagtttgtggtttcaagtttaaaaacagcactgtattgtcttccagaaatatataaatagaaattcaagaagtatttcaatgaatacagataaaattagttttgttagaacatcaaatatgtgggtttcatttcttagctcagtttagaaactgtaatttcaattttttttagcagctgtggtaaattttgagatttgaaatttcatataatataaatcctcatttattgagcatttaaattatatgcccaacaatttactgtgtacattacttcacttgttcttaactataactctacaaaatattattgtccttgatttatagatgaagatattgagactcagttaagtaacttgcttgaaattcaaaaacgttaactgtggaaggcagtatttgaacccagtgttcaaaaccccatgctctttttattatatgaccttatttcctattcagtcttcagaagatatattgtcttattagattattctcgttctctaaataagtgaccttgggcaactatctttttccctggtattttcccctgcctttaaaacaatgtgatcaaactggaagtttttcacgatctctcttagccctaaagctccttggttctgtaattccaccaatagcccatttcaaaaataattctacagtaatcagtgggactcctgtttttcccatcttttttttttttgaaacagaaaattgaaacttttaaattagtttagtaaatacatctactagtttttttcttttatagtcatggttatattatttggtccttcttagttgcaacatgtttccttgctgtcaatttataatacctctcatcaacaatagcctgaagaaatagatttgaattgctttccctaatttatagctggaaaactaggctacgctggtatcttaaattgactttcctgaggtcacgggcactcagtgccaagaggagttggtacctacgcatttgaaatttctggatttctggtcttactctgtacttagtcactcttttctttcatttggccctatggtgggcaaactacagcctacaggccaattccagcctaccatctgtttttgtatggtccatgaactaagaatggttatcacattttaaaatggtgggaaaaaaagactattttgtgacataaaaattatatgaaatccaaatttcagtgtctataaattttgttggaatatagttaccacactcattcttttatgcactgtttttggctggttttctgcctcaacagcagagttgagtaggtgcaaccaagactgtatggcctacaaagcctaaaagtttgttatagaaaagtttgctgaccaactctattggttgcttagtattgctaggcactctgcaagtcacagggaacacagcaaactagacacatgactgccttgggcttaagaagaggtttctaaacttttgaataaaaaaca

SEQ ID NO: 890 - DNA, 1605 bp, Homo Sapiens
gaaattgttattcccattttacaaaggaagaaactgaggctcaggggtttacataagttgcccaagatgatataactagtaaggacacagctaggagtaaaacccaggcctgcagaggtcctatagacataatctttgcattacacagagccctggccacagctacctcctagtcctaatgttctgcaagtcttgctttttaagctctgtttttgttttggttttggtttgttttttgggttttttttagacagagtcttgctctattgcccaggctggagtgcagtcattttactatcctcttttgttaagtgtctgttcaagtattttgcctgtttatctactgggctgcctgcctttttcttactgatttgtaagagacttttgtttttttaaaaaagtctggagaccagttctctggtggttttgtgttgtgaatatcttctttggtattcacgcacatctctttaaagctcacaacaactccgagaaataaatactttaatgtctatgaacagaacaatcttagagaagttgggtggcttgttcaaggtcactgagctagttagcacaagaggtgggaaatcaaactcagatctgctcagcttgaaagactggctcttaagcattcagccatactgggaacagaggtcatccatccctctctagcgctatatgggtcttcagccccttctcctgcacctgcttctctcttctctccttgtttccttgtgactttaacttacgacttccatttcctgccctctccttgtgtggcctttcttctgactccccagctccaaacattgccactcacttgggttctccttcaaactccatgaaggacatctcatcagctccatttggcactgccccttcatgggcaggctttcactccagaccacgttatggccacggctcaggtactttcccactccaatcagctgtggccagggtggcagaatcccatggtcagcctgcctttgatagagctgcgggtttataacataaaggggtattttatttaaaatataaagagctttcacaattcattaagagaaaggtgaacactctaaaagaaaggtaggcaatttacaaaaaaatgaaatacaaatcatcaataagcagagatacaactgaaacaagctggagatgaaattctctcctcagactgaaagatgaaaaagaatcatccatacagcacctatgaggccatgaggaaatgggaattctcatacaccctggcaaagtttggcaatttcaaaattgtaaatgtgcatccactttgacttggcaattccatttacagaaaagcatcctaaagaaataatcataggctgggcactgtggctcaaacctgtaatcccagcactttgggaggctgaggtaggtggattacctggggtcaggagttagaggctagcctggccaacatggtgaaaccctgtctctactaaaattacaaaaaaataaaaaataaaaaattagccagacgtggtggcaggcacttgtagtcccagctacttgggaggctgaggcaggggaacagcttgaacccaggaagcggaggttgcagtgagcctgggcaacagaacaagactccat

SEQ ID NO: 891 - DNA, 5756 bp, Homo Sapiens
agagtgtcctgcttcctccgagagcttagctggggagaagagctgggagcgactcgagctgaggacgtggaaggggtgagtgctaattcctcagggcccgcggggcccacccccgggcccacccccaatcctacccccgccaggcccttcccccgtgggcgccggcagctccaggcccagcccagggcgtccaacgcggagggggtgcaggagttctcctgggcctgacagcctcagccgtgcagaaacccggcctagggagggcatgcaaagaaggacgccagagaaaaaggtcgagacaagccccagaccccaggaagtgactgtttgggggaagggaggatttccttcccaaggaaaaggggacagatgaggaatgcacttcgcgtccacgccgccctggtcagggagccgcctagagtcccggcttcggcccagtctctcctgctccctcccttagcgtcccgcggtgcccgggcctcttggcgcctggcacccctcgtctcgggtactcacagagtccggggctgcccgtcgtcttccatcatgcccgctccggacactgcgctccaaccaggaggagcaggaggaggaggaggatgaacaaaatggccgccgccaccagccaggcaggaaacagggcagagcgcaggcgcgacccgccaggtcaccgctcaggccagccgcgacagcctgcaagggggacgaccgaggggagagaaaaaagggccgccgaggaaaccctgggacccgctcacgacggatcacgtcgtcgctgtgggcctctggccggccgaagcccagccagctccgggagagatcgggcaaaaagagaaacgtcgtgaagccgaagtctctgggaattgtggtcctggaaatgagagagggaagcacttctgcagaggacttctggaacctgtggttaagaggagccgccggcgcccacccgcgctgggacgtgaagaggagacttctgggtagtgtagtcatacgtgaggacgtgcgacgaccaggaagtcggcgggctgggaggtaaagggaagaataaaagcgacattgaaaggcggggagaccaagtggggaaaagcgctgtctgggaaagcgaactacaagtcccagagttcctcgcgccgggggctgtcctcggactgctccaggcattgtaaggctcttctgttggcccagtctgagctgctgctccgccttcgtccagcccgagagcggtttcttcaactgtggctcaggcagcactctccctccgcgtggtgtccgagccagcagggccgtccggccctcctgtgttcatcagaacggctggctcgcgttagtcaaccgccgcttcgcgcgacagtcagaagagaggctgtgctggcggggacccggaggggttggggtgttttggggactcgatttcccacaaataggtatttctagcctatttgttaaatacaagtaggtggcctgcttgtaaattgctttacaagtttcagaggtttccctatcaaatgtctcatcggatagtggggtaagaagaggagccctattataatgacttgcccaactccccccgtattcttggagttaaaagaaaaaaaaatccttgggcagagacgtgcacaaacataaagttgcgtttacagacatcagtcatgtgggctagaaacgcagttttgcatgaagataggggaagccatgttcatactagctctgcatccctgtagaatttgtcttctcaccccccacaacagttcctggtgtgcttttttcctcctctaagtaccttcaggagaaagtacttggtcttgtagcttagtgaagagtggcgatgaagaaagatctttcagcccattgccagaacttaactgccccggttagtaatggcttaagagttgcttctgccgacatgtactaagtgcatgtcgacctctgcaagtggcggtgcgtatgcgtgccactgaacattaatcttgaaagcagaatcaaccatgcagcaagcccttatgttgtccattttcaggggaggaaatttcaacctgaaagacttcatagagacacggcaaaggagttgagccccataagagtccgtaggaacaacaaaaggctcagacgccaggacccatggctaaaatgtatgggctggggatgcgggcgggagcggggggaagggaactaaagctagagaggaccttgtagaaccgtgttgtcaagaatctatttcatgctgaggaatttgagctttctcttccaggcagtgaggagccactcaaaggttttgtctatgtttttaattggacctaggtgtagaactggatttaattataatccaattcattaacccatgcctggcccgctgtgatagtttcctgttgatgctgtaacaaattactgcaaatttagatacttaaaacaacacgaatttattttcttacaattctggaagtcagaagtccaaaatcagttacactgggctaaaatcaaggtgtcggcagggctggttccttgccttttccagcttctagaggctgcctgcattccttggctcttggccccatcctccatcttcaagaaaagaagcatagtatcttctttcttctctgcctctgtacgtacatcgtgattctcctgccaccccttttcatttacgagaaccttttgtgattactttgggcgaagattatctcaagattcttaatcacatctgcaaagtcccttttagcataacattcccaaattctgggaattaggacatagaaatctttggtggaccattattcagtttaccgcacccacctttattactttagttttgattatagccacaaacccaccacactaaaaagttataatgacacgagtttatatctgtatctatgctatacctcctacacacaataacacacacccctgccttcgcttggggtaaccatctttctgaatcctgtctttactatttattgctttccttctacaaggttttattccacatgtacatagtcctaaaaatcatatgtatatacatgtatatttgagtttttttttaacttagtaaaaagaatatgcccactacaaactagaatggttaaaatgggcatgtttactggcagtgaaattattaaggttaaaatccaaaacactaacaccaccaagtgctggtgagtatgaaaagcaacaggaactatcattctttgctggtaggactgcaaaatgttatagcccctttggaggacagcttgtcagttccttacaaaactaaacataatgcctaggtacttacccaaatgagctgaaaacatgtttacataaaaacctgcacacaaatgtttacagcagctttgttcataatcatcccaaattggaagcaactaagatgtccttgatataagtgaatggataaactgtcgtacaaggtggtacatccatgcaaagaaatattgttcagtgatttttttaaaaagagctattgatatggtttggctctgtatccccacccaatctgatcttgaattgtactcccataattcccacgtgttgtgggagggacctggtgggagataatttgaatcctgggggcagtttcccccagactgttcttgtggtagtgaataagtctcacgagatctgatggttttatcaggggtttccgcttttgcatcatcctcattttctcttgctgccaccatgattctgaggccttcccagccatgtggaactctaagtccaattaaacctctttttcttcccagtctggggtatgtctttatcagcagtgtgaaaacagactaatacagctctcaagctacaaaaagacatggaggaatgttaaatgtacagcaccaagagaagcccagtggaaaaggctgtaaacgctacaactttaactatatgacactctggaaagggcaaaactcagtggttccctgggcatcagggaaggagagagggatgaataggtggaacacaggtcatttttactggtagtgaaattattcagtatgatactctcatagtggatacatgaccttatgcatttgtcaaaacccatagaactgtgccacacaaagtgagtcctaatgtaaactatggacttcagttaatcataatgtatcaatagttgttcctcagttgtacatttgttggaattgatgaaccaatattgatacattgtgattaactgaagtttatatatcaattatgaattgatatacttgttaacactaatataaaacagtaataacaggggaaactatgtttgtaatgggagagagggcacatgggaactctgtacttcatgcacaatttttctataaacctaatactgctctcaaaagtctattacaaaggaaaaaattatgtccttgtaatcttttgagactgcttttcacttaattaacacacataagattcagccatattttatggctatcattcattcagactattatatgatattccagtgtataaatatactacatttgtctgatttctcattaatggatatttgggttgcttccaggtttttatactgtgaataatgctgctatgaacattcttttttttttttttaacctttctttatttttatttttttttttgtttttgagatggagtcttgctctgtcatccatctagagtgcagtggtgcaatctcggctcactgcaacctccgcctcccgcattcaagcgattctcctgcctcagcctcctgagtagctgagactacaggtgcccgccaccactcctggctaatttttgtatttttagtaaagacgaggtttcaccatgttgcccagggtggtcttgaactcctgacctcaggtgatccacccgccttggcctcccaaagtgctgggattacaggtgtgagccaccacgcccagccagctatgaacattcttgtgtctcctgtgatagatgtggaagagcctttcacccctcagccattagaccaccagggagtgcaagagcttttctttgatctatttggatctatacctaaaagtgaaattgtcaggtaacagggtatatgaacactccattttggtgggtaacatcaaacctttttcccaaagtgaatacacaaatttgtactcccatcagcatcgtttaagagactctgtgagcggatccacattttcttcagtacttagttttgtagtctgacaatcaaagtattagctcaatgtggtcttaatttttacttaatcaataaagttgaacatctcctcatattctgttaaccataagtttcctcttctgaagcatgcccattgatatcttttgcctatttttctattatgttatatgtgcttttctcaattttttaggaatttttgatgctaattctttgttatatatgtatattacaaatatcttctcctagtttgtaacttgtccctctctttttaaaatgcttttgatgccaggcatggtggctcacacctgtaatcccagcagtttgggaggctgaggcaggtggatcacctgaggtcaggagttcgagaccagcctggccaatatggtgaaacctcgtctctacaaaaatgagccaggagtggtggcatgtgcctgtaatcccagctacttgggtggctgaggtaggagaatcgcttgaacctgggaggcagaggttgcagtgagccaacatcgctccactgcactccagcctgggcgacagagcaagactccatctcaaaataaataaaataaaatggttttgatgaacaaaagcttttaattttaaaatggtcaaatatctt

SEQ ID NO: 892 - DNA, 3273 bp, Homo Sapiens
aaaaaaaaaaaaaaaaaaaatcaaaatctatataattaagcattgttttttaaaaagtagtttaggaagatttgtaaagcttatgaaccattgtaaaaccttatttctaaggtctgtaagacagttttatatgtaataatgtgtccatttccaggaattccccaaatactcatacagccattgagcaccccaatccaaaattcagaatgcttcagataagaacatttttgagtgccgatgtgacactttaaaggaaatgttcattggagcattttgcatttcagatttttggattaggaaaactcaaccactgtatttctgcacatattccaaaatctgaaaaagtctgaaacctgagaaactctggtcccaagcattttggaaagggtatactcaatctgtattaacatagacttctaaattagtgaaaatttgcattgaattaaaatgtgaagtaaatatttttgtttaaatattgtttaaaatttagtcatttaaaaattttgtgatgtaacaaaatgttgaatgaaataatgcttctacaacttaaaattatttttcatagtgaacaaaactagttgaatacttctaaatattcatttttgttagtgcacattttatccagttttaggctttagggaattgtgaccctttttttttttttttttttttttttggagacggagtcttgctctctcgcccaggctggagtgtgtggcgcaatctcagctcactgcaacctctgattcctgggttcaagcaattctcatgtctcagcctccctaatagctaggattaccggtgcccgccaccacgcccagctaattttttaaatttttaatggagacagggtttcaccatgttggccaggctggtcttaaactcctgacctcaggtgatccacccaccttggcctcccaaagtgctgggattacaggcttaagccaccgtgcccggcacttttgtttttaaaataatatcttactttcatatgattctttcagactgtggtatggcattctgaagcaagtcttaacagagctaaaaatcacccttacccaattctctgcactgacatatgtacacaaagtaatattttattattctccttcataaatggtttctttaattgaacctttgagccttatactatttttaaatttccctttaaaaattgaattacagccaggcatggtggctcatgcctgtaatcccagaactttgggaggccatggcaggaggattgcttgaacccaggagttgtagaccagcctgggcaagatagcgagatcctgcctctgaaaaaatcataataatactttaatttagaaaataccctgaattagaagtgcttcattcctcatttgtgtacagctgttcctctatatacgaaggggattggtaccagaaccactgcataccaaattccacccatactcaagtctcacagtcttccctgcagaatccaagtatacaaaaagtaggcctatcatttatatgggttttgcatcctgacagtactgtattttcaatcctagtttgtttgggaaaaaaaaattgtttgtatgcctgggtacagtatcatacctgtaatcccagcactttggaaggctgaggcgggaggactgttttgtggccaggagttcaaaatcagcctggtcgacgtagtgagaccccatctctacaaaagaaaaattagctgggcatgtggcacctgcctgtggtcccagctactcaggaggctgtgaggcaggagaattgcttgagcctgggaggttgaggctgcagtgagccgcgatcacaccactgcatgccagcctgggcgacagagtgagaccctgtctcagaaaagaaaaaaaaagtaaaaattgcatgtaagttgacccgcactattcaaatttgtggtgttcaaggttcaactgtaatttcctagcagcattttgtgtgtttgagaatctcttgacactcttcaagtaaatccctaaattacaactttgacatcaaaaaagctagacattcctacatttttgcactacaatacataaaaactcccatgctgatcggttgtgggatcgtgcctgtgaataaccactgcactccagcctgggcaacatagtaagtaagaccttgtctcttaaaaaaaatacattctgaagaaagttctacttatgaatacattttatttataacaaactggtgaaaattttagaccaaaccatgtctttctgggttgtagtgattaaaaaatggttaagagaatgttccctatacaaggcatatgttattaaacatgaaatttaggattagttttctctttgaaaattcttttgatatgctgaggttacagtttggaggttacattagagaaagaatatagggaagatggcagtggtaaaacatttccctgctttacatttttatattggcagtatcttggtttcaacttttctattttcagcaagatatttgcaagtttttactttgaagatgtttggtttatagtagtccatgctatactaatgctgttgctgagataattaagttagatactaatatgaaaaagaatatttgtgtaaaatattttgaagttgtaattagtgtatatacaagttgttaatacttacgaaaaaaggaagcattcccacctgtaataattttgttaacactagactatcagtaaattatcaagaataaaaaccttggtttttctgtaatatttgccactgagcaatttttattaaaaaccaaacagaagtatttacacaagaacaagtgaaattacacaaaatgataatggggagaaatttctcatctggtgataaagggaaaaagataatgtaaaagcagattgctgctatttgcataataagcacttgttgaagaataaatgattaagttcaatatttttgctctattttatacctactcactttggtggaattagttctccatgtaaagtatctttttaatagtaagcaccatttaataatgaaacaactcatatgttttgtaatccttatggagaattacttcatgtgataattatagtctcttcatggaaaacagtaaaaatactcacgtttatgatgatgggcctaggtactaaattcctcattcaatctttttttaccaaatggtacttaataaaatcttttaccttataaaaatctattttcggccaggcgtgagacactgtgcccagcctgtcagagcttttgagtagaaatacggtatcagaaatgtgctttattttattttattagacaaagtctt

SEQ ID NO: 893 - DNA, 7113 bp, Homo Sapiens
gcacagctccagagagcttcgagggccaagtctgcagtttggttgcttcctcctgaaatcaacgtgggagtcttaaaagcacggggagaatagtctactcagcagggagcatttcgggatgatgcagccattcataggaagcatggagaggcttgaactggaccatgtggtgctggagaggccattgcactgactggcaagagaagacctgcttcaccgtggtccacacagtaatttccctggcttcactcaaggctaactgtcctccagcaaaacacccctcttttcctctcacagatgaagcagatgagtaaaactgaggctccgtaaggtactcatccgaaatcaggcagaagagttctggtggctggaagtctgaaatcaagttgttggcagtgccagctccttctgaagcctctagggcttctctgaaagaggtcaagaaagcccctgcctctcgcctctgcagatagccatccagtcccagaggaagcggctatttatgcagcaattatcattcaagcaaagccatctttattgcaaagaatggagacctctgtaatatagcacaggaataatgaatgcatctggtctgtgtggcagaggggctgtgactgaaagcacaccatcaggcaatgctgtagaagcgggaatctgatacaacctggtttaatgagaactggagatcatgatctcctggacagccagaactatgttttatttatctgtttgtggccagtttccagccctgggcctggccttgagcaagcccttgagttgaaatgatttaaatcagagatggcacagataataaaaacaggaatggatatggagatagaggatgagaatttgggtattaacttggttatttactaattggagggattgaggtaagttgcttcattctgagtctcacttctcaaatttgtacagtgatgaagtttgggattggagtatatgtggagaggaacctccaaaacctttaccgtgcttcaacattctaacttaagcttaaacgaaaaattgaatttttacctggaaagaaaaaaaatactgttcagaatcctgtgttaatagttgttggtattaataaacaagtaaataaagtaaatacatgcattaggttttatttaccctcctacagtggaagataatcatttgttagttcaagccctgaggcattaccttcgtgacagctggtgaggtacgtgtgtaaaattgaaacatttttatgaaaaatcctaacaaagcattgctgtgtgtgcctattattttaatgtgaactaacagccttattcgagcaatttgtcacatttgaaaatataaactggaccccttattcatgcattttctgaagatgctgctttggtgctgacatttgttggtgcccttggtcataggagtgtgtgtggacccattcatattctcttctgatttagatcagtgggcaagaaggtcttacacacagttacagatctttcatatgccctttgtgttctcaattatgtaggggattttgactggctagctgcaatcagtctgtgagaaagatgaaagaaaatgaccatgaccatcacacactggagtaattgggtgtcttccctgcctcctggtgatgaccaaggacggttcccatcaaaaacacctaaattcaaagaagtcagcagtctgctgaatggagtcccgggatcaggttacatcaaactccagcttccaacgtacatttcaaatatgaaacataaacaccgattgcaaatctgaagacattttcatttagccctaggccaggatttttaatttaaaaaaaataaacctgtcaaggtctgcaggaaaggctcttagatattctggccaatggtttatttaaaaatccaataatgcaatttccttagcagcaggaggcaagagaccttctctaagctgaatgtcccataactggatggtagccagattcccagtacgtgaaacagaagtccatgaaacagaaacacattcccagtacattaaacccctttataaaaggggtgctaccttgaaggcccaggacaggatattctgaatgccatttctccccagaataactatgtatattgggagcaagaagacctggtaatcgaatctcacttactatccatgtgaacttgaccattcacatggattatttatgtatttattttactattaatttatttttgatttttttactttaagtctggggatacatgtgcagaatgtgctggtttgttacctaggtatacatgggtcatggtggtttgctgcatctatcaacccgtcacctaggttttaagccccacttgcattagctgtttgccctgatgctccctctctcctcaccaccccccaacagtttctggaatgtgttgttgccctccctgtgtccatgtgttctcattcttcaacccccacttatgagtaagaacatgcagtgtttggttttctgtttttctgattgtttgctgaggatgatggcttccagcttcatccatgtccctgcaaaggacatgatctcatccctttttctggctgcatagaattccatggtgtatgtgtaccatattttcttatccagtctatcattgatggcatttggattggttccatgtctttgctattgtgaataatgctgcaataaacatatgtgtgcatgtatctttataatagaatgatttatattccttggggtgtatacccagtaatgaaatcactaggtcaaatggtatttctggttctagatccttgaggaatcaccacattgtcttccacaatggttgaactaatttacattctcaccaacaatgtaaaagtgttcctatttctccacagcctctccagaatctgttgtttcttgactttttaataatcaccattctgactgacatgagctggtatctcattgtggttttgatttacatttctctaataatcagtgatgttgagctttttaaaatatgtttgttggctgtgtaaatgttttcttttgagaagtgtctgttcatatcctttgcccactttttgatgaggttgtttgttttttttcttgtaaattcgttccttgtaaattctggatataacacctttgtccaaagggtagattgcaaaaatttcctcccattttgtaggttgcctattcgctctgcgatagtttcttttgctgtgcagaagctctttagtttaattagatcccatttgtcaattttagcttttgttgcaattgcttttggtgatttcgtcataaaatctttgcccatgcctatatcctaaatggtattacctaggttttcttctagggtttttatggttttgagatttacatttaagtctttactccatcttgagttaatttttgtataaggtgtaaggaaggggtccagttttagttttctgcatatggctagccagttttcccagcaccacttattaaatagggaatcttctccccattgcctgtttttgtcaggtttgttgaagatcaaatggttgtagatgtgtggtcttatttctgaggtctctattctgttccattggtctatatgtctgtttgataccagtgccatgctgttttggttattatagccttgtagtatagtttgaagtctggtagcatgatgccttcagcatcgttctttttgtttaggattgtcttggctatgtgggctcttttttggttccatatgaattttaaagtgttttttttttctaattctgtgaagggtgtcaatggtagtttgatgggaatagcattgaatttataaattacattgagcagtatcaccatttcacaatattgattgtttctatccatgagggtggaatgtttttccatttgtttgtgtcctcttttatttccttgagcagtgggttgtagttttccttgaagaggttcttcacatctcttgttagccatattcctaggtattttattctctttgtagcaattgtgaatgggagttcattcattcacatggattatttaaataaaaaacttaaattttaaaccccaaatttaaaatgtgtcatataactgctagcaatctcccaactttggttgcttatagaccaagagtagagaaagagtctatgtattgtctagccctgccctgttggtcagaactggcccagagaagcaccactgactatttggagcaatcaaacttcctctctctagaatttaaaatcactaaccagaaaaagggactcagccatgggcactgaagctataagagccaatgatctcaagggtcaaaacacattttggagtagctatgacggactatggttaatctaaagaaactggttcttagacaagagactagcacatatggatatgcagaagcaggaatgggaggctatgtaagcccaaagagcaagagagaggatgcagacatctgataatattctagttcctatgtggtctggaagttgagttcatgagagtttctgccttccattgtcttgaatttctctgagtaaaattttattcctggaaagcaactacaagagaatgtcataactttttatctgagcaaactttaggtatctcttgtcttaccaaataattgaattcacaaatacttattgaacatgctttatgaaacaggatctatgatgaaagctgatgaaaaagcaatgaacaagatgggtacattttctgatttcatagatctcgtattttaatgggaggataaaaagaccaaaataagataggaaaacaaaacccatatgtacataagtaagtacaggttgacacattaacaaataaaaaattaaaaacaaatgaaaagacaaaacatgttttcagttcaaagacttagtagtgttaagactgatctatagatcaagatttaaggcaatccttatcaaaatttcactggacttttttacagaaattgacaagctgatcttaaaatacatactgaaatgcaagtgactcagcatagcaaaacaatcttgaaagacaaaaaaaaaaatctagagaactcaatgttctaaattttaaaactgaacacaaactgacagtaatcaggcataaggatacaaatatagataaatggatagagagcccagaaataaaccatcatatttttggatagttgatgtttgacaaaggtgccaggacaattcagtaggggaaagcaatagttctttcaacaaatggtgctaagatgactgaatatctacattgaaaggaatgaagctgggcctcttcctctcgccatacacataaattaaccaaaatagatcatagccataatataagaactaaaaccacaaaactcttagaaaaaacataggaataaatctttgtgaccttagattagtcaataatttcttaaacacaacattaaaggcacaagtgacaaaataaattgtatttcatcaaaactaaaaccctttacgcttccaaggacaccatgaagaatgtgaagagacaatttgcagaatggagaaaatatttgcacatcatacatttgataagggatttgtatctggaatacataaggaacgcttacaattcaattattaaaagacaatccaatttaaaagtgggtgaaagatacaaatttacatttctccaatgaagatatacaaatggccaataagcacaagaaaagatgctcaacataattaaccattaaataaatgcaaattaaaaccaaaatgagatatcacttcacacactctaggatgtttatagttaaaaaagatagtaaatgctggcaaatatgtggagaaattgaaatcctcacacactgctgttggaaatgtacaatggtacagtcactttggaaaatagtctaaccgttcctcaaaatgatggagaaaatgaggagtgagttctaataggtatgggcttcctttgggggtgatgaaaatgttcttaaattgatcatggtaatggttgcacaaccctgtgcatatactaaaacccattaaattttgtacttaaattgggtgaattgtggaataatattgttaataatatctcaataaatataaatatatttcattaaaaataaaatataggggcaacgtttcttcccttgcaggaacattagcaaaattgagtccccggctatttgtttgaatttgtattattgttgtaaatcatcctaaatagttcttaaccaaccatggactcaaagtgtcatagctacttatatttgtgaaaaaatatattctttaaatggaagggaacatccctacacatgatatctaagagtgaagggacattcttaagtattgttatcaggaatttcagaacacaaagtgaaattttttgccatgcaaaaaattgctttaacgtatatttttttcaaaatcagataaagcattgaacttgatgatgatgatattaccgtatgttaactacttattatgtacccagtctgtgcaaagcactgcataagcattagtttctgtaatccttccaacaaccttcagacatttattttgtttcccttatttttgatggaatgattgaagctcagtcagatgggttagttaacttgtccagtatcacacagttcataggggcagtttgaaatttgaaagccaggaatggttgatttccaaatacattttactgttaatctctaattatgcttttcctttactagtacgtttgtgtttttagtttttctgtttttatattttaagcacataattatgtaactaattatgtgcttaaaagtataaaattaatgcaggtcctttgtagaaatcttgaaaaaatagaagtgtgccataggtgacactgggaataactggagtttgaaatggggaaataaaattgctgataaaattataatatgtgtttgtatttagtactattaaaggatgcttatgacaatgaaatgtacgttataaagcaattgaattgtattagctgtttacatacacagttgacctttcaactgtagggtcatgagtttgaaaagtgggtccacttttacgtggatttttttcagttaagtttacattgaatgtgcttgcctctcctgcttccccttccaactcctccacctgttccatctctgccaccactgagacagcaagaccaactccacctcttcctcctctgtagcttactta

SEQ ID NO: 894 - DNA, 1033 bp, Homo Sapiens
agataatggtgtcttgacagaaccagtctggccagagcccagaggatctcactcagatggtcaccaactcaggccctcttcaggaccaagtttggtctgaagcattatggttacctgggcagcaggacacacaaacaactcactgttgtactctcaactctgagaacacaactctagcccaagcccctgagaccgccgtccttagaaaggcctgcttggaaaactggactttggctgacatctaaaaacagctctcagagcgttcccagtcaactgttagccaataaaagtggctcacggtgcactagaaacttcgtgcaaataatatggcttatgctgaacacttgctttccttctggaagtctagactgacagaaggtacatatgtcaccccccccagtaaaaccctggggcactgagcatctactggactttcctggacataaacattgcacaaatattgctgcgttttttgttctggagaaagaaagcactctgtgtgaactcttatcgtagggagagagatacaaatgcctggatacagattcctccagagtccatctgtgtcttttccctttatgaacattgatatcataaatcttagtcatgaatacaaccatatgctaagccctctgagtcttctagcaaatctctgatgatagtggtgaccgtggggatcccaacacagatatagaaaaataaggatgttctttaaaggctacaaaagtacaaccctgtgagcatggggcgctggccctggctcatcctctacccttcagttccctcattccatgtcatgaacttgctgctctggagcatcaacctgtttgtaggcctcaggcacacaaaagtgtggctaaattcctatgccttagcttttgctgcccctctgcctggagcaactctctggccccaattcaaccttgtctttttcctgactaactcttcttcactatgttttagcttaaatgtcatctcctccagaaagccttcattaactccttcattcttgttaggtagtcccactctgtgc

SEQ ID NO: 895 - DNA, 7882 bp, Homo Sapiens
gcacacacgcacgcacacacactcgcacacacgcagaggcacgggagggaaagaagccgatgaataattttgctattttttaaaatactggccgccatcatcaagcagcgagcagcagcagaagcgttgaagggagaggaggcatcgggacaggcccctcttaggagaggatttatatctagttggaaaaaaaaagaaagaaaagaaaaagaagaaaaagaagaaaaaaattgtcaagcccccgaactgaaggttacgagcggcccgtcagcagcccacatgtaaccgaactgtcgtgtttcatggctttttgccactccagctgtcaatcaaagcccggaatgtcaaggtagtgaatgaatgatggttgatgatgatgaagaggaggaatctttcagacccgtttttttcttccagtaaaactccgcgaggggtttctgcttcttgaattttttcctcccccctccccccttttttagctttgcccccgcggtatctataatacgatcctctctctttaaagtattgttcaaagaaagcagtgagaaaaatcaagaaaaaaaaatgaatagtttgcaaaaattggacttcctccccccctttcctgaagaactccaagattaaaagtatccttatttgttgctgagttgctcgtcgacatttaagagaaggtgagtaaaaaagaaaagaagatgaaagagaaaagaaaaagttggtctccagaattttatttcaatcgacagttacgcgaattcagtttagccgggaccgggaggtttgagagtgcggcggggtggggaggggaaaaaaacaaaaacgctgcggagcgttttcgactttgcaaagctgttgatgttggtgggtccaagttcccggtgcagcgccgctggctgagaaatttgtactcagtttttactcttctaattattcttaaattcaatttaagaatttaagtttatcgtcgccaataggattattgttgttttaaatgtcttgttcaataagtgccagttacgtttctttttaaaagaaattcctcagtgtccttgataaacctttttttgtaaagatcaacttcatgcggaacctctgccttgcagggtttaaacattcaacattgctaccttctgtttctttttctgtttttatagtgatactgtaaagtgagttagcatctctatagctttcatttagaaaaacttaagtcgcatttttagaaaaatattccttcccttgcagtgtgagtaaaaacaactcagacagattgatgatttctatattttcttttctttctttatcttctttttctttttttcttttcttttctttttttttctttttttttgagacggagtctcgctttgtcgcccaggctggagtgcaatggcgcgatctcggctcactgcaacctccgcctcccgggttcaagcgattctcctgcctcagcctcttgagtagctgggattacaggggcgcgccaccacgcccggctaattttttgtgtctttaatagagacgggggtttcaccatattggccaggctggtctcgaactcctgacctcctgatccacccgccgcggcctctcaaagtgctcgaattacaggcgtgagccatcgcacccggccgatttctatgttttcaaacaattgtaagctaataatgagttgattatctggtgataatcttgggttttacaaaaaaagaaaagtttaaactttattttcatgtgtttttatcagatgcagaaggcatttttaaccttaacgcctttctctgtctctctctttcatattcttaacttcttttgcattttattgaatacattaaagcaaacaacaggaacaatatggttaggtgtaggagggagagagaaatatgacattttaagatattgtcaaaaagtcatatttaacttcaacgacttttagttaaaaaagtgtgagagtgttgaaagtgcattcctactggaggaaatctatgtctttttaaaatttgccagttgtctcaggggagaacccagaatttctttgaacgaaagagatcttactgatctagttgcatgtcacttatgaaactgttagtttaaaatagcagtcctagtgtagtggattacacatgaggagatcaagttggagtcgattcaaggtattggttcttggtcagtctgctgaattcaaaacactattacctttaatcagcaacttgcgggtgttttattaatagagctgaaaaaggctcatctaacatataagaatttcctggtttccctcatccccaattttccagtccaatagaagcgattccaaaggagtagggtacccgcacttactgatttccatcctggtggcattttgctaatgccccattgtcagcgttggcactcccacccaggcttccaggctcatctgctctcccatatttggggtgaaaggaaagtaggtggggcaggcccgggagacaggcacgaaatgggggtcgcaggaggtggcacacacctccgtcaacagtcagctccttctgcccaggctggaaatggttttaacaggcggtaaaatttcatcttgcggtgtcaaattggggtcattttggggttagagttctcagtgtccgagaggagctgtccagctgcgtggggactcattaactgcaaaagatctgtttcagtaaaaacaattcaaagacaatcagaaggctaaagaccctctacaaatcgcattttacaagtgccccagaacaaatatggatggtgaaacctatttcttcagaatcccaaatcagctacttagctctggagtgggggtgggggtactgcataaaaaagaggtgaaaaggaggggaccaagcgggtggggaccagtggaagggggaatcgggcctctcaaatttaagagtctgtttttaatcacctctttcttattgaagcagccccaagagttctgaaaactgctacttttctatttttcattttctttttttgagccaacatggaatgctattataggtaacatttaagatttaaaaggaataattgaattccactatagtcccttaatttgaagggcattggctttatggggagtgtttaatttgaaccaagaatttatgaacccagactctaggtgaatttgcccacactccttaaggagcttgtgtagctgtttctttttcttttccttgaaagttatagcttcttagcacagataacttcaaattcctcagaactgagaagtccaaagtgttaatctgtgtattaaaatcgccaggtttaaatcctttttgtcttcttacaacagttagaacaattgacgccttgctagagaagcaaataagtccaaccttaatcttatctgtaactttatttaatgttttgatttggaatattttggattaagcatatctttaaaaactctgtaaggttaatttttattccgggagggaagttctctttactgattttgaaaaaagacatgaattattactttgattttcaaaaattccttcaggtaaaaggaaaattcaggtttaaaatgagaagctagatatgtgaaatgccagagattttaggataaaaccaagtcaatacttaaaagtaaagtatcatttgaaagaaattttatttcttgcattactgaactgagcaagtaacagtgatcaaaaatatgttattctctctccatctctctctctctctggactccacttctgtcactaggtcttctctttccatccccagcacttttctttgggttctgaatgacacagtgattttttttttttgtagtctagttattttctccaagcgtctcagagtatttctaaattgttattcaaggagtttgatttcagccctgcagaaacagccctgagcccagcatcgctgggacaaaggcagaaggggctatcttctgttcaagacctgctggctgacagttggaatttttgatatatattttatttggcgtttccaataacgtgtttgtctttccctctccaccccttgcagccatctattacttttaaaacatcccttctccataaacatcggctcatccttgtgaactattcttgaccttcccagcagtgtaaccagcagctctgaaagttggcctagaaataattccactggcttccttacctgttaactttactcactcttcctagctgggatcaacagaaggaaggggacttttttgtttgcttttgttgttgttggtggtggtggtggtggtggtggtggtttttggttctttggtccttttcccacttaaactttctataatgatttattctccgcctcctcccattaataacgtttaagcaccccacactttattttttaaataaaatggagtaaaattattatacttttttcctttatgcccccttttcttttatttctcccaattttaggggcttcaccatctcatagaaaggacttcaataaatagccctctagcgctatctggcggggctccaaacacgacgtgcgcttgctctcactgtttcttcctccttcccgcgctctcttctttcctctctttcttcctctctcctgctttttctctcgtctcttccgctcgattgttttcctctttttttctgtcctcctgcggcctcttgtctagttcctacccctacttcagcgcaggcggcttggaaagccccggccagaggctagtaactctcgcaagtgggagatgctctggcgacggatctctcttttctgatccctcctcccccttacccagcgcggatcacacacatcctttgcctttgattagcatcttaaagttgcttagcgtgccgcttaagtcccagcgtctcagctggcggtggtttggagaggcttaaaactgcattcatgaagtttggaggaaagaaatcagacactggaattcagggctaggagcccagctcagttttaggtcagaaggccgagtctcagtgcgagattgaggaagggtcggggcttaacgggggaggtgggggtggcgggggggggaacagcacggcgcggcgcctagcctgcgagatggagtcggagtgggggtgcgagcggtcctccaccgcctctgcccgatccgtacctcacaatggactgctcgagtttgtatctaggcctgtccaggattgtttactccttcaattaatcagctttatctcttttccccctccccccacctccaccaaatctggagaggagtgggaaagaactggaaaactcacagggcaaagagagaaagccaacagtcatagtgcgggaggaggcacgcctgggatgcaatacccaacagtctcctccctgctttcctgcaatttgcaggtcattgtctttcttatttgtagctttttttttttttcttcagtagccggtaaacaatcgaacgccgggtagggaggtcagaggggatggggctgtgggagagattctactcaggctaggtgctttagatttggacctggctgtgtccctactttattaaaattctcatgtggcgcgcgctgtcttctctcttctctctctctctctctcacacacacacgcacatacacacacagcccgagagaaatttccaatctttgagcaaatctcttccatctagtccttgaaacagaggaaaggacatgggacctgaaggagagttatgattgaattttctaaaatttagttttgacattgcaaagtaaaagtgaggaccgtattcccaatacagacccagagggtggttatttcaggtgaggggacctcagcctgtgacgtctatgatcaaccagacaaagaccccttcctaaatctgaagtcccacccccacccgtggcaaacatggaatacaagggaggggaaggatggcacaatagtgggttctgttttccaagaactgccccccacctccattgcagaaggaaaaaaaagcacggttcgggtgtaattaattggggactgttattaggtcatcattagccaaggtacaaataatagcagcacatttttacttaaaattgaccagccccagagtgatagatcgatttggagtataaaaagatgtatcaaaacatcaatgtcgattatttgaaatattgtagtcgaattttttttattgcttcatcggttaagtgtctgaaaatgcagtgttcaaacatatatttatgttgtcaatactgtcagaactgtcagttttactatactggatttgtactatatttcaaatatgctaatttacataaaatgcccaccctaggattccccccctacacccaccccatctctggaaaatccgtgtcagtttcttcaaaggattcagcaatctttgcctaagctaaagtgtgcactacctcttttactcaattttccacatcggattacatgtctttttcaccatctctaactttcaaagagatccttcttcctttctccccaattctgcctactctaacctcttcttcaaaatagtactgaggcacttggaaagcttcgaatttaaatatccacatcccagctccaaatataccattggagtaaaaaaacggaaaaactggacttgagtgtacttggccgcactcgggtaaaccaggcttcaccaggtagacgttctcataccgtaagggtccatcatcaaattacctggcagattgaaatcttccagggaaaatgaatttggaaatgtaaacaccttttctttctttttacttaaaagcctcgatggtagaaaaagaaataatacttataaatgatcggcacgttttaactttaaaagcttttgaactcaagtgaaagacacacgttggaaacagaattgatagttttaattctacccattttcacctggcacatcagatcagtggcaatcatttattttatggggtgtggaggggaaagggatagaaagcggatagaaagctagaatccactgaagtccctgtcctaaaaatctcagagaaattaaagacttattgaaacacaaacattccatcgctccatactctccgtccagatgaattgaaacttataaatccacgctctccccaattttatgttttttatttattttttttcagggtttgataggaaagatacccaagtctgatagggaagacagggccacttctggactagctgtgaggatgtgttttcatttccataacactgaagcactttctgtaaaccttttgatgtacttaaataagtctatttggacatttaaagaagctacacatacaaacatagcttggctttttgccgtcaatcccagcattaaaaaaacattcataatctaactgagaagctctttcatacccatccttctttcaaataagtaaataaataaagaaatagaagtgcaaaccaaagaaagtttccagcgtgcatctgtacgtcttcgtgtgcgagtttataaacaacttccagtcggtacttgggtgttacctccctcctgccacacaccccaaggcagaggcatcgagggatcgcccccagagagctgtgtttacttagcttgttttaaaaaaaatctcgccgccatgtatgacaagtgttactgcaagaaattcatcagccttctacagatacttccagttttgctgtaatgatctgcagaagagaactgccatcactttctcacatcccaaggtgttgcaggaactcagagagaggggagagtggctgaaacgcttaattaccggaggcgaaggaggggcgcgcgggggaccgaaggagaggggagtgaagaaggaaggtcctttaccaggcttgtacctggagaaagctttgaatcgcttctctgctatatttggaaaaggtatgcttgctttttaaaaaaatgcctttagggcaaagtgatacccttgtgtaataattaactcagacaataaaaataattgga

SEQ ID NO: 896 - DNA, 2467 bp, Homo Sapiens
ataggggcctctgcagccatggtcatgccaccctgccctggacctgtgacttgccacccacttctaggggttccagtcttgccctcacctccttgccctcctgagctcggaccacagagaaaacctcctacatcccgtccctccgtggggcagcagacatggtactgaaatgtgccacgcattgtctcactatgaattcacgggattctcaaaccacccgagaggcagggtgtttgttcttgctactgccctgtaacagatgcggaaattgattctccgtgaggttgcagagtttaacacaggagattcacgtgcagaatctgggtgtcccaaacttgctgccccgcagtgtcactgcgtgatcatctcagctgctttaaatgccagtggtgggttactgcaccctccagtgtcgcttcttttactgacgggtaaactgaggcaaggagccttgaagtcacagatcaagagtcaagagtaagaggcagggctgggattcgaaccgagtccgagagcccgggacctgctccgccgcttccccacgggcctccggcgcccacttgggggctaaggcgcccccgccgccgggcccctccggacgccgaggccagccgagatcgggccgccggccaggctgctgggcgccgcgcccgtccgcatcacgccgcggtgagtcaccgcgcgccggccccggccccgccccccgcgccaacaaacagcgcgttgctcggcaaccgccaccgccctccagcgcggacctgggttcgagcctcaggccggggtgcgcgctaagagggattttgggactccgtagtcttccctagattaggggttcagatcaggcctgtaatcctggtgggcacggaggtgatggtgaaggagacagctgtggtccaatgaaggtggggagggctgagggtggctctctccaatccagacccaccggggctccccagaagtgggcggtcaggtcaggagatggcggctgggccagagttgcagctgagaggtcgaggccattttcctaagggatttggggagctggcctggcgggagctgtcaggagcgctgtgatgagggcttttttgcatcctccccacccctgccgacctcccaaactagctaacacttaatgagcacgttctatgttctaagcctgttctatgcatgtgtgggcctatgtgtattaactcatgtaatgttcaccatgaagtcgggcgcggcggctcacgcctataatcccagcactttaggaagccgaagcccgtggatcacttgatgtcaggagttcaagaccagcctgggcaaaatggtgaaaccccgtctgtactaaaaatacaaaaattagccgagcgtgatggccagcacctctaatcccagctacttgggagaccgaggcaggagaatcgcttgaacccgggaggcagaggttgcagtgggccaagatcgtgccactgcactccagcctgggtgacaagagtgaaactccgtctcaaaaaataataataataaaaattaaaaatagtgttcaccatggccctctgacgtttcattgacattctcattttacagatggggaaactgagtcaacagagggtcaatgtcctttgccagaggatgcacagccaagctggcatccgggctcccaaacctgtctcaggagggtgcatgcctggccttggcagggccatatctgtgggagtcttcaggcgttgtggggataggtgccaaggctacattgaagtgtgggtaggttatgcaagtgggggatggcgcctggtgggctccttgggggctgtcgacacatgatactgaaggctgtgcactacagaggttgcaccagcacccccctagacttcccatgccatctgagtgcagggagagagtttcccagcaccagcttcagatggcctgaactccgggctccctggcaccccaatagtcaccactgagccgcccacaggacccttaagggagctgcctgaggggccttccggagccccagatcctatggggcggggagaagagtagatactagcatctcagacacggagatggaccagctgcctgggaagtgaccagctttgagtcctgtaagaaatgtccatttggctcacatgaccaagtcaatcactcaaatggttgagttggggagatggctgagttacagggatcctggacagtctaaagccaagaaggtgaggagggcttctcggaggaggtgataccctgggaactgaaggatgctcgggagttggcgaataacaggcaggaccttcctgcgggagaggttgggacaccaggaacttttccaagtggaaggtagaggggacacgtgattggatttaacgggctgtctctggagaatggctagaaggcataaggaaagtcggagaggaccagggaggtggctgttggaatatatttaggccagagatgatggtgacttaaggatacagttggcaga

SEQ ID NO: 897 - DNA, 3218 bp, Homo Sapiens
gtaagcaagcccttaataaatgctttgatgtaatgttccttttgttcacagtacagttatgtagtgctagccagatatttaaaaatgctctaagaaaagcttgtcaggggggagggggaaatgtttttcttgtgataaatgaactttggtttaccaagggtattttgcatgatgctgctgctattttaacttttcagttgttttttctcttactgtagagtgtagtcattgaaaagttaactgagtgatattgttatgtaagaatctgaaccttgcagtgtaaatgcacttaagtcatctttaaaatgttgttaaactactctgaatatactgtgcaatgtaaatgctgaatgattggggttagataaatggtgaaatgagaattaatgaattttatacagattcatgctttcgcctgataacctatgtacagatattttaagtacataaatcagatttgacacatttattttttgaaaagtacatatatgttctcaatgaagattcatcctaggtttcctctttgttcgtttcaatagtagcacatacaatccaaaagttcctgctactgctgcttttgcccttccattttaaatggtatgatcgtttggccaaaatttccatgcaagttgataagggttttacaataatctgaacaaataggaaaccttgaatctctatgtatgcacatgaatacttgattgtgaataataaaagttgttttttatacagcctcattggtgaaaatggttagtgtagtaaatcagatatttcattatagactaatatggtagcagattatttatgcttttaaaaattattttctggagcaaacagtatttgaagaaaaggtaaaaactatgaatgtgtaattctaagaatagttaataattttactgaaggctgaacgtatgtagatattttttatgataaaatgcagtttttctttttttggaacatgccaattactggtatgtgtatatgctggaaattttcttacatatcctttttaagtcaaagttattaacattatccagcatgctttaatatgctccacatatcaaagatataaccaataatttaacgtagcttaaaagataacatttgttttgtttttagctttgcatacatttgtaattccctcccaccaccaatataccttaggtaccatttgtgtacatttcaagattttttttttcaataaaaaggtggggggaaatggaatcactttgccaactattgttctaagagttgacatcagttaccatttctaatgcattgttgtgattttgtagtgtcattcataactggtattgacattttagaaaacaccaaagtgatttaaaatatatgtggggaaaaaaacttctcactctagtaacaatgttttaatcatgttgtttgttaaatatttaaaagttattgttcaatttttgctagactatcttaaatcatgatagtgttgggaagggggtatcaaaatataaaattgttagtttgtgtatataaacaatgcacattaaaacaattgaattgcttccagcatacaacaaactaccttaaaattatgttcaaaatctattaaatatattttcatggctaatgtcgagtatatgttttcatcaattacattgttattgtattaatcgcggttaaacttggcatctcttggcaggatcctatttaatttctgttgccatcaaaatatatttatatgcatgagttttgctataaacctttattttctgctataaagttatatattatgacaaccataaatgcaattacaaattgggtaagaacaagctgaataaaagttgttcccatgactaatattagtcttcatgcttttagcatattttttaagacagtaacactcatcccatcaaattattacattacatttagtatttttctgagttacattgacaagaacttaaattatagcctgttattaatattgatttccaacgactgaacagtacaacagatcaataaaaaagtttatacactgctttaactaatttttgttatactcatgtggcttagtgtagttagtcactaaaacagagttcaagtgagcttggcaatggtgttgagtaacaagaaagaattttgcattaatgatttctttttattttcctcatttaaacaaccagcattactgccaaacaccaaccgtggtccatatttgtaacaggtttttaacatgacatagttagcaagtttgattgaagagatttttaggtcctgggcctataagattttagtatgatcttttttcatgtttctaatgcttgaggtgttactgcttaacttgggaaaaaaaaaaacaaaaaacagtgttcctgccatttgtaagttttcctataatattccttttattaactttaaaactggacttatcgggttcaaataggcagtatcccttttaagtgacctttgcaacccaagtgttacttgcttatttgatgctctcttgtattttaaatctcatttaaatctttgtctgtgaccaacaaagcttaagattttgtcttcatttaaaactctgaatctattccattgatcatgttagacgttcaaatgtttaatggtatagtctgacctagtgaaacaaaatggatgttgttactttttttaaagaatagaatgaaataactatttcacttgcccaaaattttaaatattttttcatctaaacttgtattgtttcccatagcagaatgtcaatattcacagtacatttctgtaaagagcaaaccaatataatgttttgagtgttgaaaaaaattccagatttttgaagaattagacaactcttcatctaccttatttctagttcacacagttatctcaaattccactgaaactaatgggatactgtcttgtgtagatgccagttgagtttataatgtgacctagtaaagctgtcttttttgttgtgttgtatgagtgtcggatcatgcttttaggaatacttttattaaaatggtgtgcattcatgcaaaaggccaactggcttttgtgaacaatagatcttttctcccctttattttgttctcttgacacttttgtgaaaattacctagcctgataaaaacattttgtaaaaatttgtataatactgttataaaatatttataatcccagaaaatgttgtgttaaatcttgtgcaaaaacagtatattcagaataaaagtttatcatttaaagtca

SEQ ID NO: 898 - DNA, 5605 bp, Homo Sapiens
gagatcgcttcctgcagaggaggcaacaggccccgctagcaggtcagggtcccgggcaggcgcaggtgccccccggcctctcaagcagggactgcggcgagctcagacgcggctgacgggcagagactcgcgcttgggctcagtgcgtgtgaagtgggcctcgggctgcggaggagggcagcaccccgtggctcctcgcgctgctgcgagcagggccgcctggcaggggcgggggccggtgggcgggagtgtcggggtaaggccgcggactcctcccatgccgctgagcagtggacagcggggactggagacctccaggtgaggaaggggaacgaagtcaagaaggccacatgtcctggcttccaggcttggtgtcctcagaagcctccagaacgtccatggaacccgcccctgcgcccaccgcctcctgctgtctttccagctgagttccggctgcccctcaccctcggcttcttcactctgcctctccccagccagcgccctgctccccggtcctcaaccaccaccttccacctgcctgggccttcatcgcctccgagctccccttccacaccaaacctggcgtccgttttcctccaggcctgcaccagcacagctgaaggggagagagacccaacctcatccactgggcctcccctcaaccagggccacaacctcaaggggccatgccacctccaacacctatttcccaccttctactctctccacaccctgggacaccacccgcctctctcagctgacgttttccttcttgttttgtgtgcatggtgcttgtgtgagaaagtggacacacagtaagtgcggcttccagatgcgtccgccacctgccctccgtgccacgcgcttccccctacctaggggagcctccaccagacagggaacccacgccttgccacccttctctctccctcccacttcacctgtccgcatcatttctggagccctttctttctggcacgagatgctccagggccctgttgtattctccctgccccagcctgaacccagctatttctgctgcagcctggttcattgtgggagaatgtcatgcagagcccgggatctggctccggatgtgctcattgctactggggtgtcattgcagctggcggagcaagggaacacatctatgtacatgcccacacgcatatgtatacacacagtttcatgggcgtgtttgtctgtttttcttgggcaccacgtgtttactctgatgccaggccaacactacagggctcaacctgttcggaatgaggggcctcctgctttgggagtgaggaacctggctctgattatctcctgtgtaaccagtctctcatccttgcttccaccccaccatatgctacccgctcctcaccctgcgtggcctctgacctccgctggaccaccgaggccccgcccccacaggggcgcctgcctgcctagcacagttgagcaaggagtgaattcccagtgaaatttttttaatttttattttatttatttattttgggtttttttttctttctttctttctttttgagatgggggtctccctgtgttgcccaggctggtctcaaactcctgggctccagcgatcctcccacctcagcctcccaaagtgctgagatcacaggcaggagccactgcggacacagcctgaattgtcaatcatatcactcctgtgcctgaaaccattgacagttcccatcacccgccctctccccagtgtccaggcccctcctcccctccccactatcaagacactggctcctgatgctccccgacaccaccgaattccatcctccaggctttggcccagtggctccatctgcctgggacggtctccccataacctcgtgtagttcaggcctttgcgggtgtcacgtccatggagatgtctccccagccctaaccatccctcccaggtgcctctctgcctgctccgggccctccccctgttgcagtgtgagcactgtgaagcccactcttaaccgctgctccaccagcccagcgtggcaccaggcacacggggtcatcggagaacagctggtgtggctgataggctctgagttctgagtgaggaagatgcaacccagcacagggaccagtgcccagagcaagggatcaggagggacagaaccatcacctgggccagaacaagggcagggtgcgaggaacctgagtggttggacttcaggagagccgggtttccgcaggaaggcttctctgctcggacactcgaggggcagggtggagcatggggcacatccagggctgagggacgatgcagagtcgggggacagtgttctgcacgttggcaggtgaggggtcagaggtggccctcagaatctggcaggcctaatgccagccttcaatgaccacctgaattaaaagtggaaatgagtagcagggagaggaggctgaggcagcagcagggaagcccaaagtgggcagtggccgtttgtcaccagagaccttccagcagctgtgggatgggagaggccccagaaggtccctgcaagcctggcccagggccatggaggagcctcaagaggagtgggcaccacactgcgggccagactgggcagtggcagggctgtaccccagggctctcttgtcccacaggccaccatcagcctggtcagcccatctcagtacagccagggccatgaaggaaggccacacaggaggaccccaggccagtgcccgccctggccatatccaaggggcagggtgcagccccagcacctccagcttatctgtaggtcctctaggtaaggcagggctgtccctggaacttgccccatggcccaggcagaaatcctatttgatggtttatggagggcaaagttgagaggaaggagggagggaaggagcaggggccccgggtgcttactcccaggtcttcactgcagcctggggctgccctctgaagtacacagtccctgggaggcagagacctctgccctgaggacgatgtgaatccaaaggtgcttctcacctccagccagggcccatccctggagataagagacactcagagcccttggtggcccaggggggtctagagccggcctcagacctgccctccctgccccgcctccattcccttcagcccaggcctcttgtatcttttggccctcacctaccaccccgccctctccctggcagagcaaacgcttcccagtaacactcccttctctgcaaggatctcagagatcagcctgtgtccctgagtccagagccacacccggtcagctctgggtccctgagtccagagccatacccggtcagctgtgcccaaccccgggcaagactgagctgggccctggggtggaggcggctgcaccgatactggctccacaccaggccttctctaaaaccccacgggagcgggagatacaattcagatgccccacccccacctgcttctcagcaggaaatggtctaatgtgaaagtaggtcttttaaatccgaattattcaatctgtgcatgtgacaggacccacagctccatctctgtgcgcgccctgggcgccgcgctccagccaggctttgaagggtctcagagctgcaggggacgtttctagatttccagctctggcaggagaggtccctttgtctttccctgggctctgggctcctgcagggcgtctgtcctcctcctaccagcactgtgaggttctccaccacacggccctctgctgtcgtcttcacttgcagtgagatccaggccccaaaggacagagaataaggagggagggagagaggagagcatcgtgatggtgcccagggggtgcagaatgtaggtgatcaagaagaaagccctaattagctcctgcagctttcaaaggaaggggctggtggaggaatgggaccatggcacctctccaaccctcagcacacacctgctgaggcccactgggtgccagggtgggtttagcaccaggctctggccctgaggccaaagcagggcagctctgctcagggggttgagtaggggcctggttcccagcttcatggggagcggccagtgaggaggtgtcaccgcagcagagccaggcacaaagtgagggcaggctgctgtggctggtgaatgagtggctggcagagctgggagggtcactgccctacaaggtcacagacatcatggcccaggaggctggtgtggcaggcagagcgaatgccgggccttgggggcctctgagaggaggctgactgtggccccctggaccccgtcttgcaggtgcggggagttggcctctgtcccccaccaggactcatcccttgttccgaagctccccaccatgcttctcacccccgaccctcctggccaccaacccgtggtcatgaatcatgaattgcacatccttcttgggcacacccgtgcttgcacacccaagctgggtacacacatgcatgtgcacaaacacacatgagctgggtatgtacacatgtgcacacacagtggggaatcggtgtctgctggggggtggaggaggtgatggtgtaagtgagcagatgcattgtgggggcatgtttcctctccctgctagagttggaccagaatccccagagaaaactcacgtggcctcttgtcactctggtgagcagacccaggtgggctgacactcgcagagggaggtgcgtagcttagaccaccagctccagtaaagacctgacaacacccagcccctgcctcccttgcaggccaatggaagaatccaccttcttccttagagtcctttatcacaggctcatctggcctcactgtagaatcccaaaactgcatgcacagagatagaaatcctgactatgtccagtggccctaagtaccacagatgaacctaaaggaagggcttttttttttttttgagacagagtctcactccgttgcccaggctggagtgcagtggcacgatctcggctcactgcaacctctgcctcccgagttcaagcaattctcctgcctcagcctcctgaggagctgggactacaggggcgcaccaccatgcctggctaatttttgtatttttagtagagacggggtttcaccgtgttggccaggctggtctcaaactcctgacctcatgatctgcacacctcggcctcccagagtgctaggattacaggtgttagccacagcacccagccaacgcggggcttttctttctttctttcttttttttttttttttttgagatggagtctcgctgcgttgcccaggctggaatgcagtggcgcaatctcagctcactgcaacctctgcctcctggttcaaccgattctcctgcctcagcctcctgagtagctggaattacaggcacctgccaccacactcagctaattttcgctttttgttttttgtttttttgagacggagtgttgctgtgtcacccagactggagtgcagtggcgcgatctcagctcactgcaagccccgcctcccgggttcacgctattctcctgcctcagcctcctgagtagctgggactacagtcgcccgccaccatgcccggctaattttttttatttttagtagagacagggtttcaccatgttagccaggatggtctcgatctcctgacctcatgatctgccc

SEQ ID NO: 899 - DNA, 1020 bp, Homo Sapiens
ccctgttgtccaggctggagtacagtggcgccatcttggctaactgcaacctccacctccccggttcaagcaattctcctacctcagcctcctgagtagctgggactacaggcagccgccaccatgaccagctaatttttttttttacttttagtagagatggggtttcaccatgttagccaggatggtctcgaactcctgaccttgtgatccgcccacctcagcctccctaggtgctgggattacaggcgtgagcaaccacccggccttattgttcttatattaaaacaaaagaacctagaaaaaattgcttggttaaattgtagagaggaagggagggaaggaaaatgaaggcttttcttctttgttctttaaaagtccaagcactttctttcagaatcaaaatgtagagaggcagtcagtcttggagcatgcttttgcattttaggatactactcattaattcagttttaaagcattcactgggttgagcacaattttaaaaaggttctgactcacccagatcctgtttgaagctcaactcattttgattgaaagagatttgagacaagaatttcagaagagaaaaatgtgtgttacacctggacatatatacacatgtaacagggattgtattccttctagtctaagacaagagattctatggtaaattatttaaaaaaattagttttttttctagcattgtattgtcaccagaaagaagagtgctgaattctctgtttctgcatttcccaataataaatctcctaggagagataactttttgcagttgtgccccccacccattttctctgtggcttgctttatttcccacatatgaatacacacacagcagatacatcatgcacaaactttttttaatgtgtaatctgtaaatctaggcccattaagttttcattgaagttgggaaactgttgaggacttacttttgttcttcaccatgcgtgcactttgccaaggatctttggtaaccaataaaacgatcatgttcactctgaa

SEQ ID NO: 900 - DNA, 2344 bp, Homo Sapiens
acttttaggctcagaagtacatattcaggtttgttgtacagttctgccccatgccactccccaccaccatgagaaaaccaagaggacaggcctcactaggaaaaaaaaaattagccagtaccttgaccttggacttcccagccaccagaactgtaagaaatctcccagacttcatcctgcttcagctcctgtcatcctgtgctgtggaattcctaaacctcttagcttgagccctgcaacgatctgattttcactccgttctaggaaggttccattcttcagtgtggagcacatataagtaagtgtctatttttgactaaaagagattgcctctcatagcgaaaccttgatattggagaaatgaatgctaaacaaacgagcctaggacttcctgctccttgttcttgggccttcaggtttgaactggacttataccactgactccctgcttagactagaactatatcaccatctttcctgagcccccagctttcagacagcagatcattggccttcctagcttccacgatcaagttgaccatctgggtgactgttctccctttttcactaaatgctatggtctgaatgtctatgctgtcccaaaatttatatgttgaaaacaaataatcaatgtgatggttttaggaggtggggcctttgagaggccattatatcatgaaggcagaacactcaggaatggggtcagtgccgttataaaagatgccctggagagaccttttgtcccttctaccagattggaaaagcattggaaaatttgtccaaagtcactcaacagattcatgatggatcctggattcacagccagctttacttggcaataaaattcaagtcctgttcacatcacaacacatttttaccgaaagaaaaatatgatgtgtagatgtttggaggcatcctatcttaatgaggcttttgttagaaagagttttcttaaaattacagggttggggaaataaaaaatgtttgttgctcagattaacaaaaaaatggtatatagaaaataaagctaagaaaggaaagtgcagacaaccaagagactagaattttcaataaatggcaaaattgtggtgttctgtggttacctcttgaagatttggcctgaatcatgcaacaattgccccttaccctcagtcctcaaattacaatagtgaaagaggtttctataggtattatatttgaatctgctatattttgtttattacttgcaaggacatataggagagcaaaagttttccctctaatttcttaggtttagtaactggaacttgtgaattaaactggcaaaatacagattaacaggagaagagtcatagacattttattttaaatttcatatgcaatgtagttccagagaaaagaagtgaaagcctgaagaagcaattagacttgaggagttatatctttaacaaagggtggtgagtgtagagaagtgactagattttttttaagatggttttaggcttccaagggtgataaaccatgggaaggaaaatacatgagggaaactaatggtatataggagttatttagtaaggtttgtttacacagactaatctcagtggtaagaacggtttttctcctttttctggtcaggggaaggagaagggacaccatcacaatgggaatttgtgctttgctggtagacaaataggagcagagcagagaacttctttctctcaattgtcttcagctcagaataatccttatgccaaacaggcataatttggaattacatattttcatcctctccacacacaagcttccgtataaagttcaaagacagtagtattttcttataattcactctgccccaaatattaactaagatgacattctttttccagcttgattctgcaacattcacttccagaaactttatcactcttaatcctggattgaaggaaaatatttgaatgtgataaaggatatatattttaaaaagaaaggaactataataaaaggcaagattcagaaattatgttgtaatctgtgacttagtgcaatttagtccttgaatttcttgtgtgcaatttattgttcatttcccttggtgaactaactttggttcatcgctttatcattcttctccaggctgtttttgaagggtctgtgagctgagaatggtttttaatagataaatgctcacaatcaatttggggataagaaatattattttgaatctcagttacaaaaaatgttatccttcataaaataattcatttttttctcagtaataaaaatgtatttcaaaaatatggtgtccttattatattttaaattttgccaataaaaataataaaaattgattttctctaattatgta

SEQ ID NO: 901 - DNA, 2991 bp, Homo Sapiens
ccgcgacccgcacggcccggacacgcccgccctcaggaaacgccggacgcttgtgggggcaaccacggaccgcaggacagagacccgcgggcggcgggttctctcggtggcgccgtatccagagcagcgcccgcgtgcccaggcggtgatgtcgccgcggccgaggatcctctgtgccagctccggccgcgcagcccggggaggtgcaaagagaaatccttggaactccttgagctctgagaattgggagcaacctcagggaaccaggtgctccagctgctgatagacacaggttgattccaaattggttattgtgaacagtgctgcaatgaacataggagtgcagctaagccttcaacgtattgatttcctttattttggaatccaccctgaaacagcaaactgtaactagatggaaggataaaaataaacatggcaaagcatccacccatcttgaaaacttctgctcagaggtggcatccatcactatgcctgacgtcagtggaacggaaaagtgggaccctcatgtcttggaaatgcagcacttattgactaactctcctgctggaaaagaaacaaaaaatgagcaagctgaacaaatattataagaaaatattttgaaccgacactgaaccaggcaagcggtgatgatatgagaggtcatgacccagagacgaaggaaggagcagagatatgcctgcaaactcaaaagctgcttttcccaaggaaggattttgtttacccaaaagccgtgcaaggaagactagaaaggctgagtagagtgcttgctaatctcctgggtctgtgatgacaaaagatgaaattcagagcccattaaagaagaaacctgtgaaatatgccagaattaaagttaggattcttgaaggactgcacattagcagtatgtgtaaatcaaaaaatagaacagctcccacaaagaattcagcccagaataaaagtatattttatgtgtggaacaaaattaaatatattaaagtgaaatttgacagaatacaaaagagatattctgaaaaccctaatagctattgaaacatttcacacatgtatctcatgcgttaatagaagcagccaaaaatatcattatggggactggaaatgtaaacaatatgattcaaaaaattgaccaaattgacatatattgaatgctagttgcagtgaatacagaatagaaggtctttcagatgtgttagaatagtcaccaaacttaatcagacgtaggagcatgaagttattctccataaatgtcagcgaatcaaatgtacacatgttgtggtacctgctaacatattaaaatgtgtggatgctgttttagtcatggtaagaaggaaatacactcaaatacataaggcagatgggaagaaagactagaaataaatgaacaaaacaacatcttgagaagagagcaaaaaaagcctggtttcatccaatgcatacattattgaaatagaaagaagtattcaatagagaatcaataaagccaaattgtagtactttcacaagattaataaacctaataaaactataataaaactgagaagtacatggagagaaggtagaaattataagcatcaaggatgaaaaaatggccattagtagtagttctagagatagtataaagattaaaataagatgatcagacaagttgatactaataacttggaatatttgattaagttgaaaaattccttgaaaaatacaatccctagtttgactcaagaagacaaaaattatgatatctcttaaataaattttatcctaatgtgatcatcttcctacagtgaaaattcaaactcaaaaaattcacaaatgaattttccaaacgctgaaagaaaaaatatgtaacttaaaaattctttgagatatttttaaaaaagaagaaacaatgtccaactattttatgagaccagaataacatttacaacaaaacatataaagacatgactcaaaagttaaattgaaaggtaatatttactataaatatatattcaaaagtcatgaaaaaaacactaccaaacttgtttcagtaatataagtcagcttgtgaaaattagagttattcattattctgtcagactgaaagaaagccacatgatcctttcaattgctttaccatggcatttgataaagtccaagtatataagcattcaaaaaatgtttaacaaactatgaatgacaggaacttacatcatcagataatgcctgtagtaaaaaaaaatagctgcagacaaacctcatgttcattcatgaaactttccccctaagaaattaagaataagaaaacattgctttctgttaaaatttaaaggtgttagctagttaaataaggaaaataatgtaagatccagaaagtaagtaattaaaatatcatttttccagaatgtataattgtataagttcaaaattcagaatcatctacagataaattagaattaatgacttgctgccttatgaaataaaagaaccatatataacaagtgagtatatctttacaacaaccttagaatttcccacactcaacaattcaattacagaatattataaattccacttatatcaaatcctgtattaccttatgacgtcaagtattaactttgccactctatttgacattgcaagccaccaatccatgtctagcaattttaaccttctgactttattctatttttattttcatagcacacctctctttgtaactaaatacattatttatttatttattgtatatataatttattatctgtttttccctaagttccctgtggatgtgacttatgcttgttttattcattgttgtatctcatatgtgtagatctgtgtttggtacataatagggactcatttctgtaagggttgtttgacctcatgggataccaccaattcactccattatcattgccactctttaggttctgaaaaggtgaattgaattacgtgaattgaattgcgtgttattaaaaacgtttttacaga

SEQ ID NO: 902 - DNA, 5086 bp, Homo Sapiens
catacctgtagtcccagctactcgagaggctgaggcagaatcgcttgaacccgagaggtgaggttgcagtgagccaaggtcatgccactgcactccagtctgagcaagagagcaagattccatgataaatttcaaaatgcagaatttattttagcaacaattttctaactccaatgaataataaattaacaacgaaagaggagcaaaaattattccatttgcttgaaaattgttaaacatctttctataataaatcatgagtaaagtcaaaagtaaaaactgaatgtataaacaaattggagctgaaagacaaggagaacaagatttataggatgtggtcaaagcaatgaaacggaagagttccctgattccccttgcagggcgtgcgacaggggtgtggctcacctgttcagtagccccctctgcagaaaccccttgcgagagggggagcacgcagatgggcaagtgcagaggccggggtgagggctttgggctctggctctgcggtagcgtctagaggtgggtgcctgcaaccccagtgttacaaagctctttcagcttggccaccacagacagctggagtgttaaccagctcaatggaccttctgctttttcacaagggcaaaggaccaggggacagctttctgtattccgagctcttttccagaatccaggaaaaatcgggtcacacacggacttgaaggatgaatgcgaggttttattgagtggtggaaatggctttcagcaggatggatggggagctggaagggtggggatggatgaagtgggaaggtgatcttcccctggagttgggccgcccaggggctggactccgctctgactgccccgagccaaacatctctcggtgtccagacgtccctcctcttctctctttctctgctacgtcgttttgccgtcagtcggcttgcctcgtatctcctcacctgctggtatgctctggaggttggggtttggggtttatatgggggcaggatagggggcgtggtgggtcaaaaagcaactttttgggccccaaacagaaacgcctcttctcatttagggccgcgggtatccaggcttgagggtggggccttagccagggaaccgccctcttctactcagtatttccgtctcctgttcgtgtcagcaatacacagaagaaaatcccagactgcaaagtgctgtacttcttgaagcacttgtgaaaactgactttaaacttaacaaaaaataactgtgagaaagagtggatagggagaaatttagatgaatagttgattgagactatatttatttttaataataacaccaataataactaaaatatagcataactttatggaaggcactgttttatatgtagaacatttgttaactcatttaatcatcacttcaaaccaagagatagatacttttattattccccttttaaagttgaagaagccaaggcacagatgagtctaataactttcccaacactacccaattagcatgtcagacataggaacctaacgcatgcaatcattgtccaaaatccatgctcttaataactatgctacacatctgctgttaagtgtacctgcttctctgcctggcacatgtcggcagatgaatataaagtggatgattatgaactgttagttacaatctagatttgtgccataatgggaaaaatactaatctcaaatggaacatgtttatctttgtttagttaaatatagtttgcttcataaaccaaatcttttggatcacggaatcacagttggtggtaagattgggaatcaccactatagcctccctacaaaaatagctcttacctccataccctctaccccattccaactgcaaatgccctagtttattccttcctttcctcttacttgggctgttataaaaggcttctaactaggcttccattattttctctctcttgattatattcattgctactcaagtaattaatcctgctaaaacattttaatacatctctattgacatcctaagtataaacttccttaccatggcattaagccctctgaaatacaactgcaacctgtatcctaagtcttaactttcattactgcttcacaaaatgcctgtgtcaatccagatgtactaactcttactattaatcatggcaattagatataaggttctgaattgttgactccatgggtccaaattttgactctgccaataattagatctatgacttcaagtccattctttaccctctctgaaacttaatcccttagttcgaaaagatctttattcattcaaatcatggcaagaaactccttcaggaacacaggagatagtggtaccaaaaacagataaccacgcaaactatgcaaacttggaaaagtgcattgctttgtcaaagttcattaagtaggtcttaatattttagcaaaagaaaatcttccatctgaacacagggcatgacaaagctcatttcacacaatggaaggaaggctttttttcttgtttcatgtttgtatgtttctgacactgcagtattaacattttaaattgaatctttaaatgatttttctgatgtcaacaacattattgggaaggccaagctcggtagatgaccttaactgaggtggttacagcattgttcccggtaattcggctttgtgatatatccttcttctcctaggtattaaggtctggtttgaattaaagtccgcagcatactcacagctgtggggagtaactgaaaggacttgttttcatctgatggccaaaagactttcttgtaacatactttttaattgaactcttagcttctacctatttccatttctttttttccaggtactaagttatctctcccttattttatacaacttcctatcttcctacctactcccaaattaataaatcccaattaatcaatcaactcccaattaatcaattatctcccaattaatcaatctctgctaagagttccttacccttccactgagcatggctactttgatccttttaccccaaacataagtatttataatatttttatacctttgtatagtatccattttataattttaccatattctttaatagcgactcaactgcacttctctgatattaagaccatggataatataactcaagagtacgtttttttcataccaacaattccatggttggcagtgtccaagtggttaaaaacatgtctctaaaattaataaaacctgggtttgagtcctagttctgtcatttaataattgtgtgagtttgggaaatttaagtcataaaactctagattttaatctcagacattttctttttggaaacaattaaagtctctttgtgctgcatcagaattcacaaaaaagctatccagtgtccatttacattaattatactggtgattgactatggctatgccagagaatgtattccaggctcaagttctactttttgatgactgttctcaggatcatcagacacctgtccgatgtagcagctggaatatttaagcatcacagtgcttttaaaatagcagacaattgctgtggctgaagccttcagatgactgcagccacagctgacagcttaactgcaattttatgaaagactctgagccagaaccacccagctaactccctcctggattcctgaccatgagaaactgtgtgtgataaatgtcgattgtcatataagctgctaaatttgggggcaatttgttatgcagccttagataactattacattagagaataggagaactgacaaaatgtagagattccatttatcactttaaaaaatctttattttcccacttatagaacattaaatacattttctgcaaaacaaacaaactaaaaacttggaaaatataaaagcacctttaatcacaccactcaaaggaatactgttaacctccaatggatgtctccattgcttcttcagtagaatccccccaaaaatgtttttatgggttgaaagcattaaaaagagtctctatttgggtagactcatttctaggtagtgagattgtatcttactcttcatggtatcaaccccaagagctgacacatactatgtgctaataaaaatgtttaggggatagttcatcagtcttattagaaatcagacaaaatcaaaatatattaccaaatgaactcaattccccatagtacctgctgtgaagcaggacatttagaatgtaaaatggggaaataattttactctcctgcatttgtacagagaacatttgagtaacagttttcccaagcaaagtaaaccaaatatttatctggtggatttaggcagcagaacacaacacagagagtttacatgtttcaagaagttacatacctcctgcaagcgatataacctaatatccaaattatcttagtcaatttgagcttctataacaaagtactataaactgggtgacataaacaatagaaatttatttctcacagttctggagactgaagtctgagttcacggtgctagaacggtgagggactggtgagggtcctcttctggttgcagactgccagcttcccattgcaccctcatatggtggaaagacagctagctagctctctggtctcttcttttaagagcactaatcccattcatgagggctccactgtccaaaggcccttccatcaactactatcacattgggattatagtttcaacatacgaaatttgggaagcacacaagcattcactccattgcacaaatcttctgacccatcctaaacttattaggttaccttatctcactaaatgcagaaactactgggagtgaggctgccataaatctcttctggagaattttactggccataaagaagacagagaagaccgcttgcaccttcccccattaagtaacctctcccctattaggtatataaacccccatctttagttgtttagagtcacatttttctgtgtgctcctgcgtgaataaaaatctatgttttgtctaagtttaattcccaggccctcaagaactgaacctaagagggtagaggaaaagattttcctctccaacaaacattacttacaaaggtaagtaatttcatcttcattaaaaacatgagaaaactta

SEQ ID NO: 903 - DNA, 341 bp, Homo Sapiens
atagggcggagggaagctcatcagtggggccacgagctgagtgcgtcctgtcactccactcccatgtcccttgggaaggtctgagactagggccagaggcggccctaacagggctctccctgagcttcggggaggtgagttcccagagaacggggctccgcgcgaggtcagactgggcaggagatgccgtggaccccgcccttcggggaggggcccggcggatgcctcctttgccggagcttggaacagactcacggccagcgaagtgagttcaatggctgaggtgaggtaccccgcaggggacctcataacccaattcagactactctcctccgcccatt

SEQ ID NO: 904 - DNA, 961 bp, Homo Sapiens
tctaagtcagagtcttctaaaaagcctgaacagctgaggaagctcttcattggagtgttgacctttgaaacaactgatgagagcctgaggagccattttgagcaatggggaacgctcacgaactgcatgggtaatgagagatccaaacaccaagcgctccaggggctttgggtttgtgacatatgccactgtggaggaggtggatgcagccatgaatgcaaggccatgcaaggtggatggaagaactgtggaaccaaagagagacatctcaagagaagattctcgaagaccaggtgctcacttaactgtgaaaaagatatttgttggtggcgttaaagaagacactgaagaacatcacctaaaagattattttgaacagtaagggaaaattgaagtgattgaaatcatgactgactgaggcagtggcaaaaaaaagggctttgcctttgtaacctttgacaaccatgactccgtggataagactgtcattcagaaatactgtactgtgagtggccacaactgtgaagctaggaaagctctgtgaaagcaagagatggctcgtgcttcaaccagccaaagaggtcgaagtggttctggaaactttggtggtggtcgtggaggtggttttgatgggaatgacaactttggtggtggaggaaacttcagtggtcgtggtggctttggtggcagccatggtggtggtggatatggtggcaggggggatggctataatggatgtggtaatgatggaagcagttttggaggtggtggaagctacaatgattttgtcaattacaacaatcagtcttcacattttgggcccatgaagggaggaaactttggaggcagaagctctggtccctatggtggcggaggccaatactttaccaaaccatgaaaccaaggtggctatggcagttccagtagcagcagtagctatagcagtggcagaagattttaa

SEQ ID NO: 905 - DNA, 2451 bp, Homo Sapiens
agagaatgatagaaggcctctcctctgccccacctctttcatgcctttcatgtaggcaaagtagacagggagggtgttttctcccaatcaagctataatcaaactgacttagaagaagctattaatgcacagatccatcattgcttggctatggacaaacgggcaggtggtgctgcacaacaggctgggatgagctctttttttccttcctggacggaaaaggagatggacctaaacagctctgagcagccaacggagggaagaagagattcctagaaggcaagaaacaaaatggccaggtaacccatctgaatagtatccgggcattagcacaggctaccagccaatcagaagcaaggaagtgaagaggaaaggaggactgagggattgttttggctgctggtcactcagagactaagagagagagccttcagactccctcattcccttgtgggatttatgaggaaactaagacccataaatatcaaaaatgtgacccaaggccttggatatagtgattgtcagagttgccctcaacctgggacctctgggatcaagagaagtgagccttggactaactacatgttcactctcgcatcggaaattgggtgtaatttggcttaaatatggggcttggggattgttatcaatttgttatggcacaaattgtcctttttcaatttgccttttctcttcccttcttccctccaaaatatccccctattctttctccctctgcacttccaattcagaggaactcaggtttttacttccttaggaggacgtgctagcatcaccggtgttgtgggccttgagccgagggcctcaggactgtgatgaggctcagggccacagtaagagcagggtttcctgaacacaacactgcacttaaccacacctgggtgaaaatttcattttcttcacacaaagactgggctctaaagtgtccagtgttctatgagtctcgataaggtgaaataattctgttattgttgactcatagattttctgcttgcatgtatacctaaagactttttgcaattcttgccagggtatatattttttaagatacaaaactgtcttacaccccacagcaagctttaatcctgtgaggacaatctgtttctcctggcaacactaaggctactagatgaacaggggtcagccgggtagtttgaagagaagccttggtaatctgttagacaaagctgagaattctctaaagaatgtctagcaaagatacttcagtttgaagtgaatagaaagggttttgttcacaggccctgccttgctgctggattcaaagaatgtgcagcaccagaaaaggacatcaatgtccttcttgaaaatgaaacacacacgcgcacacacacacacacacacacacgtgtcttcttttctgcctgcattgagcattgcataactgtggaaaagttcatcacgcctgaaaatatgtatctttcctttgatccaaagcaagtgctatattggaataaagatgccatatcttccgcctttagtaaaatgaattgtcaaggattttgcttcagaaagatcaagaaaagaccaaacgattctgcagggtgaggcctcagagttcaggctgttgattaggagttaggggccctgtaagtcttattggttctcagctttctcactagctcatgtttgtgaccttaggcaaggcacttaagctctttgtaccttcattcctccatttgaaaattagagataatacttgccgcctacttaaactcaaagggatatgtgaggattagccaattaaagtttgccaaatgcttgggaatcaatggagggaaaaatctgtatgaatataaggtatcattgtcagtcccgcctgactccctcttcactctcttacccctcctgtttccaccctctcttttaaaggattgccttcctgggaaactcatgagcattatgcatggttttacttatggttgctattgtggaaagtggccatctcctattattaagtgatttgtttgaagttggtcctttctataccatcacgggggaggtttccaaatcaaagcatcctagactgattgtcagtgaggcacagctggcaaggtttcttttgggtttacctttagcatcctgtagagaggagaaaacaaccattttaatgtaaaatagtaagcataatttggaaatatttgcccattaggaatacaaagctagtgaggtacaaaaataaagtcaatttagagcccttgttacaatccttgaagaaattccccttttaaccaaaacaataatagtgcttcctatttcataaacgttgctcctctggctgttacagccacgtgaaaaatgagtgtaacataactatggcatattatctgtttgtttcacaattggaaaattgagatgcagagagattaagtgacttgctcaccacaacttagctaacgaacggaacggcaa

SEQ ID NO: 906 - DNA, 5965 bp, Homo Sapiens
ctctttcatgcctttcatgtaggcaaagtagacagggagggtgttttctcccaatcaagctataatcaaactgacttagaagaagctattaatgcacagatccatcattgcttggctatggacaaacgggcaggtggtgctgcacaacaggctgggatgagctctttttttccttcctggacggaaaagctgccacgtctttgagctgctgagatgttgccatgatgtggtggtgcctgaggagtggtcctttctttggcatctgcaggccctgaggcatggtctggaactggaagaggaacaaagggttgctgaagtctgctttgcaggtgtagctggcttgctgaattcttctcctttgcctaaagagagaggctggaccattcctaataaggtaagctcaggcctggaaaatatcggctcatcacctagcttcttcaagccaaaatgcttttgacctacctgcacactgctcttttgctaacaactctcttcctatctctctgggtttccctataaagaagatagaagggtctgtttctccttaaggtttgtaggaactctatcccaaaaataaatccctccttaactgcatagcggaacggttcactgacagctccctgtctcactgtgggctgaccttctcctggctgactctgccaagaccctcatattttaaggatgatgtcttacttcccagtttccaccccacagcccacctgcctcttccattcctccctctactcaagcaggagatcgatgatctaaatccctatttgcagatggtgagaatgaaagtaatataagatataaagtaataaggcataaagatgggactacttttagtatgaatcatttgaaattcctttctcattggtcaaaaagcagttaaatattggcaatttcagatgattcacctaacgattctttttgcccaaggaggcaatgtgaggtgcacatcagttgcctaagtcagctagactcattggatgcccttgacttcaactactgcacatgcctggataattctcaaatatgcatctccaattcagcttctcttctgacctatcagacatcctcatttggatgtgacaaatgtaccccaaatctgtgatgtccaaaatggcatcattgttccccacttcagacctgctcattctatatccctgtggcaagtgcctccattatccaaagtcaccaaattctacccaagggaatattcgtagctgttctctcttaaatcctccgtctcagttgatagacacataagttaataatatctccttcatcgtgtttaatctcctttctacctccccactgctctcttctaaattctcataatttcttactggcattctagtaacaacctcctaattattttctctgcctccagttttctcacatctccaaagcctgtggaatccttcaatcagggacatttttctgaaacacaaatttgatgatgctcttcttcttccatgtctcctattgccttttggtaaaggcctcattcctaaacacccacaagaatcttttatctcatggttatcaaaggaggttgggatctggcagtattatctctctctgtctcttttttattttcagacagggtctcactctgttgcccaggctggagtgcagtggcacaatcacagctcactgcagcctccacctcctgggcccaagctattctccttcctcagcctcccaagtagttggaacagctacctgtgtgaccttgggcaagtcacttggcatctctgtacccccatttatacaaaggcttttgatcatcagtcttcacatggtctcccacactgccctgtgctgatggagcagagacgcaaatgacgtgggccatccactttaactgtctttcaaggcctttccaccaggacagtacctcacaggccttatggcctttggagtctggacagcctgaattctcatcagtaaatacttcaggtacctaattactacccagggaggaacaatgtggaactacaagcccagagatggctacaggtgggcagaagcgggagacatgcaccatcatccttccagaagaggaaagtgatacgtaactgtcagaaatctgattaaaatttgcacatgaaatcagttagataaattatagaacataagtcatgattctacttctgaaaaagaaataatgggtaatttttcatcaaaatagaaaataaatatgaatcactacaatacccaagtagttgttcccatcccttccacccccagcaaatgtatgcacaccttgtgccagtggatgggatgcagtattggaagtagaggaggctggagggggtggagggtaggaagaaagaacccagatgggaagaggtgggaaaatgtcagagagaaatttcccttgagtcccaatttgcctggagctgcttctgcctggagctctacaagaaaagctgttcagaaaggaggccaaagagagaggggagaaaataaactcctttgtgaggttttccagaggtacacatttctgaaaagctgattgtatttcttcctaatcattccagtccagagtccaatcagcacaaagactgagacaataaactcacatcacaaaagtttctgggatccaggcttcttttcagggacaaataatacaatttccatctggataatttgttcatcatggccctatgttttcttaactgtcgagtggagaaacaaaggcaggactcagtaccaacttctatcctctgtggatagcacaaagacatcctgcatttgccctggaggagcagttcatcatttgactgtattttgtacacaaacaaccatttttcaatcagatcaagattttcctactttcattcatcctaataccctacttctgcacaatcagtcagattggctgagcagaaaggctagcttgttcatccgtgtctggaaatgccagatgtacttttttttttaagcctggaatgtttttcactgaacttggccaagtgtctgctcagaggggagctccaggtgctacccctggactaccggctcccgggctgcaaggggtctgggtctcgagttggattgtgagggctagagcattcccactcaccccagtaccctgcagtgagccggcttggagtggtggcaagagcatacatttcagagacagtttctagcaaccttccttactagctctgtgacttcatgtctcatagttggcacgcagtacatggtagctattgttaacatttattagtgacaaatgccaccagcattaagacactattatcctctagtcccttgctactcataatgtacccacagatcagctgcttctgcatcacagggagcttgttagaaatgcgtcagaatctgcattttagcaagatctccgggaagttcctacacattaacgtttgggaagtgctgcagtctagtcaacactccctggcttcctggaagggccaacccacccagtcacaatgcttttttcaggacaatctctcctgtgttcaacatttttttctacaacccaaatcttggcacatagccaaatcaaatatgaattcatctaatggaaacaatgaggtagaatatttgacattgagtttcactatcactatgtttaactcctgtctcataaccattttgctttcctatatctgaaaaaggggaagaattattttaaacagttcaccactccagccccttttattctagtcatgggtgaggctatatgttagctttttatgcatttctctgcctaaacatttcttctaaggaaaaaagattccccagcagacacaccatgggaatctgccttcttctggaaatcagtccctgcactgatggagctggtccaggtaacgcctggcgtcccctcttcagtgaatgccacaggccctgcctttttgatgcccctttatttcagctgcgtgggcaggacaccaggctatttgcaacagcaatttctgaacatgacttgcaatgcatacttgccagagagctaccacttcatcaggactgactgaattagaggcagagacagctgctgctggtaaagtcttggtttcttggtcccaggcctctggttcccacatgcgatgccatggagaccctgtttggaagcagcaatgccccctgaactgtgagctatcactctaaatgtttgtgcaaagggagttcagtccacattcattttttgtaattattttctatttttccgattttccattctagaagatatatatgttcacggtatgaaactttcagccagagtgggcctcatcaagtagccttgaccaagaactatgtagttcatgggctgcatggaattgctctggcaaccactagaatcaaaggaggggctgactgtgggttctggagatagtatgatatggtagcagggatttggtcatttccaagtaatacaaaaccaactcaaaccagctcagattggcttggtaactaggaagaatgctgggtggctcacaggtagaagaaagagttatagaaccagaaacttatgaattgtaatggggatcttaatgtttccaggagtttctctccttgctgtgtgtgtgtatatatggatctatatcacacctacacacttacatgtttgcatgtatttggttataatgaaacctcattaaatggtggtgtgctggcttcctttattctaccagaaaagagggctatgagtctttctttgtctcattttttctctaatatgaccctaaggggtcagcaacctactggcctagtagcctgtttctgtatacccccccactcccacacctggcaagttaaaatgatattaaatttttataaggttgtgaaaaagcaaacaaataatgaaggctatgagacaggaccatatggcctgcaaagcctgaaatatttactatctggccctttatagaaaaaagttgctgactcctagaaggtaagagacagtcccttacctcctccatcaattctaacagaaacttccctgggagagaggagtcctccctgaagagtcaatgtggcaagggagaccagggatgctgattgaccaggctcaagtcctgtgacctcagggtacctgggggcagaacaggagctctcccaagaaaaagcagtgtacagtttcccaaagaaaagggaagagtcactgggaaagcccagtgggataccctgtaagaaaacagatgtcactcttaaaagaggactatttgcaacagcatggacagcgtggaaggatggagaagagcattgggactaggaacagaggactcttaggcctgaaggggtaagggaggggagtcattacctaaatctacaggagccttgactgtcagcttggtccctgagctggagagagagagaacacagcaaccactaaacagcagcccaggggtaagaaagctcccactttccccaccctccaggcaagccaacaagaagccagaggccaagtccgagaggccaacttcctgggcacagagcaagtttcctcatctgtaccacgaacttagatacgcaaagggcctgctccacaggcatgagcaacaacacagacagtttcctgcctttcccccaagtactctctctccctctttcccaggagatggacctaaacagctctgagcagccaacggagggaagaagagattcctagaaggcaagaaacaaaatggccagattctgggcactcttggctgagttcctctctagcaactggcaacagccagatagttgcctccaccaagatcatcctcccctctctggcagaagaatgtttggctaaaggagaagtccaacacctcttcctcagggcagaacagctctgacagaccatctcttttccagaagtcctcataagcttggctgaggcctttgttgtaattgcattacagttccatttcttactaggcccaatacttttcccttacctcttatggctattattctcaaaagtatgctctcaataaac

SEQ ID NO: 907 - DNA, 2821 bp, Homo Sapiens
ggaccatgacccttaacctcaagattctgtgacttgtcagggtggaaaaaaatgtatgtaaataagtatagatgtgataagctttaataaagagcaggggaatttagagaaactgtaccaagcattaaatgtattatttttagtaaccagaaattccttctattgatgtaattaagattttatagtgtttgagaggccaaggcaggaggaccacttgaagccaggagttcaagaccagcctgggaaacatagcaagaccctgtctctccaaaaagaaactaaaaaattagccagttgtggtggtgcacacctgtagtcccaagctgctagagaggctgaagcgggagaatcacttgagcctaggagttcaaggctgcagtgagctatgcttgcaccactgcactccagcctgggtgacagagtgagacactgtttcaaatagaaaaaaaactgcatatagtactttactctcagatatgagtgtttctgttgaccaggaattttaccattcctggttctctgatgcggaggtggccttgtgaaaggacacagtttctgctgagctgaacacgctttagtgtaatctgatgaagaacttctatgctggttgcggtattggtggaaagtgttttattttgcagaaaaagcacaaattccacagagggcaacagttatccattcactccatagctatctattgctgcatgacagactaccccctaaaacttagtggcccatgccactattttattttgcatgattctgtgagccaggaatttgggcaagattcagcagaacagctctactccctgtggcactggctggggtcatggacggttgtgtgccactggtgggtcagttgagaggggggcccagccggcacagggacagtgaggctggaccatccaaggggcttctttcaggtttctggtgcctcagcttggatggctgaaacagctggcagctggccagggctctccagcagggtggccagacctctatgaggtggcaagggctctgaaagtgaatgctccacaaggatgggcccagtgtgtcccccttgcatcatgctggctcatggatcactggccaaggccagtttcgtggccacacccagagtccatgtggaggggcctgcacaggacatgaagccaggaggtatagttcacaggggaacacaaaagtaacgttcactgcagggacagagcagatcactgaagggaatgccactgggaatcgagccccatgtcctggcccctgagcagagttctgtccccaagaccattactcctcatggaacttttcacctccctcacacttacggcaatgctaacagtcactacacacggttctgagaaccttcaaattgaagccctcatgatgtttcctaagaagttgcagttgtccaaatccacaaacccagattttagttggcaagtctgagaggttctgggtaactgttttgctgcacaaacgtgggtattcctgaaagtttaaagattcatcttcaacatgctagggaaagccaccatgatagctagtctaataatgcccagaccatcccctcattgatgaatggaaggctcacattttaagatgaatatgggccagggaggtttcacctttcttggctgaggttgatgccaaagtgataaaccttggtgcttcccgcctccctgttccctggggatgggccagaatcagatgccatcagggaccctgcaggcaattctgagaattccttttaagaagacacctgcaggaagggtgaaccgctttctagcccttctgcagccagccactccccctgccttttgatgacacaggttctgcataaggtgagagggaggacagggtgacatccatttcttgtaaaaatgcctcaatgagaaaagggccacatgcatttcttgtaaaaatgcatcagtgagaaaaacaacagcagcagcaacaacagcaaatatttactgaatctcctagtatgatccaagcccccaaatcaagaaaatgtgaatgctgatgtaaaaaaggaaggtatttgttcaaactgcctggccagtgtttttgaagaaaacagagatctccagagaccccttttttggtcctaagtagcaagcaaacaagttcattaaatgtgtactgtttatttgtgatgtctccaagcagagtagttggctcttgttatatatctgggagaataatcaatgatttatgcttctgacagtcttatcatagccatttacataatggtcatgtgtatttgtgactttaataccctctgcatatagccttaatttttaaatggattacactgttttgctgttgtgactttgcttgtttaatcatagctaagacttttctgaagtcaaatactttttccattatcacagtgaggcgttggcaaaaaagtgggggcttgctggttacacttgctgaaaataaatcttgcgtttatttggactctcaagattggagctctgaattcacatagtccagtgtttatgcacagagcaccactggcattgccattgattacgactggcatgaccactgccagaggtttagcagccctggcacacatccaccaaatgccatttcaatcactcagaaatttctacaacaacagaaggccccccacatgttgggatagtgggctgcccttgcttgagcacagctgatcgatccaaccactggtcagcggttgcatctcctcttcaacactcccctaaagggacagatcagccgggctctgctccagcatccccagcgatgaagaagtcaccacctcctgaagccacattggcctgtcctcattattaac

SEQ ID NO: 908 - DNA, 1757 bp, Homo Sapiens
actcgtggcctgacgcatccgcgagactgcacgcggccaggcgggggcacgaacgggttggggcatgcgcgggcagcgtcgagtgggtcccttgggggtgggggtggggggcagtcgaactagggagagagtctgtggaagggctcagttgtcacttcacacctttccccgctgtttattgatctttaactctctctgtgtgtcctctctctctctctctctccctctcctctctctgtttctctctctctatcccttcctgtccaccctttggggccatctcttccaagaaacaaccgtctctcccagcccatgggaaattgtctctcctgcgaacttatccaacctgagggggtctcatccatgccgataccggctgcttgtggaaccttgtaagagttcttccctctccctgtaaaatggagataagctgtgtggtgctgaggccagcgccgggcacactcaccctcaccttcttcctgagagaggaaagagcctggagacctggattctacctctgcccccaacccctaccacagggtagccctgccaccacctgctggttctttgggcaagtcactcttttattggacttccatttcctcagctctaaaatgaaggaggtgagcccagtgtggtggcacctgtagttccagctacctgcaggctgaggcaggaggatcgtttgagcccggggggcagaggttagagtgagcggagatcttgccactgcaccccagcctgggcaacagagcaagaccctgtctttaaaaaaaaaagtgattaaaaaataaaaataaaatgaaggagttaaacaaactcaggaattttgtatgaatggcataaatgagcacattagaaggaagcaactttccttctctctttttttcaatcctgtacaggccagcttcccctctgccctctgctcccctcctccctccctaccatcctccagccccccaaagccctcccaatttgagcctccttttggaaaacatctctgagtatggtaccgttggtatcggtgactaagaggctccaaggatacccttctgggggatttccaaaataatgaggaagtccatttccaaaatcatgggaagtcccaactgggcctcccagacagttggccactgagtctgtcccctaaaggatctgcttgacttgcacagtcttaaaggcatcatgtctggtttttaaacataatttcagttagtagccaacagttcagatcaagggatcacacggcctgtttgacctgttcttgcagggtcatgcatgctccactgagccatgggaagtgtccacacccagccatgggagccctgtgggatctgaaactgacatttctgctttaggtgccttaagctgaagaaatgcatagtagcgggaattggagtgcaagtgagtgcagtaggggaagtattttgccataagaaaccctaagcctctatggacaagaaattctccaggggcagactggccttgaccccagaaatgtcacattggactcggccttggttttcctcatctatacaatggtcaatcagactagtggtttgttttttgtttgtttgtttgtttgttttctctgtcgcccaggctggagtacagtagtgcaatctcggctcactgcaacctctgcctcctgggttcaagcaattatcctgcctcagcctcccaagtagctgggactacaggtgcacgccaccacatccagctgatttttgtaattttagtagagatgaggtttcacc

SEQ ID NO: 909 - DNA, 4892 bp, Homo Sapiens
gaaagggtacattcgccagcagttttgccacgagagtacaccgaacaaagagacagggtcatttgtaacctgatgcgtccaccctactgctgtgtccggtttccattggctggaacgggacctcatattctgtatttgtcctgattgggaagcaacttaaaactttttaaaagaggcgaaggcagaagagaacaaaggaaggagaaagtaacttgtggaatggtgagaaaggcatgaggcgaattctcagccatgacaaggctgaaggccagcaggaacaggctctagcgaaatgggtgctgtgtccccttcctgcatgtggcagaaagttgcaaagtttcatggatttgaatgtgaacatctgttccctggacgcactgccaacaacgtggtccaactggtactcatcgttggaactaccaagtcaactaattttttttttttttttgagacagagtcccactctgtcgcccaggctggactgcagtggcgcgatcacagctcactgcagccttgacttccccagggtcaggcgattctgtcacctcaggctccctagtaggtgaagactacaggcagacaccaccacatctgagtaattactttttgtagagatggggtttcgccatattgcccaggctggtcttgaactccctaaggtcaagtaatccacctgcttcagcctcccaaagttctgggattacaggcgtgagccactgcatccagccagtcaacttttaataaggtccttgttaggtacagtaagggacatgagatgaaaaagagctggactgtcttcttggagcttacaggttagttagagaagatattaaaagacagatgagatgggcctagactctctgcctacatctttctccagtgctggatgctccctgcccttgaacatcagactccacgttcttcagttttgggactcagactggctctccttgctcctcagctctagacagcctattttgggaccttgtgatcataatttatttgcatgggagctcctgggatcatagcagacaggaggcaggactagattgtagcttcagacagagcagcatgcagaggcttgcattgtgaattttagctctagatcaactgcaagaacaaaccagcaatcctgagaggacccacagaccctctgaaggaagcggattgctcctgcagggcccgggagacccccaaatactgtgagtgccccaactgtggaagtgggaaagggagatcctcctctcccgaacacacacccccccactggagaggctgaaggtctgtttgcaggagaaatttccaactttacctggagctaagtcagactcagcagagcgaactacaggggtagaggaagcagcagaaaggccgtgggagctcgctgggtccccagaaggcccattcctgcctggcaccacagggatccatcgggagggtggccagaggagcaagggataaaactccacagggagaagaattctctagtcgaacttcgtaacaatttaaacagggtgagaagcctcctggccagaacttgggcaactgcacgaatccagcatgcagacttcacaggtgggggaagaactacagcccttttctttcgctgctgggaggggcacagccttggggcaaattttcaagccagtctcaccctctgcctggaaacagactcggggcagttgtgggggaacacggtgggagtaagaccggcccttgggtttgtgtgggagctgggtgaggcctgtgactgccagctttcccccacttccctgacaacctgcatgactcagcagaggcagccataactctcctaggtacacgactccagtgacctgggaatctcacccacattccctacagcagccgcagcaagacccgcccaaggagagtctgagctcagacacgcctagctccacccccacctgatggtccttccctatgcaccctggcaggaagacaaagggcaaataaatcttgggagttctagggccccgcccactgctggttcctccccatattaccacagctgatgctttctggaaaggaccacctcctggcaggaggccaaccagcaaaaaaaatagaccattaacccaccaaagctccattgtaccctctgccacctccaccgaacaggcactggtagccatggctgagagacccatagatggttcacatcacaggactctgcagataacctccagtaccagcctggaactgggaagattcgctgggtggctagacccagaagagagacaacaatcactgcaagtttggctcataggaagccacatccataggaaaaggggcagagtactacatgaagagaacaccccatgggacaaaagaatctgaacagccttcagccctagaccttccctctgacagagcctacccaaatgaacaaaccctggtaatatgacaaaacaagacgcttcaacaccccccaaaaaacatactagttcactggcaatggatccaaaccaagaagaaatacctgatttacctgaaaaagaattcaggaggttagttattaatcagggaaggaccagagaaaggtgaagcccaatgtaaggaaatccaaaaaatgatacaagaagtgaagggagaaatcactcagggaaatagatagcttaaagaaaaaacaataaaaaattcaggaaactttggacacatttttagaaatgcaaaatgctctggaaagtctcagcaatagaattcaacaagtagaataaagaaattcagagctcgaagacaaggtcttcaaattaacccaatccaacaaagacaaaaaagaataagaaaatatgaacaaagcctccaagaagtctgggattgtgttaaacgaccaaacctaagaataattggtgttcctgaggaagaagagaaatctaaaagcttggaaaacatatttgggggaataatcgaggaaaacttccccggccttgctagagacctagacatccaaatacgagaagcacaaagaacacctgagaaatccattgcaaaaagatcttcatctaggcatattgtcatcaggttatccaaatgagaggtgacaatgtgctagtagccctcactcgctctcggcgcctccttggcctcggcatccactctggctgtgcttgaggagcccttcagcccgccgctgcactgtggaagcccctctctggactggccaaggccaaagcgggctccctccgcttgtggggaggtgtggagggagagctcgcgggccagtgagggcttggcgggccccgacctaggagtggccggctggtgccgccggccccaggcagtgaggggcttagcaccccggccagcagctgtggagggtgtgccgggtcccccagcactgccagctcacccgggctgtgcttgaattctcgctgggcctcagctgcctccccgtggagcagggcgtgggacttgcaacccgccatgcctgagtccccccctccccctgccctgctccctcatggccagagcctcccggacgggcgccgccccctgctctgcaaccagtcccattgaccgcccaagggctgaggagtgcgggggcatggtgtgggactagcaggcagctccacccacggccccagcatgggatccagtaggcaaagctagctggactcctgagtcgggtggggacttggagaacttttatgtctagctaaaggtttataaatacaccagtcagcactttgtgtctagctcaaggtttgtaaatacaccaatcagcaccctgtgtctagctcaaggtttgtaaatgcaccaatcagtgctctatgtctagctaatctagtggggacttggagaacttttgtgtctagctaaaggattgtaaatgcaccaatcagcactctgtgtctagctgaaggtttgtaaacacatcaatcagtgctgtgtctagctaaatctagggacttggagaacttttgtgtctagctaaaggattgtaaatgcaccagtcagcactctgtgtctagctcaaggtttataaacgcaccaatcagcaccctgtcaaaacagaccaatcagctgtctgtaaaatgggccaatcagctctctgtaaaatggaccaatcagcaggatgtgggtggggtcagataagggaataaacgcaggctgcctgagccagcagtgcaacccgttcgggtcaccttccacactgtggaagctttgttcttttggtctttgtggtaaatgttactgctgctcactccttgggtctgtgctgcctttaagagctgcaacactcactgcgaaggtctgcaggttcactcctgaagtcagcgagaccacaaacccaccagaaggaagaaactctggatgcatctgaacatctgaaggaacaaactctggacacaccatctttaagagctgtaatactcaccatgagggtccgtggcttcattcttgaagtcagcaagaccaagaacccaccaattccggacaaagttaaaatgaaagaaagaattttaagagtctgtgagacagaagcaccaggtaacctataaaggaaaacctatcagattaacagcagatttctcaggagaaacactacaagctagaagggattggggtcctatgttcagcctcctcaaacaaaacaattatcagccaagaattttgtatccagcaaaactaagtatcacatatgaagaaaagatagttgttttcagacaaacaaatgctgagagaattcaccattaccaagccactgctacaaaaactgctaaaaggagctctaaatcttgaaacaaatcctggaaacacatcaaaacagaacctctttaaagcataaatcacacaggacctataaaacaaaaatacaagttaaaaagcaaaaccaaaaaacccctaaagtacacaggcaacaaagagca

SEQ ID NO: 910 - DNA, 1331 bp, Homo Sapiens
gatctaacctatatctaattggaattctagaaagataaaatagaaataatgagagccaatattcaaagacataaagagattatcattttctagaacttatgaatgacatgaattcacagatgaagaaaaaagatataacaggcaagataaatagaaagcaacagttggacatagtatggggaaatgcaggacaccaagacaaaagcagccaaaaagaaagggcagattatctacaaataaattgtaattaggctggtaggtgatttatcaattgtaacagtggaaaccacaaaactattgaataactttagtggaagaaaattttgtcaacttagaaaaactgtcttaagacaatttagacttaaacaatagtttactacaaaaaagtctttattaaagaaacttctacagtatgtacttcaagaaaaataaaaaataagagatttggacctaacacctggttctgtcactgattccttgtgacatggactccatttcttcaccttagaacaaatgctgctggagagattattcctctgcttaatggagggattattcctctgcttaaatttaccatttaaaaataccaccaaaaccacaaactcttaggatgcatgaatacagtttaactgctttgaatagcatttttaatagcaaaaatgtgtttatactataatagcttacaaccatcttttcaaaaattcccagtttcatggaacttccattttagtggggacaacagacaaaaatgcaaaggcccttctgaagcaggagtgtgcttagttgaaaaaacaagtcagtgtggcaggaacagactgagaatgggagataagtaggagaaagggcagtaatgctggtcattttccatttgctgctctaaatctgacctgaatgaaccacatcaacaagcttctgtactccctctggctgggtccgccagcctgtggtaggctaaataatggccccaaaggtatccaagtcctatcccctggaacctgtgaatggtaccttatgtggcaaagtgactttgcagatgtgatgaaattaaggaccttgagacagattattctggattactcagggggccctacatgtaatcacaaatctccttaggcgagggaggcagatttggcagcaagaacagaaagcagtataacaatgaaacaagatgctatgttgctggctctgaagatgaaagaaggagccaaggaatttggttctagaagcaggaaaaggcaaggaaatagatgttcccctagtgcctccagagggaatacaagtctgctgctaccttgattttggtccacaaaacccatttcagacttctggcc

SEQ ID NO: 911 - DNA, 2005 bp, Homo Sapiens
aatttgttgttgttgcttctggcttttaattttattgtgatgtggtctatagaatgctacttctttggcatttgttaggacgtggttggtagcatactatatggtcaatttattaatttgtaattttttaattaaaaaaggttttagagacaggatctcgctatgtttcccaggctggagtgcagtcactattcacaggcaaaagcatagcacactacagccctttaactcctgggctcaagcaatcctcctgcttcagctttccaagtagctaggactacaggtgcatgataatttcacttcacactttatttttaaaagtttatttatgcttgagaacatgtgtattctttaattctcagagttctatatatgtctctttgttcaagcttgttaattatgttgcctcaattgtctatttaattactaatttttgtctatataactactgatttctgcttagatctatcaactacggatctatcaaatctgtgaaaggaatcttaaaatctccactatgttgctatctaaatttcttttccttttgtatcagttttctgtagattttgaggctaaactgttagtgtgaacaaaagttctctgaaaaggaatgtgaaagagactttactgcagtgaacagtttacaaattggggagacacagccctcagtgtaaaatgaaggtgcattcctgagaacaaagggaggctttgggtttcacagtgaaagctcctgtccaggttcctaataagatctgtttatgcaaatgaaagatacaaacttgcttagttctgactgggtaacagagctgagctctgattggttgatacagccgagccctgtttgttgatacaactgagcttgcatcaacattggttggttcaggtgagctctggatgtgtatcaaggtggaacagaggtcttggttttggcagaactcagagttggtgtgtgaactgtagtcagccaatggtcgcttggctctattataaatgtaggactggttagccacttgggatccatgttgaaagattggctctttcagatatatgttcacattaggtacatatgtgattattacatctttacgattaattttttctttaatgaatatgtaatgtccttcttattcataatcatgtcttttgtcttaattattctttcatctgatactattttttcaccagtggcttttttttttttttggttaatatttgcctggtatatccttctatcctttatcattcacttttctattttagatatgctccttataaacagcatatagctaaaacttttcctattataagagtttccactttttaattaataagacaatctctttacatttattgtgcttgcttttttaaaatactaattctctttaacttcctgccttgtactggcttgattatgaagtttttgtgtgcttatttatatgaaatattccattcatgaagataagaattgagaccagtataggtaaaatgaacttcacacacgcagaacgcagctttatcgaattgtttttcatcctttgtttggaaatcacagattctgctcctatttgttttagtggtagccattagcttttaaacatgcatctgtgacctaacccaggacaagaaacttcaagtacttttattccaatctcatcatttattcagtttgtaatagctttttagtattttatttaaaaaaatcctttaaactactcattatttctctttttgatagtttgagtcaatgcctgtctagatttacctatagacttgacaactatattgtttgcctgtgagcattaaaaaacaatattttctgttagtggcgaactgtaatagctttttatgaaaatgtctttattttactctcagtttttagttgtggtttagttgataatagaattctaagttgctagttattttccctcagtactttgaagctattattccagtattttctatcctgtaatgttgctattagaaattctgttgctatttgggttat

SEQ ID NO: 912 - DNA, 2618 bp, Homo Sapiens
agacgccctgcggccgctttgcctgaccaaagtctgtgggcgtggaacaggccctgggttctcctactgggaagaatgaagttcaggtactccatgtgatatatggttccacaatcctcagcgtgttaactgaagccttgttgagtttaacaaagctgccattgaagatctggggaaagtgaagaagttgcaacagagttttgggctcacaccattgatacatttgatccttaaggcccaccccgcctcactcccaccctcttctacttaattcaggatgtgaatagcacatgccttccatcttcagacaaacactgaggcctggacaatgacctgcattaggtagatagaatctactgaaagctaaaagccttttcctgtgtcttagcagcacggaagccacgcctccttccccccaatgtttgtgcaaaccctagagaagaggagacagcccctatgatgtgtgaggttgaatttcctgccctcaacccatcaaatcaggcagaatgagggctcagtcagaactacaactacaaaagagaaaaattttaatgtgacttttcttgtctgctcagatttttgggttaaggttcatgccagctacattctttgcataataaaatataaatagagtataaattgttctagttagagaaaacagcaaaacagtgctctcccaagggccctaataaatcactttacagaaacgtggatgtgtgttggatttacaggatttctatgccaagcagagaagtacgtgaaaacaggaaagcaaaatgcataagttgcaataatagttttgtggtttagctgaataatgtcctatatcaacagaggataatgattttagtttttcagttgccccaagatcatttccattactgatgaggcttgaaatgtctgtgaagaagagtcattgcaattgatttatttgtctggcaaactttttgtcagcaaattcaccactacctcaaaaatctcactagctactctatgcttaagacattggaagcataagccacaatgaaaactaactcttagcattagaattctaagaagcagtaatgtatttatgattttatgttaaaaatctcccagatgtcagcatttaaatcacaattcagtaatataagtaatttgaaattagaaagttttatacttcaccattctattttcctcttcaaattgaacacagtttgaaagaattaagaaaagaagctataaaaaataaattgttcaaggattcttcctgtttctaaacaccacaagattatgatgatagagacatcatttgaagtggtagagagtactgtgaaatatctatatgtgaatgtaatgaaaatgaaaaaataatctgatgaatttttaaaattaatcttgttagagtcatttttgagaaattgtatgcaagtgtattgattgaaaatgaccttctcattcaagaaaaatttattgagcacttaccaagtgtcaacaggtgaatgtgaataaaatagatatggtccctgccttcttggagttgaataaaatagcaaacacttattgaatatttattatatgttgtgcattataatattaaccaatgtttattgagttgttattatatgccaactatgccaatcctgtcctaagcaatttatgtatgttaactaatttaatcctcacaataaatctatgaggtaggtactattatttctgtcataaaattacaaaggcatagagagataatttgtctaaggttccatagagtaagtaggggacccagaattcaattcaaggagtctttttgttctgcatgacatctcaactgctatataaatattatttagttcccagggcaaatttttcaggataatattcttattctctcaattttacagaagagaaaactgcagtgtaaagaggtgaaataactcaccaaaagttaactgacaatgatcctacccactacatcacactgcttaactgggaagacacgcaatttaacaagtaccaaccaggctccacatttaaactctgaccccgtttgaccttaaagtaatgcatttttcttcaaagcagacacttcgccaccccaaaaaaaaccatatctgaaaagacataatgtacttaatcaatggcttcctgctataatcaccacaaccacatcctttcctagaatcgtatctgtcttattgaatccttccattagcttttctcctatacatgaagttcaaatagcacacctgagtttttgagggcatacacaacttacacattccaggctcaaatatttttttcctcccctgactcatgaactttttgaaatttaacagtttcttctatcttttatgctacctggtctatctgaaccaaacatatatattttgcagtttcctcctaaaatacattcaaagcactgttttgcttcgcattgctgatatttaactcctttgcaatatcactgctacttatacacaaacaaaaatctggtgttttttaagaggaagccaaactaaataaatcattttaaagatatatatatggttgggtgtggtggctcatgcctgtaataccagcactttgggaggctgaggcgggtggatctcctgaggtcagaagttcgaaacaaacctggc

SEQ ID NO: 913 - DNA, 3861 bp, Homo Sapiens
tttagggacaagaatcagattcagaaatctctagataataaaactgaaatcattattattttgtataaatatatctacattacttgcttatttaataaaggaatacatttttaattttctaggctattatacatgaaatgttgctttggcttttgctttaaaaaaaaaaaagtatttggtaacatgtggacatttactaagcaaatgtgatagcttaagattgagggtagccacctgtaatcccagcactttgggaggccgacacagccagatcacgaggtcaggagttcaagaccagcctgaccaacatggtgaaaccccgtctctactaaaaattaaaaaacaaacaaaaaaaacgaaagaaaagaaaattagccgggtgtggtggcaggcacctgtaatcccagctactcgggaggctgaggcaggagatataattcctcaatttagccttcccacctcaatacagtctgataacagacgagcctttattagtcaaatcagccaagcagtttttcaggctcttagtattcagtgaaacctttatatcccttacggtcctccatcttcaagaaaagtagaatggactaaaggtcttttaaaaacacaccttaccaagctcagccaccaacttaaaaaggactggacaatacttttaccactttcccttctcagaattcaggcctgtcctcggaatgctacagggtacagcccatttaagctgctgtatagacataacttggcccatgatagctagtattcagttcttccttttatgcacaaccacagccagcaggaagctaccagagaatatgcaccagtgaaataaggttgtaaataaaaaagatatgcaatccatgaaacagaacatccagccaaggatcataacagcaaatgccagctctggtgagcacgttatattgaaaagggtgtgactgtggtgaaagacttgccacaaatcatgaaacaaaaccaaccagcactgacagatcatttaaaatgtttaaatacttctttgtttgacatttaaaatgttagtcacgtttctgcaattttaccgcctgaaaatatgttcactgcaaaattttggcataaccaaaagcacatctggaagttacatttctcaataagctaaaaataggatttagggttaacctgaagtgtgtcagcaattctctgagaagggtggattagagtgctcctaaataatgctgaagtgtttacaattcaaacacacctgaggcatctcttcacatcctgttttcctgtaactcttgtgatctcctgggcccttgtgcgtcacctgggttggaggattatccatccgctctttctaaaacatgctctaaaaaatgtcttaggaaaaacactatctaaagtcgtttataagctattcaaatttttagtaaaatatcaatgaaaagactttctaaatgcctgccacatgacaccttcgtgtaccaaaacctatcaaaattacatcttaaagtcattttttgttttcactgacaggaccatatttctcttgcagttgtgtagtttgcaatgccagatgtagggatgtcaatatttaatggataaaaatatattttataaaggagcccactgggatcacttctaaaggcaagaggggaataacagacaatggggcgtgcttgaggctagagtgtgggaggagagaggggatccaaaaaattaactattgggtactaggcttagtacgagggtgacaaaataatctgtagaacaaacccccatgcacgagtttacctatataacacacctgcacatattgccctgaacctaaaataaaattttaaaaaaataaatactctatagtaaaatcaaagataactataaacataatattttggtaaatgagttaaattactgaatagtctagtgtttagcaaaaatttacaaaaactatattttccactttgactttaaggataatttaggagattacatatgttgcttattactgacagcaagagagattattattttgagattctaatctttaagtattcttatttgtagaaaagtattaaaggtaataataaaataaaataatttatttaaaggaatttttagtacgtatttgcaaagtgaggtatctctttacaaacagttactgtactaagttgtgtatgtctatgtttacatttgtaggtcttgtttttctaaggctataatgagtatagttaatcgataatattacttttgcttaaaaagtaagttaagtcataaagatatttaaatgtttggaaaacattcttatgcatgtatctacactgttctcttttcctgtgctcttcatttctttatggaaatctgaattttatatggatagattttcaatgtcaagtgttgatcaagaaacaagtcaccagattatactttaaataccacaggttcaatgtaaatttaataaaaacacttgtatataagatatacgtatctattattaatgaatatataaggaatagaatttaatattaacaacatttagaaataaacagcctaagttaagaatagtgatgcttgggagagtgtgaaagggagtggaacagaatgtgggaagaatttttaaaactattttgactgtgtctgtaaaatttgtaatttttattaaagcagatttagttaaacatgttaaattttaatgttatttttaattctagttagaatatacatgagtgtttgttataatttcaccctcactacggggaattaaaacttttctcaaattaacatgaaaaagaacaaatgcacacatctcagcagaatcagaaaaaaaactaaagataaaagtaaggtatcatccttaggatcaaaagcaacagctttgcaaatgtgcacagaatgagatatgctataattattcatcacctctttctcacaatgtaacaactatttaagaagaatggtttagttattttaaaagagtgttttcgggttttttttctgcccaaaaaaaaaaagtactattacctttttttcctgggtttacttggtatataaaattctttttaaaattttatttttccttaagttattggtatacaggtgatatttggttacatgagtaacttctttagtggagatctgtgagatcctggtgcacccatcacctgaccggtatacactgaaccatacttgttgacttttatgcctcgccccccctcccactcttccccaaagtatattgtatcattcttatgcctttgggtcctcatagcttaagtctcatatgttagagagaacatacaatgtttgcttttccattactgagttatttcacttagaataatagtctctaatctcatccaggtcattgtaaatgctgttagttcatacctttttatggctgagtagtattccatcatatatatatatcacagtttttttatccacttgttgatcaatgggcattggagttggttccacgattttgctattgtgaattgtgctgctataaacatgtgtgtgcaagtatcttttttgaattacgactaaaagaatggtttaactatttaaaaagaatgattatcaccaaatgaatttggtgataccatcaaatgaatttggtgataatacatgacatgataattatgataataattttaaagcagaaatcagtcaatattttcagagagagattatacaaatgcaatttagactataacagtttagacttatatcttagagcatgttaacatgtggggaaaatgatctcttgtgtggttatttagaaagggaaacttttaaagaagaaagcataaatgtgggcatattctcatcttttacttaatgtaattagagtgaacatattgaagccacatactagaattttat

SEQ ID NO: 914 - DNA, 1387 bp, Homo Sapiens
atggcaagtccggatagaagtaaagggaagacattaaaagcaaaaaaaaaaaaaaaaaaaaaaatgcccccagcttgctggaagcaagtgcagattctgaataagtcaaggcatgttgaagcactgaaagcagcagcaactgggagtaatgttccaagtggtaatcagaatttcagtcctagtgtcataactagcaaatgtagacattctgaaaatggtgcttcctcattggactctaataaaaatttgttactagagaaaagtaaagtattctctcagaattgcagaaaaccagtagaagaaatcgttcattcagaaacaaaattggaacaggttgtttgtccgtatcaaaagccaagtaaaacaacagattccccaagcagagtctttatacaagaggcaaaagattcactgaacacttccaaaaactgttctgaaaaccattttgaatattagacgaatgtaacaggatccctttttgagcagaaaggggcttgtagtctaaagtccagtttctgtccaccaagtttattgagtggtggtgttcagatgccaaagtctgcagcaaccagtactgtggataataagagaactgaccagatggttttccatttagaaacaaactccaatttggaatcacatttgccttttatcaaagaaaaagtgacaacattttaagttcagaagacttaggttttgtgcctgttgagaaaacacctaacttggtgaattcaggcacttgtaacaactgtgctgatgacattttgaaaactgaagaatctagtagaacctgtccttccagcatttcaaattgtgaaagtgcagattcaacttggcagtcatcacttgacactgataacaacaacagccattatcaaaaaaagaggatgttttcagaaaacaaagaaaatattaaatgcatgaaaacttcagagcaaattaatgaaaatatttgtgtaggtttggaaaggcaaacagcattcctggaacaggtcagacatttgaaaaattacatcaggaaattccagcaattctcccaatgctgaagttatggctgtacagaggaaacttgattctacaattgatttgacaaaagaaggcctatccaactgcaatacagaaagtccagtatccaccctggagtacctttgaaaactgttttaaactcaaagagcctcattggcacaaaatgcagcccaggttcctgagtcctttgagcacctgccaccactctcagaaccaccaccactaatacccgaattagtagataaaatctgagacacacttcctcaccacaagcctgagctcaaagtgaaatgggttttgagacccaggggcattgccctgactggcaatataaccaaaatcaatcccagtgcactcctgt

SEQ ID NO: 915 - DNA, 1871 bp, Homo Sapiens
aaagtgcacaattcagccaggtgtggtgactcacgcctgtattcccagtactttggggggccgaggtgggcggtcacctgaggtcacagagacctgtaatcccagctactcgggaggccaaggcatgagaattgcttgaacccaggaggtggaggttgcattgaggccaagattgcgccattgcactccagcctgggcaacagagtaagactccgtctcaaaaaaaaaaaaaaaagcaagtgttcctcagcactgagggtttttaattttttatatgaaaagtctgttgaaggatatatgttagaagctgttgactgaaattttcattctagattattagattatggttttggattgcttattgtcactttttcatattttagtcaccgcccaggagcctgtctgcctcctgctgctgttcatggtgcccagactgttcatgccaagggacacgtgcaggccagcactgggccgtcctcagcctgccttggccctccttccgtgttcgctggcgcccaaaggctggaaggggccactgttaaaagtcgggttaagatgtggtcactgggcctgagggatgctaattgcctgcctccttcgggattgcctttcccaggttctggtcaacggggtacgagtcaaagtgatgtgggttctcttgcagtaattttatcatttctctatagatgttgacagtttctaaagtcctaccaggcattttttctaagtgaccttatttgggaggaaaaaggaatatgtgtcagaagggaaaaaatgtagtggaacaggaaggaaagggagggatactattttgctactccaaagtaattgatagaggattcctttggagggaggagtggagagggaatttttgcagttgttttccattctactgctttaaatcattacctttcatttaaactcatttaaatgtctacttttttctgatggattccactctttctggtcaaaagtattgaggggaatttgaaagacaagtcatcaggtaggcctggatttgatcccaacaatagttactgacttctagagctaaatcacatgcagagatcattagatataaggtgggaaccaggaatctgcattttaacaaattcctgaaataattgtgttcatgcagatggaccttgaaccacaattcaagacacactgttacagagaaacaactcttagagcttttattctcactgcaatcttttacttgaggatttggttaagatctaaaatgacgtctgaaagacagatgcttgctgtgttagaatcatgtctcctagttcactgcctttggacccaagatgtccaccttgagttctgtttccttagcttagtggttcttaaccccagctgcacattaaggtcccctaggatactttaaaagaaaataccggtgtctgcacttcacctccagaaattctgatttaattgctctggagtggggcctagatggcctcagtgatgttaatgtgctgccaggcttgggagcagctgccttaaactgagtctgaccctagatgtttcttggtcctattgcaaatccttgtgtcctttgcacccatccaagccaatgtgtcttaaggttacatatagtcagactcaagctggagcccttgttgaaatattatgtagtggggattattgtagagaaacactttgatagaaattgtaacatatgtaatttttcaagaaactgataagattattcaccacccgtagtctactcagaggctactcacctgtagccaagtgagtttaattcccttcaaaatagtcactttggggattgaggcaagtctttttaaggatgcttcaatttttcaaaacccatttggccttttctctgttttagacgttgc

SEQ ID NO: 916 - DNA, 3530 bp, Homo Sapiens
actggttccttgcagctgtgactccccagggtaagaggcaaagagccaccaggtcccagctgaggaagccctgtggtcagctcagacagggatgcggactgaagccgaagcaggtgttagtaattgtcgtacctacagacgaggaaaccgagcctccatgaagtgaagtgactcacccacagtcacacagctaatatatgccagagcccacagcagaacccagacgtactgaggccaagttccatgccagcataaaacaggctccagttctccctggattccaggaacaccatctccttcctcgtcccttccatcccagggaaggtttacactgaaaattttttgtgatgaaaagatttgaagaagatgacaggagatggagaagcaccagctgatctgcagactccaaggaggtcccaggaagaggtgtcatccactaagatcttctgggacaggaaagccctgtgatacctcttacatcacaccaaacagagccccacaccaagaaaagagctgcccacacctcacagaagccatgttagtggacatttctccactctggaagccttcctgcgtggtggaggccagtgcagaccatcctctgcccagaagagttgcattctaaatgacccctcagagagccctctggatggccgcctctcccacaggtccctgcaatcacataaaaaacactcattgcagccaagatgcacaaagcacagtattgatttcatactcaggtttttccaaaacaaatcataaacccacaccaattatgtccaatcagttttatggataaagaagcctgagactctccaacaggagagcttgagtttcccttctcactcttgtgctgggtgtccttttcctacctccagaccatcacaaggatatctgtaatgtagatgaggccagtccttttgcccaatgttgacagacaagaggaagattccagggagaaatgccgcagcagcaaatgaatatgaatgatgcttttccactttgtgcttataaaatgccttttgtaccagaatctcaaagctctccaggaagcaaggctttgaatgggactttcactcggggtaaacatgagtggtcggagcttcccaagtcatttgtgataagaaagaacaaaagtccgggcacttttaaaatgcaatattcttgccttctgggtagtaaacaaagtgtgcagatggataatgacatctgtggattctggctccacttcctagagagaaaaaaaacatgtaaataaatacgtaaaaaattgtcatatgtggatgacacccttggttcatccagtagttaccattctgcctaacattcacgagctatggattctattactgggtcccttgtgactgcattacactgagaaagtaaaatatatttctcttcaatgcctgagggaagataaatgttatagaaatgtttagtaaaaaggtccagtcagtggctttgacacttgatgcttttgcactaagcagtgctgtccttttgttctctccattggaagcctccttgtaaatgtttaatagctaaatgactcaccagagtctgcaaaggtcaggcccttaactggaaaggcagaggggaactcagaagcagtctctatcagattgattggaaggttcatttgagaattctttccttctcatccttagtttaaggtgcacatgcagcatgaataactgcctgggctccagccaccgacatgcctgaacagcagacattagtgactctgacactcttcctaggattcattcagggtattaatcagcttcagaggaaaactcacaaacactctaagaagaattctgttgcaaaagtgatacctagcagagacagtctgcccttgcagtcacttgcattatatcccaaaagtcaatgctaagagcttgcaaaagaatttgagttcatcaggtgtccagaaaataaactccttcaaatgcagtcgaaatagtttcaataacttcaaatactctgcctgttatgaatctacagagcagcaattaaataattatcagttaatgattcaatgtcagatacctataaccaagggtgtcttgctattacactgaaaattacatattaaggttttgctggggtgcagaaaatgatcccccaaaatatagtgcttcggcatgccgagtactttgaaaatcggaaggttttagaaatcagccttagacccaagctctctttctgactttccttacctccttgtttctctgatcctctttctagaagcacctggagggactggactgactctctggaattttcttatctaacaaagcttctttccaaaaaaaaaaaggcaattgtcttaagaccaccccccccatctttaggaatctcatcaaatgaccaggaaagaagcaaagagacggagttgtcactatacccagatagactactcatctattctcgagggcaggtctgacaacctttgtgcaaggtgacgtttcactcctcaccttcccaacacctcccccagagctcagaggaacttttgtcatttactcctacacacctcatccccgccttccctaagaagagagggtagacaggcatctggaccctgctgggttattaggccattactcttctgcaattccccatggtatgcacgttaaaataaacgcatgccttttctcctgttgctctgcctttttcagttcattttcagcaaaccttcagagggtgaaaggggaagttttcttctttgtccctacattttgcattgtcttataccttgacatttttctactcgtcaagttaaactgtaaagcaaaatatagatcattagctgactaattatttttgagttaaaaagtagctagcatttggttttgggtaccacagtgtgtctaatatagtctttttagaagcaatgatctataaacattttttatcattcaccatttctggttgagtaaagtgactcacagttgtagtcctacctattcaggacgctgaggcaggaggatcacttcagccgaggaaggagttcaagtccagcctggacggtctctaaaaatattaaaatttaaaaaaaattctgaacatgcaaccccaatatgtatttatttgtaaatgatatactgtcactaatacattgacattaaacaagtagaaaacaatgtaacattttaatttattgactgataattagttctattttcattaatattttttaaaagagcaaaactgctgaataggcttcttttatttttgagaatctttgttgaaaactttgtggtgtaacagtttgaggtctccttccaagtcaagtttattttaaaatgtggttttaatggctgtcgtcacttaaaatatctcaaaagataagcaagcctacttgaaaaaatcacccggtctcagggtttactaaatcaaactgctcatttcggttgtatgcacaaatcacgcacaggttttaactgaaatttaattagttaaatttccatcttctttgaagtccatcagtcttttttttaacaaaccaattaaacagtatcaag

SEQ ID NO: 917 - DNA, 3944 bp, Homo Sapiens
agcaccagacgcagctcctctctcctgatgggatggccctggggctcctggtggctctgacttctgtaaagcgtctccctccggcgcctttccctccaccagccggtggctgcacagtgccctgccttgtttctttcacacagaagtgagggcaggaagcaggctgtgccagctcacaccacccctaatgctcgcagcgctgactctaattgtttccaggaagatcgcagctttgcttttgtgctgttcctggtgaatgccatccgttgtctatgcacaaacatggggctgagagtaaaccacatttccttgtggaagcaggacttcaggatagccaggtccacgaacaatgagaaaatccggagcttcccagcattctgctcaaggcccagcatcccatatcggaacccgccgcacccactgctctctcagctcctgagcctccacaccctggctgcctgggaacacctcaggcacatgcaggtttaatataatcaaagccttcaattagggggtttagtccatatggaggaagtccagattctgcagatgagacaagcatggggagcattctgaggtgctggctttctgagcctgaaatgttcccccaagtggaggccacggccggccatcccactgaacagccttcacctcagggcagactcagtggcaccactgatttgtcactgaccgtcacgattccagctgaagctgggtgcagatggggtttcagctggaagaggttttccctttgggccagtaatcctataaaagtcatcatacctgtctggggagatgggcgatttccctagaatggagagtccaacgtgcaggagggagctgctcttcctgtcgggccttgggtgcacccctcatagggctcaggtcccactgctccagaaaggacctttaaacactcaggtcgagaagcagcaagatcacatttggtatttgccctagtcttaaaaacaataaacaaagcatgatagggagcccatgggcagatgtctgcaatttataaatgtgtgccctgaagcaccctcacccttctgtgctcatcacctctgagccccggggacatgcaccccggggaggccagccctgccctcactgccttctgtggcctctgccttccatctttctctctacatggacgcagggctaggaaacctagagactgggttctaaaagaaatagaaacctcttttttaccctgctcctgagagtcaacccttctgagctcaagcaaagggcattcccggtcctcagctccttgcccccacatagatctgaagtgagcctgtaccgcccacctctcagttctcaactgtcgcttaatcctgccccacaataggccacccctgggctacaacttgagcttctaggtgtgcacactgaaggctctgaacaggctcacagcccggggacactcggcaaggactccccacattcccagcacctgagcgaggcccagaaaagagaggggcaggcaccagattggcagctttgtatcctttctgcccacccccagggaaagggtgtagcccatatatggggaaggggggctggggaggccaggggctctgcaagccagggtccacgtcacttaggactgaaggcggcactgcccaggcaaatggcacctgaaaacccaacaggaacctggaggcccaaagcctccaggcgcctaaaaacccattcacttttctaaactgcatagtcccttatttgaaccagtaatgtccttaaaacctccagtgcagctctatctcggagggagtggaggtgggacctgggaaagccatccctctctcactccagatggcttggggccaccccttactgactattttcattctaaagaggttgcttctgtcaccctttcagcttctccagacccctctccttccatctttctctcttgtataatctaacctttcctgaacccaagcagaaatgcagtgacaaacccacaagatattcaagtgctggcacgcttctctctgcacttgcactttgcctgggctgactggcttctcaagggcaagtctaagggaacactggccagtgccacatacagactttaggggtcagggacaaagagatgtgatgtgtgatctacagcgtttctcctgtagatcaatgacacagaagacgccggaagggcaggccccattgctgaaacgtttgccaggtccaaatggttttggagcacacttgcaaactttcaaagaacagctaatttttgtattaaagtgtttcagagcacaaaaagatgggaagtttctcagtttattctacaaggtccgaatagcactaaaaatcagagagatactagaaaaagaaaactatagctttattcatgaatgtagatgtagaaatcctaaatgaaatgtaggaaatggaattatttattctaggaattaaaagatagctcattttgtttatacacgtgaggaaaataataggtgaaatgttaatattaactcatgttcataaggcatcaataacgcccaatcacattgctgttaaaatctcttagtcacttgggaatagaggacaacatgtttaattggattaaagtatctgtcaaaaattaataagaaacatcaaacataaaagtgaaataccaagaacctagcaccttaaatcagaacaagacaaggataactattatcacatctattattcaacactccagaaatccagtgttttgggggacaagagaagacatattacttaaatatgatatatttgcatcattagaatatagtcagaaaaccaaatctagtcagcagcctatttctatgaggttttattaggacacagccatgcctacttatttatgtattgtctgttatgactgcttttatactacagtggcaagttgggtagttggaactgagatcctttgacctgcaaagccaaaaatattccctgtctgactttttacagcaaaagtttgcctctcccaaaataattaactgaaaacaaaattaaacaagaaaatcagtagggtaagcacatagaaatataatcagtagtttttctacataccatccatcattaattagacaacataatggaaaagaattccatttaaaatagcaactaaaacaacaaaatatctagaattaaacttaaatgtgtgagaataatatgaaaacaaaaactaagaatcctttctgaggcataaaaggagactcaaaaagatatattacattcatggacatgaagacgatgttataaagataccaattatccctaaatataacatacattcaatgcaattcaaatgaaaatttcagtggttattttggggagtataagctttagaatttggaatctagaatagaaaatgtaccacagtagccaacaacatttggaaaacaattgagtagtgaaggaatgatacaaaaatatactatataaaaataataactaaatcagcacagtaattaacggaaacatagtttggaagcagatacgtgtgcataggaatgtgtccatgataaagaggacatctccagatgggggacatgacagactacccagcaaatgattttggagaaaacgcctatacatttgaaaattaattatggttctatttcacactctacccaaagacaaatttcagatggaccgaagatctaaacataacagccaaaacaaagtattgggtaaaatctatgtgaatatttttgaatctcaggaagaggaggtgatcctagtgcatagcacaaaaccccaaaggcataaagaaaaagatggacaagaaggaaatccaatgtttttcagtttttaaaggaaaaataactaaccactgaagaaaagccaatatatatacagggagaaaaactttaagatatatcaacaattaataccctaaaatgtgaagtattccaatgaatttgtaaaaaaattaaacactctattaaaacttt

SEQ ID NO: 918 - DNA, 1104 bp, Homo Sapiens
gctcttcaccagagcctcctgactccccaggaccccagagaggaccgaccctctccagccgacctctgggctcaggacagctgggtggggcagccacaggagctgcctgtagggagcagagtcaggacggggaccgagccggacacccattctggaagtgtctgcacttccagactgctggccagacccccaagctagcccgccaggcctccatagagctgcccagcatggctgcgtccagtaccaagagttggtgggagacgggtgaagtacaggctcagtctgcggccaagactccatcctgcaaggatattgtggctggagacatgagcaagaaaagcctctgggagcagaagggaggctccaagacctcatcaacaattaagcattccggtccctggaggaaacatcagacaaacacagatggagggaccttcaaggactgacctgaactgttcttcggtgtcaaccccatgatagacaaaaagaggcagaggaactgttccagattaagggagactaaaaaggtatgacagctggatcaggggaaacgtgccttaaagggcattattgggactgttggcgaaattttaagtgaactgtatattagacaattatcaaggactacacgattgtatggcatcaacctcaaattccccgaacttgagcactagagtcttcttgttctgatggaatatgttctgaaatgtttaagggagaggagaaggatgcctgcaactgaatttcaaatggttcagggaaagataatagagtagaatagactatatagatggagaaagtaaatgtggcaaataacaattggtgaaggtgggtgaagggcatgaaagttctttgccttacaattaattcttctataagtctgaaattatttgaaaataagagaaatgctttcagctgtgaataacagaaagtctgactacttgtggcttttgcaataaagacatttagttatgtaacataacaggatttaagaggaagaaggcaaggacttgaaaaggctcagtgatgtagctgaggccccagattccttttatcattttgtccaaaggctccaccttcctgaatattactgctttataccct

SEQ ID NO: 919 - DNA, 2509 bp, Homo Sapiens
gggctcagagctcgccgccaaggggcgtggcctccgggccgcggcggcctctgggagttgtagtcccgcctcaacttgtggtggcctctttaaaaaaacaaaaaacaaacaaacaaaaaaacactggcgcttgggtccgtcgctgcctcggtgtccctgtcgggcttcccagcagcggcctagtggaaaagtaaaagatgtctgaatatattcgggtaaccgaagatgagaacgatgagcccattgaaataccatcggaagacgatgggacggtgctgctgtccacggttacagcccagtttccaggggcgtgtgggcttcgctgcaggaatccggtgtctcaatgtatgagaggtgtccggctggtagaaggaattctgcatgcccccgatgctggctggagaaatccggtgtatgttgtcaactatccgaaagataacaaaagaaaaatgggtgagacagaagcttcatcagcagtgaaagtgaaaagaccagtccgatttaatagtgttgggtctcccatggaaaacaactgaacaggacctgaaagagtactgtagtacctttggagacgttcttatggtgcggcaaagccaagatgagcctttgagaagcagaaaagtgtttgtggggcgccgtacggaggacatgactgaggatgagctgtgggagttcttctctcagtatggggatgtgatggatgtcttcgtccccaagccgttcagggcctttgcctttgttccatttgcagatgatcagattgcgcggtctctttgtggagaggactcgatgaaaggaatcagcgttcacatatccaatgccgaacccaagcgcaatagcaatagacagcaagaagtggaagatttggtggtaatccaggtggctttgggaatcagggtggatttggaacacttctgtctacatgccttctcattcaagaattcgtcatcacgcatcacaggccgcgtctttgacggttaatgagaatgatccagaagggaggagaagctaatggtgcagtggagagcagagtccctgagcagtggaaacagccatgaagatctttcatctcttccaagcaccacctggtgtacctcgctggctgccgggctgaggtggggcaggggttacgtctgctcttcgatcctgtgattcaagggggatccattttcgtcttctttggtgtccgacacttcgctgagtcccagagaaggaatatcttcctcatatggtcctaaaaggcaccttggcttcctcttttcctctctggggaagtcacctgctacactgtgaggacatccaggcagccctacggagaggtccccatggcaaggagctgaggcctctgccaagagccagcagtgtgtgagaggcctgcaagtgaggctcctggaagccggtcctccagctggcaggtgacagaagcccccaccagtatcttaccgtcaacatcaggaacgaccctgagctagaagtacccagctaagccgctctcaaattcctgacccaaagagaccgtgcaagcctgagcaagatcagaggggagcattgccttgcaaccaaattcttcctctgcaataacgagtgctgctgagtaaggcattcttcaggaagatggagggactcaattggtaaaggagggactctggaggttctctatgggctggcagtaactcttgaatctggggaagaaggagagaaaggaaagagtggagaagacataatcctcaaggaagctgtgggcttaatttcttacaaatttcccttggtgcgtctgcccagagacccgggggagctgggtccttgtggtgagtggcttcctgggctcactggctctgatccctgtgccagcgtcccagggggaagggaagaggccccatctctaacaagtgtctgggggtatgggaaggaactgggggatcaggagccagacttctgggccaggaaaggggtgaagaagctcatctattttacttcatcccttgaccttcaaccccccaagtggcacctggcctacacagcagcttcccacaccatgaccatggactctgcctgactctggagtccaaagcccagccctgaggctggcccagtcaggagggtgcatctcctggggagaagggcaccagaaatggtacatccctccttcctcatgtgcccagcactacatgcccactatcttgaggttgaattcgctgattctctggaggtcccgtccaggtggggcccctgcccacatggttactcaggcaagaaatgtggacatggcagcactgccctgccatggttcttcccacctcgggcactagcctgggactattccccagggaatgcaagctgacatcccgagagcacccccccggtgggaagttctacagaaacagatggcgttgccagggaagttccaacagctgtcttatatgttaatgcttctgaaactggacacatttcacattttgaaaccagcactggactcagtaccaacaggaataaagttttttaaaacgca

SEQ ID NO: 920 - DNA, 3489 bp, Homo Sapiens
tcaagagatttaccttttcaagcacatgatgctttcattcctgtggcttggcagtaaaattttgaatcaggaaatgtgagtctccagcttcgttctttttaggattggtgtgagtcagctctgtccacgtggttgctcataggaggttgtgagtcagctctgtccatgtggggtgctcacaggagggtgtgtgtcagctctgtctgtgtgggtggtcacgggagggtgctgtctgtgggtggtcacaggagggtgtgagtcagctctgtctgagtgggtggtcacgggagggtgtgtgtcagctctgtctgtgtgggtggtcacgggagggtgtgtgtcagctctgtccgtgtgggtgctcacgggagggtgtgagtcagctctgtctgtgtgggtggtcacaggagggtgtgtgtcagctctgtccgtgtgggtgctcacgggagggtgtgagtcagctctgtctgtgtgggtggtcacaggagggtgtgtgtcagctctgtctgtgtgggtgctcacgggagggtgtgagtcagctctgtctgtgtgggtggtcacagaagggtgtgtgtcagctctgtgtgggtgctcacgggagggtgtgagtcagctctgtctgtgtgggtggtcacaggagggtgtgtgtcagctctgtctgtctgggtgctcacgggagggtgtgagtcatctctgtctgtgtgggtggtcacaggagggtgtgagtcagctctgtctgcggacctccgtgaaggccagtgaaatggacaggacaaggtgcttggcctgcggctggagagccatcttcttaccccctggccacatggttctgggaaggcactgacgctttgtaaaacttgcctggtgtggaaaatgatggcggtcatatgtagtaccttagaaggctgtgctgggagttaacgatataacatagcgcaaatgcctgacccctgggagaggggcagtgagagtttgttgaagttgggaagtcgaggctctcagtgaggtgcagacttttcctgtccaggaatgggagacaaggagctgtcattcactcaagcccttcgtctgccagcccctggcctgttatacaccccttttcaatcctgtaaggtaagtgttcttatctccaacttccaggtgggaagtctgaagctcagagagcctgggccaatggtacaggtcacacagcacatcagtggctacatgtgagctcagacctgggtctgctgctgtctgtcttcccaatatccatgaccttgactgatgcaggtgtctagggatacgtccatccccgtcctgctggagcccagagcacggaagcctggccctccgaggagacagaagggagtgtcggacaccatgacgagagcttggtgagtaccaggccaagctgtgctttcctcctccacggcacagctcgggttggggttccagagggtcccagctggccctggaaggtaccttactctaggcaagaatgaacaggttccaaccgccagcatttccttagctctccctggacagcctccgagattaagagaccaaaaactccatgatgtgatataaatcagcaaatataaaaaacaaaatcttcactctgcaactgagagacaggacaggagtccaggggctcaggatgaggatggcatcgcgatgagagacagacgccagctggaacaccctctaggcaggccaccctctgggcaggccgtcagccacagttccatgtttaggaggaccttgacaaggtcattcataataaaattattccccggcagagcatcacttctcggagggaactgtgtctctgaactgtgttcagtttttgtcccggggagctctgtctggtgctcacctttgtacctgcagcaggtgcactgggcaccatgttattagtgtctcagagctgagttcatgtgcatttcttcacctaagaacccactcacaatgaccccaccccagctcctgcagacccggcagaggctaggacgtggctcaggagacaagtagggtctttagagaagccccccggtcactccctttcaagccataagttcccaggtcctcaatagttggctctgagtagaattgtcagagaatgggattttcttaaccatcacaatttccaagtagactcaggcctaactcccagcaatttgtatgtcagactctacagacaattctgtgctgtctatttttgctcatctttaaaacagccacgaaatatgcagcttcctttccctgagaaaatggcaaagaaaattcaacacagaaggccagggagggtgtgtggaaacgattcacatgttcaaaagatttatatgtgtagaagaaagctgtgaagtgtgaagtatattttctattgtagaatggatgaaaatggaataaaaataatatcctttgctaggcagaataaataacttctttaaacaattttacggcatgaagaaatctggaccagtttattaaatgggatttctgccacaaaccttggaagaatcacatcatcttagcccaaggtgaaaactgtgttgcgtaacaaagaacatgactgcgctccacacatacatcattgcccggcgaggcgggacacaagtcaacgacggaacacttgagacaggcctacaactgtgcacggttcagaagcaggtttaagccatacttgctgcagtgagactacatttctgtctaaagaagatgtgtgagttatcaagaccatcctggctaacacggtgaaaccccgtctctactaaaaatacaaaaaattagccaggcatggtggcgggcacctgtagtcccagctactctggaggctgaggcaggagaatggcgtgaacccgggaggcagagcttgcagtgagccgagatcgtgccactgcagtccggcctgggtgacagagcgagactgtctcaaacaaaataaaaataaaaataaaaataaaaaatataaaaaaaaaagtgtgtagcgcctccccctttactcccatgcaagacgtgcctgcttcccctttaccttctgccaggattgtgactttcctgagacctccccagccatgcttcctgtacagcctgcagaactgtgagccaattgaacatcttttctttagaaattacccagtcttaggtagttctttatagcagttcaagaaaggactgatacagactgtgctgtgagcaatcacgtacaagctttggcgtgaatgtgtttttgtttctcttgggtctgtgcctaggagtagaactgcaggttcgtgtggtgactctgtgttcacctttttgggaaattgctggactgtgttccacatggttgcaccatctcacatccttatcaggaaagtatgcatttccttggttcctcatctcagtggttccgatatcttcacatcctctccaatctttacatcatctatctttctcatctagccatcctcacaggtttgagctgatgtctcattgtggtttcgatttgtcccactttttacggaagcc

SEQ ID NO: 921 - DNA, 1532 bp, Homo Sapiens
ttctatttaaaaaatatttttaatttttaaaccttattttaaactaagacacacacactagcctaggcttgcacagagtcaggatcatcgatatcactctcttccacctccacctcttgttccactggaaggtctttaggggcaataacactcatgaagttgtcatctcctaggataataatactttcttcaggattacctcctgaaagacctgcctgagactgttttacagttaactttttaaaaatgtatttactatactgtactttttgtcataattttagagtgttctccttacaatacgagggcacatttgtttcctgcctatgatagtaaagataatgtcttcctctggaacaaagataggacagattttctagcagtaccttacatgattttgagtttcctaagccctggattccacagctgtcccacaaatctattgtgtgtccacttgagttcacttctgcattgccccctatgggacttgtcaggagaggaagcaaaggaagtgcagtgaacataaagctctttgcaggccactgttacataagtaataaagttctttgtctttaacccaggaatgtcatgtcttctactagcatctatgaaactgtaaaacgctaattcattagtttgaaagcagggtaaaatctgaaaatcatttttttgacataggcagattatagtctttctttaatgcctggtaattttgtattaaatcctaaattaagtaatacattgttcagtgctatattaaagtatttcctttaaataatttttgtttgtgaagttttccagttaaatttcttggaatgtgttgtatttgtacatccatcaaggtgatgcccttcagaagactctatagaatacagattacaaactcttctctggttgatggcaactttatgtctagccctgtgtgagctctggaagttgtgtaatctacctcttactattaaatttttcacttgagttcagtggtttccgctgaagtatgtgaatattagtactcaggaaaagactaaaaaggattcctctacatatctccagaatctctctgggcagctaccatctttctagtcccttacccatgaattctagtcgttttcactcagggataccacctgagtgttctgtttcttcaactcagagagaccaccagcctatgtttaggctcccctcctcactctgtgacccacaaacttcttccaggcaatacaaaatggggagaataacaaggctcatttcttttgtttcttttctgtcagggattatgatccctgtgcttctggttgtccaatgtttaaaatccattgttttgtatattttgctcagttttttagttatatacagcagaagagtaaattgagtctccattacactatcattaccaacagtggaagtatacttgcatttttagagtttaaaaaacaattttgttactatagaaatagctttagatatagaaaattgaattatttccaaaaaataaagaatggaagacaggataaggaaaaaaacacaattct

SEQ ID NO: 922 - DNA, 2155 bp, Homo Sapiens
aagactgttaatgtaaagcacgaggtacattgtaggtatatgagaagtgtttgttccatcacctcttatgtcttcctttcttctgtcaaagcacttcctaaaccaaaaaggtctactcagatttctggtgttactgtttttatggttttgtattgttttcagcaatgtgaggaaagtggaatgaacttggactttgaaggcaaactaacctggaatcaaatactggctctgctgtttgcaagtgtgatctttgggtatgcttcctaatctgtgagcttcaacttcctcctctgtaaaccaagatcaaagacaaacagggaaacctacttgtctggtgcccatccccttggcagaacactcctctgaaggatgacagtttggctgtgccagggcagagctgccgacaccaaatgagccttcatagcaactatctgatgaggaactcactggcctacctttccttgacagctggggcctgccagccttgaagcatgactccacaacgcccctacccaaggccatggaggttgctgctgatgagcaagctgttttatatttaatccaggtttctgcttggagaggaagaaggtagaggagccagcgaaggtttgtctgaatgatacttgcagaaaaaacactggtaacagtcacaaaactttgaaaattaaagtgccagcgaggtggcttttggtggccagatgaaagctgttaaccccagcttttacaaatgctgggctttgagtaagaggagagtgtctttctggaaaagtttgagacctcttactattgtagcagcaaaagcatccacggctagtgttttccaagctcactgctacttgttgcagtctagcagtgttgtgtctcctgaaattcctacctttcttgatggatgtaaaagaagtaccaatttattaagctcctagtatgtgccagatgctccatatatgttacttttgatcttcagaaccactcagcaacttactgcttctcctcactcccaattacatagatgatgaaattgaagcagagtagtttgtctaggattacagagctaggagggaccagagttgggattctccctcagttctaatacacagtatgctacatttcctgtcgagtagtaacaaagcttctaagaaatctgagttttcatttgttaaaactgaatttttaagaaatgtagacaggagcactaagtactctatagtttaacgttaataatggtacaagtatataaccagtttctcatgcactggcataacatacttcagagggtacaccagggctggatgaatatctgaacccaaaaatatctgagacaggtctcagttaacttagaaagtttatttttccaattttgaggacatgcacccatgacacagcctcaggtggtcctgacgacatgtgcccaaggtagttagggcaaagcttttttttatacactttagagagacaggagatatcaatcaatatatgtaagatgtacattggttatgtccagaaagacaggacaactaaagcagggagggggcttccaggtcttatgtaggtgagagataaatggttgcattcctttgagtttctgactagcttttccaaaggaggcaatcaaatatgcatttatctcagtgagcagaggggtgactttgaatagaatgggaggcaggtttgccctaaacagttcccagcttgacttttccgtttagcttagtgatgttggggccctgagatttattttcctttcacacttcttccattttctttttaaaaatcttttgaagaaagcattttagaagaaaatgagtctctgctctcatggctaggatagtttattcctacaggggtaggtcccaagttattaggaaagctcatttttagcagattgagaagtctcatgtcctgtgaagagacaatagtaggaggaagggagaaaaacaacaaacaagagaacaatcctagaaaatctatatagaccacattactttgaagtccatacatcagtaggtaggtatgaaagtggcttatgtacctaaatagtttgcttttattttcttctgaagtttaagttgtctagattcagtttgcaggactttagaaagtacagcttagttttcaattatttcgaattaggaaaaatggggtgaggggaaggaaa

SEQ ID NO: 923 - DNA, 18682 bp, Homo Sapiens
cgagtgaggatgagagtgtggatgtggatgtggatgcggatacgggtggagctgctggggctgaggctggggttggggctggagctgcggctgcggctgcggctgcgaggggggctgctgctggaccaggtgctgctgcttctgccgcgtggatttgaccgccaggatggcctgacgattcttgtactgcaccatctgcagcgtgatctcggcgttccagccctggtcttgcgggcaccgaaagtcgatctccttgccctctgccatcaccacagtgaagtacatgtacttgcccttgcgctccacacagtccacggtcttcatgttggagaagtgcagttccttgagcttgaccggcggctcgaggctggcgacagcggggccactgggttgggacggctcggccggcccctgcccgggctgttgttgctgctgctgctgctgctgttgctgctgctgctgctggtgttgcagctgcttgggcgggataagcagcagcccttcctcggtgaggatgcaacactttttcttccagagctgcaacaacccgtcgctgcgcttctccagcacgccctccttcagcgctttgcagccgctactctccagcatcctcccagcataagaggggccgccgcttggctcggcctctccgtttccagccgcgcgggccgggggcagcagcagcagcctcgcgccgtcctcgccccagcggctcccacggccgcctgcccggagcgcgcagaggaggctaacacgcaggaggcagagcggcggcggcggctctgggtcccggcagagggacagccgcgtcctgatgcgccacaaggtcccggagctccgagctgccgggcctctgccgtcctcttgcgagcgctcactgaagggcactggccgggccccctcgcggcgcttttgaatgggccatcttccccacccccgagtgacacccagcggaaaaggcggctcctggcgcccgcaccgcgggggaaagcccagctccaagaggcgctcggcagccggcgcacgcctcattaacttggggcctttccaaagcccgctgcgtccacgccctccagcgtctcttgctccgcctctcgccgcccacttgcttccgcgctcgttcccctggaaggcgacccggacccgagccccggaaactcctctcctctacccagggcgatcgcccaaggagccctggctgcctgactactgccgacgctcacagggcgctgcgaggccatcccccgcgtcccgcttctccccggcccgcgggactctctgctaacagcctcagaaagtgaggacgggggcgcggaggcgggggcagcctccaggcagtgctgcctctcggttcttgggaattagcccgggggattcgcgctgggctccgagagcccgcagaaccagcgtcgtgtcctgggcgagctgggaggccggggccgagtcccgcgagtcccgcgagtgtgcctcccccggacgcctaggtaaacaactgagcgcacagaggccgagaggacatcgtgtcttcccacgcatattcgctcacggtcactaagtagctcttcttggaaagagggcgattgttaaagcaatagtgcgactgtcgggcttgccacgggtggagagaggcggacccacgtcaggtcgcatctcgcctgcttttctcgaccccgaccgcaggcgctaacccgtcttcggctttcttcttgacccgtacggtttgcaacgtctcttaaaacagtaactcaactctctacaaaccggggtaatatccggtgctgagatcccacactgcaaggcgcagttccaaacgtctggtcggcctcgcaggtccctctttccaaggcctagccagatcttggttttggaatctcatttatctgtgacctggggaatgcaatacccccagctccctcctactcctacatttaaacaatgcctatagaagccgcttcctgggaagtaaggcataaccgagacctagcctcccggtagggaagttcatccgtttagtaaacagccccaactacgtgcggaccctcacggggatacgaagaattcaaccagggctggacaagtcagagtgggccaaggacaagtgagcattccagagaatttctacatgaccagctgttcattcttttaagaggatgacattcttcagctcatctggaaaggatacttcctttaagtctgttattcacagtctccaagggcaggtgtagttgggaaagacatttcatatggaaaaacaaacttgatagggtaaaaaaaaaaaaaatgagatgtaatctggaggcccaagtcattttcttaggagaaactcaaatgtgtttggtgttatctaaccttctgcagtttatcagtctgaaacaaatgcattctattctcatttgaaaatgtctgaacagccaccaattttcaaaatcacccatttaactagagactttaaagcccagaatttgcagttacgtatttcagaatgatttagtaattttgtgagcagctcagaggttaagtctacaatgtctgactacggtgcattattgaaaatatcagtagtgtaaggatcccgtagattggtgataactttgctcttgttatttcaacagttaccaccaacagttggtgacttaacaaattaagagcatagttgccatatgctcatatttggcaaatatgtcaaaatggccatatttgccaatttttaagacaataaattcacagaaaatgcattacagaaaataacttaaaaaaaaaaaaaacaacttttgggccaggcatggtggttcacacctgtaataccaacactctaggaggctgaggtgagaggatcccttgagcccaggagtttgaaaccaacctgggctacatggcaaggcctccctctacaaatgtaaaaaaaaaattagccaggtgtggtggcatgcgccatgtagccccagctacttgggaggctgaggtggaggactgtttgagcccagaagttcaaggttgcaggagctaggatcgcaccactatacaagcctgggtggcagcaagaccctgtttaaaaaaaaaaaaaaattcagctgtatatgcaatgaaaacctacaagtcactgaaaagttactgaagtttagaaaactagccaacaaaatcattgctttggtaaacaaatttgaaatggctaattgaaagtacattttacagctggcaatataaagttatctatcagcagcactggacagttcattttcttctcttggataaagtttatcacttggcttcaaggacatcactcagttttcctttacatctccagtgtctcctctatgaggtgctttctcttctctccaaacttttaatgttggaatgccccaagtctttgtctttggctctcttctttatctacactcattcccttgttgatatccagtctcatcacttttaataacatctatatgccagagtcccaaatttatacccccaacttatatccaactgcttactgccgaagaataaaacactgaagttaaaaaataataaacataccaggcaagggaacacttactagtaaagccatttactgagtagttcactaaaggtttaagtctgaggggattttaggtcataggaaaaaaaaaaaaaaactgaaaaagaacactcggatggtcagaggagtctgtaattcatacacaataggttttaacaaattcctacatggaactgctccagtttataggttagaattaactatagtgaaaaacagccttcagtttttatcaattccaggccagtgagtgctactataagttgaaaattctccatttacacttctctacagtacggcttgtgtagtctaagaaatcaaacatgtgaatgagctcccaaactattttcctcactctaacctactctacctgcagccccctttctcagttgacagcaatcctctgtacagatgctcaaactaaaaaccgtagatcagtactgcccttacaccaggccaggaaaggcccttatccaaggccctgagctttaggattgagtgctttagagtcaagatgacatgtcaatctagagagcatactcattctgcactacactctaggtactcaagaccccaaataccctgcccagaatagccccagctgttccaggaaatgcattacatcatcattgcatgcactgatgtgttagggggatagggcagttcgaatatactggttatggcatccaagtaaatgtgcaggaggccccttgccatacagttcagagccggggtgggaagaaaaggaaggtggctcatgggctgagggtcagctctgcccgcaagttatattctggcataaatacaaacctggcttcccagttctaatgaaagtttgtcaagacaggcacattgggcatattttcattaaacagtacttttaaatatttaaacatacggtatctccattgtactcttgccccaggccttcaagtgtgtagaatcatgcctgccttgtagtaatttttttctctcccaatatttaatctacacatttagtcaggaaatcctactggttaggccttcaactacatctggattctgtccacttccttcattaccaccctgatccaaatcaccatcatatccccccactggattactatgatggcctcctaacttgtctccctgattctatccttgttatctattttcagcatagcacccaaagttatctccatcactttcttcaagtcttggctcaacaggcctatcctgatcactctcaaatggtagccactcaattccccttaatttttcccatagcatatattatcttctaacatgctactcaataatttattgtacctattgcttatttctgttccccttcccactagaatagtatgcaagctattcaagagggcaaggaccattgtttctgatgtgtcccaatcacctagaaaaagtcttgataccaagtagatgctcaacataggtagaaatcttgaattgaattagaagtccatacccatcataaaaagaatatcaattttttcaaatgcttttgacagatttttcatgatgcatcctactttttaaaacttgagatgtaaggacttgaaatttgccctacaaacatatctctggtatactttttaaatggataactacatgctaggcctctctgaatcttaaatgcttttatagtcagacatctaaaataaatcccacaaaccttttcccaagcaacatgcaatttaatatcatgagaggtgtttatataaactagtatcctactgttttctagtaagagtatttagaagcatgagaaacacagtaatggaactgagttggtaagtttcttacttggcagttacatagtcaaacacttgactaaaagtccattaatcaatactggcttaaagacatgtaacagaacttggaaagttattaagtgtttaattcataatgattacaaaattctgatctgtaaaccaatttgcaatatacagtagaaactcatgacaatgatcattattaaagatttggatagaccaaaggtcaaacatctttcaagaaaaagttaaagcccagtaaattatgaacatgtcacgttaccctcatcagggtataaaagataaccaaggctgggcgcggtggctcacgcctgtaatcccaacactttgggaggctgaggcaggcggattgcctgaggtcaggagctcgacacaagtctggccaacatggtgaaaccccgtctctactaaaaatacaaaaaaaaaaaaaacccacagcgcctgtaatcccagctactcgggaggctgaggcaggagaattgcttgagccagggaggtgaaggttacagtgagccaagatcacgccactgcactccagcctgggcaacagagcgagaatctgtctcaaaataaataattaaataaataaacaaatagtctcacagagtgcagtttagacttcttagccttatttcatctttgaagtactattcagaagaaatattctagattctagtttccaaaagtccttgagttgaaaacgttaagtattaacacagaactatccagacttcttaggtgggtgtccagagctgccttccttttcgccttagtagttgatgaactgatgcctcctagtgaccaatctgtgtaacagcttaaagcaagtgctttataatgagtgcttagcgcttttttttaactgtagtacaaacacaattgtggatccaagcaccgtccatcagctgtctccgtcctttctgttctgccagcagcctaattcagttctctcatctaagttcttgggtggcccaatcacctgatccatactcatacacatggccttcagttttactcttaaaacatgacagaaaacttctattcgcctccaattgtatacattccaattccttacccttgcatgacaagccctccacagaatgggtcctacttattttgactcgttccactcaaccttgagcgagtgccagtcatacatctccttgtcctcgcagcctccaatttaccttcccaaatcctctgtaaacctttcattcttcaaagccctattcaaatcccagatttcctctggctgagttaattccttcctaatcacttcaaactctgatgagtagttatccaattttcacgtctacttcactaaatatccaagatcctggatgagtgttttcgccattgtacctaacggagagctgattgacagcacttaaactgaggggaaatgactaatgttttgtctggaaatgtattgatattattcaaaatgggcaagcaggctatcttattgagtattaacaagtaaccaggaagtctgattatttgtaaacttgttatggtaatattagctttgaagtgacaaacgaaaatatggaactggatgaaatggagcagagaggaaggtaatccaatgaaggaggctgagagaaccagtattatgttgtcacaaaactgcaatcactcaaaagtgttgatattctggctctgggtctctggggtgacaagataccccagtaactaagagtggaagcaatcctctgtccccactgaagagcccaagaacacctaccacctttcctaagtatgcttctactctgaaacccggtaaatgcaacccgttgtttgcaactcaaatatgtaactgacagtcacttgggcaaatacctccatttaaggaactaaattccaaggatatttccctcttttgctgtcatttttccattgccacaaaacacacagcctgaggacataggctgttcaatttgatcactattgatctctgtaagaaaaaaaaatccagtaatgggcaaatacctttcttaggtgatagaggacatatagcagtgagtgtagacaattcctcccaaaaacatgagaataaagaaggtggtagtggtgttactttagaagaacaactcaggcttcagagagggtaagtttcattacagacaaggtaatctaagagtaaaagggataaaagaattctgtggggtagccagactcagaaaggtggaataacacttttacaagaagataaaacccaggaaatgtttatggcaagcttgtatgttgccactaaacctaccagaaaaagaaatcccattagaaccgcccccatcacaataactacctaagtaaatcattgttgagtaacaatgagcaccccttaaacatgtcagaaaccagaaagtttttgtttctaatgagatttcatttacacttttaagtcattgtctcaacctaatttgtgcatgcatggttctgagaaaggttatcatgcaaaatgaaataaaaagccttgggcaaagcaggactccaatcataattaatccttttgggccgtatttaaagaaaattacttttcttagccctgttcacttatttctaaaatgtagttatttgctttatgttccaggatatccttgatcaaataatccttttctaaatcaacttatttcgacatatgtggccaatgtggctgtcatcctaacctcccttggcattcacacccagctctattttatttactatcctacttttagcactgtgagcataaaccataggttcttctttttacaggagaggttggatgccagtagcctttagcctccttcagcccatcctgtaccttgaacctggacatgatgtatagagccccagcaaccacttgataataaaccaacttgccaaagacaaaaagtagaatgaaagtctgcctgagaaccatgaagctcccatatcagtcccagagtctgtctaagcctaagagaaaaacctatataagccacattgtattggggctgtgttatacaacattataataaatacaaactcttcagggcaggggagagaaaaaggaaagattatctgaatattgtttaaaatgaaatctagattaactctggtctctaaaatatttcatctctgaaagctctagcctaaagaacatgcttatttaaccactagttgtgtgacagaaatatctacaaggcagtgcaaagtgtagggccatccaaatgctggctccaacacaactcaactgtgtcattgttaaagttacttaacttccatccttatgcataaaaagggaattaatattctcaatcaagtatgattaaggcattatttttattatcttaatgttaaacgaacacttagttctccccaaattgctgattaatactgtaaactgaaatcccactagtttaaaactatacatggaatagcaatgaagtttttctcgaaacctctcagtctagttacattatacccaacttttgaaaacacgtgtacttaagggtcaccttatacataccacttgaggttcctttactaatcaagcttgacatttttgtctgagggagttcactacgttatagcttgaattatagctggaaatcaattgtccagctataattcaagtaaaagattccaaaatgatggggaaaagcatatgtttttctccctgaacaggcatacaatatgtaatttaagctttgatgtctttggtcattttggaaaacgactgcaacaaactaagcccagtcagaaaaattttgcttgttttaagccattaagttttggaggttgttttgttatgcagtactaggtaactgcaactattgatatgccttcccttgactttaaaaaacaactaagttgactcttgaatatcaaatttgaactaagagggtccacttacaggtttacttctgtctctactacccctgtgacagcaagacccccctcctcctcagctattcatgaaggcagtgaggattgagactgttataatccagttccacctgagagtaaatatacatacacatacatatacatacacacacacacacacacagacagtttcattctgttgctcaggttggagtgcagtggcactatctcggctcactgcaacctccacctcccgagttcagtcaattcttgtgggctcactgcaacctccacctccagagttcaatcaattcttgtgcctcagcctcctgagtagcttggactacaggcacacaccactaccacctacagctaagttttgtatttttagtagaggcagggtttctccatattagccaggctggtctcgaacttgtaacctcaagtcactggcccgcctcagcctcccaaagtgttgggattacaggcatgagccaccacacctggccataatatatttccgattgcttaacattttctctagcttactttttacagtatataatacacataacatacaaagtgtgtgttaaatgacttattggtaaagtttccacagtaggctgtcaagttttgggggaatcagcttatacatagatttgactgaaggaagctggggcccctagcccctgcattatgaaagagctaactgtatacacaatccagctttgtttcattggttttctcaatctacaggaatatgacaactacaaaagaccttagagactgaactactgagaatcaatcattcgacttgctacacagtcccacacaggattatggttggtacattgaatgggtctagataaatcctaactgacctatacatccaaaacttttctgtacacttaccaagttccaagcacagtgctggaaattaggaaactcattaataagcaagtgtttctagagtattttgaactggttcaaaaccagttcagatttatagaaccaaagagtaggtactgatgaaaaggagatcctatgttgaactagtaaaacacatgcacaaaagcccagtggcagaagtaaaagaaaaggcagccaagcagagctgaaatagtgcaaatgcaggttaaatacagtgggctattcatctccaagttgccgtgaagtggctaagtccactcaccaagccaaatgaatagcaaagacaacagttccagcctccagttttgaaatccatagttaagtgcggcagctcccacttgtaagcatagcacctcaggaggttgaggtgagacaaccacttgagcccaggagttagacactagtccaggcaacatagtgagaatcatctcaaagataataaaaataaaactttgttgactggcctaatccaagtctaaaatcacatctgatctcaagacagacacccatgtcacatccacaccagtgtcaaggctccaggtaaatgttgggagatagaagggataacctgaataatgacaatttgggtattctgaagcatgagaaatccaaatatatagcgatacctcatttcgttttaccctagatcatttctgggttctgccaaaggccaaagaaagtaaacagcatatgaaaacacatgtattaaaataaaacaagaaaggaatgagatgagattttcaaacctagctcactttaggttaaggtcaattttttttttgttttttacacataaaatcttcaaaacgaggcatatgtttaattttattatccagtcttagtctcagtgttcttatgtacactgagtaatgcatcccttacacctaggaggaattttgcctttgaaccaagaaaaccccaactagttcagaaataaagttctaaaaccaatttaaaaagtaatcccaatcacaaattttaggttttcttatgtttaggaagtgctcataggctctaagtacttttgtttccttattaatgttcaccacgatctttcgcaatacagatgaaaagactgatgctgaaccaacaggtggtagacagactctaaagcctgtgtttaaagacactacccaaagacactacttgtattctcacacatatccattaaaatttggtagcagagacatttgtttaggggctgaaaagttttagtctaaaattagatctccatttttattcatggattcttattcctatagagcaacctcatctactttcctagttggatcaactgattccacttatttgaaaataattacaaatacggacggcagtagcagtaggaaaaataacattgtttgattcaacttcaaagtatccactgtgcgttcagtttttatgatacatgtacaaattttctttcacctgaaaggccctagaaataccctgtaaagagcatattcagcaactggacttaagtttctaagtaatactccctattctaagaagccagcaatccttggagaaatggcccattccagggctgaaatagaaaacgcctgtaagactagaaaactttttgagccaaaaagtatgttgatcagagtaaagaatataccggaattctttcaactattttcagagttgaaggaaagctgtaatattgataagttaccccaaaacaccaatctggagtttgactaaggggattcactgcagataaaactttattcagcaatttttttaaataaagcttttgttcttggctaagtaaattatcttaacagctaacagcgtcttgttcactgctgctgccacgtcatttaacttactttttcagttgcatatatatgaccctgaagcctttactggcccctggggcccacctacctcaaatgttctgaccttcaaatggctgacttggtctatcaatcatgtcttcctttaaaaattatctttcagccaggtgcagtggctaacgtctgtaatcccagcactttgggagaccaagatgggtggattacctgagtccaggagttcgaaaccagcctggccaacatggtgaaacacctctcaacaaatgtaaaaattagctgggcgtggtggcacgtgcctgtgataccagctactcgagaggctgattgcagcagtacactccaacctgggcaaatgaagtaagaccctgtctcagaaaaaaaaaaaaaaaaaaaaatttctacatggaatggtcatcctcatcctcacttgaaatactcttgtaacaggtggttccagtgttttaaacccattaagaggacttccacagctaaactttctatggactggccacttgtatttctacctgtatttccaggtatctcaattccttgaatgtagcctcaattgttctgttctgggacctttgcctgtatttcctcctgttcctccacctgaactgctcaccgttcagaggttcttcctctcacttcacaaattcctacagattctcaaaatctcagctaaaagctcatacaaattttgagccttctggtagcaactattttacaacctcatgaaatttaccagagccgcaattgcctaatacattatgaatgataaaattatgaataagaccttcaactctggatatgagatctgtcgacttctggcactcacgtttaatcacacattcctagttccttctttttggctttaagtttaaaacatgtaagaaactggctgggcgtggtggctcatgcttgtaatcccagcacttttgagaggccagcactttgagaggctgaggtgggaggatcactggaggtcaggaggtcgagaccagcctggccaacatggtgaaaacccatctctactaaaagtacaaaaatcagctgggctcagtggcacacgcctgtaatcccgactacttggaatgctgaggcacgagaatcgcttgaacccgggagatgacagctgtagtgagccgagatcatgccactgcactccagcctgggcaacagagcaagactctatctcaaaaataaaaataaatggataaaacatgtaagaaactaaaaagcaatgcttttatgtaatattttatcctgggtttcaaaataataaaactcagtttgttctaggatccacaaaacttaaaatgcccaatttcccataggaaaattaaacaaccagactgacttatttcccgccagtaatctattatttctaaataccccatttcttcttttattcagactcttggcttgaggatgacatggtcgggcctcaataagcccactgtaagtcaaaaatatcataagtagaagatgtgtttaatactccaataaactcataaagctgaagtcttaagtcaaaccattataagtcagggactgtctgtactaagattttagtgaataacttaatttttgtaaactggaaaacctgacaatatgatgtcaaaaggaagaaacacaagatacaaagcatactgtatttttgaaaatatacatcaatcaaaatttcttatgaatacttatccttgagtaaaataatttcatataccaacaaggatgtttccatttctgtaaagtcatgtaagtgatcctcaatcagtccaagaacttggctttttatccaggttatattttaatatctggagttttaatccagcatacaaaaatcaccagtatacatctattaagttaactgcagtattatttcaccatcaccatttacatgtacttttcaggtatcagagacttagtgctttaagtagcaaattacctaaattatgaacacatatttccaaaaacaaaatcaagctcataattaccaagtatatatgtacagtgcagattaaaaaaaaactgaattagcacatatttctcttttctaaagctcctatgaagaacttacactcttctgcactaccaatctattctgtacatttaaaataacatttgttttgatttaaagtcaaaaatataaaggcttaaatttttgtaagactaacccataaaaaaggactccaattttaaaccaatccctgaaaccaaagcattcaaatatttgaatattagttcaatatttctacatagcacgataagattttcagttacttcaagttttgtctttatttttaataatgggaatggcctacaattacaataaacaattaattcagttattttaggggccttaccatatcattaacctattcacacaacaaaaatatttttatgaaagttaatatatcctttcctgattaagtgtgctaaaacagaaatagaggtagaatcccatttttcttaagtaccactctacaagccagttccacacaattaaggtatttttgcaatctaaaatagtgatgctaatactgcttcagtaagctagatttactaatttaagaatcctaagaaattatatatgtggctttcagacatccatgttaaactatcaacttgtggaatttgtggaacacttaccctacttgagtgaccataaagcaaacaactctaaaattttttcatatcagttttctttataagtgattatatgatatttcaccatttctaacaggaaaaaatgagacttacttggcagtgtgcatgggctgctggaaactacaatcagagtgtaaagacaaatctcaaaaatgtttgtagataactcagaataataacccagaatataacctatcaggaactatggaattccattttagtcttcaaataataaactccacttagcagggattgtgaggttgctcttaaaattatatatttacagaacatagtggcctcagcacaaaatagctccctctagacatcactactctccactcttcaaaaaaaaagtatatacattcatttaaaaaaaaacacccaaaatatcaccagtacattttataaaattaaatccaaattttattaaggatttcaggttacatacttcaaatttctagaatggaatggaatcattttggaactggaaaaatggcataaacactgacgtcccttaaaacttcaattttataaagaaaattcttctgcaaaccacatcccctttatgtaacaagactaggtattatctacaccttcactttggcaatagctatttcctaaagaatgaaaaagatgattttgctacttcagttcattaaaaatgggattctatctttgaagttcagaaaaagctgcatttcgatgaactatggttaaaaaaaaaaagcacatagtgtctaatcaaagcaaaggaaatcattttgaaaataaagaaaaaaagctattataattggttaaggatttccagtagtaagttaaaatctcaggagaggaatggatagcactacaaacaatgtgttcacattccaagaccttaacactaacttctcagaaaggaagttttcattacctctaaaaatcaattcaatgtaattttattaagagcaggaaatctagaccttcctctaatgacaatccaataatccaccctcactgtcaaaaaaaagttcaaccccaaaattaacagtaattagcctgaggtattgtaaatgtggctctacagtctgaaatttaatggcatcttttgtcaaaaatagtcttatttccactttaagtctcatgactacaatactatagtgctatccctgtagtatttacaatacagtcatcaaaaatatctgaaaacaaatcttggaccttgtgaaatagtgcatccctccacttctataaaaataggagccacacaaagatctaaaaagagtgctgactgcccagatccagaacagaggtacttaacacctttgttttccagtttagttatcaaagcgtggtgtgaacaaaatgcttagtgtcacactggcattacaaataggcccaaaattttgagcttttaacaagattgagaaacattatatgagatttaactcaatatgccttaacacatccatgaggtagttaggtaaacagtactacccattttaattacacagtaaacagaagcacgggtaagtgacatactcatactttaagcaataagaattagaagaaaccatagaagcttggggccttctctctagctctaacccaaagaaaatgaatttttttttttttttttaaaagaaaacagcatcaatcacttaagattttcttcctcttttttttttttttttacacttgcttattagtatagcatctcgttccaaagctggtaccttttcttcaacaatgtgttaaaaactgagtataacccttaattcaaggtaggcctctacttctacctgaattggtacaaaattaagacattatcttgtaagaactaaaattgtatttgaaatttttattttagctgcaaaaacaaaaacaagcaaacaaacaacaaataacttgaaaataggcttgtcaaatgatgtaaattcatcctttccagggaagcagaaggtagaccctaccacaaagaaaagatgcttagttaatggaggttaaatttaaaaatacagttaaattcaggctaacttctgaaaatcccgttttattcacctcactgtggtaccagtaactatactgagtcaggttactttacagttaactatgtcacctaaaacacaataatccattaacactctaataacagttattgggtgtggtcatactggaaattcttaaccatatagttgtcttgccaattttttttttaaacaataaattgtcttagtataagtcactgcatttctgtaacaaagtaatgaaaggcacagctaatccaagcggacttaaccctattcaacaaccagctgaaaaaatactttggttcttcaaggaaaaaattacaaaaaaaaaaaaaaggtatttcctttaacagttgttaattttcatagctgtactccaagagctacataaaaatattccagaagaaccaaattatgtagcaatgaatgaacatgcgtgacagaatttgtgcattcaacatagctggcagaaaaactagttaaaatgctaggtagaacaaattggtctttaaaatatcagtttcctgtcctttaaaaaaaaattacctagtctaccaagaaaatacaaaaacataaggctgtaagtaaataagagttgtgtttaggctattacagtgcaggttatcctcaaggccacatacatcctgcttcactgctgcttgcactctgctgggttttgatccttctgttaaaggaaaacaacaagtcaatctatcttcttctacctgcttcagtgaatttctcaatagtaattactgccttaattataacagtagctcactgttgtcaaaagaaatggtataggacaatggtggtaaattatttattttattagcaagtcactgaaatgctaaaatcaagctcaaactttacactgtagaattaactccataaaatgtgacacacgctaaaccataatcttaaaaaaataaagttaccaagcaatttatgttagttatattaccaatcagctttgtttttgctaatcctaatataacaaattctcaggaataatagactaggactctcagggactgagtaagagtagttggaaggatctaacaaactgcactgctccccagttcccgaacactcctacaaccagatcttttaaaaacctttattttctaatgcttaaaaactgttacaaatcgtcccattaaaatagaatcctagggttcactgtacctgaaactataaaaagcacgaagtccaaacaaaaaacaatgttttttagaaaaacgtccactgaaattatgtgtactgttcacaatgccagtgggactgaaaaaacaaagttatccagtcaataggctttatttattaaagactttaacggagagaaacttgatattcaaaaacaccaactcttactttagctatcttaaatttaatagaaagcagcactaattttgctcacctttgggtcatagtctggatcattttcctcatctccttcttcttccccttcctatattaaagttcaaaatgcatccatgaagtatgtacatagtaggtaaactggctcataatgtagggaaaatttaatacaagttactctacggatcaacagattttcatgattacagactttgatgataatacaatttaatttgaaagcttctaatatgaaaaatttcccaacacaacttgagacatccagacagcttttattgaaaatagttactgcagccaacgttggaaaagtttactgcagcttttgacttcttcaaagagctgataaccctgcagcagaacaaaattatttgaaataaaaaaatgttgctgagttttgcaatttatttattgaaaccttatacatacattgtttggctgtagaattctaaaatcatgttttccaaaatgtttttatcccaaatcacagaatgattatagcaaaggaatacataagtcattcaatttgcttctcaatgtgttaaccacagagaattatttgctcatttggtaaacattacctcatccgcttcttcaccttcttcatcatactgaaaaggaaaaacagcgttaagtgttgagtgaatgtaacacacatttcagagtagcatcagtaac

SEQ ID NO: 924 - DNA, 2391 bp, Homo Sapiens
ctcgccaccttccctggaactgcagcctggagggtgcttccccagccctgcttcctgaagcttccaagctcatgcgccgagacagtagctccggccaccaagatccacccctgcgtgtgtggcgtgtgtctgtgtgtgtgtatgcatatgtatgtacaggagctctaactgcaggaccgtcctcctcatgggtgacagggagctcaccagtcactctgggttgggaactcctagcaacattttcccacaagtaagatcagattaaagtaaagatcaggaagggtcaagagagaaaaacagccataaaacggtgggttgggaactcccgaaaggaccttcctcacacaactggcccagaggccgtgagtcacggaagacagctgcatctcatctggatcgaagagtcgatgctggtggcggattgtgtgtggcacgagttccctgacactcgctcaggacatgtcccgtggatagcttcctcctgaggaaggcaggcaagccgtccacccacccacgctcctgcacgccttgtgtcagagatcagctgtcaaatctgacacgcatctacggcgctggcgccaaggcctcagcctctcacgctccacgtcccttggcctctctggttgagctcagctgggacagccccctgaccccacactcacctacccccactcctggcccggcacagctctggccccatcgtgccacaagcaggtgggggataaagggagaggacacgtcaccaatatcaaagtcgagcacgtggcgggagcgtctgtctcatgcacgggagggctgggctcggggaagcagagaggagcgaaaaacgggatgcaggcaggaaccatggcccggaccctcagagccggagagcagccacgggccctggagtcaccttggcttcccctgcagagggatacacaccctggaggagattctgcctttcctacaacacagtgaaggccattaaaagctctggaggagggggaggggctacctgcggggacaccagatgacacgaagccctggggtttggcttcagtgaacttcttctcccagtgggaggaataccccaccactacacacacacatgcacgtgcacacacgcacatatacacacacacacacacacacacacacattcttgcacgagtgaaaggggatgtcccttacatcctttgacggcaaaagccctcaactgggttggggttccaaacacccatcagagccgcgtgaccctactggatttctcggtggcagcctgggctctaagcagatgagcttctgaaagccccgtactccctcggccagcttcgaacagccatttaaggttgtctgggtccaggaaaaaggccatctttggatttgctgggggccccagatcttagtaggaaggaagaaaagaacctcgcaaatccctccagtttcgtgggctcctccaggtgggggcagccaggtctgcagatacagagggaaggaagcctggaaatgaatgctgatcccaggggatggggaggagtcaaaagcatccccaaagtgcactgtttgggagtcctagacccgggacaggtgaagggcacctgtcttcagcctttaatgatctagggcagccattctctctgaaggctgagggagcctggaggggcaggagaggcaaggcaggtccctgtggtcagagagcgccttctggatacagccacggtttgctttcattatgcaaggcacagaggaatgtgatgctagacacagcactaccgccgagacaggagcgagacagtgctgtgggatgcccagggttaaaaaaagttgccgcggtggctcacgcctgtaatcccagcactttgagaggccgaggtgggcagatcacctgaggtcaggagtttgagaccagtctggccaacatagtgaaaccccatctctactaaaaatacaaaaataagctgggcgtggtggtgagcacctgtaatcccagctactcgggaggctgaggcaggagaatcacttgaacccaggaggcggaggttgcagtgagccgagatcgcaccactgcactcgaacctgggcgtcagagcgagattctgtttaaaaaaaaaaaaaaaaaaaagttgcagggaaactgcaaagaaggtggggaaaggacactcctacacactgtgggtgtgtgttgaagggggacagaccctgaactggggcagccttctaggtgtgcaggtacaacgaggcagtccctgtccatgtgcaaaacgcccagcaatcacccagcaacagcccttccagggctcttgtctaccaaaccctataggcctccacagggacatgaggatgaagatgctggggacagcatgagtcccacctcatctacaccacggagctccatgcagcccctccaaa

SEQ ID NO: 925 - DNA, 2693 bp, Homo Sapiens
ctggttggctgagcctggggctttgtcaggcctgtgctacagtctgacttctcccttttcctgatcctctttccttccccttcccttcagaagacttgatccctaataaacatcttgcaccccaaactccatctcagagtctgcatttggggaaccctgccctttgagaccagcctggccaacacggtgaaacagtgtctctatcaaaaatacaaaatatgccaggagtggtggtgcacacctgtagtcccagctactcaggaactgagaatacatgtgtgtgcattcttcattctaaaattatctcagctttaatttcctatacagtaaatattgatagatatagctgacctagcaaaagttctttgaggtccttaatgactttacaagtgtaaaagtgtcctgagaccaaaaatgtttgagaaccgctgtaaaaccattgggtttgggggtaatttgtataagacgtctatacaaatataagcatgtaatcaaaatgttaatagtgatcatctgtggatgatgggattatgggaaatgtgtatagagatttttcccttttttatactttatctgtattttccaactttttataagaaatgttttgcttatatgagaaatatagctttaagataaagttgactgatctgtataatctttagaaagaagagagaaacctctcttgctctatgggaaggtcgctcctgtgggaaggtcttggcagaaggaaataaacatgttgaaggccattctctgtagccctggtcacctccatccagcgaaagtagcaaagggaccctgaatttccacctcctccacttctagagggcagtttggtcagctttctctcgctgtcctcttttcaaataagaaaaacaaggactctagttcccaatgtaaggatccactcagagaagcccccaaacaagaagtgagcaagagccattttctattcctgcctgtgaagaacctctagaagttgactgcattccagcagcagttgcctagggaacaccagtgacaaaaaggagccgtgaggacacactaaataactttagcaactatttgcatttggcagatgtagccaagggcagggccctgcctggctccctgtggaagccgcaggagccccacaaggaagggggggccactggaacagtcataggggagcagggaggtgggtgaagaagtgagggccttaactctttcattgcccctccccaagcctgctggggcaagggtttgtcccagaagagatctcctgggctttgtggaaaccccagagaaagtgcagcctcttccgggaactgggtcctcccacacacccacagcctacagccccccacccacccaccatgccccccagtcttgcttctgcttccgccaccagggaaggcaggtgacaggatgggctgtgagctccaggctcagccttgctgtggcagctaattgggatggtttttacctgccaggtgaaaagtctgcctggggaggggcagtcagctctctgtcaaccctgcttcctctctgtctgccagctctcattaggactaagccagtcccatggagccccaagaggagaagaggccaatgagccaagccgttcctgcctgtggcctggaaatcagagctgcttcgagcaagctctgcgcgggctctttaaggtgagccccagtgcctgggcttcccactctctgggtgggatggagacgagaccgaaaatagaaagcagcagaggcccagaccaagcctggcttttctcactgcccccttcaaaaagttctgctcagatcagatgatatcagaaatgattggcgcctttatttcccccctttgcttctagtcccccaccccctttccagtttgaccacatctgtaggctctgttgaaacagagccaacataaacaaaaacaaactgaaacccagcagccagcgagggcgggatgtgccacccatctgggcaggccacgtgcagggctgaggactgccaaggcacacctcctgctggtaaaaggcaccgtgtggagtaattaacctccagggcttggtgagtgaaaagcaccatgtaaccatgctgggtaattgaagaggaagagaggagcgctctcccgagtgaacattcaaatgtgtgcagcttgctggaccctctcaagcaggatggcagtcggttggccatgccccataatgtggctgtcatcatttgtcttccaaattgttgcccaatcagaatggcttcgggacccttcggcttctatgtatgcatatgtataaagagacttcttaaagccatgcaggatttgttgttttattttttagtgagaatgtccagagctggcgaaagcagaagagaaataaacactccggtagtctgctggtgaggatgacaactggtcgacatttctagaggccagttccggctccaacactgcttgcgtgtatctgtgaaagagacccaggtgccatgaggctaggaaggctgggatttcgcagctctttgcactgaaactgctgtttccttgctggtgctgctggagatgaaaatccaccatcctccagaaacccaaatctctcctggcaccagctcccggtggccagcaagtcctatcatcaactggaagaaatgaatgacatgctctccgcatcacactcacttagaggggtcacacagcaaagctgcttaagcccctgaagc

SEQ ID NO: 926 - DNA, 2105 bp, Homo Sapiens
tagcagccttgtgggaaatattaaagaaaatatgcaccaaggccatctaataataggaccatgttttgaaagatgtttacatggtggtgcttcaggaaatggggctttgcttttaaggtttttgagtatggagaaatagtatcccagctctgcaataggaagatcaacttgcaaacagtttaaataggctggtaggggacagtctgatcatgaaaaagcaactaggaagctattataagagattgaaccacaatggaggcagcaggaacttaaatttcttttttcatttatacttgcctttcaactttttgtagttgcaacatgtactttcttattgaatcctacctctgtcaaagtggaaactttgataactcaaattgtcccaagtataaagtgatttcaaagttttctcatagtcgtcttgtgtttttcacaaaaaccaatttctataatatacttttaaaaaattgttaatcatttctgttcaacatttcttcagtctggatcttatccaatgtcttacgctcctcgttaaacaacaaaaaaaaaaaaaaaagaaaaagaaaaagaaactcacatctaagattaagttcagtaaaattttgattaatcagaaaatgctaggaatggcgttttcgttacttaacagtaacacttttgtggtttcagggtagtcaatgaaaatattttcaaaatatatgtctatatctataactggatataattaactcaatttaacatttatttgatgatccacaattttgaagcctttgaatgtttgacttcaagcagcaagaaagatggagtgatagtgggaaggtaaaggtgaagtggtactctgagggatcagtggttgagagggaagaggtaggaagaagagcttcacagaggaaaaggatcaaatccttattgttccatattatagatgtaagttactgaattctaagaaaatgctgatacttattttaaaaactgtatccctaatcttttttcctcatcagttccttatttctcataaaagtaaaattagaataaaagatccatttctttaagaattatggtgagattgattttagtatgttatgtaacgtagcaagtgatactgagtgcagggcattttaagtaacagctctttcattatatctcagctaatttattcaacaactattgaatgagtactgttatatgttaaacaccattgtaggtgcatgtgatatagctgtgaacaaaacatcaagaagctttgccctctcttgttgagacagacagacactataaataaggagaatacatagtatatagtttttagaatacatagcatttttggtagtgaaaattaccatggaggaaaggagtaccagggtaaggtggggttatgaagaagatcttactgctaatatgacatcaaattaaggcttgaagagagcaatcaagtcttatagcaactggggggaaaaggttctgaggtaggaatatgtctgataggtttcaggaatgtaaagcagctagtgaagctagaaaagaaggaagaggaagagaagtagcagttgagatcaaagagctaaagggaggccttgtaaactattgtaatgactgctttttattctgagtaacacaccactggagggttttagatgaagtgatctgatttttttcaaactaacaatttaattttaatattaccatatagttaatatacagtaaattcactcctgttagcacacagtcctgagcatgcacagttgtgtaaccaccaatacaaagtataaaacagtatcattatttcagaaaatcttcccatccccatttgtagccaactttattccattctctgcccaaccacggtcttctgtcttttttgattgttgcagaatgtcatataaatggaattgtatcgtacgtagcatttccatctggcttctttcactagcagagtacgttggatgttcatccatgttgtgtgtatcagtagtttgtctctattgctgaggagtattccattgtatgaatgtaccactgtgtgtttatgcatttcttgttcagttgagggacatttgaattgtttcaaaacttggtgattattaataaagccactataaatgtcc

SEQ ID NO: 927 - DNA, 6557 bp, Homo Sapiens
cggggcggggcggggcggggctgggacccggggccgcaggggcggggaaggaggccgcaggctccggggtgccctggctcagcgcagaaaggacgccgcgcacaggtacagcccaggccgcccgggagccgcggtgggccgcggtgggactgcgtttctccacctgtctgcggtcccggcagatgctcccgcgaaactcactttctcacctgcgcctgtcacgccctgggcgcccacagcttccccctccttcccgttctctcaacctgcgctggccggaggaccgttttcacactcagagctcccagaaagatcccgggaaggctcactgtcttctgcagggaaagtgcagctgtaactggccccatccctactttcaggtacactattggggcacctggccgcgcggcgtggactctgcacgcctgggacagggaaaaagtacaccggagtaccgctcagtctttgcacagcagggaccgggctttttattctgggaaccttccgagggattggcgagggctcttctcagcatttgagggaagatcccatctcgtcacacactgctttgctcgagggtgcacagtggcccgcactcctgggtctcccagccctggaggatctggcctcaaccccgagaaaagattctttctctcccatttaccattattttgtaatttaaacgcgtccctgacgattactcatctcatacctagcagtacggcaacggacgtttgcttaagtgaaaaatgaaattgcgaccatcttccaacccaaaatggcaatctcatgggggcaaactataatctgtgctctctttagacgggagcggtcagtggagacttgggattggtgttacctgactgccagatcatcttcctttccttccaccttctgttcttttgacaaatacgcccagtgtctttatatgtccagtgctctccaacaaaagcaaggattctgctttggatcacattgcctcatcacaacctacagcatgtcatcttctcttgcagcattagagagagaaatcagccttcgactttgacaatattaaactacattacattgaaatttaacatagaacaaacaaaatgggatccaaggtggtgggtggctgaagggtgaattatgggaaggagcgatacagtctaagtaatacagcaaaagcagctaaaattatgagtggatttgaatctccccatttttagtaccacttgttgggaaaggcagcaactctttgtcaaaggttttcaccttatctggtacctccagcagctagatccaggatggggctacccacccctccacactcctaaagtgggtatacccctccagtgcttcaggacaactttgccagttttctctacccagtcctccgaaagcctcagagcctgctcagaccagagggcttagctgtatgtacagtactaaagtttagaatgttgcctctttacagagataccctcagattcattctgtaaagggagtcccagtgattaactgtgtctacttatatgaaatgataagaagaaaaatgttcaggaaaattactggaatttcttttttaaaatactaaccatatgataatgtgtttgtgtgtgtgtgtgtgtgtgtgtgtgtgtaagtcatacagacactacgtgaaaatctggcaattatccaattgaacagatcattggaaacaaaaaccacgatcagttaaggccctaagtgaactttttgccttaattttaagtaaatctgtttgcctaacaaaataatgtgaaagttatttgtgcttctattcaaaaataggaagtctaaataggcctatagcaagtaaataaatttaatcagtaataaaaaaacttccaacataaagaaaacacatgatgagatagcttcatgagtgatttataccaaacgtttaaagaagaataaatgccagttcttctcaaacgtatggtatgtggtgaaagcagaggaggggaaaagctgtcaatattctaaatttgctatttgtaattattataactaatctgagctcatgagactagtgttttagaaaagcagctctaggcaggaaaataggtaaaaatggagaatgatcttttaaaatagtgatttgtaagatgtttattttttatatactctttaagaaatttttgtaagctatcaactgtctcccagggggaaaaatgcccatgaatacgctaatgtaaaaatttctgcttacagtttaacagactgtaagtaaaaaaacctgaaaaagtttattctgttttaaggaaaaaaataaaaacacatgatgtctgaaagaagattctttgaagttcccaaattacagggtcttcatgactggaggcacaagagtaaaggggaaaggaaaaggaatttggagtcaggtacatttgcactcattctctttgtgcttctgggcatttaacctttctgtgcctgtttccttctctcaaaattggaaaaaaatagtacatatctatagtagattttgtgggtgttctgctcagatccccttggatttcttccacattttctgagcacccctcaccctgtttttgcctcctttggtttccaataccagccccaagaccaccacctgagagctcctgggacttttctttggaggaactgcccttagctaccagaccaccattgcccataggcagatagagcctaggtgcccctgagtagcacttagccaatgactgatggttgagaaccttgatctcatgttggataaatctgaggtacaacttacaaccagagctcctctatgggatcggactgaaaccatctcccactagaccattcctaaaatcccatctgtgttggcttcttgccctcctctgtcctgctacccctactccctttcctgtttctcctggcaacactttctttaaattgcttttgtagaaaaatacttgactcaagtcctgctgacataagacatcacattatagagttgatataagcatcaaatgaaacattataaagaagaaactagtccagtgcctgaaacagagtaagccttcaataaaacatatctaatctttttattctgaaactttagatctcttttagttcacataagcaaggaaaaaaaatttctctctttcactgcagaagaattttgaggaacatctccttgcctagattatttctgggcatagtattatctggagtgatcatatactatgaaattttcttctgtgaaagttcatgtctctcctaatttgtttttctgttcaccaaaattattttataaatacggcaagtactttgctttctgttaatgaatttcattttgtttctttcaaataaaagtaaagtgaggttatgaacctaacagcagagccccaaaatacacgaagcaataaataccattttttgataaaggtactaacaccattcagtggaaaaagatatatagccttttcaattatataaccacatctaaaagaatgagtttggaaccctacttcacactatatacaaaaataaaaatggttcaaagacctaaatataagagctaaaactgtacaactcttggactaaaaccttgccttaagtctttatcacctgggattaggcaaaggtttattgaatgtgatacaaaaagtacaagcaataaaagaaaaaaggtagataaactgaactccaccaaaatgcgtgcatcaaaaaacactatcaagaaaatgaaaagacaacacacaatggacaaatattttaaaatcgtccatcagaatatataaagaactcttacaactcaacaatcaaaagacaatagcccaatttaaaaacatgtaaaagatttaaatagacatttctccagataagatatataaatggctaataagcacataaaatgctcaatatcattttcattaggaaaatgcaaatcaaaaccacaataaggtatcacttcacacccactataattttttaaaaatgataatgaggttgtggagaaattgggaccttcatacattgctggtaggaatgtaaaatgataccaccactgtggaaaatagtttcacagttcctcaaaaagttaaacatatgatccagtaattctgttcctaggtagatactcaagagaattgaaacataaattcatacacaaagcttgtgtaaaaatgtttatagcaacattatgcataaaagttaaaaagtcaacacaaccaaaatgttcatcagctgttctatacataaacgcaatgtggtatatccatacaagggaatattatgcagtcattaaaaaacagtgaagctgaggctgacggattgcttgagctcaggagtttgggaccagcccgggcaacatgtcaaaaccccatctctactgaaaaatacaaaaattagctgggcatggtggtgcatgtctgtaatcccagctactcaggtggctgagctgagatcgcagccactgcactctagcctgggcaacagagcaagattttgtttcaaaaaaataaaacgaaacaaaacagtgaagcaatgatacatgcttcaatatgtatgaaccttaaaaacatcatgtcaagtgaaataagccagatataaaaggctacatattgtgtgatccatttacatgtaatgtccaggataagcacatccatagagacagaaagtagattaatgggtttgccaggggttagaagtaggggaaatgagatgtgactccctaatgtgtatggggtttcttttttggatgacaaaaatgttttggatagtgatgatggttgtacaatattatgactgtactagaagccactgagctgtacacttcaagacggttataatgatgacttctgtgtgaattttgcctcaataaagtaaattttttttaaataagaaaggccagattttttttgcaatggagtcttgctctgctgcccaagctggagtgcagtggtgagatctcggctcactgcaacctctgcttcccgggttcaagcaattatcctgcttcagcctcctgagtagctgagactacaggcacacactactgcacccagctaattttgtatttttagtagagatggggtttcaccatgttggccaggctggtcttgacctcctgacctcaagttatccacccccactcggcctcccaaagtgctgggattacaggtgtgggccactgcacccaaccagattatttttaaaaattaagaatctgcttaccaggtaagaattactacttagtccaaaactttgctgtggaagaaatttataaaatttcgacaaattttccaggcttgttcttaaaatatgaactatcagttttcctgttatcatataaacatcaacagattaggtctgcattccttcttcaagtctaatttcctcctccttcaatcttggttgtgccatatgtttttccttattgcatgtaggataatagagaagtaacgggggaaatggaaaatgaagaggagagatgaagaaaaggaaggatcaataaatggctgagaggattgagggagtcaattaaaaaagagagaaaggtaaataaaatatattcagttggttatgatttaggagaccgagttgatgggtccagtttctgtgtgggcagaaccattcttttttccataactgcataccaatgtaaaagacaaattaatttggggaaaatccaggaaaggaatcccagttggtcagggatcggagtcagaaaggtagtatgtggttggaaatggggagagtgacaggtactaatgttattgaaaggaagaatcagtatagcctggcgacaaatggggaggtcttgcatggaaagaaaaagttatttcctagattgcaatctttaggaagtatcaagaaaaataaaaagtactttctatgtaattaatttctcagttggttgttttgactttataccagaactcactatcagcactgacaatcacaattgtcagacaatttcctgaacaactatctcttctatctccatcattctaaagatagacatgtcttttaagcccaagacaggaacttcagcttgaattggggcccagagctggcaatttaaccctgaaccagaagtgtctttaatgagaatgtgtgctgttgaaacccgtttaggtttgtaaacatttccttcgattttccttagggctgtgatgagatattcttcttcccttgtacctcttcatacaataaaccttaatgagtgacggattcaaataggctcatttcttatttgatatgtgattttgaaaagtaaaagtgttaggatagagagtgtaaaggagcttattacattactctctttttttaaatatatatatattttttattatactttaagttctggggtacatgtgcacaacatgcaggtaacagagaatacttggacacaggaagggaacgttacattactctctttttaaaaaagttatttcaaaataaaaattttgaagctgagttttttttaattgttagtaaaagttaacttatgattgtttgtaaatagaagatatttatataattctagggatgcaaatataatcataaaatatgttaaagcttgggaaatgtatgtttat

SEQ ID NO: 928 - DNA, 1843 bp, Homo Sapiens
ccagggtacagggcaggagcctggacctctttacagttgccttttctctctctctgtcccttctccatcttccgagctcctactcgcccttcaggacccagctcgaatgccccatctctgggaggcgccttcaatcttgggctgccccttccgtcacaccccctgtcccctgtctcctgcctccccttcctcctcacacaaagccacccccgcctgttggtggcctgtgtctccgctggcccagggctctcttgccgtggccaccgtgggttttggcctcgtgacccagtccatgcgtgcacagcgcaagtagcttcccaggacaccgatttcctccccggccgcagctgcttctggtcctctgcccactcccgggttctgcgccttcctgcgcccccggcctggccacagctcggtcaccccagaaccaccgtgtgctggggatttgtcacgggtttgtcctgacgtgtgaggtccagccggggtccccatagcctccctgtccccgtccctgtccccgtcaggcctcctgctgcgctgtggacagtggcttggcgccatctgctgggctggtgcctgtggtgccgccaagcgcaggagggacccagcggctccaggtctgtgggagactttaagttggggccgaatgtggtgctcgctgccgacgcagagcccccaagctggacgggacccctggccgtgcggctgggaacacctggggttgtcctacctttgcagggacagcgagccaacccctgcttggaaggagcactttccccaccgaggccggcccagggcgcgtgctgagcaggtgggttgagtgggtggaaagaatgcaacccctggttgtgggacatgttgaagcccaccccaacccctccagtaccgtccttctgtccctccacttgctggggctgggggccaaggatggggtcactgtggggactttatccagctggttgacttcagggtcctggcagggagtggctcttgctgccaggacagtagaggcctagagagtcctatctctgacaccagccaccttgcagggttcgggccagggaaggggaagggatgggagagaatggaaacctccagagtcattttaactggtcgttggacagagccagtgcgacttcaagttcaatgacaaaccccctctccatgtctctggggtggggtggggcctgtggccccacagagctgagccacccaggaggccagggaaggagacgcagtacacaggaggccagggaaggagacgcagtacacaggagcccagcatcctctcagctgcatggacatctctacccagacccttctgcagccacctccccacttacccagcaggagaccaagccaatccttttctgcgaaactgtgctggcttctgtgactgtcctgcaaccagatagaggcctgagggactctgcacagtttctgggctgaggcagaagaagccccatggcttcccctctgcctcctgcatgctgccttttagctcttagcacctgctgggagaagctggccccagcgtggacaagcctccaggagaccggagcacccaccggaaggaagggagggagggagggaggaagggccatggaggtaaaacgaagttattagggtgggcccaaatctgactggtgtccgtagacaaaggggagattaggacacagacatgcacagagggatgacaccgtgaggacacagggagaagacggcatctgcaagcccagaagagaggcctcaggaggacccaaccctgcccacaccttgatcttggacttccagtctccatgactgtgagatggtaaataaatgcatgctgttaaggccacgg

SEQ ID NO: 929 - DNA, 2919 bp, Homo Sapiens
actggcccgtgacgcaggcgcggttggaaagaagctgaggactggatgtgcggaaaccaggtcagaggggcaggcaacagagtgggcgggaaggcggccgggagcgctatacgggtctagggaatcagtaggaagccggaggcgcggctggcggcgacagcgtggccggcagagcagggtcagcccaggtcgcccggggagtgcgcagggacgcgggcaaaaagcccgggacgcgcgccgccggggcctgcggggcctgcccgaggccgaggccccggttgggggtgcgggccggagctcccgctctgcgccgggggcaggcgtctgctggcaataccttcccaggagagctctcctcccggctcccgcttcaggaacttgtaccagaacgtgtccacgcggcccggctccgccccgtcctgcgccgcctcctcggccgccagctccacctccccgagccacaggcccggctcctgcagggccagggccccgtcgcccgccgcggtgccggccggcctcaggcggacggcaccgcgcggctcccaacgccccagctcgggccgcgaccccaccaccagcagctccggccgggcgccggccacggcgggtggcaccaccaccccaaagcggaagcgcatggcgggcggcggcggcgcgaatacccgggcccggagtccccgcggccggcaggcgcggcccgagcactaggcggccgcagcgattgggcggtggtgtgggagccccgggcaccggggagaacacgtgctgttctgcgccttctttgggatgcatcacgcggctcccgagcccagacttcgtccaggccggcgggaaggggtcagcggagccgctagctgcctctttgtgccccgcaaccccgcgggcggttgatttccacctgtgggcgctggggacacgcgaccggaagaaatggaagagaaaacggggttcggggagggaggaaaacttctaagccaggcgatcgtccagttctctctccaagagactggaaattaactttatgaggatcataaggaagggaatgacctctagacagccgccttctaattgtgaaacgggggaagatcttggacctggtctctggagcgctccctatcttaaccaagtcacttactctagcaggtctcaggttctttgtctgtaaaatgagggtgtaaaataatgatctttctagaccctacgagctctgaaggatctctgattggtggagatcacccaagacccggagctgatgcaaaacattacctaccattcccttgtctgaaaagccacatcaactttcttttttcaaaaactatatttttagtatgtgtaaagtaagtttggagtaaatactttcaagtccttttcaaggtcaaaacaaaaactaattctgtgactacaaatgtatgcttttttttttttttttgagacagagtctcgctctgtccaaatgtatgcatttttaatggagtaaattaaaaaaaaaaacctttgtttaaaatttactttcagcaaaagtcagcattattttttcaacttaaaacctttttgggttttaagttgaaacaggttttttagctgtctggcccaaatccaaaatacgtatatcttggtggggaacttcaatttgtctctgccataagacaaacgaatgtcctgatactttttgattctttaacaaaattatccttgtattcttaggtttatatattcactaacatttaacataacacaaatctgttacgtgaattaaagacacacaaaggcatttttaccagtgtttggaagtttgtgaatagtaaaggggaacaggccaaaatttcatgcgttgaggatataagtaaaacagaaagtgcaaaaatgtaaactacacaaactcaatctcttgtggaacaattagaaaactaataatacattttactcttgaatgttgatattccactcgaagtttggttggttgctaagcttaaggataaacactatgaaaaatgtgaagacagaagggctggccaaacacagctgattcggcagcaaatcacacattaaatcacagtggcatgtgagtcggtttattcaaattgctgttaaaagatattcttagagtaagtttaggaaaataagagtcatttggcgatgcagagaggattttgtctacagtggaatccagactccggtgaaagttctcattccttcaggacctgggagctaacagctccggactttcttgtgctccactgtgctgcctatgttgtgtgcttcccaaatggcattattcccaccagctcttccagagtgagttctgcccattctgtagaagaaacagtagcggaaaaattaaacaatatctttgctcaacggacattgtttcctttactcttctttcatcataaagaggttgaaataattttaaccattggaagaagtaaccctcttaagcccctaaacaaaatttgtaatagcttattttatggcaaggatttaaataaggtataaattggatagctgcactgtgtagtaagtaaaatgcaactggaaaggagaacaagaccaaaatagggcttaagggacatatatcaaggccttgatcatattttgacggtcagtcatttggatgtataagtattaaccatgataatatccattgagcctatattatgggccaggcacatggttttcgtactcatattatcttatttaagtctctcaccaatcctataaggtaactacaattgttacccccatttttagatgtgaggatacttcagcacaaaagggtccaatgaacagcccacagcaaggaaggggcagagccaggggctaaaaggggtgcattcagcttatagatatagatacagatataaattctgataaggaaaatctgtttcagaatgcatataaattctagcatatttaaat

SEQ ID NO: 930 - DNA, 22303 bp, Homo Sapiens
agggcggaagccacgggacgtggagcagatggtgaggatagtggggaggtagcagcagaggatgacccgaggcaaaagtgcaagtgaagaaaagtcgccttgccgggcagaggtacgggaccaaggcgcctcctctgggctgaggagttagagggaagaaaatggcgccctgtcatgagggcgcgaggtccgagttgaggggagaagactgagggacacagaagtggccgaagtgagggcgctgaggtcagcctgagctgagagggccggcagatcacgccgcagccgaagtgaacgaactcgagtgagatggaatgttgctctgtcacccaggctggagtgcaatggcatgatctcgactcactgcaacctctgcctcctgggttcaagcaattcttcggcctcagcctcccgagtagctgggactacaggcacctgccaccacgcctggctaattttttgtatttttagtagagacggggtttcactgtgttagccaggatggtctcgatctcctaacctcgtgatccacctgccttggcctcccaaagtgctgggattactggcgtgagccaccacgcctggccgttccgtatttcctttatgttttattttgctgttatttgcctagcatattcaaggtaccaaattaagtattgattgatggtaatagtgataacattaagacttggagatcaggttaaagacagatatgcaccatgaatccgtaattgaataagacagaaggaaatttaattagcctttttcctgtgtccatagcagtgctttaataagaacaatagaaaagtcttttttttttcctttaaattgctaatccaggatgttttcgatgcttttatggaagtcagctaactaaataccttgagagaacagcaataccatcaaattacatctgtctgtgacattttctctaggatgggactaacaaatttgatctgtttttttttaatatgtattaattcacacttattgcattacaacaaggtttttgtcttcttagctcttctctttttcaggaaattactccaggatttgaatcatcacaagagattcaccagaggattttatacacttgggctgtggcagcagactaattacatcacagcactaggtaagataccgggagtccggatcctcaggacttatgaaaataaaaagcattactgtaatattagtgctatttattggagttatctatgaaaagaatcttattaatctgcttttttattagctcacttagcaaatatttattgcataccaactatgtgccaggcattgttccaggtgtttgggccacatcagggaccaaaaaagaccaaaattcctgtcctcgtggatctcacattctagtattcctttccatatgcattagcttgctagggtttccataacaaaatatgacagactgggtagcttaaacaacaggaattaaattttttttttttttttttttacacttctagaggctagaagtgcaagaacaagatgttagcagggttggtttctcctaaggaccatgaaggaaggatctgttccaggcctctgtctttgacttgtagataaatgtcttcttcctgtgtcttcacattgttttttgtttgtgtgtccgtgtccaaatttcttcttcttagaaggataccagtcatattcaattagagtccatcctaatgacttcattttaacttaattacctctttaaagatcctttatcccaagatagtcacatgctgagatatatggtgttaggacttcaacatgtgaattttgggggaacacagcccataatatcacatatgattactgtgtatccacatctttgtgttgtctgtgttctcctatccacatccctgagatatccaaagccatttatgtttacttgcaaaatgtgtccagtgacctgtaattatgagtgattacttttctaggtatgacttattattttgaaagttttactttttaattgacatataatagaggtataaattttcagggcacatgtgattattaaatacatttgtataatttgtaaaggtcaaatcagtgtaattgggatatctatcaccttgtttgttttttatttatgttagaaacatttgaattattctcttttcgctattttgaaatatacaagacataatttaattttaagctatactaaaaagttcttggttaggaaggattattctacttggaatgatgctccatctagtgttcaccatattctactacttttgttaaagttttaaaaatgaataaaggggaaactgtgttgaagaaggggtcctctatttaacagttaggttcttactcacagagcactatggattcatagtaaaaaaaaaaatattgtttcaaataccatatgtgggaggaaagagcggtctatataagacattacttttaataattcaagaaatatcgttaccatcatttactgtcaccaccagttacgatgtacttttatcccatgaggagactgagactgagtttagtcatttacccaaaatttcacagatcttggtcaggtacaagtcagtgatggagatattgtttgccctacatacactgtgtaattcctgaatttgaactcctaattattcagaataaataaaaagagacaaaaagacacaaacttgtcctgatgcactttttagatatgaacacatgtaagcatatacctaattgggtactgaagtttcccttcaattttagtacattttaatccttgtcttatattgaaatgttatctttttgttcagtattttatcattgttgatgtgctgtgtcagaatgtgtctgtccatcttagatagtaaatttataaatgacaggacttaatccacaaccaaatcagcatattatagtttatttcattgtatatcttgaatgaaattgaaaaatttaaataactatttaaaagtttggactttcctctttgtagttttaaaacataatttttgtttttctcttgtacaagttgaatggggcagcttgactgcttggagacatcaggaaagacttccagggaaacaggagtttagtaggataaacatggcttacaataggatgcttcaggaatacagaaaggtccttgtaaattcataggcgtgtgtcagagcttgacacttttgggtaaatgtaagtagtaacagtgcaggcagtggtgttgaaaaatgacagtggattaaaaggcatagcctaaacttaaaagataactatgaagctgctcaaagagcttaacaatgggagtggaatgaacatattggacttatcaaaatattatataatggacaatctaaataggcttatatatattaaataattgaattaataatgataatttctagaacagaaagcaccaagtccagatgggctcattggcaaatcctaccaaatatttaagaaaaatattgtaccaatgctctataatctttcagaagacagaagcagaggaaacatttcctaactcattttatgaggccataattactctaatatctaataccaaaatcagacagagacattagaaaaaaagaaaactacagacaaatatggcttatgaacatagatgcaaaagtcctcaacaaaatattagcaaatccaatccaatgatgtataaagataattatgcattatgaccaagtgcagtttattctaataatgcaaatctggttcaccatttgaaaatcaattaatgtaatctgtcatatcaacaggctaaagaagaaaaatcacatgatcatatcaatagatgcagaaaaagcatctgacaaaaaccagctctcattcatgatcagaactctcagcaaactagtaatagaggggaacttactcaacttgataaagaacatatgcaaaaatctttcagctaacatcgtacttaatggtaagaaattgaagctttcccactaagatcaggagcaaggcaaggacgtctcctttgaccaacccttttcaacatcatatttattggaagtcctagctaatgcaataagacaagaaaaagaagtaaaaagtatacagattgggaagaagaaaatagaactgcctttgtttgcagatgacatgattatctatgtagaaaatctgaaagaattgaccaaaaaaaccctcctggagctaataagcaatgataacaaggtggcaaaaataggttgatatacaaaagttaattgctttcctatatgccagcaacaaacaaatgagatttgaaattaaaaccaaaatcccatttacaataatacccccaacttaaatacttaggcataaaactaacaaaaatatgtaagacctttataagggaagttataaaactctgatgaacatataaaaagctaaataaaggagagagattccatgtttatggataggaagactcaatattaccaagacatcacttcttcccaacttgatgtatagatccaaggcagaccaaaccaaaatcccagaaaataatttcctggatattaacagaatctttttttttttttttttttttcctgaaacggagtctcactgtgttgcccaggctggagtgcagtggggcgatctcggctcactgcaagctccgcctcccaggttcacaccattctcctgcctcagcttcccgagtagctgggactacaggcgcccgccaccacgcccggctaattttttgtatttatagtagagatggggtttcaccctgttcaccgggatggtctcaatctcctgacctcgtgatccccccgcctcggcctcccaaagtgctgggattgcaggcgtgagccactgtgcccggcctattaacagattcttaagtttataaggacaggcaaaagacctagtatagcaaacataatattgaagaagcacaaagttggaggactgtcactacctgacttcaagacttactataaagctacagtaataaggacagtatggtatttgcaaaataatagaaaaatagatcaatggaacagaatagagagcacaggtatagacccatacaaatactatcaactgattttttttataaaggagcaaagggaatacaatggagaaaagataagttttcaacaaatggtgctgaacaaggggatgttcacatgcaaaaagatgaatctagacacagatcttaaacttcacaaaaatcagctcaaaatggattatagactgaaatgtaaaatgctaaactatgaaactcctagaagataacagaagaaaatctagatgaccttgggtttgaggtgaatattttagatccaacaccaaaggcatgatccatgaaagaaataattgataagttgtacttcattaaattaaaaacgtttaatctgtgaaagcactgtcaagagaatgaaatgacaagccacagactgggagaaaacatttgcaaaatacatttgataaaggactggggtccaaagtactctaaaaactcaccaaagaagacatacagatagcaaataagcatatgaaattgtcgacattgtatgccattagcaaattgcaaattaaaacgagataccactacatacatattagaatggctcaaatgcaaaacattaacaacatcaaatgccaaatgctggtgcagcaagaactcttcattcattgctggtgggaatgcataatggtagagccgttacacagtgccaatcataatccgaaagacaaaatcccaaatgccataatctcaaatgcctatgaagtgttcggttgtgtttttatgtttctcaaacaaacctcctttacaaatgtaagtaaatgtctttaaaaaattgttttttaattatctttccagaattatattgtgattttggtctatcaggatcaggatttttgggattttagactttagggattttgatcttttgggatttcaacatttgatattacagcatttgcaattgtatctttcaggagtatggcccaaaccccagccatgtagaaaacaatttgataatttcttaaaaaactaaacacccagccactgttgaaaatagtttgtcaatttcttaaaaaaactaaacacacttttgccatacaatccagtaatcatgagccttggtatttactcagatgagttgaaaagttatgtccacataaaacctgcatgcagatgtttatagcagctttattcataattgtcaaaaattggaggcaaccaaattgtctcttagtaggtgaatggatgaataaactgtagtacatccagacaatggaatatttttcagtgctaaaaagaaataagctatcagctgggtgcagtggctcacgcctataatcccagcagtttgagaggccgaggtggatggatcacttgtgcccaagagttcgagaccaccctggccaacatggcaaaaacccatctctacaaaaaatacaaaaattagccaaacgtggtggcatgtgcctgtagtcccagctacttggggggactgagagaggaggattgcttgagcccggaaaggagaggctgtagtgagccatgtttgtgccactgcattccagcctgggcacagagtgagaccctgtctcaaaaaaaaaaaaaaaaaaaaggaaaagaaaaagaagccatcaagctgtgaaaagacatagagaaatcttaaatgcacattgctaagtgaaatgagccaatctgaaaaagctatatactatatgacttcaaccatatgacattctggaaaagacaaaactatggagacagtagaaaggtcaatggttgtgagagattggagggagggaggaaaaactgtgaagaatgtagggaatttttagggcagtgaaactattctatatggtactataatggtgaatgaatgtacttatgtgtttgtcaaaacccatagaatgtacaacaccaaaagtgaactctaatgtaaaccatggactttggatgataataaaatgtcaatataggctagttgattgtaacaaaggcaagaggtgttaattgtggggaggctgtgtgtgtgtgtgtgtgtgtatgtatgtgtatgtatgtgtgtgtgggagcaaaagtcataaaagaaaattctctgcactttctgctctattttgctgtgaacttaaaactgctctaaaaaataaagttgatttttttaaaaagcatgctatcagtaagccacccagacttcaatctgtttcactcttgaatgaattcacatcaggcatcctttttacataactttaaattgatttttaagaatgagacttagaatataaacactgatgatcctgccagacaaaaaagcttcttgtaaacatatataccattaggaagcaaaagaaaggaggaagttaaacaaataaaagatacataacaaatagcttcatatttaatgaattgatcccagtatgtcatttgggactagctgaccataaaatatcctcctactacccttgaaatattttttcttgggtcttcagcataatagctgtggagctactgggtccagttactgtattattgggtgttttatgggtgctatttgtacactgtatctttattttaaaaacctattttggctgggtgcagtggctcacgcctgtaatcccagcactttgggaggccaatgtgggtggatcacttgaggtgaggagttggagaccagcctggccaacatggtgaaacctcatctctactaaatatacgaaaaattagccaggcatggtggcatgtgcctgtaatcccagctactcgaaaggctgaggcaggagaattgcttgaatccgggaggcagaggttgcaggtagctgagagcatgccactgcactccagcctgggtgacagaatgagactccaattcaaaaaaaaacaaaccaaaccaaaacaaaaaaaacctgttttgagaagtcagcaatggtcagttcaatattggccattaagtaatgcaagcattgtaatgtaaggtttgattattgtatttgtgttacctatcattttacagtactaaattcccataagccatgacaagttacctttacaagttacattcatgttttacctttctttatattgactattctctgtttatagagaagaggtgaatgagtgaaatattagctactataaaataatggctaccatgtccataaaataatagactgcctggtctactagatgccagtaatcatattaatagctttatataattatctcctttaatctttgcaaaaagtctgcattatagttctcagccctcttctaaattgagggaactaaggttcaaagagatcaactaatttggtcaaagtcacacaggaaggcagtacagagtaatagttaaatgcacagtctttgtggcctaattccctgtgttagtattcttgttccaccatttcctaaatctgtgaccttaggcaagttatctaactcctttaatgtcatttttctcatctgtaaaatgaaagactaagtgaaataattcatgtaaagtgctcagcacagtggctggtacagagtgagtacttcataaatgttagtggttattaaaagtaattgtatattacacagtcattgtatattctttttattattacaaataggtgacaacatggatttaaacttaagtctccctggccctgaagttcccttcttttcctttactcaactctctctgtgtaaatttttagtcattggtgaagagagaactgattctcctaaatggctttacctctgtgaaaaaacagatttgccagtttatcagtcaggttaggctaggtttgctgcattaatgaacaacttttatatatccttagtttatcacaaacaagtttatttctcatttccattttatgtcctatgtggcttgactgggagacttctttcattatagtcacccaggaatctaggctgagggatgctccatttgccgtatgttttatcatggccaaggcagaaaaaaagggaaatggtgacttctgcactggttcttaaatatttctttttagaagtgacaagtgccactgctgcttataatttcattggtcaaagccagtagcatgaccaggtctaacttcaagggctttaggaaagagaggagaattagacataagtgagcagcattaataactaccacagcggccaggcacggtggctcacgcctgtaatcccagcactttgggaggctgaggcgggcggatcacgaggtcaggagattgataccatcctggctaacacggcaaaacgccatctctactaaaaatacaaaaaaaattaggcaggcgtggtcgtgggcccctgaagtcccaaaaactcaggaggctgaggcaggagaatggcgtgaacccgggaggtggagcttgcagtgggcagagatggcgccactgcactccagtctgggcgacagagcgagactccgtctcaaaaataaaataaaataaaataactaccacagcaaattgaactttttgagtttcctaatttgatatttctctttttgatttctaaatttcttcttatgtgtatagattcacttggtaaaaacctaaagataacttcatagaaatagttctctttcagagaggtccatcggaattatctggatacagtttccaaaatgatgtgcccaggccccactcaagacttaatgaattgaaatatatgagagtcaggctctgggcgtgtacattttgaaaaactcctcggatggtgctggcttgcactctgttgtgtttatgcaatagtaaaccgatacgtgttttcaaggatcttgctgaagacagatgggaggaagcagagctgaaaggatcagaaagaggaagggacaaggtagaaattacgactcaagtgtggcagggttctgagctcagacttaagctgtacttaccttagaagttcacattgggagatatatctgggcatgcctagatgactggtgggtcagtcatcagagttccctttttataaggtaacatggatcctcctgggaaaaacttcatcttaaattgagagacttttttccccaatatttaattgaaaaatttttaatcatacggaaggttgaaagaatttacccatcatttagatttgataggtgctatcattttgctgtatttgctttatttgctaatttttatagccactgatgatcattacctgaatcaattatttcactgaggagtgggcattggcaaatggtgatttttccgatgtatcatttcttctacaattattatctacattcttctattaaaagagaacttccctttatcaattggagatgaagtaaattttcctaaaaagacatcataaatgcttcattattttaatttggaaagagttttcaggaacctatgtttggtttaaggacagttgacctacattgtagtgaacagatgagctgagtatagcagaggcttgtgcatatttttctacagcccaaccctcagaatgctagagcaaggtagctgcggtgaaaaatagtgtagaaattacagtggctatatcactgaggacagaaagacttggcagcgtgatcagagctcactgcaaactctgccttccgggttcaagcagttctttgcctcagcctcccgagtagctgggattacaggcgcctgccaccacgcctagctaatttttgcatttttagtagagacggagtttcaccatcgtggccaggctggtcttgaactcctgacctcatgatccacctgccttggcctcccaaagtgctgggattacaggtgtgagccactgcgcccagcccaacaaggtcctgtctaggtaaaggaaacgcataggcgaaagtgatggatagaatttgaaaagcagagaaaagatggcaagtggctcagattgaaagagaaattccaaatatactagttaactagttgagggaaccagagagtctctggatatttaatgacaagcttaaataagctaatctctgatggaagtcagcattgcatgaatggttgaagggccaaaaacatgatatatccctttatatgtttaagtgtttttttgtgcttctcaatgccatgtgatgttttttatggtaaatactgagatttaacaaaatataaattaaaagtttattcttgatacaattaatagctcctgaaaagttaaaatgatctagaaatcagaattcttttaatctatactgaatgtaggggttgtggttactaaaaattagtcaaaccatatttgggaattaaagaaataatgattgctggccaggtgtggtggctcacgcctgtaatcccaacactttgggaggccaaggcaggtggatcacttgaagctaggagtttgagaccagcctggccaacctggtgaaatatatatatataaatttgctgggtgtggtggtgcatgcctgcaatcccagctacttgggaggctgaggcatgagaatcacttgaatgtgggagacagaggttaccgtgagcctagatcgcaccactgcactccagcctgggtgacagagcgagactctgtctcaaaaaaaaaaaaaaagattgctttttccctttcacttacccttttttttggaaagataaaacaaagtgactttcttattatctcatgtttcttgtaaacagtgatttcttggtagagaaataaaaattgtttcttaattgggagaaaagaaattaacagctattgctgtggttggttctatttttattatttattggctaaatgtacatagactgaaaggaaaattaaaagacaaactattcactaaatcctggaaaacagtatatgttataatctgcatttcataaaattaagggataattttaaacatatttcctcaaacagtaatataattaagttatgcttagtattcaactaagtgattagaattcagttgtagtggtacttatctttttaaaaaatataaaagttaccatgtttttacagagtggaaatacagtaattaataaaagtgttccattgtgtaggctattttcttccccccgagtgaagctaatcagttagtttcatgctccatatgcagtcgttggatcatttttaaatgatcaatgatcattcttaaatgtgtcaatgaaaagcgccaaactttgtcaaatatttgaagagatttattctgaaacaaataagggtagccatggcctgaggcacagtctcaagaggtcctaagaacatgtgcccaaggtggttaagttacagctttattttataggttttatggagacatacaccatcaattattacatgtgagatatacattagtttgttccggaaaggtgggacaactcaagatggggaggggaaggagggaacttccaggtcataagattttctgattggcaattgattgaaagagttattatctaaagacctagaatcaatagaatggaatgtctaggttaaaataaggggttgtgaagaccaaggttttatcatgcagatgaagcctccaggtagcaggcttcagagctcttatcagacctgaaaaggtgctactctcttagttaattttctctcctggatcaggaaaaagacctggaaaaggaatgggaattctctatagaatgcagattttccccacaagagacagctttgcagggccacttcaaaatatgtcaaagaaatacattttggggtaaaatacttcaatttctttcagggtctgctatccattatgtgatgctatactagaatcaggctggaatttggtgtcctattgctacaaaaagtctgttttgtcagtcttaagatctccgttttagtgttaatgctggtcagctgtacctgaattccaaagcaaggagggtataatgaggcatgtctgacccccacttctcatcatggcctgaactggtttttcaggttaattctggaatgcccttggccgaggggagggtccatcagctgattggggagtttagaattttatttttggtttataatactaattatagtaaatgaatataaaaatttaaataaaatatttaaagctggaatttctaatttgttttgaaaatttaattaaatactggtaaacatcttataaaaataaaactaattatgactctagaattaacacccaaatgtcagtataaaactgggacccccaaactcactatgctaaagagaataacttgcttcatacttattacacctagacatatacacgcatagattcatgagtaagtaatatgagctgggcatggttggctcatacctctgatcccagcactttgaggggccaaggagggagaatcatttgaagccaggagttcaagatcagttctggtgttacaggaaaagggtcctgatccagaacccaagagagggttcttggatcttgcacaagagagaattcagggcaagtccacagagtaaagtgaaagcaagttttacgaaagtaaaggaataaaagaatggctacttccataggcagagcaagagcctgagctgctagttggccatttttatggttaattcctgattatgtgctaaacaaggggtggattattcatgagttatccaggaaaggggggcaattcctgaaactgagggttcttcccccatttatttatttatttatttttatttttatttttgagacagagtctcactctgtcaaccaggctggagtgcagtggcaccatctcagctctctgcaacctctgcctcccaggttcaagcaattctcctgcctcagcctcccgagtagctgggactataggtgtgtgcaatcatgcccggctaatttttgtatttttagtagagacggggtttcaccatattggctaggctagtcttgaactcctgacttcgtgatctgcccacctcagcctcccaaagtgctgggattacaggtgtgagccactgtgcccggccagtccccttttggaccatatagggtaacttcctgatgttgccatggcttttgtaaactgtcatggtgctggtgggagggtctcttagcatgctaatgcatttaattagtgtataatgagcattgaggatgatcagaggtcactcttgttgccatcttggttttggtgggtttggccagcttctgtaccacaacctactttattggcaaggtctttatgacctatatcttgtgccgacctcctgtctgaacctgtgactaagaatgccttaacctcctgggaatgcagcccagtacctctcagccttattttacccagcccctattaaagatggagtcactctggcttaaatgcctctgacactggcaacgtagtgcgatgcagacttaaaaaaaaaggtattagccaggcatggtggctcattcctatagttccagctagtcaggaggctgaggtgggaaaagctcttcagcccaggaatttgaatttgcagtgagatatgattattgccgctacattccagcctggatgacagagcaagaccttgtctctaaaaaaaattaaaaaaaacattttttaagtgtaatatgaattgtttaatattacagactgtttctcagctaccatgaataacagtgctgaatagtatagcaatcagtgattatcactggatattccaagtgaaacctgaagagaagccaaaaaaaaaaaaaaagggacatttgacactctgagacattggtaaagtatctatttcattcatgctctcagagaggaaggatttgtcaaactatttgtattttctcttactaaagtgtttctacttttgtccaaattttctctgttgtccaaagcacagtcttggacagcagaggcacaactcacacacctacatagaatgccagggtagtcaccttttttctttttctttttttttttttttttgagacgctctgttgcccaggctggagtgcagtggtgtgatcttggctcactgcaacctctgccttccgggttcaagtgattctcgcgcctcagcctcctgagtagctgggattacaggcgtgtgcccccacacctggctaatttttgtatttttagtagaggcggggtttcaccatgttggccaggctggtctcaaactcctgacctcaagagatccaactgccttggcctctcaaagtactgggattacagatgtgagccactgtgcccagccagtcaccttttattttgagcaagagctgtggagaaacatttacttggagcctaaatgaagttagtgtcacaaaagggaatgtttaaggttatagattgcactgtggcagctctgagtgctggatggtgagtgacatacaccagtgtgttttttcataagttgatagccctctcttgatgatacatagggccctgtaatgtatggggcctaggcgcccagttctaagattggcattgagtcttagcattaagtatgcacatgttcagatcatgctcctattttccagtagagtaattattcccacagctgtttcttttactttttctttttcctttttattgagacaggatctcattctatcacccgggctggagtgtggtggtgtcatcaaggctcaccgcaccctcaacctcctgggctcaggtgactcttctgcctcagcctcctgagtaactgggaccaccactgcatgctatacctggctaatttctttttaaattatttgtagagacagggtttcattatgttgctcaggctggtatcaaactcctgggctcaagcaagcctctcacctcggactcccaacgtgctaagattacaggtttgagccactgtgtccagccacacggctgtttctatcattctgtattccagagatcaccagttctagtcttctgcaggggtagttgctcaatgtcatgagtaagagaggggaactacagatctacctccttttaagttttgtattaattttttttttaattttgaaataattttagatttataaaagagctgcaaagatggtacagagagttcctgtgtactcttcatcaagcttcacctgttgttaacatctttcataatcatggtgcatttattgaaactaagaaattaacatgagtatgatgctatgaactaaaccatagactttattaggatctcaccagtttttctgctgatgtctttttttctgtttcaggatatcacattgtatttggtcatcatgactccttagtctccaatctgtgccagtttttttggtcttgtctttcatggccttggggatttttgaagaataatggccaggtattttgtaggatgccccttaacttagatttgtctgatattgggatttatcatgattagattgggaatatgggtttgggggaagaatactgcagaggtgaactgccctttccattgcatcatatgaggggtgcatgatatccacgtgactatgagtgctgatgttaaccttgatcacttggttaaggtggtgtctgaaaggtttcctagttactctttttccatactttattctttagaagcaagacactaagtacagcccaaaatcaaggagtggagaatttattttaaaactgcattctaccaatccttatttgatactcccccaccccacttccaaaagtccacttggttcctgagcctttagaagattctgtggtatacatcagcttagtttttggcttttcctactgtatcctaagtcatttttctgttttccagtctccacaattttgttgctattgtctcttttttctctctgtgagtttgtgagtttttttttttaatccctttactgtagcttagtggggcttcggagagattaaaactgtatttttatgttcaatctgccttctttatttggaagctctgggagaaatatttttttttttgagacggagtctcattctgtcacccaggctggtgtgcagtggcgtgatctcagctcactgcaaactccacctcccaggttcaagcaattctcctgtctcagcctcccgagtagctgggactacaggcacatgccaccatacccgggtaatttttgtatttttagtagagacggggcttcaccatattggttaggctggtcccgaactcttgacctcaggtgatccaacccacctcagcctcccaaagtgctggcattacaggcatgagccaccgcgcccggccagagaaacattttatcatcatcaaaattgatatttaatctgtgtttagatttgtcatttctgcttgtcataattctgccattgatataatacatgaaattactgaatactttttgggcaccattgttatgttttgtaaagcattgtgatcaatcagaaattcagttcccagctagagaagaaactcttctagtattggctggtgtgactggccctgattttcaaaggtaaattagggttactgctataaagcagggattacaatggggtgcttctgtatactccaatgcccagttactaaggttaccaaaaaacaaagtgggtttgggcacctcaggagtcaaagtttgagtcagtccaccaggcaaagaaccttaactggcataagctagccaaaggcaacctaaacttgaatgggtagaggaggggagttacaatatccactatggtttcttgaccagttacataaaggaggactgtagctctctgtgtatctgctctctctcctttctttttcaccttttgttttcctacaattttatagagtgttttgatatcagaaatgtttaccatttagtgactgagttgcacttttttattttttatgcgtttttataatttttattactttttcaataaagataatgtatctgttactacatctgtgtaatacatctgtatggcttataaataccattctatactgtactcagaacagcagatactgttctgtactctgctttcctcgctgcatgatatatattagtgcataggaagagtcctttttttcagctctgtagatgtaccaatatttatttaaccaatgccctatagaaaatgtcttgggtttgtttctcatttttggctttacaaacaatactgcagtgaataacttcatatgaacctcattgtataggtttgtaggtatatttgcgtaaacattctcagaagtagtagagttgtagagtatcagtttagtattataatatatctagagtgggattatctatcatctgttttaatatggacaatcaggaaaatagcaatcatttctagtacttacaacagggaaaatttaatgcaggaaagtggttaccaggtgttggaggaactgagcacctaatggagaaaggggagcaattcagatattagtaacaacagaaaaccattgcctgtagcctggaaagacaaaagaagacaagaatcactgaattctggagctggaggtcatttactggaggctagggcctctacggacctgtgtgatgagaactggagctgctgaggagatgcagtcactgccagagaagtgactgagttagaagaggaagggggagaaatgtgctggtttattccttccctcctcatcctccaatctttgagaaaccagctgatatgagtctgggaatcgcagtcaatggatcaaccccttgcgatacaaaacagagcagggaagggcaaggaatgcatttgaggacaaatggattcagaatccatattgttcaccccttctgctactcagcattcaagttcacccttctacccatgtttaataccatcatacttctgtctgtcatacaaacaagaggagagacaccaagtcccatcaatcattgtatccatctcaagtttgggatctactggtgatcctcattccttcccatcaggtctggatgtgtctttttgtggcctggtgacctacgaactaaattgtaaattaagcaaccactgacactttccatgcaaaactgtgggggaaggggaaggggaaggggacaaaatagaaatcgttggttaatagatacataacaaatacacgtgaatgctacaattcttgttgctataaaaagtcgcaaggatgaagttgatttttatcatttcctttttctaccacttattccatatttcctttgcttttagctaggactgcaaatggtttgggttctttacttgcaggatgattgtatcagtcaggataaagccagaacaacagaaaccacacttggtatttcaacagagataatttaacataaggaattggctacggagttttggggaaccaaaaaagcaaaaaaaaaaaaaaaaaaaaccaaaaaaacaggtcggggcagatattgaacatagatatagtaactataggaagaagctaccactcctatggctgaggacacaaaaggaagtttgcaccaaaggaaacttaaaggagaggcatctcagacttctgaggaggggccactgcctaactcttgctggctcattgatgagacatgttgaggctggttctaggaatgccaaaaaaaagttgagtgttagaaatgatagccacttgtcaggaaggaagcatatcctgtctcactccttctgccttgaagaactaacaggaagccaactggcaaagtagaaatatagctctcatagtcccagccccgtggtcataaagaagagtataaatgtgtgagtttggactgagagaaaatggcataacaactgggacagctcattactttgcttactcaatattcatgcacaactttctctgtatatttgagcttctcatatagcaatttaaaaatggcagctttttctttaacaagatacagctaccctttgtagaaattgacactcttggccgggcacagagactcacgcctgtaatcccagaactttgggaggccgaggcaggtggatcgcttgagcccagaagttcaagaccagtctgggcaacatgatgaaaccccatctctactaaaaataaaaaaaatagctgagcatggtggcacatgcctgtaatcccagctactcaggaggctgtggcacgagaatagcttgaacctggggggtggaggttgcagtgagtggagattgtgccattgcactccagcctgggtgacagaacaagactcggtctcaaaaaagtaaataaacataaaaaaataaattgacactctcaccctttccccataaacggatgatcccaaattatattaatctctggattatgtgttaattactcctcaattcagtaaagtcccttatgaaccttctgtaacctaaagatgaaattgtaaagttaacaattgccattaatttttaaaattacagtgggaaaggagaagaaaaaaagttaatatatacagaaatacataaatacacacatatacattaagcaagtaagaaataatgcttagttattagtctttgtatctgtctagtcatgagcctgtggttagtgtcccttcctccccagctcatttcatgcttcctgtactctgagccagtatataccaagtggtgtgatccaaactgtcattcctgaagggtctgaattgtcagtggtcctgtcttttcttggttatcgtagtttaccattaacttttactgtcagcgatgggaatataggggtgccatgttgccatgaatgacagcatccccatatatagtccttcgtggcctcattttgtagcagcaacccaatgtttctttagttgtcaggatcaatcactccagccagtaattcccttctttgcccattggttcagttgcatgtggagtctaaaatggccatttagctgttagaaattcaatggaaactgtcttgggaataaagcagagttcaaattacgggaagcagaattctgtgaagaagtataacagtgagagaagccactttcccttttgctctttgattacggacttgtgtcttgtggctttgggagaaatagtgccatacattggtcaatggctcaaagcatatgttgttctttgaagacagtcccagccttacaaaatgtttctcagctcatgttgtaactgagtctgtagtaggccattccattgttatatcgggccagatatttctagatggtggggtgtgcagtaaggctagttatttccatgatttgcaaactctaattacacttctaagatgtgttccttagaagctgtgttgagtaggataccatgatattgagtaaggaattatgtggtagtgttggcagaaacacaatgggcagaagaggcaaatctatacacagaatagttgtctattctagcacaaacaaatggctttcatttccatgatggaaggggtgctttataatcaacctaccaacacagagttggctgatccccttgggaaatggtgccatattggagactcacagtttagattctgttcttgataatttgggaactcaacagtgccaacagtcagattagcttggtaaggggaagtccattttgttgggtctgtgcttcatttctgccactatggccattttgtacacaagcccattaaaacagaagatgaggaaaggtgctgactgataatcccagaacaagtcactttgttcacccctattattgaggcctcctctacaatggatgtaccttggtaagcactcacacaaattccttcacatttagtgcccattctgaaagatctgtgcatgtgtctcttcttcagtcttccttgttatcaatcttccaggcttgttcttttcaatttcctgaccaggtgaccaaagcattattcactgtccacagatgagtgtacatctgtaccacaggccacccctctttcctggctgaggggacttcaaggtatactgccaaaacttctgccctcttggagggttttccttcaccattccccttcagtggcatctctgagggagtatactggtactagtgtaatgtggacacacttctgtgaaccaggcccaagttggtttaaaaaattttttaaattttttatttaaaagattttaaattgacacataataattgtacgtatttatgaggtacatagttatgttgtgatacatacaatgtatagtgatcagatcagggtaattagcatatccatcacctcaaacatttatcatttctttgtgttgggaacattcaatattctttttctagctatttgaaactataagatattgttaattatagtcatcctatggtggcatagaacactataacttatttctcctatctatttgtttcctttaacaaagctctatctccctcttccccctactcttctcagcctttagtatcctttgttctactttttacttctatgagatcaactttttttagcttccacatgtgagtgagaacatgcagtgtttgacattctgttcctggcttattttgcttaacgtaatgtcctccatttccatccatgttgccccgaattacaggattttattctttattatggctgaatagtactccattgtgtgtgtgtgcatatatatatata

SEQ ID NO: 931 - DNA, 2894 bp, Homo Sapiens
ctgagatggttttttttgagacggagtctcgctcggtcgcacagcggcttgatctctgctcactgtaacctccgcctcctgggttcaagcaattctcctgcctcagcctcccaagtagctgggattaccagcacccaccaccacacctggctaatttttatattttcagtagagacggggtttcaccatgttggcaaggatggtctcgaactcctgacctcaaatggtccactcacctcagcctcccaatgtgctgggattacagacacgagccactgcacccagccaaggatatcactttttcttagatctaaggagatcaaataatttatgtttattttaagtttatttctggctacttcaatttttggttgctctgagttccttggacatacatccatatgtgtctgtctctcatactagagacttttctcaaatgtttgaggaccattaaccgtctattcatttgtaagaccaaggcattaaaaatctgagtgtcagccaggcacactgcctcacgcctgtaatgccagcactttgggaggctgaggttggagggattgcttgaacccaggagtctgagaccagcctgggcaacatggcaaaaccctgactctaccgaaacaaacaaacaaaccaccaccaaaaaaaattagctggatgtagtggcacacacctgtagtcctagctactagggaggctgaggtgggaggatcacttgagcccagaggtcaaggctgcagtgagctgtgtttgtgctactgcactccagcctaaaagaatgagatactatctcaaaaacaaaacaaaataaaacaaaaaaaatctgaatgccaattccagtgctggataaaatggaatatgcccactacaagctgctcttcctgacaggttacaattaaaaattggacaacacaaaaagcaattgaggattctgaaaaggaaaaatagctggttgatagaggagagtaaaaactggaagatcaagtagtacactggagtttcttgggttcttttcccctcttctttgcagaattgcccaaggggtaaggtgtgtgaggggtcagacagcaaaacaacaacaacaacaacaacaaaacaaaacccataaaacttctttctggccagaggatgaggacaagagatccatgtgggctggagagcatgatgacagcgtactttcacattcattattttttccctcttggccttgcctaaaggttggccagcagtccaggcacctcaaagcctgtctctttccctggaagaaatgagagaaggggtctctgtggctgtaagcatgtaaaaggaatcctgttgtttcttctcttttctttcactgcctcactcttcgggtgaagccagtcacatggaactgtgtgacagagaaggaggttaaaactgtctgagagaaacccatctttctagcaagagaaacagcgaaaggggtgcctgggagccagagatggggaagaaaatcccagcaaggaaaggaccagagaagggaatcccttaattctgtgtaggaactaacacaagccccagactcacccaagtggcacatgcatggaatagaccccaaaggcacagcaaagtctctcagaaataaactatgatataaaccatcattcaaattgcagacaaatcactgagaggcgcacatgagggcaaactcaaacaggatagcaaacgcttttaaaataaaactggcattgaacccatcacccacagaaggagaggcagagcttgtgaaactggattgcctgttaaaacaaagcaaaatcattattctccagatgttaacaggacccagactcttaaacatactcttcaaaatacactgacgatgcactccaagattatatgacatacaaagaactagaagaatgttaccagttctcaagagaaacaaacgatgatgaacagatgtcaaccctgagatgacacagatgctggaattaccagaatcagatttaaaacagttattacatctatgttccataagtgaaagtaaagagaaatgactgggaagatggaagttctcagcagagaaaaagtaaccattaaaaaaaaaaatggaaactatagaactaaaaaatataagatctgaaattaaaaatccactagatgaggtcaatagcagaatggagataccaaagggaagattcagtgagctgaaagattaacagaaattatccaatttgaacaacagagaggaaaaacatgttaaaaaaaaaagaatagagacttaaagaacaatcttaaatatcaatctgaaatataggacagtatcaaaaggtctaacatttatttcactggacttctggaaggagaaagaaagagattgatgcacaaaaaggtatgaaaaaatagtagctaataacttcccaaatttagccaaatataaaaatttatagattcaaaaactcagttaacatgagagttgattaaactcgaagaatgccacacccagacacatcataaccaaactactaaaaaccaaagacagaaaagcccttgaaagcatccagagaaaaatgacacattatataagtagacaagaattcaaatgcctaccaattttgcatcagaaaccatgaagggggccaggtgcagtggctcatgcctgtaatcccagcactttgggaggctgaggcggatggatcacgaggtcaggagatcgaagatcatcctggccaacatggtgaaaacccgtctctactaaaaatacaaaaattagatgagcgtggttatagaggctgggggagtgggaggaatgaagagatggtggtcaaaggatacaaaaatctcagacaggaggaataagttttattttgagatctattgcacagcatagtgaacatagtaaataatagtgtgttctgcatttcaaa

SEQ ID NO: 932 - DNA, 1856 bp, Homo Sapiens
gtttgttgcctcctcttaactgtgagactctaggggacagtgatggagttgctcatccatgtgcccccctctgcctaggagagagtgcccaacatagaacagaccttcaaagaatatcagcttaatgcgtaattcatctattccagttttcatctgggtagattgagatgtccaagattacaaagtttggctatctcctgagggaactcttacacatttcagtagcagagccacccagaggtgtctaactttaagtgcttctctccccattatggtttacagcagcaactttcaaattttttaatctaagaattcttttacacctaaacaccagtcatctccaggacttgacttcatcatttgcctgttcaccattgtatccctagaatctgtaacaacaaccagaaggtactcaataaatatttaatcaatgaacaaatgactaactcatttctactgtaagggtatatgtacttgagagaagttaagtatatgtacttgagagaagaggaatttttattatgtgaaataaggcatatgttaattatcttgattaagccattacacaatgtatacatatttcaaaacatgttgtatatgataaatatatacaattttatgtcaacttaaaaaagaataaagaaataataataacatcaaaaggagcttttatgtatttatttgtatatattcctggggtacaagtgcaattttgctacgtggatatattgcattgtggtgacgtcggggccttcagtgcatcactggaacaacacacactgtacccaccaagtaaccccccatcctccaccctgcctcccaccccctcagcccccaccctctgagtctccactgtccatcattccacatgctacatccatgtgtacacatttttttagctcccacttattagtgaaaacgtgtggtatttgtctttctgtgtctgagttgtttcacttaagctaatggcctccaggttcattcaggttgctgcaaaagacatgatttcattcttttttttaaggctgaataatattccattgtgtatatataccatattttctttatctaatcctctgttgatggacacttaggttgatttcatatctttattattgtgaatagtgctgcaataaatataccagtagagaatgtgtgctttgaagagattgaaaaaggtttgaaataagcacagtagagaatggaatacagagttgactaataaaacatagtggggattgacaggaaatactaggaatccaggtgaagttggtgacaatgaatttacagtaatgtaagtctactcagtagcatgattttccccagcaccactaagcagcctgggtgcaggtgaagacaagatgagcagttgcgcacatctaggtttgagaatttgtcagatagatgtgaataaaagacaacaaagcaagggagtgtagaatactgaccaaaaaatgactcatggaaaaatagaatctaaactgtgctccagcttagagagggaagagagaacatgtgtgcagggatagaactgggaaacagcaggaagatcagtggactagaacagataggagataatagtcaggaatggctcaattcatgatttcttaggtgtagttattttggatatcacagttcatctcagacttccaagagagtttacattcttagtatcccccaaagacctccttcacttagaaggtgaatataatagcaaaaactaaaatttactgagaatttcatatgttcttagcactatgccaagcattttacatgcattgtccccatttaaccctaccagtatcaatagttacttcaaacgttacagcagttgggcccatctatgcaggttgact

SEQ ID NO: 933 - DNA, 6440 bp, Homo Sapiens
atttttagattatgatggatcccatagtgctcactgcctaccaggcattcaagtagaacatgtgtatgtggctcattcattcatcaagaacctgtgcactgctttaaatgctgaagagtcagcagtgagcaaatcaggcaggaattccggtcttcatggagcttacattcgtcaggaggtcggggcaaggttggtaggggagacagaaataaataaatagttatacggggcatcagatgatggttatggctgtggagacaagtgaaacggaaggcgcatgggaagtgggaggaggaggtggtaacgattttaaatggagtagtcaggatggactcaccgagaggatcacatttgagaggggtcaaaccgtggaggattcccagtgggggaacagctggagcaaaggtcctgaggcaagagagtgcctggcacgttcccaaaacagcacggaggccaatagggctggagcagtgaacgaggagcttccccaggaacacagacatgccactgagctcaacccattgtatgcgcccatcccaaaacttcagtttggaacaggaagcaggaacctgcagcatccatattttggcgaagggctgatggacagcagtgttggaacttctggagtctactttccactgtccaccatacaagctgagggatctgtccctactggctgtggtttggccattgtctgggctatgtatcctgcaatcctgactcgagcattcctgaagtttctgtaatctgtctgataccacactagccagtgaagattctgtgatctactgctaagagggctgtgtgatgttgaaaatcatttcaggagtataccagcaacaggtgctcaagggtgagcttgagaagtcgagagaatttctaatggcctgcttgcttcttcactgacttctgggttaaaggtggcctatgatgcaagaagttgagatgctggaaatgctcttacattacataaaaggatccaaaaacaggcagcccagaatgttggagtggatttattaggtatgtcatccatccccacctgtgtttgctgagagggcttagaggacacttttgcccatcactgaggaacttgttggtgagaaatgctggcaactttggcctgtcaagggtgtgggtgggagcctttgcctatgaagtggccttcctgctttcagggaggataatgggatcttagggttgacaatggccaaggaatggctcataagcaccaaaggcaaaatgggcatggttactgtaataagcagcagggctggagtgggtggtaatcagatggtttgacctacagagatccttgggagtgactaatggattgtgggtttcctaagaattgaaattggtcattctactaaagttttactgatatgtattctgaatctggatttgccttctctgcctgccacatttctgctaatccctctatccatagacttcacgccttactcattttcatggaaccaaattcaagcctgcttctgatcgaagatctcattttgtagcaggagaagtgaggcaagccttccagttaatggtggcagataaaatacacattttaattttgcttccttttgaaagctcactacaattaaagtagatggtaaagagaaaaaaatatatagcataaactctcaggaacatagtatacaacatactctacagggacataacaataccaccacggattctggaaagcaggtgatgtgtgatgagcagcgtagcagtcctgactctaagtcagcagtgggaagcccagatgcaactcttctatacctcagaatccacagagaaggtccagaattggcaacaccaggtacctttaaacatacaggagaatcaaccaccacctggtagaagccaggtgtttcatttccaaagaaggtaaaccagagggctcttgactaagacactcagcagaggtgaaggcagtggtgcagtgtgaacactgggtaattaaaagaaactccatgttctaaatggaaaaccctattcccactcagctcccagaaagctggcaggtcagctatgacctccaaatagagaattgaaattgagggatctgacagcccaagaggaaacaaaaagatatcagtaagcctggtcaaatcatcctacagtgaagccctctaattaacaaggcccttcacacatgctgagtttccaatgagctctttggcgattgatatggtttggccatgtccccacccaaatttcatcttgaattgtggctcccacgattcccacgtgtcgtgggagggaattgaatcatgggggcgggtctttcccttgctgttctcataatgaataagtctcacaagagctgatggttttataaagaggagttgccctgcacaagttctctctctgcctgctgccatccatgtaagacaggacttggctcctccttgccttctgccatgattgtgagccctccccaaccatgtggaactgtgagtcaattaaacctctttcctttctaaattacccagtctcaggtatgtttttgtcagcagtgtgaaaacggactaatacagtgatctacttttttaaatgtttgaaaagacgacttctggcctggacaaaatggtgtaaacttgtttccccctgctccttcctgtcaagtacaactatgaactgtgaaaacaatgcaagaggcaatcagaagataacactgaaagctggcaagggaattatgcattagtttgggaccctaagaataaaggaacaactcagtggcaggatatcttatgtgcccccactcagtggaagaagatgacccaggcctggtgtttccagacacccagcctatcaacagaaggcagccaaaacaggctcagccctcttacaatttgaagaggagtccctctgacaactccacatgagcccagcaccaccagaggggagattactcaggtgccccactaacaattagcaaccaggggaagcactctcctttcacactgggcccgaaactcacctcccctgccaagagagctgggcagcctgacctgggaacaccccttctgccctctcaggcagcaccagcaggaaccagcaggagctccagcagcaccaaagaaaccaagcatatgaaaagaacaccacaaagcatctgaaaattaaattgtcattggaacctcagcccactggaacctcagtcctcagaccgagatatgcatgataaatgtaaacaaggtgactgatgttgcaaccaatgaactaagtaggacccagagtctcctaacatgatggccaaaatatctaagacacaactgaaactcacctgtcataccaagaatgaggaatatcacaacctgaatgtgaaaagaatcaactggcaccaacactgagattaaccagttgttaggattatctggcaaggattttaaagtggccatcataataatgcttcaacaattgattcaaattttattggaatgaataaaaaaatttaaaatctcaccaaaaaagaagttatatagaagaaccaaatggaaattatagaactgaaaaatacaaccacagaaataaaagcctactagatggcctcaataggggagagatgacagaagataaaatcagtgcttgattgaggacagatcaatagaatttacccagtctaaacaacaaagacataatattgtgggaagaaatgatatatatatatgtgtgtgtgtgtatgtgtgtgtgtgtgtgtgtatacatatatatatacacatagagagagagagtcagtctcaggggcccataggacaataacaaaaaaatcagtgtttgtatcactgcatatcattgcagtctcagaaggagaggagaaagaatgaggctgagagaataactaaagtaataatgcctgaagacttccaaaatttggttaagacacaaaccagcacatccaagaagctgagaaaaccccaaacagaataaacccaaataaatccatgccaagacacatcataattaaacttttgaaaactaaagacaaagaaaaaaatatcaaaagcagacagagagaaacaatacatcacctgtagttaaacaccaattcaaatgacagtggatttatcatccaaaactatggaggccatttgggaggcctacgcgagcagatcacttgagatcaggagttcaagaccagcctggccgacatggtgaaaacccatctctactaaaaatacaaaaattagctgggtgtggtggcacacgctggtagtcccagctactcgggagaccaaggcaggagaattgtttaactcaggaagcagaggttgcagtgagctaagatcatgccactgcactccagcctggactctaacactcgctggacacagtgagactccatctctaaaaaaaagcaaaactatggaggccagaaggaagtggtacaacatatttcaagtgctgggggagctatcagctgtgaattttatatccaatgaaagtatctttcaggaatgaaggggaagtaatcccagaaaatccccataaaatgcttacaggaactaatcaatgagttcagcaaagttggaggatataagattaacacacaaacattaattgcatttctatttactaacaatgaacatgaagaaaatgaaatttaaaacttaataccatgtacagtcactcaaaagaaaatgaaatatttaggcaaaacacatagaggatatgtatgccaaaaactacaaaatgctgattaaagaaataatggaagagctaaacaaatggagagacagagtgtgttcatgtgttgggagacaacatagtaaagatgtcaattctcctcaaactgaattataagtttcattcaatgcctatcaaaattccagcaaagtttttaatagatttagacaagcatattctaaaatttatatggaaagttaaagaccctcgaatagttagaataatcttgacaaagaagaataaagtgggaggaatcactctacctgatatagctacagtaggcaagatcatatggtattggcaaagggataaacatatagatcaatagacccgaacagaggacccagaaatagatccaaataggctcaaccgatttttgacaaagatgcaaaagcaattcaaaacttttcaacaaatagtgctggagcaattagacatccatagcggaaataataacctcaacctaaatctcacaacttacacaaaaattaacttgaaatggatcgtggacttaagatgtaaaacatctaaaatgactttgagccaggtgtggtggctcgtgcctatagtcccagctcctcgggagggtgagacaggaggaggattgcttgagcccaggagttctgggctgtagtgcacagtgctgattgggtgtccacagtaagttcagcatcaatatggtgaccccctggaagtgggagaccaccaagttgcctaaggagaagtgaactaacacaggttgcagatggagcaggccaaaactcccatgctgatcagtagtgggattgcacctgtaaataaccactatactccagcctgggcaacacagcaagactattgtctcaaaaaaaaaaacttgaaaaagaagaaagttaatggtctcccacgtcctgatttcaaaacttactacaaagcgacaataatcaaaacagtgtggcactggcataaaggcagataatagatggtgatagttaattttaggtgtcagtttgactggactaagggatgtccagatacctgatataacattatttccagtgtgtctatgagggtgtctctggaatagatgagcatttcaatcagttgtgcattgttgatgggaatgtaaaacagtataggtgctgtggaaaacagtatggcagttccttaaaaaattaaaaatcggccaggcacagtggctcatgcctgtaatcccagcactttgggaggccaaggcagctggatcacgaggtcaggagatcgaaaccatcctggctaacatggtgaaatcccatctctactaaaaacacaaaaaactagccaggcatggtggcgggcacctgtaattccagctacgggagactgaggcaggagaatggcatgaacccgggaggcggagcctgcagtgagccgagatcacgccactgcactccagcctgggcgacagagcgagactctgtctcaaaaaaaaaaaaaaattaaaaatcaaattaccatgtgatctagcaattccacatttgagtatatacccaaaagaactgaaagcagggccttgaagagatatttatatacccatgttcatagcagcattatttgcaatgcccaaaaggtggaagcaacccaagtgtccactgatgaattaattaataagctaaatgtggtatatatattattcagccttaaagaggacggaaattctgacacacgctacaacatggatgaagtgtgaagacattatgctaaatgaaataaaccagtcaaaa

SEQ ID NO: 934 - DNA, 9683 bp, Homo Sapiens
actttgtaaggaaccgctggcagtcggaggtctcactcccgcctccgcgtctccctggccggcccctcctcccacccgccggaaggctcggggtggggggcgctctcggcccacgccgggcagggtggtcccccgcctccccaaaaggtgtgcctggccggggcgcggcggcaagtcgctgcaggcgccgtcaccgccctaggggagggaggacgcgccctcctggcggtggagccggtcccgccaccgagcatgcccagaggctgccgggcgcggcgcagtccgcagtcccggttttcgcggcggcaggctggagcaggaggcaggctgggatggggttggaggggccaagataggcccaaaagaagggggcactgggcgttaggggcgcaggtccagccagttagcaagggcggcgcgctgggaagagtggtgtattttcacgccgacacccgtattttcttggcttgcctcaagccgtctctgcgtgactcgttaccccgccgaagccacccggcatcccaaagcacgagcctggcgcctcctattccacgcggaagtgcccgagtgaccctgtgaaggacctccctcccctcacacacgcacatacacaagcccatgtgggagcccgagtgacgtgtgctcggtggtcatgcaccatcatttcccttccaccttcctcctcgccgcttcctctccctccaccgcgcagctccagccgccttgccgccgccgcatccccttccaagttcaggctgtgggtggaacctgttgctttagctcacgtttcccttcccctccgggctgcacgctgaggatgacctcagcgaggtgtgtgtaaggggaatggagggtaagtgcgagaaaggactcctgcctggcaaggagacaggggaagcgggtaggggcgaatgttctaaagggttgggcgagccaccagagactctttccgccacctccaatcaaggggaccttaaaggaggggaagaggtagatatcaggtgagggtgcccttggcacatccgctgcctttgcttccttagatatttcaggtacctgagtcaaacctatgctggcgttttcaaaaacgtacgggctgcctgagtctggcagctaatctcctttggaagaaggttctattaaatgaaaaataccaacacttggaaaaacatagatgcatcacagagcgcctactaaggatttcctgtgaaccaaccattctgacctgtaagaactgggaaactaggaaatgcccttttctctgtggtgattgtgaaaaatattacttaattttataacaaatcggagagaaccaatttctctgaacttccagatttgggcctgttgctaattgttcccagtgaattctagcctggaccaaatgaattccctggcgtggcacagtccagatggaagaagaggggaatgcatgggattcctaagtagggagtggctgccaccctgaggattcttctaagccctagtgggatgtggtgctgagatcctttttgaagtgatttctgtgaggcacgactctcctgtgctaggtagacctgagccagggaaggtaatctaacctttcaactcctctggaagcagcaatcttaggaataactggaaaaggggccttccggtctggccagctgttttgtaaaacggtactgatgattatttaaattgtcttttatggtaacatctgtaaacagcctgtcttgtgctccaaatacggtttgattttgagattgctgtggagccctgcctgccactccagcggggtggaggtggccctgtgagtaggaagatgtaagtaggaaacatttggtgtgctgggaattagatagctgtttttcagttcaccatatgacatggcatggcttagatcacaaaaagctccctgctctgtggcaggacacaggtagacagataagtactgatcacctggggtgatgagagagagttgtggtttcattccaagttttgaatattaggacctcctcagccacccacccagactccctctgagctctgggctcatccccctgttgcccagatggtccatgttcagggaatgcaaaataaggcctaagaaaaatgtttggcaaagtaagtctagtgccaaaaatgcatggcatttcaaagccaaatataaacatctttgaattacctgtacttttaaattattttccgaccagataatttctggatcagatgggaaagtaccaggtttcccttcttttctcttcatgcaaggtgcctggctagcccagtttcctttctgtttccagccttccatctcctgccaggaaccctcccactttggaacaggaagccctgccaactcctaggcccagcaacagcctgcagatatgtccagcaggatagggagatgatttgcaaagtgattgaaagattctgtcttcctgtttacagggacattttttcaagttaggagcttggagctttcagacttagatttgtctcttgaaacctttgtaaattagacatcagaagtgtgggataagcacctttgtgctctggctccagcacctttccccatcaatcaacaagtcctgtcaattctacgtaagtacaagatccctctcaaatacacactgcccccaccccagtctaggccgctgtgtcctgaaattactaaagtttcccaactgattcctgcccattctcttcatgcagccagagtggccttactaaaatgcaaatctgaacaagtttctcccttgcttcattaactactcccctacccacccaggtctactcactgctcttaaaggaactgtttctcctcctccaccccacttcttttggtaaatttttactcatccttcaagtctcagcttaaatgttacttcctcagggaaggcttgcctgattctctgtacctgcccttactgggtcgggtgacattcgcacgtgcccgtgacactcactgcatttatcttatgcactgtattgaggttgctgtttaattgctaatcttctcactagactcataagaaatacttttatatcaagacataggccaaacattcatataaaaatatatgcaagggaaagaaagtttcataaaactcttattttgtaaaatcatattcgaattcatgtaaaactaaatctggtcacaccttactgcattgacttcccaacccttagatgggtcagggcttctagtgtgaaaaaaatactctaaattccatgaagtgggggacaatttccctcattcacggtaattggaatggaataggagcttaacaggtatttgttgctggaattattaacgataatatctaattcatataatcctcgatcctatgaagaaactactattatccccacttacagatgaggaggctgaagacagtgaggttaagtaacttgccaagtgtcaaaaagctggtaaggtagatggcagagccaggatttgaacctgagtagtttgcattcagaattcttgtcctagtcactcagcttagtatcctttggtcaaggtgcatgtgaatgaatttaccaagcaaaaatgtcagaaagggtctccttgcagctacttcaaactagatctcagtctgccctgcagaggctccttgggcagtatttatgtctgtgcagtgaagaaggcatctggcaagaacagctgttcccctttgctcacatgtactcaacctcctaaaccaccaagtctagcaatatttagcaagtagggagatttaattgtataaaggaagagtatagatacttccaaaaatgcaatttcacattgttatgaactatgtgctgtatatcccccccacccccctgcaaaacaaatcctttaaaaagaaagccaccatgagactggggtatttattttgtcatcagtaggaaactgtctagattaatacttaaagataggggtaagaagatcatgttcctcaggggtcagtgctatttataggattttaatctgtaaaggcaacatttgagaaaggacatgattgaaatatttgaatcaaagagtatgaatagacaggaaaatatttatttgcagaatttccaaactaattcttatattattagccccgatgctgaaccttaagtcgtggcatttagagtaataaagaaatggctggcaaagggtttgtatttcatctttattacatgaattacatgcaggtcacatgcaatacacagatgctctcctatttaatcacctgaatataactacatggagatatttaacagccctgtggggtaaagggtcctggatacagaacatctggggtttgtttctggccctatctctaaccaactttatgaccacagattcctcatgaaggagcccagacacttgatcacagtgtttggcaaatagtaacaattaattaaatgaataaataatgagtgaactaaaaagctacttccagcttgaagactatggatttcattctagaaacaatgagaaatatagtataaaaatgtctccgaatcttttcatcaccttccttgttgggtgatacaaagttggttcctccactaattaaaaatccagatctatctctattagacaggttggccttcttggatgcatggtagctctcttttatttctgtagagccaatgggttaatcttaacttactagtctatacgtgtagatactttggagatggattctatgtacacctaaaattattttcttctcactttcacttacagagctatattttaatgaaaatatgtcctttaaaaaattaacatattaaatgtttttattttctagcaaaccacgagattatatttgttttctacattttcctcaattaaaaaaatgaaatggcaaaatataggcaaaatggcacttaaaagatatatccaacaacctattttccaaacttgaaaccaggacacctggcttgacaaacactacagtgcttacagaaagtaggtgaatgtatgtttgaaatgaagattatcctgaatgatctgtagattggcaaatgaagcaaccctagctgcagcagagggatggtgtctttatcagagaaaagtcacacagagggtgtcagtcaggacctcagcatgtggttgcacagattgtgccctgtatagtgccaggattgtgaactatacaacaggtctcctccaggagggaccatttggcaccattcacatagatggcaatgtgaatggtgccctctggagttgtgcagtgtacaatctgcacaacagtacacagaatctctgcaagaattccattggtaggaaatgtgctctcttgacaggattggaagaggcagcctgctgttctttttaaaataaagtcattcctcagattagatggcaatgacaaaaattcaaccaaaatcttgtttttttctttttccagaaggtttctgccactatattctactttccttaagttgctagcaattctcaaaaatgcaagtctgggccacgtgtggtggctcacgcctgtaatcccagcactttgggaggctgaggcgggcggatcacaaggtcaggagttcgagaccagcctggccaacatagtgaaacaccgcctctactaaaaatacaaaaattagccaggcatggtggcgggcacctataatcccagctacttgggaggctgaggcaggagaattgcttgaacccagcaggtggagtttgcagtgagccaagattgcgccactgcattccagcctgggtgacagagcaagactctgtcttggaaaaaaaaaaatgtaagtctgtaagtaactctgaacttactttttgagcttcattgaagagaataaattgaacaaaagggcatttagaaaaaggtggggaagtttgtagacaactgcaagggtcagggaagcattataagtcataggcatggaagctcatgtatacatgactctaatataagatgaaatgtctccaaaaccgcatgccttctactttaaagtgtttagcttatcaaagaggaacattttcacaagatactctaggaatttaaaactgttttggtcatgtcttgacataattctggaaaccttataacgtcagaaaatagcattgtcagtgccacacagcaggaggcatggaggtagcttggtgggacagaggagaactcttcaggatacttggctctgcctctgactagctctgtgtttatgggcaagaccatccctgcagctagctctctgggccactggcttcctcacgaaagcagagttgtatgaaattgtctgagccttagaaactgccagaatttcatgggctgtaacttaggtgcctccaggggccaggcgggtgaggtaaatgagtgaaggggtcaccaccggtgacagggagttccaggtctgagtcattaaagtcactaaaccacacagcacaaaggcatctgatatggtttagctctgtgtccccacccaagtctcatcttgtagctcccataagtcccatgtgttgtgggagggacctgatgggagatgattgaatcatgggggcagctcttttctgtgctattctggtgatagtgaataggtctcatgagatctgatggttttaaaaatgggagtttctctgcacaaggtctctttttgcctgctggcatccacacaatatgtgacttgcttctcctcaccttccaccatgattgtgaggcctccccagccatatggaactataggtccaataaacctctttcttttgtaaattgcccagtcttgggtatgtctttatcagcagcatgaaaacagactaatacagtaaatttgtaccagtagagtggggtgctactgaaaagataccagaaaatgtggaagggactttggaactagggaacaggcagaggttagaacagtttggagggctcagaagaagacaggaaaatgtggaaaagtttggaacttcctagagacttgttgaatggctttgccaaaaatgctgatagtgatatggacattaagtcaggctgactgaagtggtctcagatggagatgaggaacttgttgggaactggagcaaaggtgactcttgttgttttagcaaaaagactggtggcattttgcccctgccctagagatctgtggaactttgaacttgagagagatgatctagggtatctggcagaagaaatgttaagcaaccaagcattccaaaggtgacttaggtgctgttaaaagcattacgttttaaaagggaaacagaccataaaagtttggaaaatttgtagcctgacaatgcagtagaaaaggaaaaacccattttctgaggagaaattcaagctggctgcagaaatttgcataagtaacaaggagctgaatgttaatccccaagacaatggggaaaatgtctctagggcatgtcataggtcttcatagcagcccctcccgtcatagacctgcaagcctagggggtaaaagtggttttgtgggccgtgggccaggcccagggtccctgtgctttgtgcagcctagagacttggtgccctatgtcccagccgctccagccatgtctgaaaagggccaacatagagctcaggctgtgtcttcagagggtgcaagccccaagccttggcagcttccacgtggtgttgagcctgtgagtgcatagatgtcaagaactggggtttgggaacctccacctagattttgaaagatgtatggaaatgcctggatgcccaggcagaagtttgctgcaagggtggggccctcatggagaatctctgctatggcagtgtggaagggaaatgtggggtcagagcccccaaacagagcccctactgaggtactgtctagtagagctgtgagaagaggaccaccatcttccagaccccagaatggtagatccaccaacagcttgcactgtgcacctggaaaagccacagacactcaacaacagcccgtgaaagcagccgggagggaggctgcatcctgcaaagccacagaagcagagctgcccaggaccatgggaacccacctcttgcatcagtgtgacctggataggagacatagagtcaaaggaaataattttggagctttaagatttgacttccctgctggatttcagacttgaatggggcctgtagaccctttgttttggccaatgtgtcccatttggaatggctgtatttacccaatgcctgtacccccattgtatttaggaaataactaacttgcttttgattttacaggctcataggtggaagggacttgccttatctcagatgagacttggactgtggacttatgagttaatgctgaaatgagttgagactttgggggactgttgggaaggcatgattcgttttcaaatgtgaagatacaagatttgggaggggccaggggcagaatgatattgtttggttctgtgtccccacccaagtctcatcttgtagcttccataattcccatgtgttgtgggaggtacccagtgggaggtgattgaatcatgggggcaggtctttcccatgctgttctcatgatagtgaatgggtctcacaagatctgatggtttcaaaaacaggagtttctctgcacaagctctctttttgcctgctgccatccatataagatgtgacttgctcctccttccctgctgccatgattgcgaggtatccccagccatgtggaactgtaagtccaataaacctctttctttctttctttttttttgagagggagtcttgctctgttgcccaggctggagtccagtggcgtgatgttggctcactgcaagctccgcctcccaggttcttgccattctcctgcctcagcctcccgagtagctgggactacaggtgcctgccgccacgcctggctaattttttgtatttttagtagagacggggtttcactgtgttagccaggatggtctcgatctcctgaccttgtgatccacccactcaggcctcccaaagtgctgggattacaggcgtgagccaccgcacccggccagcctctttcttttgtaaattgcgcatctccggtatgtctttgtcagcagtgtgaaaacggactaatacagcatccaaattaaaaatcggaatgaaaagcaggtttcatcctcaattcatccctagatcaccacttggaccccagctcttagctccagatttccagagttccaagtctacatgaacatgaaagagtcagggagactgtacatcttggcttgggcaggatggtcctgctttatacttgttgtcctggcataattattaatggcaccctccttcactctcaaaagtgtcctagtttacatgagaagtcttagagccatccaaagtcagggggaatcagtgactaaacacaaacttttaggagcaagttcatttattcaagtttgtgcaagccttcagatgaagctaagtagatttggcattgttttgtaagtataaagatatttaaataaacttccaaaatatcccaacagaacggttcaataaaagcagtatgtcatgaattttaaaatcatagacaatataggaaaggctatcaatatgtgaaaaattttgaaattcactaataatcaagaaaaatttcaataacaatgaggtaacattttgcctaccagagtatttaaaaattatttaaaactctaataccaggtgtcaggataggtgtgatcaaaggaactctcatataccgctgataggtttataaattgactgatacaaactttctggaatgatatttga

SEQ ID NO: 935 - DNA, 22832 bp, Homo Sapiens
agcagcgcgagaccctcgccaggctctgaagacgcggcctggccctggccgttcggcccttcgtctgagcgcaaaggctccagcacctccgcggccgaagccgcgggacttttcgtggaaaatgggacccagcccgatcgccagcggcgctgcagcggactctgcgggaacctagcttctgctccaggacctccagggccaccccagctcgcagggcgttcgcagcggctcagggcgaatcacgctcatggtccccgtgcgcattttcagccccagccggtacctccttactcgccctcacgacattcattccaccccctaaaggtcctgccaaccccaggctcttcccgagcattcccgcccttcctcccttttgaaaccggagcaaatcacggccgggcggaagcgggggagcccgggtgagagtcagtgactcagctgcggactccaagtgtcgccggaggccctggggcgcaggcccagcgggctgtcgcacagctcggctgtcctgtgccccttcctgacgaggctggggaggaaaggcggcccagagaaggccggaccagctctccccgtcagccccaggctctcgaatgacagcggatgccagcgaccggggatggggtcccggaattgctgggttaaacaagctccggattcaggcctgggcctgggctggggttccagggttctggaccgccctcaaagaaggagctccctggggcggcacctggctctgcttgatagccccagggacagggagctcactacctatcagggcagctcccccagtgccgagaccagctcggtcctggagaccctaacccagcggtgctagaggaattaaagatacacacagaaatatagaggtgtggagtgggaaatcaggcgtctcacagccttcagagctgagagcctccaacagagatttacccacgtgtttattcacagcaagccagtgataagcacagtttctacagattatagattaaaagtaccccttagggaaacaaagggatgggccaaaataaaggggtgggtttggctagttatctgcagcaggggcatgtccttaagtcacagatggctcatgctattgtttgtggtttaagaacgcctttaagcggttttctgccctgggtgggccaggtgttccttgcccttattccggtaaacccacaacctcccagcgtgggcatcatggccatcatgaacatgttacagtgctgcagagattttgtttatggccagattttgggggcctattcccaacaccctagcattgctcacacttgtccctgaagtgtcaccttgtcgtagctgggctctgagccctctgccccagggaggggtggccttttgggctgaagggactgaggacatagccgttgagcctgttggccattgctcaaagaatgcagcctcctggtcacccatgttgtccccttgccaacaaaaagagtgaaacactgtgcaatgtttgaagagatttattctgagccaaatctaagtgactgtggcctgtcacacggcctcagaagatcctgagaacttgtacccagagtggtcagcctgcaactgggttttacaaattttagggagacataagacatcaatgaatacttgcaggatggacattggtttggtccagaaaggtggggacaactggaagtgacagagggacttctaggtcataggcagattcaaagattttctgattggcaattgattgaaagagttaagttgaccgggcatggtgggccatttctataatccttgccatggggaggctgaggaccatttgagcccaggagttagataccagcttgggcaacatagagagacctcacttctccaaaaaaaaaaaaaaaaaaaaagttattttttaaagacttagcattaatagaaaggaatgtctggttaagataaggggtcgtggagaccagtgtttcatgatcagatgaagcctccaggtagcaggcttcagagagaatagattgtaaatgtttctcatcagacttaaagagtctgttctctcagtctttaaggggtgtgttgatgttactgctggtcagctgggcctgaaatccaaagggaggagggtacagtgaggcatatccaacacccatttcctgtcgtggtctgaactagtgtttcaggttaaccctggactgcccttggtcaagagcaggggtgcattcagatggtgggggtgcttagaatttcatttttggtttacaccactgtgtcctctcctgccaggggagggacccagagctggaggcttagccctggagataccggtgaagatggatgaatgagaaaccagttggagcttccaaggtctctacccaccctccagacctcctctgctcctgcccctgcccattcattcccaacttctgctctcccagctcccctcccacccacatgctgttccctcctcttccatcttccgcttcctgggcccagagactgggcaagatccccagggctctccttgcacagcgaacctctcccagggtgcatagccttgctgcaatcttacacagggaatacataagcaaggaatacttctgtccctcttggactctgaagccagaaggccagggcctggttggcctcctaactgctgtgtcccagggccagagcagtgccagacacccagcagtcttagcacccacgaaagctggagggacccacaccttccccatcactcagttgcatcagtctaacgcaatggatttgggcagcttgtggtggttcactggcagtttattgggggacttgaaggagtcaaggtcaagtgggggacttctgggtgccagacctggcccttccttggcctgggcttggggtgtccaagcccacagagccatgcagggggaaagagctaggcaagcagggtggttgaggaggtcattagcgtggcctcgagggaaaacaattccaagaggagcccaaattcgaatgtcccctggtgtcattgagaatggagagatttaggttatgaattgtgcagttggtgggtagcaagccagggtcctgaagatagtctgcatatcccctggtgtcattgagaatggagaggttcaggttatgaattgtgcagttgggggtatcaagccagggtcctgaagatagtctgcatatcccctggtatatatcatttatataaggatgttacttaactattgctgtcttccagaggcagcttcttgaacaaatacttgaggtcctctataggtttacgggagtagactgttttctccaagcaggcctgtcgtccatcaggagaagcaaaaggttttattctagagacaagtccttccaactgtacagctgatggagtagccaaggaaacctggtctttccagagacacatagaaggtgccatctatgaggaacaggccttcaccagacatcaaatctgttggcatcttgatctttgacttctccaccgccagaactagatcaagacatgaaacccatgttcaagatactttccagtgtgtcttcatgtgatcctctgagtccagccatcaggctaccagcagctcttggaaaccctgacatacttattcttagaagactgctttccggactcaaagtggaacctcaaattttcaattttctttgtttttaaagcctacacataggtgatgatatatacatgcatatatattttggagaatttataattctgaaaacaatgctggtcttatggaacccatccattcccctttccccgtgtgtgctccgagctgtggtggcacgtgaaaaggggtccttccagcagtggcccacagccctgggctgcttacttgctcacttcatttacaagagcaagaaatacacattcttgtgttgtttaagtcattatgatgtggggatttccattactcacacacctgatctagtagtaacacagtagcctattttagcaatatcatttattcaataatccattctttccccattagttttgagccttcatttattgtgtactaagttctggttatttttagtggttgtaatctccttctttcctactctcttaatcatgggattgccaatatctgctctgtgtttctgtgccatctatagcctctggccttggtactgcttcaaaactgatatttctaaccttactttgacttctccattcagtgaagttcccatagttcatcactcaactgctctctttccatcgtgaccttctgaactagctcacacccagatgtacttttgttatctgcctttccccctcataaacatgggctgctgctggggaaaatccactaccgaactcttgcaggtctctgcaaatgtttaatgccctgtcttagccatgacctccacaatgctgggctatcctatgttatgtcccctaagatatcccttctctcttacctttggggatagtcctaagcttccatcatggcactcaaagtccaaccttatttgtaccctcattctctgagcagacaccaccgtattctgtttcacagagaaaatgtgactgctggggataattctttcaacttcctggcctcttcctatacatgatctttctctgtattcttgcctattgctcttccatgttgatagaagtgtctgttctccttgtcagtgtctcggccttggatctgtcccctagactattctgcctgtgtaaggaccttccctgaccagctgggccaccatctcctgcttctccaatccctcactctagactgactcttaacctttggtcaacaatacttgagcttttacattcataatggagcatctgtgttgaaccttgttcttttctagacactaccctccgttctgtcttccatccatggtgacttttctagaaagagcatctatcacactggagacagcaaactccttgatccattctaattcctaaccctgcaataattttctatctcccttactcaagtaattgggagtgctcctagtgttaccagagacccagcagttcccaatttcgaatttttccgtattcacatttcttgacttgctatgattttacatcacagattacatccttcatttgaagagactctaatggaaggctgccatggaaactctctcatgtggctgacctcctacctcacttgctctttctgaatgaagttcccacttttgcctgccttaatgaaagtaatgctccccaaactcaagcccagggctgcgaattggaagcagctggggctactgtttctgggtgctggtgtgaatggcaggatgtgaacaccagcctgtgacgggcaaaaagatggacacacaggcagagcctgacaggtgctggtggtcctatctggtcctgagttgctgggaccctccttgcccactgcccctagaatggactttggcctcaggttcgaagtgttcagatgtgactgagatgagccttttccccatgcctcaggaatagcgaagaaactctatctggaaggttccccaggcttccccacccagcagcctctggtattagaccaggcagtggctggccaggatggtggggacagaagggagacaaaggtgagcagtgggtggggtcacatcctccctgacattgaatagacaacatggggaggaaggatgagtgatctttagaatgttcatggaaaatgcatattgggaaaaagaatgcatgaatttcaaattgttttgcaacaaaataaacttgtactaacttgtgaaaacacgtccgaacaggatctagtttgaggccctaagaagtataagacaacagtttgaacagagctcctatcagacacatgaattctgctaaaattgaaaccagaacaaacatgcaattgatggtgaagcttggctggaaacatggtgaaatcattgatgatttattgaaagtttatagggacaatgcctcaaagaaatcagcaatttaagtaagtggataactcattggaagaagagaagagatgatgttggagaggaagtccacagcagcaggccagccacatcagtctgtgaggaaacaattcatcttgtttgtgccctaatttaagaggactgattaatagcagcagaaacaatagccaacgctgtaggtatcccaaggtgttcagcttacacaattctgactgaaattaaagttgagtaaactgtccactcggtgggtgccaaaactttctcccagctcagctgcagataagagaaaagcgttctatggccattttaaacaagtggaatcaagatcctgaagcatttcttcatataattatagccggagatgaaatgtggcttaaccagtacactcctgaaggcaaagcacaagcaaagcaatgactacctagaggtgggcgtggtcccatcagagtaaaagcagacatgtcaagggcaaaggtcgtggcaaccgttttgtgaatgctcaaggcatcttgcttattgactttctggagggccaaagaacagtaacatcttattatgagagtgtatagagaaagtcagccaacgatttagcaggaaaacacccaggaaatcgtcaccccggaaagcttcaccagagagcccttctccaccatgacaatgctcctgctcattcctctcatcaaacaaggccagttttgtgagagtttcaatgggaaatcactaggcatacaccttccaggcctgatttggttacttctgttttataattttaaaaaatctttaaagggcacccacttttcttcagttaataacgtcacaaagactgaagtggcatggttaaattcccagggtgcccaattctttagggatgaactgaatggctggtaccattacttgcagaagcgtctcgaccttgatggagctcatgctgagaaataaaacattttttaatttttatcttttaattcaattttttcgtgaacttttgaagtccccttgtatttgtttttggtggaactttgagtctgatttctcagctccccatggatggctgcatcttaacagagaaatgaacgccatttaccctgatgctctctacttggcctaagtttcagatgttgaacacacacgtgtgggaatttatgaatctgtgcacctgtgccagctggtgggtgaagtctaagtttcttcaacacaattagttatcttctgcctcctggaatctggtaggaaaggttgaggaaaagcagccatccacagcgcctccaccactggaatgggggcagccctaacgtgtgccccactgccccccatgctgaggagtccttcactccagggatgtcttcaccccaatcattcagactcccccagtgttcctgcgtcacctgaaaggtcggaagcatctcagcacatactctccatgagtggtacttaggcctccctccccatcaatactgaagccctcagaggcagaggggagtcaaggaaaagagtggccatcagcaataaatgagttacaaggtttgatttcaaagagaaaaacttgtcaccaaaatcactactcaggagatctggacttcctctgaatgtgagttaaagaacccttgagggttaagagccaactgcacctgatccccactctcccatcccaagaccctgggaagtcaaaccaagaggtaatcaacagaaaacaagtttaatgcaacaggtgacaacggtctggagcgagtccatgctccggaaggctcagtctgtggcagtcccgtggctcaagacaggctgaggccggctgcaatggaggccagcagcaggaggatggccagccacagcccaccacagctctcacccatgctcccagcatattctttgaacactgatgagttgataggtggcccctctaaattgcagtagcgaattttacaacacttgaggtaaaagaagggcatgggctcttccaggagaaaccgcttctcctctggcttgggtctctccatcgctgcacaaccagcggagcactgcttcgcaaccatgaaaaaacgtggaaatatttctaataggaaataaagaccgagagaaggcaatcacgcaattccaatgcctgacaccgaggcccttctgtctgggtcaaagcctcacccctggcggccctgctcaaaggtgcacagtcaactggggcaccaagggggagtcgggaggacgagggccaggcctgtgtgttgaatgctgcttcagggaagggctggcttctgcgtggtatggcctgtccatatgcactgggaatgcgggtctaggggttgctgtttgggaacaaacaggtctcaacttctcaaacacagggttggctcaggcctttgtgaccacagacagacacatgactcccagccattctggccatcacccagggtgtggagctggcctcttggtgggcctggctcgactctgagctgggggtcttgtctcatgaccacacttcatcttatacatcactgtacaaatcattttgccatattaagttataaagtcgatgtgggccacactgagtctgaagcatcacctcagcaccccaccaacttcgtggataccgaagggctggagagtgactgctgggcggaatcagaattcacgagccctgaagatctccctgtgggcagaatgtgctgggtgtccagattccccttggggagggcttcatgtacccagaggttttcaggggaatcacagatgacagagcagtggtctccacaatttttaaggcatgcaccctcctttgagaacacacttgaaggctgtacaccttggttttgtgcatctcttgtaagagtgacatagacactgttctctgtggcgcatttaacactattaaagcttaatttttcatttaaaaatggatgatatgaaatccagattttcttcctacctcccagtatttcatctggacccactgtagcaggcactgccttacactagcacagttcctacacctctctctggcctctgaggactttgctcttcacattttaaagggaaaaaaaggcagggcgcggtggcttacgcttgtaatcccagcactttggggggccgagggcgggtgggtcacctgaggtcaggagttcgagaccagcctgaccaacatggtgaaaccccacctctactaaaaataaaaaattagccagtgtggtggcgcgcatccataataccagctactctggaggctgaggcaggagaatcgcttgaacccggaaggcgaggttgcagtgagccgagatcacaccactgcactccagcctgactccgtctcagaaaataaaaaaaaaaaaaggctactttctattagttattccccattgaggaaaactagacagccctgattcctgaaagccctctgttcacctgcctttgggtccccaacaagagcgaagatactcactcacggccgctataacgcagtatggctctgtccatttgcacctccttgggttctggcactcgaaagtgttttctctctcacaaacatgacaccacactctattgtcaccctcgtctgaaaggaggaataaaaaagaaagcagaatgttccagttctccgtgcctatctgatgaacacagccggcatccgaccagcacaaactcggcgggtccccatccttctccccctgagcagtggctggggccacatgactcgagtgagccgcatggggagaaagcaggaggggtctccggccacgtaagagctgcccgcttccccttcgccttcccccatgattgtaagtgccctgaggcctccccagaagccagcaccacgcttcctggacagcctgtggaactgtgagccaattccacctctcttctttataaattgcccagcccccggacttctttacattctgagtgatttttcttctctcctgggggctcccccgtcctcccacatccaagcacacaacatgagcgcacagcgcacccccactcggccgcagcaccctgaccccaggtcggccacgcggcacccacgggccctggcatctcccggccgacggctgtggaagtgaccctggggcttgggtctgctcccacgtgccctcccgcccacctcccaggtccacccacctcccaggtcctgccccccgactccctcaaaggagttctcccttgggtctgggttgggcctggcctagctctgcaggaggagccggccctcctcccgcagcttgaacggttctcagcccgtgaagcccccggaggccaggccggcgggagcctgcagcctgagggctcccggggaagcgcggccggagcggggcaagggctggggaagggccgggctcaggctgccccgccgccctggtggaagccgcacgaggcgaggctccccagaggcttccaggcgccacgggccgcctgaacgctccgttctcacggcctggtcggggcggtggccacgcggtgccaggcagacgccgcccggccctgtcctctcggcccgtggctgtggagggcgagccaggctcacccgttcgctgggagtcctctggatctcgttgtctcgcagtcaggttggcgtctgtccacacccgcggtagggccacgaccagcagcaaggcgagcagcgccatcgtccccagcggtgcccagggagggtcagcgcgcggcgccccctccccgcccttctggaaccttcgcagcctccgcgcgcctctccccgggtctggccggtagggggagccccgcccgccccggggcgcgcgcctcccacccgccggggcctgtcggggtctttggagcctcatctcagggcctcgcggccgctggcggccctgaacgccggttctgagtcccgccttgtgctgctgttggagcggccggcggccaggcaggaacgggcgcgggagccctgggaaaggcgcgtgtggaaacgcagcccctgagcccaagggccgtctccttgaggaccccacggcccacagaaagtggccggcggccaggtaggggatcttctccgctgaagagcacgggctcacctctgataactcgcccctgaatagcttttagctcattataataccaaaaaaaaaaaaaaaaacaaaaaccacatccctggggagagattccagatgctaatgacacactccagcgcactagtgtgtgaggtcacggtgcctgcgtgccctgaggacttcccaaaacgtgcttactagtaaggcccctgcctgggccgttcgtgagtaatcctgtaaaactctcatcaagagggtctccccagcgtgagtagcgactgactcattcttttgagcagttcctctttcaagctgtactgttttccttaactaaaagctcaaataagaattcctcctggcgcctgtagtcccagctactcgggaggctgaggcaggagaatggcgtgaacccgggaggtggagcttgcagtgagccgagatcgcgccactgcactccagcctgggccacagagcgagactctgtctcaaaaaaataaaaaaaaaaagagaaagaaaagaattcctcctaagtcactagcttttggctctatctcctgagtggcaggttctgtcttgtctctctgagatcctgactctttaaataaaggttacttaaccctatacctcttgctaggcatctcttgtctgaattccttcctccaagaagactaagaactggaggatttccatgcctctcacagtgacagtgctacccaaacatcagggttgtcatctaggccccctgccctgcacagaaagccaatcaccaacagcagtgccagggaagaaggcctcattcaagtgctacagcccagagatgggcgctcagtcacaaatccctctcctcagcccactaaaattagaagtttccagagcagggaagaaatgtcaccctgtgtgggaaaacaggaattagggagagtgaggaggcagctaggcagtcatgactggtgaggggtctggcctcaaggacctactgagtttcagcgccttgatactgtctgggaggcccgatggttggtttcctgagaaaggagctcagataagacaaatgtaactttcccaagttttaagacagggtgggccaatttctatgtttattcaaaagaaaccctaaatactagttttacgagaaattgggcccatgtgagtaggccccaaagggcaatccacaggtggtgttctccaccctgctttctcctctcaaccctctgtatagaggccctctgttaacacaggcaggagcaggaatttcacactcttttcctttctttgctttcttctttgtcttttttttttttttacagttgtgatatagtttggatctgtgtccccacccaaatctcatgttgaattgtaatccccagtgttgggggtggggcctggtgggaggtgattggatcataggggtggtccttcatgaatggtttagcactatccctttggtgctgttcttgtgatggagttctcacgagatctgttttttttaaaagtgtgtaggcaactccctttcttcctcctgctcaggccacgtaagaggtgcccgcttcccctttgccttccatcatgattgtaagtttcctgaggcctccccagaagccagcaccatgcttcctgcacagcctgtggaactgtgagacaattaaacctcttctctttataaattgcccagcctcaggtatttctttatagcaatgggagaaaggactaatacaagttgcatcatattccatggcctggatgtaccatagttaatttaaatagcctccttgaatgaacatttgtgttgttcacagtgtttttatatctcacatgtcaaagtcaaatacattataggatgaatctctaaacgttttattcaggaatcacagaattgtaattctgggcgtacacagaccagaaatgtgtttggtgtgtctgacgaacaaagagaaggttgaaagttttatttaagaaatgttacctattgtttagaaagaaaacttgtgggccctggtagaggtttggggagctggcaggctctgatgggtgagtgacacagtaggtagaccttgtctttgagtcacggcaggtcgttccagcagctgttaggtgcacctgattgtaaagttgcagcaggcgtttcagcacttgggcttgcagatggttcttggagcaggtgctgtctgcctgagtggttttcctctggccctctgccttgacttagtcgggtatgaccagaataactcaatttatgaagtcaactttcatatacatgacgctgcaattgtccctaatgtcattccttacatataccattataccacagctttccagaaatgagatcaagggacaaaagttaaatatatttgcagtttatatgagtattgcccagttgctctatctggtctttggacaattttgtcattgaggagtgagtgcttgttttcatggtggtgtcagaaagaatgtcctcttatttactctttggattttcaccaatgtgacagatgaaaatgaaaatagtatccgggtgtatttttaatttgcatttttaaattataagtgagcttgagcacttgatatggtttgatatgtttgatatggctagtggatatttgcattttcctgtgatctctctatttatgtctctcgtccattttcccgtttaacagacattgcttaacagaagacaatatttgagttgctgaccaatcccgaaatagttgtgaggtatgatatcagcaggacttgttttccgagccttgatcatgaccctgtgatcaaaacaggatataacaaagaaactggcccaaaccagctaggaccaagatggtgacataagtgacttctagttgccctcattgctcattatatgctaattataatacattctcataagacaccacatcagcaccatgacaatttacaaatgccatggcaatgacccagaagttatatggttcatatatgatgccaaaaaggctcattacaatggatcttgggagtaatttttcaaggaatatgaacaaagtcttccctctgtggttaattcatgaatgctgtgttggaatattctggatggtccagactttcctctgtaatcgacgttgagccctgcacaacttcaggagggcgccagacctcactactctcaaggaaaaggctgaagtggaggaattgattcccactgatttttttttttaatttttttgagacagagtcttgttctttcaccaaagctggagtgcagtggcatgatctcggctcactgcaacctctgcctcccaggtccaagtggttctcctgcctcagcttcccgagtagctgggattacaggcatgagccaccatgcctggctaattttagtatttttagtagagacagggtttaccatgttgaccagtctggtctcgaactcctgacctcaaatgatccgtctgcctcagcctcccaaagtatagggattacaggcgtgagccactccacctgaccttgattttatttttaaccatcctgtctgagagattatttgtggaggctgacagcagatgtgcagggttcaacagtgcagtatgctgcatttcttcagctatacctcatattgtaaagactgtccaggtaactcaacaagcgggaggtaagggttgcaggtgggatactgtagtacaccccattggtctaaaggcacatttccttcttttccacccactgttgcagtccagccaggcataactttaggagaatgtggttaggtaaacatgtgccatttggcacagggatatttgaatttcctggcatgaggagtggcgggacttggactagctaaccatgagagtgagttagtagagatgtggatgccgtcatgctgatggcctgctcagagtagcactgggctgtattcgcccaaacacccaacagagcctggccaaatgcaaggcccagtccggtctggggacttctctggaatgcctgtgccagtataaccgggaatgtccctcaaacagagagaagcaaattattatctcttactgagccctttgctaaacaagaagcagagccatgtggacctatgagagatctggagacacaacattccccattgaggaatacaccgcccttgctattctgaattcaaatgggtccctgaaccaataaaagcatgaatgtattttcaagaggtggtgcatgcagcttcatgcaggcctcctgagccagtcgtccagatgtggttaggaatgtctgctatcaggacacttgctgcctgggaacccttggcagaggccagcactgccacccagcagggacctctggtgtgttgcagctgctcctcaaatgcctctggaagacaatagcaacttacgacttccttaccaggaaacagcatcagatagccttcaaaccagaaatgcctctcatgtcttgatgtcagagaaccattctaccaagaggaggagcagcccagcaaagtccatcaaacggtgagagtatattccagagcagggggcaggaggacgttaggggagcctgtggcttctgcagcagaggcaatagcagaaggagaggagagggaggagcagaaggagagcagagggagagcagagggaggagccttcaagggctgctgtgtgttcggagcccagctaaagccaagcaggcctctgagctccctgctaggagttcatgtctgcagggcatgtggctgcttggaaattagccatgtagacctcacagtctgtctttgccagagaaaggcagggcaaaccatattatacacctttataacattgtttcaaatccagaagtgtgatgcctccaccgttgtttttctttttcaaaattgccttggctattttttttttttttttttgtggttccatgccgattttggattttttttcttttctctcttttttgatggggagggatggagtctcactttgttgcccaggctgcagtgcagtggcacaatcttggcttactgcaacctctgcttcccgggttcaagggattctaccacctcagcctcctgagtagcttgagactacaggcgtgtgctaccatgcccggctaacttttgtgtatttagtagagttgggattttgccatgttggccaggctggtcttgaactcttcacctcaggtgatccacccacctcggcatcccaaattgttgggattacaggcgtaagcaaacgtgtccagccagatctttcttctatttctgtgagaaataccactgaaattttgatagggatcccattgaatttgtacattgcttttgatgggattactagagaaacaggagtgtaggagagccagagtgacgccattttaaagccaattccattttaaaacaagcaaggcaattccttgccagtcacagcccatggtcacaggtgttgacagctaaggagggagtttagtaatgcctgcaaggactaactcctacagcaacaaaatgtccaaatgcgccaatatctaataacaatatgtgcttttaaaataattagaatcatgctttgatgtacttactcactaaaatcccaaggatagtttactttaaatcaacaaagtaataagttttgtcacgctgtcaacccacccacacatagacttaacttagcttttacatagataagacccctacatgagaggagtttaaaacaaagacaatgcgttcctcctcttgttttctgaggatgccctactctgcatctgagtagctttcaataaatgatctcttctcactgcactctgtgactcacctgaattccttcctgtgcaagactgaaaaaccctcttccagcaacatctttctggcgatgcactaagggaccataagatgagactatgtgctggggaagttttgtctgcagcaccagttggccacctctggtaaatggggtccttcttggcatcctatgtcatgcttagacaaggatgctcgcctagaaactcaggttagaggctcagcccacaaggttagatgccctggggtatatctggaacaatggaagtctctttgcaagatgtttgtcagtacatgatctgaactaatccaccttgtgccctctgctggggatgggaaagctctacttctcatcatttcccagctcattgctttgctgtactgcagccttggggcagccccaaatggctggtccagaggtttccaccttccagtggcggattctaatgttctttatgtgtttctctctgttcttttctgcctgctttggatctgctgttactaatctgctgccgagtggcaactctgcttatctcacggtgttgaggtgagactcactgtttttggtattactaattcaaggctacctggagattgtcttttcttgtacagttcagccagttctggctaaaatgtatacattaaaaactcatttaaaactgaagaaaaaaatgatgaaaaggttttttttttttttaaaccaaacttccttaaagactactttaccaaaactttggtccacagctttccttggattgcgtgttggatgtctgggtcatttccaattaagaaaagtttatgctatgggaaacatgtttctagaattgtggaagggtcttatctataaagtgctaacatctggcaaacagtgcaggatctcttgcttcctcagttttcccactcacggatgagcgagtgcgcttagctgtcccttcccttcccttcccgctctggtttcctgtatgcaatgtgctcagccttccaagccttgggacacacagggatgctcatgctcctttatgttcccctagggactaggggttagtggacctcacccagaggtgtgggatcctttgggttctgtctgctggggagcctggagccggggatcctccaggtcagccaccatcctgttacatggggctcttcagcctttcgggtcccagggctgcagtgccaccccagtggaaagcccatttgagactcagagggatatttgccagcatgtcctgctgggtctccctcgtccccttcattggctgcatatttgctgtctgtgcctcactagtgatgcccgtcatcctgagcttgcatgctctgaagtttatgcctgccattttccttctcctggtgattttctttctttgggttatttaattcagcatgtctctgggcagcattggaggccaaaagcctcccaggaactagtcttattgagaagaaaaataattttgtctaattcagaagttatctaaaggtcaattcaaatgatgaacttgaaaatagttacttatgaagcaaggtagaaaggagccagtaagtaggggagcgagagatgtgaataaaagttatggatatgaagatgtatttttggtaaggaaggttataaagaatagcaaataatgtatgaaaaaggatctcgtgtggtaaatttttgtcctaaagtaaaatgactaatgattattagtcattagccattaatatgactattattattagttattagtcattaatgactaaatgattatttaggaaagagagaaggttagggcaaggcagaaagtccaagcacatctaagatggtctgtgtacactgggataaagttcgtgaaggggaatttatgaaaggaattttgtatatgattaagttggttataattgaaaggaagccatttataacagtctttctaaaaattggtcgcctacgttaaaacaaagttttcttgaggtactgatttgctgtgaatgaagttacaagaaattttactttcaattttataccccgtttctcttctaaacttctcagatccatatttccgacattccattttttctgtctcactgctttcagctttttcccccttgagcaggcctgagatgatgaccttctccttcagcattttttgtcagctcctgcaccccttttttcctccagttttaactgttggaatgacctgatgctaaagttttatcttgaaggtctagaaaagcaatgttttcttctagtataacttgattttatattcttggcttttcttgctgtgtctaaattttcagtgtaatcagaaaacttctcatgctgttcctaagggtcacatatgctcataaccttaaacactgttcctgtgtctgattgcattcaagcacttctttcctcaagtttgtcttccaggttatctaaatgggcttcctgtaagaagaagcggtctcactgcagaaggttttccctgcctttttattagctggcttaaaaaaaaacaagattttatgtttttttcacgataattcctatactgtctttattagctttatgattgcaaaaaaactgaaagttaaaagggttaaggtttttacctccatgtgactttctctattgcttgttaaagtctttatgattattactcttggttaagtgtataactattacaatgacctgtgattttatgttaataaaatgttttgagccttttaacatcttagagaaatatcctcaaaatcaaaatcttaaatttagtctctgatttagtcttattgctggggcttattaagcctatagaaattaatctctgcaaggtcatagactctttctagaactttctggcagaccatgaagtccagtatcaccacctccagcctgaaaattatatattggaagaaaaatcagttaaaggattccctcagcccccttgaagctgtccttatcaagagttattaaccaatgcttgtgcttagttaataacctgttgtagggctttgactcctggacacacatatctaaagatggcactgacttctaccagtatctgacaaaaactcaagttaactgaaggctcgtctttagacctgggcaaaggggacaacgtaaactgctttcatgagacacaaggacaggtctgtattccaaaacattatgattcatttcataattttgcctttatctgaaataatataatttgttctatgtctatgtggaaggaaaatatcttgggcccccagaatcactaaggtagagggaaaattcaagctgggaactgctcagggcaaacctgcctcatagtcatccctctgcttgtattcatagtcatccctctgctcactgagataaatgcatatctgattacctgctttggaaaggctaatcagaaactcaaaagaatgcactgtttgtctctcacctgcctgtgacccggaaaccccctccctgctttgagttgtcccacctttccagacggaaccagcatgactccctaaaatgcagaaaaccaaactgtgctctgaccaccttgggcatatgtcatcaggacctcctaagtctgtgtcatgggcgtgtgtcctcaaccttgacaaattaaactttctaaattaactgggacctgtctcaaattttctgggttcatatttggtaaccatggggggattctgagtggaggtgcccctgagctttgacaaatcttgtattgatgcttggtacatcatgaactaatttattgctcaaatcaataggacaatttgctgaggtctgcgagctgcccctccagagaatccctgctctcccaaaatttggtcaagatctcaagtttattttggtgtacaactcctttattttggagttttactttcttccaacaaggaagggaagttttcctgcttccgtgataatggaaggcaggtaactcctttatggagtttgagctcacttccaacagcgaagatgagatttttcctgcttctaggatggtggagagcagtcttcagcctgagacccatccctgggtaagtaactgaattggggtttgtcttggctaaagttaaagttaacaaccagctggtcttaatttctttttaccattagagtgttcagtgatcatgtaagttgtgccattgtttgttttgcttaagggttttttttttttttttggtgtttgtttgtttctgtttttcctactgtttctcttgttgtttcagtcttttgcccattgggtttaatcaactctatccaacttgatcaactctgaagggaagttccaaattatggggaacaaggcctctgaagtgactaaattccaccccccgcctcccctccacacacacacacaaaaggtggtatggttgggggagaaaaacagccagcaaaaggagaaaaaaaggaaagatttttgattttgactactaaaggggttttatttacagaacaaggccacttttttgctagcaggccaaactgaaacaatggcagttgccccacgctgtagttccatacctaaggctctgctttcttttcaccatgagagcctgggtttggtgggtttggttcctaaatcaagccctttctggtttgatacttggtacctctgaaatagcagcaattttttctgactaaaatacggtaatgaaatttaaatggattattttaaaaagagctcaatggttaaaagtcagtttaattaaaaggctaacatccaagatgtacgtgtgtgtgtgtgtgtgtgtgtgcgtgcacgcatatgtgtatgtttgtctttgaaaggtcttcatgtgtttgttttttggttgtttttctcctctaggaccttgccttttttttttagcaaaagtttttttcttctcagttgactgaattctgttattacctgattgtttgactaaaatagatactgcacagaggctactctggggtttttaaggaagagtgtagtttagacacttaaaaatgtctttgtttaaaactattttttaagtgcactgtaaaagcatcacgttgtctagcctcataataattcaccctttttggagacccaggattcagtgtgggctctacccagagctcagatatctggttaaaaaaagaaaaacaggtagtctctatctaaataaaatcagtcttcctatgtaatccaacaataaatttctgtaattttattactgagttggcatccatctttaatctttctctagcaccaccagacattttctctgtgtacctgataatgtaaattttgctatttgactttcacctgatatgcagatttaaggctatttagctgacaactgtctagggttctgaaacaggttatcaagaatctgaaagtctaagatatgaaaaaagaggtttttatgaatctataagatgtacttttatcagcatgcctaatatgtctgtatttatgtgttgtgtacacaatgtttcactatgaaaaatatataaaagagctctaattaattggctcaaagtgaaataattcaaaaagcagctatattcattaaatcaatatcaatgatttatacttaatacgtaaatactttatcaggaaaaaaggaaagattagtcaaatgctttttcaagtttgcataacttaagtaaaattattaataaatgagctcgctttaaaattattggtaaagtaatattagaaatgtcagcatacatttttgtttgcaattattaatcaagcaatttcatacttacccctgccaaatagtataagttgtcaaaatttggcagagggtttacaaaactataaacccggcccaaaacataatgatatttgcttgtgtaatctttaataaataagtcattgatattgatttaatgaatatagttgcattttgaatttagtaagattatcataacttctaattctgtggctttaggcagtctagtgcacaggcagtaaggaagtttgttttgagaaaggactgttatagtgtttgtttcaaagctaaactataaactaagttcctcccaaagtccaggaatgaacaaggacagcctggaggttagaagcaagttggagttagttagtcaaatcttttttccctatctcagttataattttgcagtgatggtttcataactttaaatcatgactatcacagttttcataaacaatctaggtaaacaaggtaattaggtaaatgtaatgtgatacatacttgtagacaaatttgtcataatttagaatagaaagttatattaa

SEQ ID NO: 936 - DNA, 1872 bp, Homo Sapiens
gtagccttttcagattggcttctttcacttagtgatacgcgtttaaggttctttcatgtcacttaatggcttgatagtacatttctttttagcaatgaataatattccattatctgttcacctactgaaggacatcttggttgcttccaagttttggcaattataaataaagctgctaaaacatccatgtgcatgtttgtgtgtgtgtgtgtacacaagttttcaactcatttgaataaaaggagtgcaactgctggataatatggtaagaatatgtctaattttgtaagaaaccaccaaattactttccaaagtggctgtaccattttgcattcccacttgcaatgaatgagagttctattactacacattctcaccaggtttggtgttgtcagcgttttggggttttgccattataataggtgtggggtggtatctcattattttaatttgcaatttcctaatgacatatgaggttgaacatctttttatatgcttattgccatttgtatattttcttttgaggtgcctcttcaggatatttttgccatgttggtcaggctggtctcgaactcctgacctcaaatgatttgcctgccttggcttcccaaagtgctggattatgggcataagccaccatgctttgtatattttccataacagtactttttcagaaatgtcttttgcaaatatttttctcccagtctgtggattgtcttctcattttcttgacattgtattttacagagcaggtttttaattttaatgaagtccaacttatcaattatttcttttgtggatcaggcctttggtgttatatctaaaaagtatttgccatacccaaggtcatctagatttgttcctatgttatcttctatgagttttacagttttgtattttacatttaggtctatgatccatttcaagttaatttttgtggagggtttaaggtttgtgtctagattctttttttctttttctttctttcttttttttttttgcatgtgatgcccagttgtcccagcaccatttgttgcacagactatctttgctctatttgtattgcctttgcccctttgttaatgatcaggtggctatatttatgtgagtctgtttctgggctctttattctagtccatagatggatttgtccgctcttttgccagtaccacagtgtcttgattactgtagctatatagtaagtcctgaagttgaatggtgttagtcctctgagtttgttctcctttaatattgtgatggctactctgggtatctttggtggtggtgatgtttgttttaaatgtctccatataaacttcagaatcagtttgtcaatataagaaataacttgctggaatattgattgggattgcattgaatctatagaccaagttaggaagaaccgatatcttaacaatattgagtcttcctaaccatgaacgtggaacattatttatttagtacttctttgttttctttcatcagagtttcatagtttttaaaaaatatataaatcttgtacatattttgttagatttgtacttaagtatttcattctggagggagctgatgtaaatgataccgtattgtgtgtgtgtgtttgttttgagacaggatctcaatctgtcactgaggctggagcgcagtggtgtgatcatagctcactgaatcctcagcctcctgggctcaagcaattctcccatctcagcctcccccgtagctggaactacaggcatatgccccatacccagctaattttttttggtagagatggggtctcatcatgttgcccaggctggtctcaaactcctgggctcaagcaatcctcctgccttggcctcccaaagtgctgggattacaggtgtgatccac

SEQ ID NO: 937 - DNA, 9133 bp, Homo Sapiens
gaccacatcctgcagctcacagccagaggcaggtgcagaaggggcactgtcctctattggcctcagcctctgtggaccagatccctctcaactgatcgggtgcaggctgggctgcaggcgggtagttagtgagtgcctgagatgtgcaggcatgctccaggcactgggaacacagccttgaaccaacagacaaaaccgtctgcatgcatggagcttgcatcctgacaggagggacaagcaagaaacgaagaaataaatcgacagcattccattagttagcacctagataaaagagatatacctatagtgttcaaagcttgagctatgagaaataaaagagcaaaagatcgttttcatcaaaaggactatgaagcatgttatgttttacttaacaaaaccagtgctaaccatgttacatcctccagacttgaagtgtgtgggtgtgtttaacagacacaattttacctttttttcccttttaagttatccgtcaacatttttcagtctctctttaaagagcatcttaaatttgcataatagtcattcatcttaataaaaacattacactgttgttggacattgttgtttcctttcaggtttaactctttaaaaacttctctaactcagccgcagggtgcactgcctcatgcctgtagtcccggcacttcaggaggccaaggtgggtggatcacgaggtcaagagactgagaccattctggctaacatggtgaaaccctgtctctactaaaagtacaaaaaattagccgggcgtggtggtgcacacctgtattcccagctacttgggaggctgaggcaggagaatcgcttgaacccaggaggtggaggttgcagtgagccgagatcacaccactgcactccagcctgggcaacagagcaagatcccatctcaaaaaaacaaaaaacgaaaacaaaacaaaaaaacttctataactcagtgcagaatcgtttaaatttagtactgttgcattagaagagagtggcagaagcaaaactacagggtcgaagggtataaacattttaaataaacaggatatgaaaagttctaaagctcttgatgaagattgacaattgctttctaaaggaatctactctcaccagccacatatgtgggaatgctcgtttaaccagttcctcgatgaatctgagcctcatcttccccagtgggagatgggagctcactgatcctctttcatttttgtctgaatttaagggaaaatttccaaaggacacatggtagaccagttccgtgatctactcaaacaaagggcggaaactgtctctccacattgcagagttccacagcaggaggggaatgctgagtttcaatagctactgcaggaggggagacgaaaacccaccagggcatggagaagtcttctttcttcctgtctgttttcagggaactcaactagtcagtaagtcagaagcagcaacttggcaggggtggaggtgggggctcagtcccaatagcctagaaaagtgcctcctctgtactctgagatcttgtcacacacaaacccagatgagaatcagcttccctgccctgaaaattctggggtctcagccccatgaaaaaataatttcttgcctcggagagcaatcgtgaggataggaagggccaagacttaactgaactctcaaacaccgaagtgcctgaaatgtgtcctgctggcagaggtgacctcacaggctgcaaggcttgcctctcttggagtatatggtaggaacatgcagagatgcactttttggcaggctgacctaggagagccgatgttcaatccaagcagctccaaatgctgaagagaatacaggggtatttgatggggggatgggatggatagcctgcgacagaatgccagccttcagacccaacctagtgctgaggtgctgatgtgcgtgcacacccacccgttcccccagagcttgcaacatcaagactggcctgtggggatctggctaggatgtgcactgactgaaatgtctttaggccaaatcctcttaaatcaaaagtataaacagtgaatttccaaaccctacagaaacctcaaatgagaaatgacagagtcagaaaatggctaatcctccaagtttgtactggaaggtctgaaaaaagatagaaaaaaaaagggggggcctggtatatatttgaaaatccaaaatgacacatcttctcttggaagtgacacttggctggcagatgcccttatataaatatattttctttcggtaattttcaaaatgtgaaatgtccttaaaaataagaataaatgacttgcttcctcctgtgggattactgcacctgcagagtgcagccagctctcatgctcccagacaccaccccaaatcctcatcatcctgagatcaacctcaactactgtgttgagttttgtctcacccagtgtacgacccgcctcctgatatgcatttcactcccactgctcaagcaaagacggttgtcaagacagggctagcaagagtgtttattgagaaagatgaattcacagagattttgaggttcctggctgagtgatggagacctcaaaaaacgcctggtgagcgatttcaggaccttctgtccagagggaaagaccagaacaacttccaggtgagtcctgccgcttcacagggggagaagtgtcaccagattcaatgcaagggttttgtgagtgagaagggcagggggtctgacttggagaaggtatttctctgaaagcaacggctattgtgggagacgggagaaagcacagccagaaatcagaatggcatttgggggtctgggttagatattctggtgggttctcttcccgatgggacagagaaggaaacccacttcccttctgtctacttggtgaatctgcgggtctccgagttgctgtctgctacatctcatagcacctatcttggactggacaaaattagctcaggtaccctgcaggctgagagggaacagctagtcacaggagcctggtttaggggagttcaattgttctgaggttccggggaaaccgatggaggaggccttgggagtccaggcagcgcgcgaggaaatgcgatgccggcccgagcagcttgctgccgccagaacaggcgcgtctggggagctcagtcccctccgggacctctggcctcctctcgatgctccgctgccgcccacctccagcggcccggggcagctaccaggaggccgaggcagtgttcgcggcctgggcccggcaacggaacacggaactgtcgtccctggagagcgaggaggctgagctgatccttcgcgccaggcggccggtgcgcccgcaggccccgtccagcgcccgggctcggaatgagcggtccagcaggaggtagatgagcgggttggcgcagctgttgacgaaggccaggcaggtggcaatggtgaggccccagcgcagcgccagcagcagggggcacggcagcggcagcgcccccagacgcgccaggtggaagacggcccgcagggcgctgaagggcagccaggagcccacaaacgtgctctcgatggcgaagatgatgcgcagcgagttcctccgggcccgacccacgtgcggcggccgtcgcaggcggcgcgagatgcggcagtagcagaagagggtgacgaccaggggcagcacgaaggtcagcagcagcagcagcaagctgaggccctggaaggcgtgggagggctcctcgccgcactggctgtcctggcccccaggcaggggctgcaacccccggtagaccagggagggcaggccggccagcagcgccacggcccagacgccgcagcacgaggccagcgcgcagcgcggggtgcgcagtggcctcgcctcgagcagcttcaccacggccaggtagcggtccacgctcatgcccgccagcagcagcgcgcccgcgcagcgcgtgcccgccagcgcgaagctgctgagcttgcagaggccatcgccgaacggccagcggccgcctagcgccgccgccgcggcccacagcggcagcgtgagcacgaagcccaggtcagctgccgccaggtgcagcacgaaggtatccaccagccgccgcgggccccgccgcccggccagcagccacaccacaaaggcgttgcccagcaggcccacggcgaaggccgccaggtagagcgcggggatgtagacgtagccgtagggcaggtccccggccggacacagctccagctcctccaggccgtccaaccccgagtagtcccagggcgctgaccccgggctggggctccagggctctgtgggggccatggcctggctatgaggcctgcgcggagtgcagccctgggcgcaggcggcagcagctctgagcaggagggggtttgctcttcacgcccggccctgcacctcccttcctgccacccaagccggaggcaaatgggtgggcaggaaagaggggagggaggaggggatggggtgggaggggcaggcttctgtgagagagatggtggcctccgatttggggctgacccgaggggtaagggcagggacaggcaaaaggggcttcacatctaaatcttgggaggaaaagtcttcagggctgggagacctgcccggcctcccagtaggagcgtggcccattcctctattagttgctcagtttctttgttcgtgaaatcgggatacttgccccactgtctcagggtcgcgttgcaagaggtggtgggtgcccgagagccctaacctcttctcagcctccacttcaccccttcccacctgcacccaccggctgctgtcttctctgttttagaggtgagaagacagagccccgggattttatgagtatggggcctaaggcacgccccaccccaaatccacctgttccctaggaaagactccactgccgggacacagcagatctgggtgggtgggggagcccgccctgggcagtcaagcagttgttagcgtcctgagatgtggggctcatgtcttcaccctatgagtggcttctctgacccagtcaggtcctcatgaagccacgcgaaagggttttaaggcagcgaggaaggggtgtagtcagatcatcctgctggaaaggggtgaaacctgggattcacatctgcctcttccctgtcttctcctatcctaaaaaacctgtcaagccagacacagatgtaagctcagttcaaaagatgacacctaatgaaacaccagattagttgtcctaaattatgagtcaggagcttggaggcagcaagatcccttctgaactgagaaactgagagtaaggggaggattcataaagacgagggggaatgaagtctgaccctgaggaggcagtgggacctaaggaggagaggatgggtgagggaaagcttgctctttctcctgaaggaggcatgcagccacttacatctgaattcttcttagcagatatcccttccacaagatattgtggtagaactgatgtcacagtgccctctgagtctgtccccagtgttcccaggtatgagtggctgatgtgccgggcaacccggtgtggaaaatttgaggtggattatcaattttgttcgattaagacttgttaacaatgaactcctccatgaagcaggcactgtttcaggcactgcaagagatgccattcttggccttcgcagtttgttgcataggcaggagagatggttacataagcagaatcttatgtaatcttatgcaggggccaaattgtagtaaatgttaaaaaccaagccctcttagggtttagtggagggggagtgattatttttgacgggagggctgaatcagaaaaggccttcgaggagatgacacttgagatcagtcccaggaaggagctgaaagtcaaataagagcagcagaaaagagaagaaagggtcagactcggaggagggagtaaagggaacaagtataccaaaatgagtaggaatgtgggcttttcaggggacaagcagtctgccagagcccagggtaggaaggtgggggcaggagatgaagcaggaaaggatcatgaggggatttggatttcaatctataggtcatggggagccaggaggcatcgatctgtgttttgaaaagatcgctggcagaactatggagaagggagaggctcaagccagggagaccccatagtaggttgtaattatttgtgtctgaaatagatcatgagcagtggggacagaaatgggagggtatattcaagagataattgtaacatcataggtctcacaaagaggagtcaaagataagcctggggtttctctgcttagggactatatggacgctgtccccttaactgccaagaacacagagaggcacatgtgtgtatgtgttcagtttgatgttgaagtggggtcatgaaataatttatcatctaaccaggatgtttctgagagtgaaaggggcactatcagaattaacctgggccgtaaaccaggactattttgggcaaactgggacataaggtcaccctcgctcagggtccctctggcacacggagatccccaggaaggatttggaaaatggtcttagaggccgggcgcagtggctcacatctaatcccagcactttgggaggccgaggtgggtagatcacttcaagtcaggagctcgagaccagcctggccaacatggtgaaaccctgtctctactaaaaatgcaaaaattagccgggcacggtacgcgcaagtcccagctactcaggaggctgaggtgggagaatcgcttgaacccaggagcaaaggttgcagtgagctgagatcaagccactgcactccagcctgggtgaaagagcgagactccatctcaaaaagaaaatggtcctagagctcacagagggttgggtatgcagtgtttaggctgctcctgtcaagaatttctcccacaccaattacaagatgggcagggaagagaagagcctagggaatgaatggtctggaccttcccttcactggcttttcagcctccgggcttggttttcccctgaagacccaccccagagccgcttttctaatgtctgagcatgtggttgctggtgagcggtgcccacatccggggtggagtagggggctgcagcctcctcccctagaaggctagcaggggcagtgcttgcctgccagagcccagagaccatcagagacagacccagtgttgctggacttcaccccttcaggcacacctcagtctgcgggctcagagagtgtgagtgatcctgaaagctagagatgaacagcagagaagccgccgggtgaaaacaaagaatggggcaagcagaccaagaggggaatataggaagggggttgaggggaagtagaagtaggttattttaaaaatcacagagctacttgcttcctgggccatcatctcatacccaagggaagtctgtggcccagagcatatgctgaattttctctgctgaggcctgggtgctgtccatgggccttactgaacttgtctggatgagaagaaacagcaaaggtcagagccagggacactgccttaggcccggtctcctggggtgcccagcccggtttcagtgaccaaggccaacttcacaagactgctctttcacccttcaggaggactccccacaggattacacacaagtcaactaatagaaacactcacccttacaggctgggaatcctggccatgctctctaacaggtgtggacaaagcagaagaagtcttccctcttcctccatcccacccctgggagccttctctaacctccatccctaagaggacttcctctctctgcactgctggagccagggcaactgttacgtggctccgtcttgccttgcccatgggattatgaacttctcagggcgagggggagcttctttctactcatcagggtgattagcacaagcctgaaaacagaggagatactttaaataaatatccaatgcttcgggctaaattgttttcgagagtaggtttatttctgcccctttacaggttatatttaagttcttataacttattttttctaattttaatttttctgtacaaagaatcttaacattttaagtaaattgtatttgcctttttatgtttaatcataaaagccatctaatacattacagaataaagaagtagtcgtcatcttggacctgctacccctacacaaccaaacttagccagtgaaggacattttcaaaagtatttatttgtaatctcattatttttagattttctatttttaaatattccatttcagatattcttcacattttttacacaggtgtttcaaagtcgtatctgtaattagagtgtacacagtattctcaattaatatcatataaatccacatgagtctatgttgcttaattttctaaacccttaaatatggatatttaggatgtttctagtatttttaactgttatagaaatttgtaatgaataattgcacttatgacttttttatattgtttttataacataaatgctcttgtataagtacatataaatatgtatttatatacatataaatatgtacaaatataacatatttatataaatatgtataaatataacatttatataaatatgttgtaaaacacgttataaatacaaattttgtaacaaaggcaatgaaaatttttattgcttgatacaaatgtttacagtgattagcagtttagaatgtcactggcattgtatgagagtataaggttcaacacagtcttcttagagatgttcatcggtaacatatattttccattgtaataggcagtgaggtaaaatggtacctcatttcaatttgcacttgtttataaataagatggaaaatctatttatttcctaagtgaaccattctaatcatgtccttcacatatttattataatctatgtatttcttattaatttgtacaaactatatatttaggatgagtcatgatttattccacttgattcaaatatttttccaaattcttttcttagctattatttattttagtttgacattttcatatagtcaaatttgttgctattagcaatttcagagtttagaatgttactttctctttgacaatgtaagaagattcagtctgtcattaaaaaataattttcattagtattttaaaatttacctggtgtgtaatcgatgttttcatatttctatccagctttcctaacatcatt

SEQ ID NO: 938 - DNA, 1440 bp, Homo Sapiens
cattgaactgcaaatccccagttaaatcaagattgtgttgattaagctatgtctgatttatggcttaaaagtcacttggttagactcaaacattgttgcaacatgctatatgttattcttaactaacattatacaaaatgcacaataaaggtagataatgaggatcttacacgttatttgtacatttattgaatacctatttataatcacgcatgatttctccgcaactgcattttctccagttaaaaaagaaacaaaaacaatttttttaaacccttgcaagagcaaagaaacaaactcaaactatctcttcaatataactgatttagactctttccatgttacaggtatcttgcctgactccaattcatgttacaattatcactgcaaacatcagcatcactttttgtgggactctcttatttatcatcccctgctttaagaatacactgtgttccggttggtattctcgggccccacaactcatagtattccttctggtgttaattgcttgttgatttgccttgttctaaatgcccctatcatggtcttttccaccctaagtagctaaatatattcaacgctgtcaaccattcctcgattcactttatttccctgaaaaaattttttatgtcttcttgcaaaaagaaatcttgtagtatagtagaattaaaccatgctgcatttataaatatttgctctagtgtattgatggctctcttaaaagctgccattcaggccgggtttggtggcgtgtgcctgtattcccagttacttgggaggctgaggcaggaggatcccttgatcccagagttcagggctacaacgagctatgatcaattgagccaatgcactccagccttgaaaaccctgtctctaaaacaacagtaacaacaaacagccattcagagtaaatagtaggtacaaaataaaatactccttattgtatacctagtataatacagaagttaagaacttggtttttcatatgttagtgtgtttaatatgtactctttagtaaacaggtactggtagcccttggcttttatatcattgacttttcaaataactggcacatggaatactatacgtgtcacctctgaaatgccatttatatactggattttgacttacgaacatcatttgatgaatgccttttttgggctgtttgtgttgctgtcttgccaagtaacccccacctgctacagaactgtgactttgccacttttggcaaaaatttcaaaaattatttggaaaattttattgctttttaccttattttaacaaaacaagtggaaaaaggggaaatgaaagcatctagttatgagaaagtttattatcttgatataaaattgagacaataatcattagatgtgctgaaagtgatgaatctttattggaagtgctgcatggagttaagctgatgaattgtgaaaaaaa

SEQ ID NO: 939 - DNA, 1989 bp, Homo Sapiens
cactacgcccggctaatttttttgtattttttgtagagatggggtttcaccgtgttagccaggatgatctcggtctcctgacctcgtgatccgcccgtctcggcctcccaaagtgctgggattacaggcatgagccaccgcgcccagctgttttgcatttttgtatgatttccatccttcactttatgaaggacattatttatcacattaatgatcaaatatatttatcacaataatgataatagaaaattaaatatttacatttttgtatgtgtgtcttttgggagaaagatacatattctgcattatcttactagtatgaagccttctttatctatgtctgctgattgtgtacacctcggtgccagacataaggaaaaccagcataggccccagagcctgatgtgtaagttctggtcccagatccatcgaaggccatttaaagtctctgaaaatccactctttcatatgtaaaatgtgatcattaagaattgttatgcctacctcataaagttttggttagaatcacatgagatacatgtgaaaatgctttgtcaactaagaacgtgttacacaaagacaagatatgtattattatggttattttctatttctctagtttgactagtttcattctttgcaggacattttcatttttagatgttcttagctattttgcctgtggtgatcagaaggcagatgaaccatggggttctatttctctgactctagatccttttaaaaagctggtgacctttttgtctttcttttcttgttttatcgtttttttttttttttttgaaaagtggaaaaatattctcagggtatattgaattgattgagcctcccttggatttctttgacttatttgacttactctatatcttgcttctttactcctctaatttaacattttcctctaaaccatcatcagaatgtttttgcactatcattattcatttttttcagttacagaatgtgggaaaaaggagagaagggggctgttgaagaggaggcttcatagaataatgaatctggaagaattcaaggagaaagcgtgtttgttgtggttcacgttaaaagagagagatcgttgcagaaactgtatgctgagcccttgtctgggtcgatcacagcaccagctttctctattcttggcctggttgttatgagaaagttgctcatctgggctggctgttcccgaccaaaatttatgctgatgacctcaactaggacctttctgaagtgcaataatatttttagccttttctaactgtccatgaatcatccatagctttccactgtccttagacactacccctaccatcgtcactgtctgcctcttctcaccttgcagcccgagttctactgaatccagaaaacccacttacaatcctgtaccacaatctgtcttccttttctttctcattaatattcttgagtctagttccatttttaaaaataaatgttttattttagaatattttagatttacagaaaagttacaaagatagtacaagacactcctatgtaccccacagctggttgccactattattatcttacattagtatggtacacttgtcacaattaatgatccaatattgatatgctattattaactagaatccatgctttatcatatttccttagtttttgcctgttttttcccttccgggatttaatattacatttagtggtcatgtgtccttaggctcccctgacttgtgacaatttctctgactctgtttttgatgaccatgacagttttgaggaatatcgatcaggtattttgtagaatggcctctgttgtgattttcctgatgtttttctaattataagcttcgggttgtgggtttgcgggaggaagatcacaaaagtaaagaaccattttcatcaaaagacatacggtgagcacgacttaccactactggtgttgacctggatgaactggctgaggtcgtacttgccaagtttctccaccataca

SEQ ID NO: 940 - DNA, 6595 bp, Homo Sapiens
gggcagcccccccctccgcgcgcccccgccccgcgcgcgcgccgcgcgccccactagcgctctgcgcgcgccgcaggctgtagccggccggggtcgcagcacgcctccccgctccgccccctcgcgcgccgcccggcgccccgcgcacgcgcgccgccccctgctccttcagcgagggtctgcggggagcgcgcgtccaacgcaggtaatgatgaaactcctgctctggtccgggctaccggtgaacagcgcccagcgggccgggcccccaacctcgctcctgagcctgaacatccccccaaccccaccgtgagaattcagcgaagagtaaaagctggaaaaagttgcgtgtcttaggctaagcagaacaaagtggggtgacggctccccggctaggaacagagatgcccttagggagccctctgatggaagagctctccgcttaagaaggtcaccactcccttacactcaggagatgttgctgagatgggtgcattaaagtttaggctttccagagtttatattgctaacaacttgaaaggaaaaaagctaactagagaactgactggtcttatttgttttagattctgggctttactaagacttcctactctcagaatctctggactataaacgctgggtggggtgggagctgggaatgttattctggaaaattaatcacaaatgaaaagaaaatcaactctaagactccagttagaagatttttgaaaatggcagaacatgactggccttcattcaagtcagaatatttaaagcaatccttgctaagaagaacttgattttgtataagcagtcccttaaatacagttgcttctcaagaaaaccacacacaattgatgtttgaatggctttatttacaaacatctcactccgtaagcctctgcaggtatttctagcctcccaggggccactgtcccgtttcacctgtaatttggatcacaattctgtttgttgtcacacacatcatatgaactgcttttcatgctgcttttatccacaaagctttacaagctttaatggcagctctatgtatgacaactttataaagatctgccaaaaggtatgatgccaagctttgcttttattaaactattagctattagcactgaaacgatgttcagtagagaagtactctcctttcaatatgtgagtggaaacacatttctctatggggactgctggtcagggactcactctaaagaaaagccacagtgttgtggttcagagcatgggctcaaaagacaaatggataagaagcccaagaccagtccttctgagctgtgtgaccttagacaagttgtctaatctctctgtgtctcagctctgcctcagtgttgttaatgggattgccgtgagagcaatgctgtaacatgtaaaaagcacttagaactgtgtctggcacacagaaagcactcgataaatattgacctggttagcagcagcagcagccatcgctggagcatctctacatcatacagggcccgatggaaagagaccagcactgagaatgaacagaacagtgctggctctgacccgctggctctggcattgctgaataactctaagcaagtctcttaagctttttaaatatgatttttcaccagtaactaatgaagggattgaaggagcaggtcccctgacgtcttttcaaattctaaaattctccagctttatttaatcctgcagtgaatccttttgcaaggtaaagagtactcgctcccctcaataacatcttatgagtttaggtttcggtgcatagggcaatacccagggcataaatcatttccactgtcaccatagcccgcaggtgaggtgagcaatccattagcttgcttctggaaacaagcctgtctgtatttgttcccccagcatctgcactcagcacactgactttgctcagtatatgtattggatggataagtgagtaaatgaatgaatgacataaagatcatagattgcctcagccttctattggaaaataacctaaagggagggggaaaattactacttaaaaccacaagtgccactcaagggatgcctcctatgaaaggaggagtgctaactgccaggtccccactggttcttcgtgctgcttatggcctggaaggcctctcctgcagccaagagccctgatgtgcttgggctgtgcaacggtgagtctggggtgagtctgggaactttaggcgcaggaatggagagcgctgactccctttgcctaagaaaggggacttagaggggaacttgaaagagggagtaagagagagggcaacaagaggggccgaggctaggcagtccatgcagcgggtgccaagcctgaggtggggtggtctggaaatcattccagaacaggaaatatgttcttctgtcttctgtgccattttaagttctgtacagcaatgcctgcttttccagtgatccttacaacttcccagcttgtatttgtgggtactttgatggaaagttgcaggggaagcagggaactagggctgggatcaataccaggaccaagataaaggaacagctgtaagagcaagagaacaagaactaagcaaaagcagggaatttggggcctgccatgatgatgggaacgtgggctctgaagatccacagacagccaaggcaggcctcggcctctccatgggactggaaagctcatcttgtctccctctcaaggagtaagaagatgacttctggatacgtgagtcacaaaaggccagaacttttctgcatctcccacggcacccccttacaagggcaggtcattttggggcatgccacctgggccagtggcagcaggtactgagcaaatccaccccccacctctcagagcttgtctcttcctgtcctggccaggtctgtttcttctctcttgatcaacagaaataactcccaaactgcttggtatagagcagttcatgaatagagattcaaacaggtcacactcaattatgaaatcagggtgcctgggccaggcctggcataaccctgatctcagaggaccacccctaccctccccagggagccaccagagaagctgtcacatgctcctaagacgtgcttgccaccagcacccccagacacttatgtgctgaaattgccaacatgcagattcggattcagaggtccaatcagggcctgagaatctgcactccttgcaagcccccaggtggtgccaacacagcagaaacattgacatcttaggccccaccacagacttaagccaaatctgcactggaacaagatgcccaggcaatctcccaccctgaagttgttcagactggcctcacttaggggagggagttccagattagagaaaggtcagatcagcggagcccagatggacagccaccagacaaaggaggagaggagggagaggcaggtcagagagatcagccggccttgattctgcagcacctggagccacagtgggaaattgaagctatcctcggggcaccagaaagccagtggaaggtttccaagaggagagtgacaaaatcagatggaccattttataggattcttctggctggggatgcagatccagttggaggcagggggggatagttgaattaagggaggcgctagagagagctagggtagcagtccaagagacccagatgagggtagctgcagtaagcagaccagcacatcactcatggtccagggtgatttgcaggcctctgaagcagccaagtacaaaacgaaggccctcccacttcccttctccctggaccagatctctctgacttctcacctggaaggtgcccacaggttgccaactccttgtcctgtttccaaaccctccctccttcaatccatctgacactctcctgcccctgctcaaaaaccttcaatagctccccattgcctgccaaatgatctgctaactcctccacccacactgttatgttctacttctatgtctgcctaacccgtgacacagtagttcacactttcattcatgcaacaaatatttattgagtatcatcaatgtggcaggcactaaaaagaaaccactcatctgccaaggcacataatcaatttcaggaggcttatagccacactgaaatgctcttccaaataagtgctttggctgtagcaaatgaaaataataatagaaaacacttattaaatactaactttgtgccaactatcatgttaaacactttgtgggactatcttaataatcttcctcagacacctataatggagagggttggcctcatttttcgttttgtgggtttttgttttgtttgtttgagacagggtctcactctgtcaccaaggctggattgcagtgctgtgatctcagctcaccgttgcctcaacctcctgggtttaagcagtcttcccacttcagcctcccaagtagctgagaccacagggatatgtcaccatgcctggctttttttttttgtcttttggggggtgctaccatgttgcccaggctgatcttgaactcgcgagctcaagcaatccacccgcctcagcctcccaaagtgctgagattgcaggcgtgagccactgtgcccagctggttgggctcattttagccaaaagaaaaatctcaagtcacttgcaacgtaagtgcaacaactaaattcatagggtatgaattcaggcagtctcaacccaggacttctccctcaacccctgtcctctgaatgtccttgtactctaagtcatggggctgtgagtgaaacaacatcaaataaggcatgttaaagtgcacaataaaaccccattcaaattctctttccgactcacctcatgctaatcccaagtcctcccatgatgcccgggtcacaccgaccaagcaattccaaccttgagggttttgtcttccttttccatttgcctggaacactctccttcaaggccttgttttggcctctcaccattcagatctctgctcagatatcacccctggcatctctgggagagaagccactgagacacttgtaggcaataatggaaatctgccaaaaattctcttggtgggctcctatcacgttctaagcccttttctcctgtttccttttttctgtcttcctctccacttcctcccacctccccttgcccctttagcccttcaagaacaagtgcctctctcttctcctccgtgttctcctccttaatcaaaagctgctctcatcaaaagatgtcctgtccatcatatacgccttagtgtgaatttgttggtaggtcaattttcccagaaatgtctgatttatttttattttttattttttttttaatttttttgagaccaggtaagtcttgctctgtcacctaggctggagtgcagtggtgcgatctcggcaatctcagcaccctgcaacctcaacctccacctcccaggttcaagcgcttctcctgcctcggcctcccgagtagctgggattataggcatgtgccaccatgcccagctaatttttgtatttttaatagagatagagtttcaccatgttggccaggctggtctcgaactcctggcctcaaatgatctccctgccttggcctctcaaactgctgggattacaggtgtgaaccaccacacccggccaggagtgtctgaattttaaaccatatgcttgattataaaatagtagagtttgcctttcttaaaggaatttcatacaactgggttgctagtttgtgtgtgtgtgtgtgtgtgtgtgtgtgtgtgtgtgtgtgtgtgtgtgtgtgatatgttaggggcagcaggtttttccttaacgccaggaatcattcaggctgactttgttcagctggaataatttcaggcatcgtgatacagttgaaaggaaagaggatgaacattaaaataaggaaggcctcaatttgaatctcgcttctgacagtactcgaacgatcttagactaagtgatttcactctgactcccagttgtctcttttataatgtgagggtaattaactattgtaaagattattgtaagagctagatgagatcacaggacacaccataagggctcagtggggctggaatgcgtgaagtcctctttggagcagtcaggcctgatggaccccgtgcctgggctcgaagacacctacacacactcccagggcccccactgcttataactgtttctggaaagaactgagcatgaaacttggcaggagaccacaaaacgtcctggaatcctggccactgtcaagtctagaatgctctcctccagagaatcacattcttggggccagtgttggagcatggaagacttagttggggattggaactgctccagccctgaagccctccttcctgtccctgtaaccagcaaatgtcactgtctgtcttgccaggctaacaacctttctcataagcatcaccaaacctgaccagacatcagtcctctgaaaagaatcataatccagccaccataaacccaaaagccaaagtggtaattatctaaagatgaggaaaggtttcctcccaggccctccaggggccaaggaagttctcacattaaacagttacactgatctccattgatttcttcagtccatcaaccaattattggcaactttttcttggaaacctactgtatgtgag

SEQ ID NO: 941 - DNA, 1279 bp, Homo Sapiens
tcaagatattgtgtccttgtcattggccagagatagataggagaaagcacatttggttcttaagagtagggaattgtgtggaagttattggttttaaggtaccattacagataatctttaaaacttgggtgggatctcataaggtgatgatgtagacaaggaagatagaagaagcagagggataccatatagggaggtgtttgggatgaaggagtccatgcaaagaagtgagaaacaaggctggaactatatagtagagatctcagttccagactaaggaataatagaactgatggcatttatggaacacttactatgcaccaagtactttctttggagtatcttaatgagtccttacaaactcccctatgagacagtcttttgtgaatgagaatcagagacacaggagttaagtaattaatacagagtttgtaagcatagcaggcattgaaacccagtctgtcaactccagaacctatgaacattttatccactgtgctgccttatggtcatcaactttactacctaaagttgctgattcctcagacctagagttttgcagcctcctacatgatggttttatttttcaaatagcacaaaaatagccctttgtgagatttatgtaggtaagagggaacctctgcccttttgagacacttagccttctccaacccaagttagggtatctttgggcctaatatttctgctctcggaaagccctagaggtcctaggcagcaatagtctctttaaatgtttatttattgcaagggacaatcagggtcagctaatccaggacctgtggcgaggcatgcagagcactgtggccaggctctgctcatggtacacacaccccagggccatgggcttttcaccccaaccccaccaaacttgctaaaagtgttagatctagtctagaagcctgaggtaactcctagatgtaaaattcaggatataggcccaagaattcctgcatcccagcaagaaggaagccagactgtctgcttttacgaactgaattgagaattcacctttccagtgagactgaagctttgctgaagatttatcgccccctggaggacaatagtataatatatctcttcaggtactctagaaaagatgcccaactgaactgaaatacacatttttttcctaaagaataggaaaatcaagcctttgctaagacaaccctttaaaaagatgtccaggcatccaaatggcaggagttctctggatctgacctcaaaagctaggcctgaaatgaatacattgtgggtctct

SEQ ID NO: 942 - DNA, 1939 bp, Homo Sapiens
agactccgcccagccaggagtcccctgaaggctgctggaaaaagagcaacctggcacccggaataatgactctgcctggatgcttagagcagtgcgagggactcccaagaagcccctagcccacttgggggaccagggaggattaggagttggtggttgagtaccgaaagagttagctaggcgaaaaggggcgggaagggcctcctaggccgaaattgcatggaggaagatccttaggtagaggaaaatgagaccaggcttgtaggcagaagcagatttgcagtgaaacaaatgaagcttaagtttcgggacctggccgggcgtggtggctcacgcctgtaatcccagcactttgggaggccgaggcgagcagatcacgaggtcaggagatcgagaccctcctggctaacacggtgaaaccccgtctctaccaaaaatacaaaaaattagccgggcgaggttgctggcgcctgcagtcccagctactcgggaagctgagggatggcgtgaacccgggaggcggagcttgcagtgagcccagatcgcgccactgcactccagcctgggcgacaaagcgagactccgtctcaaaaaaaaaaaaaaaaaaaaaaaaagtggaggcgtgaataacccaccccttgtttagcgtaccatcaagaaataaccataaaaatgggcaagcagcccttggagctgctctatctatggactatccattcttttattcttgtactttaataaacttgctctcactttgcattgcggactcgccctgaattctttcttgtgcgagatccatgaacctctcttggggtccggatcgggacccctttctggtaacaatgcctgtaatcccagccaatctccctgccttttgatctccctgcctcactcctacccaccctgataattggctgttgaatgatcatttaaaaacacagtttctgatcatgtccctcctctccactggatccctactggtgatgtcaaatgttgtggggcctaacgcttccgcaatttgagaagacatagttaagaaaaataatacaaaacttggccgggcgcggtggctcacgctgcccccagccgaaagctttttcttatttggcatttgaatgtggaattttggaattttcttattggcaacaaatactgtcagttattttccttgaagtgacaggctcactttgttcatttttcaagaaaaaggctggccggcactgtggctcattcctgtaatcctagcacttgggaggccgaggtgggtggatcacctgaggtcaggagttggagaccagccaggccaacgtggtgaaacccagtctctactaaaaatacaaaaattagttgggcatggtggctcatgcctgtaatcccagctacttgggaggccgaggcaggagaataacttgaaaccaggaggcagaggttgcagtgagctgagatcatgccactgcactccaggctgggcaacagagtgagactctgtctcaaaagaaaaattctagtatattaaaatataattgattttttctgttgaccttgtatcctgagaccttcctaaactcaattattacttttggtaactttttggaaatctgttcaggttttctatgcatatggtcatgtcttttgtaaataaagacactttaacttctttcttttctatctatatcccttttttttttctttgctttattccactggctaggacttccagtacacagttgaatgtaagtggtgatggtaggcatccttgccttgttcccattcttaagaagaaagcatttagtacttcaccattatatatgatgttagctgtagttttgtgtgtgcgtgtacctgcatgtgtatagatgtcctttcttaggtttagaaagttcccttctgttcctagtttgctgagattttaaaaaatcatgatagttgttgattttcc

SEQ ID NO: 943 - DNA, 1395 bp, Homo Sapiens
ctaacgaggaacactaaatattgtttcctgtgtgcataagtcacttgcagatctagaagaaggagtttgcccaattttaaattagaggcaaagtacttttcttagatctgcaatttacatctctaatttaaattgcccaattttaaatagaggatttttttgttgatttgagtgaattctctgtaaaatgaagatttttaaatctgctatatatacacacatgcacatacatgtgtagtaaatattttacaagtatgctgccttttattttttctcaaatgcagggtaatttttgttttgctaaattaaccttcacaatgcttatttctgagagtcttagaaaggttttgtcaacataaaaatgtatctgtgtaaataggcatttatattttcttctgattttttttcattttgtatattaaaaatttttaatctatattccatcaggaacttatttcttttatgtactgtaactttggcatttttttctagagatcatcaaacccaagagagtctagattttctcctgttattttccagaagttttatagttttgtatttgacatttaggtccgtgattcattttgacttaatttttgtgagaaggtaagatctgattcattttttttacatgtgggtattcagttgttccagcaccactttctgaagaaaccaacctttgtttcatcatgttgcctttactttttcatcaaagattaattaaatatatcgatgtgtcgctatttctaaactctctgtcttgtttcattaacctgtctattctttcatcaatatgatactgccttgattaccgtagccttacagtaagtcttgaagttgagtagtgcctgtctgtcctccagctttgttctccttcaatattgtgttagctattcaaggtctttttcttccccatataagctttagaattactttttctatatccataaaataatttgcttccattttgattagaagtgcattgaatctgtacattggtaagaaatgacatcctgatgatactgagttattctattcatgaatatgatgtatcttctccatctcttcagttctttttttatttccatcatcacatatggacagtttatgaaattacataactccctctaccttgaccaaaggacagtgatgaattcctcgttctgcagccaacaagtcacctctgagggccatgtgtctaaacatagacaggagggacacctgttgcttcagccaacacctgctggcatgtgctgaggatgctggtgctgctggctttcccagccctgcccccggggctgctttgggtgtgtgcctcttgactttagtgagaatgtactttttcatccctaccatgggtgaaaagttttcacaaataaaaactttttaaaataa

SEQ ID NO: 944 - DNA, 1964 bp, Homo Sapiens
tgtgtccagaagaaacaccctcaggaacagcacccaaaatcacactgaaaagtggtttagtgggaagcactggtaggcacagacagctctgacttcagcaccattgtcaccaacgtgaccaatgctggatacacgactacagcctcttatgctgttggctctggaaacaggatgtaactgctgccattatccccagaatagattctggagggagctcatgatttgaagtctaatatgggtacatctgtttggctgcatctctgcatcaagagaggctgggaatgagtatctgatttctgtagtcagaggctattgccacatcccaccaagagctatagagcagggagcgcccccaaatggaggaaaagtgtttactgggcaaaaagaatcaccaaagtctacaaagcctttgactacccaacatcagcaagtacacacacacacacacacacacacacacacacttaaataaacaaaacaaagtaacagaaaataatatttataaaccccttttagcccacatacacacaaaaatactcttttcaaaaggggatcaggacacatcagttactgcatccagctccaagtcagcttccaattccatcccagggcagatcacctatgtcttcattccagcttcttggtggctgggaaagtgagtttaccgatcaagtgctgggtggctgtgatgttttacaaatgtccaccagagtccatgtcagtttctctcctcctctccttctctctccctgtcattccttctctcctgtctctcattctttctctctctttctctctgtcattccttctctccgtctctctgtctctcattccttctctctctcattccttttctcctctttctcgttccttctctctctttctgtcattccttctctccttctctctcatttcttctctccttctctctctcattcattctctttctctcattccttctctccttctcactctcattccttatctacttctctctccctcaatctttctgtcattctctctctcattccttctctacttctctctccctcaatctttctgtccttctctctctcattccttctctctttctctctctcattccttctctctttctctctgtcattccttctctccttctctctctctcattccttctctttctctcattccttctctcccattccttctctccttctctttctctcattccttctctctctcactccttctctcctgtctctctcattccttctgtccttctctctctctctcatcctgtctctctctctcattctttctctccttctctctctcatcacttctctctctctctcattccttctctctctctcgctctctctcatcccttctccaatctgcatataaggggacccatacagttcaaacccatgttgttcaaggctcaactgtaattgtacatgtagaaaatctaaaataatctacggataagccattagattataataaatttagtgggctccctggatacaaggtcagtatacagaaatgcattgtatttcttcatactaagagacaaacaataataaaatgaaataaataatttatgatattagaacacatcaaatacctaagaatatatccaggaaataattttcatgacactgaaactacaaagcattgttaaaataagtgaaagacctaaataattggagagatactatgaattgaatcccaaactgttgggattacaggcatgagccactgtgcccagccaaagaaagtgaatcttgattccctcctcacatcacacataaaaatcaattgctgattatgacagatttaaagcttaaaataaaacaataaaacttacagaaaaaatcagaggaggatatgttcacgatctagggatatgcaaatattctacacaacattaaaagaactgatagatagaagaaaacatttataacttggacttcact

SEQ ID NO: 945 - DNA, 811 bp, Homo Sapiens
actgaggtgctgaagaggctctcactctgtctaagagagtgtcccgagcaagacaagcagtcctagatgcccagattcttgttttggcttcggatctgggcaaagggaaagcaaagcagctgtgctcagatctgaacttgttggacatgttgtgttgaaactttactgacatgtatgggtgtaaatctgccagaagctgaagaactcatccgtgatgaagatagctctgatttgaattcatagtctatgactcctggaaaatatcaggcaaaagagcagaaaacacctttaatcaagcccatacactccactctctgttggattcaacacaaggagagttccttgtgccaaagtcccaaatcattagtccaagaaaacttcctatgatacaaaaggagacgataatgcctgcccagttaaaaagaagggaagaatctcatcaagaaacaacaaagaaagaagtagaaagaatcttgggattgttgcagttgtatattcgagatgctacccagcgtccttctttgcctttgtggttgatccacaatctttcccccaaacagtggaaaacatctttcatgtttccttcattatacaggatggttttgcaagagtaaaacctgaccaagaccgactgcaaataatagagcctgttaatattaatgaagaaagtgaggaaattcaccaaaacacccaagttaggaatcgaggaattctagctgtgaggtaccctgactgggaggagattgtgaatacctttgagatttcaaagcctgggattactccaagtcagagacagcagaggctaagtgct

SEQ ID NO: 946 - DNA, 2095 bp, Homo Sapiens
gagacggagtctcgctctttcgcccaggcaggagtgcagtggcgctatcttggctcactgcaagctccacctcccgggttcacaccattctcctgcctcagcctcccgagtagctgggactacaggtgcccaccaccgtgcccggctaattttttgtatttttagtagagacgggagaattgcttgaacctgagaggtggaggctgcagtgagccgagattgcaccactgcattccagcctgggcgacagagcgagactctgtctcaaataaaagtggagttacttttgtgcagagtttccactcccctggtaagaacaaaatacttgtgtgtatgagacacaaatatcaattctgtaatttctaatttcacataagaggtaaaggctcttatgtttgtatttaaaatgatcattacaccaggcctggtggctcacacctgtaatcccagcaccttgggaggctgaggcaggttggatcacttgaggtcaggagttcgagaccatcctggccaacatggtgaaaccctgtctctactaaaaatacaaaaattagctgggcttggtggcgcacgcctgtaatcccagctactcaggaggctgaggcaggagaagctcttgaaactgggaggcggaagttgcagtgagctgaaatcacacccctgcactccagcccgggcaacaagagcgaaactctgtctcaaaaaaataaaatgatcattacacaatatgaaaatgaataataaaattcatgctaacaattttactttacttagaatggcattaagtagcaaaatttaaaaccacgaccagttgagaaattgttaaaggatggaaaaagctttatagttagtacctttaacctaatttttccttttaatttttttttctttttttgagacagggtcttgctctgtcaccctggctggattgcagtggtgtgatcacagctcactgcagcctcagcctcctgggctcaagtgatactcccaccttagcctccctagtagctgggactacaggtgcacactactccacccagctaattttcaaatattttgtagagacagcgtcttgctatgttgcttagggtggtctcaaactcctgggctcaagcagtcctcctgccttggcctcccaaagtgctgcgattacaggcatgaaccaccgcacccggcccaaggagtttgccttttcattttgcactgggccctggatattacatagctgaccttgtcttcaggactaggaaaaggaccgatagaatcctgtgttccttttgaattaatctacatttctttgacaacaagctggacataggcttcatgaagtacagggggctccaggaatactttgttctgaaatccaagaatcctcactgtatcctttacccaagctctggcatatgtcatcatgactttggttcccttggggcaaagagcatacttttggcctgaatggacattgagtgtgggggtgcttaacacctctgaacaggtcttgtccacttttgagttggagggcaggtcagctaggtgtgcacttccaaaagagccctcactgtccaaggtgcagttgtaatccaggaaggaaatgaggtccatgatgtgccactatgtggagaactcacaggttatcacaacactgaaactcttgatgaatgattactggaggagggagtttacatcgtgtcaggccctacactatggagtgtagggatgccacccttggttcccattgtccaaaaacaaaacccaggaacttccacatcttactgtccttcacattggtgtggaaggctttgaagaatctgctgtcctgatgagcgccttgtctcaccacaaaaggctacaacagggatatggcatcaattggatcctcatccagcttgaaataaaccgtggaagctgcttttcctcaggacccgatagagggtgaagttctgggcttggtagagactgaagcagactggcacatcagtggtcacgactgcagtcaaagtgggagacacgatggtaaggaagatgccagaaccacctgctatttctcctagctctatcatacatgcccacatggcactcaagtatcctggtagca

SEQ ID NO: 947 - DNA, 1261 bp, Homo Sapiens
tgcaaacgcagtctcctttgcctggaatgctcttcccatgtgtgtcctttccagctcaagtgtcatctgaaggcaggcttccgataaaatacttaactgacaaattaataatctaaagtgaaaagaaatagataaatatttataaaaattaggctctcagatcaaacaggtcaaaatcttgagctcagagcaataacgtaaggtatctgtccagcataaaaattttactttttggctacactgaggccaaaaggaaaaagctgagaaaaagagaaaaataaactgctcaaattcttccctgcccacatttgttaatgaagtaaaccagatcagcaaatagatttgttacttgttcaaggctacctggagatttcatttttcttatacaattcagccaatcctagataaaatgtaaatattgaaattttaaccttgaactcacttgaagctaaaaaaaaataagatgaaggaagtttttcaaaatcaaactgacatggaaactgctttacccaaaattttgatcttcagccttcattcaattacctatcagggcaaataaagtttagcaatgtgaacaaatctcaattttgttagaaatataatttggatctcactttcttttatacaccagtgagttggccgggcatggtggctcgcgcctgtaatcccaggactttgggaggctgagctggctggatcacctgaggtcaggagtttgagaccagcctgccaacatggtgaaaccccagctctactaaaaatacaaaacttagctgggcatggtgatgtgcatctgtaatcccagctactccagaggctgaggcaagagaatcacttgaacccgggagacggaggttgcagtaagctgagattgtgccactgcactccagcctaggcaacagagcgagactccatctcaaaaacaaaaacaaaaacaaaaacaaacaaaaaaaacaatgagttgttatactatctcatgactctaatactaaaatgaaagctatatgatttttatttgagtgtgtatatgtgtttagatgtgttacggatatgtacatttatcatgttgtatgctgtgtttacatagtaaaatctgatgtcgttggtcagaaatcctctaaggataaatgagtactcatataaaatataatatgtatatagccattagcccagataccttttagttcacatgactaaagtaaacctttagtaaataaactggtttttaaattactgataacataaaaataaaaatgtcttc

SEQ ID NO: 948 - DNA, 3902 bp, Homo Sapiens
gggagatcttgcctggaggtggtggaaatgcgagtggagagggttcaaggcttcctgcagagaaaggtgtgcaaatcctggcggcgggagaggggctgttaacagacctcagtttttacttcattctttaatctctcctctactcgtataagtgatatacctgtgctttgtttgaactttacggcagccctataagggaggcattgtaagagacctctttttttgtctatttgctcagtgctctctgctgtcagtgggctgtgctcagccctctgccagcattaaatttcctccttaaaacaaccctgagtgtaataggctgaataacggcccccaataatatcagaccctaatccctgcaacctctaaatgtaactttatatggaaacagcgtctttgcaggttaagttaaggattttgagatgaagattatcctggattcgaaagacgaacactaaatggaatcacagtatcctcatcaaatcataaaagggaggttgagagagacgatttagccacggtggcagagattggagtatggcagccacaacccaaggatgccagcagccaccagaaacaaagagacaagcacacactgggggtgagggggtggaggagcggggagcatcaagaatagctaatagatgctgggcttaatacttaggtgatgggatgatctgggcagcaaaccaccatggcatacatttacctatgtaacaaaccttcacatcctgcacatgtatccctgaaataaacagagacaaggacagattcacgcccagcccatggggcagccctataatgcatgctgatttgggcccagtgaaactgattttgggtttctggcctccagaactgtgagagcataaatttatggtttaagtcagcaagttcgtggtaatttgtttcagcagccaagggaaactaatacatcaagataggtaccattatccctgttttacaggtaatgaaactaaggcacaaactggcagttccagggggagccttgccctaatcctttctactgtacagtgagtgagggcttcttccaaagtccttcacatgaggggagaaaagctgagccagatgtaagccaccctaactattaatcaagcagtttttcactatacagtattagctcccctccatgggaaggcagtcccttcccagtgaccaacataacagattggcaacaccccataaatggcaaacatccccaatgcaaaatacagctttccacctaaaattggtgctttctgctcaattaataagcaaaggactagtgccaggcatgatggctcacacttgtaataccaacactttgggaggctgaagtgggcagatcacttgaggtcaagagttggaaaccagcctggccaacatgataaaaccccatctctactaaaattacaaaaattagctgggtgtggtggtgggcacttgtaatcccagctactggggaggctgaggactgagaatcactttaacccaggaggcagaggttgcagtgagccaagatcacgccactgcactccagcctgggtgacagagcaagactctgtcttaaaagcaataacaacaacaacaacaaaatagtaataataaataaccaaaggacttcctgctgacctgctctgctttgggcactccaaagtgttctgtggcctctgaacctcagtttcctcatccataaaatagggataataatatacaccttaaagaattattgtgtcccatatctgtaattccagcactttgggaggccgaggtgggaggattacttgagcccaggatttcaaaaccagcgtgggcaacagagttggaccccatctctaaacaaaaagaaaaattagccaggcatggcggcaacacacctatgatcccatctacgcggatcacttgagcccgggaggttgaggctgtggtgagctgtgatcgcgccacagcactccagcctgggtgacaaagtgagaccttgtcttaaaaactaaaaaagaattattgtaagaatttgaaataatactcataaataactagtatagttcttatcatgtcagaggtcctggaaatggggcaactgtcattttttttaatcctcctagttagttttctgctagtctcagaccaccaaggggcattttgttcccatctctcacatcccccaactgacctatcctactttttatcattgcacatgttacaggtactctgtcccttctctgtgagaagctaaactgttagaagattctaatggaaaagaggaaactaggccactagggctcatcacaaatggcattagctaactgaaaggaaaggtacatggaaaatgatgagatcgtatatcacaaaatgtaggtacatgcttctttcatctaactttggggccagactgaaagcaggaatgaggtggcagcatttcctaggaaggaaagacgagctggacaaaaggcatggaaaaactctcagctcagcagaaattaaggagatgcaaataaaaattataaggacatacatgtttatacctaggagactgctagaagtcttaaagtctgaaaaaaatcagatcttggcaagaatttgggagtataaattgatataacctctttggaaaatatggccttacctagaaaaatggggcatgtccatatcctactacccagcaattgcactgctaggaatattcccccagagaaactcttacccatgtgcaccagaagactcaaataagaattttcatggttacattgttcattataacagaaatctaggaacaacccaatgtttgtcagtactagaatgggtagacagttatgataaatgtatacagtgaaacaccatacagttatgtaaacaaatgaactacacctgcatgtatcaacttggataaatcttacgttgtaattttgagggaaaaatgtaaatcacagaagaatatgtatccttgatgccattaatataaacactaaaaaccaggctaacctaaagagtatattgttaggcatacataaatagaatggtaagcctgtagtaaaagcagaggatgacaaacacaaaatatgagaccagtgagttctgagtgagttggcagggctgcagcctggagtgttggaatacctgtattactcagagtcctccagataaataaataggaaacaagtagacagatatttattataaagtattgtctcacatcattatggaaactgagaagtcccacaatctaccatctgcaagctggagacccatgaaaatgagtgaagtagtttgaagccctgagagctgaagaggtggtggtacagatgctgtctcaaggcctgaaagcagggagaactgagagcagggaaagatctatggcccagctcaagtattcagacagagagtgaatgcagccttcctccccctttttattctcttcaggcccaccatggattggataatacctacccacattggggagggccatttgctttactcagtctatccattcaaatgctaatcttggctgggtgtggtggctcacgcctgtaatcctagcactttgggagactgaggcaggcagatcacttgaggtcagaagtttgagaccaacctggctaacatagcaaaaccccgtctctactaaaaatacaaaaattagctgggcatggtggtgcacgcctgtagtcccagcttgggaggctgaggtagaggaattgcttgaacccaggaggcggaggttgcagtgagccaaggttgcaccactgcactccagcctgggcaacagagcaagactccatctcaaaaaaataaaaacaaatgctaatctcttccaggaatgccctcacacacccagacataatgtttaaccagctacctgggtacccattagcccagtcaagttggtacataaaattaaccaacac

SEQ ID NO: 949 - DNA, 2513 bp, Homo Sapiens
acaccggcgtgctcgcaagaggcgggaaagcgttagggagagacgcgggtcgcagggtccctccctctgcctgccctatctacccgcctgcccagcgagcctgtccatcttcagcgcccaggccctaggggaggggacgagaaaggccccgcgcttctgactcatcatctccaacccctttctcgcgcgcgctccaagtctcaggacttcggacctgggccctcctgcgagggggtgcggcgacagcatctgggaagccccagctctgccaagcgtcagctccgagccctcgccagtctctgaagctgccagcgcagggctggggacccagatccagctctctattgcagtggctgggggagcggcacgccagtgcaggaccgcccgcccggctcctccccgaacgcggggccagtggtcgcgtccgagaaagcgccaggctaggccccgacttccccgcctcgcgtcactcagcacatccaacagcgcccctaccgcggagagaaggctctttatttcctagccggtcacgggctagcggggcatcctgggacttgtagtctccgctacagtagaaaggagatggatcgaaaggggaactggggcactcctgaattggattcagggagttggcgtgtgcagggtccgggatttggagtggatgggattatgaaaggtggacagaaaagaaaagtgcgatgaggcaaatgtgaagctgtatggggaggtgacaggaagagaggatatggatgcaagggagaaagcagcttttcagggtggtgaggtgaggatatattctcgtccaggtgtatcttcccctaacagggaaggaacgaaaaaagggcctgctttgagtgaaaactgaaggcactcccggacttcctattggactcgaaggatcccagcaagcttctgagtttggtggggtgggatgcaggaatgtctggagagcattctctcagggtggaaggagagcagcacgtgtctgttcccgctgtcccaccctctcatttgctcctgtgctggccaccgtgggaccattctccaaaccaggaacctcttccaactcagagaagccctgaaaaccagagacaggtgtgagcaaattgtagaggtgagaaaggagaaaccccagacagaaacaactgcttcctcctgcccaattttctatcctgtttcccatagtcctgccaatatttaggcagcttcctaatgctttcccactcttttaacctcaatcatttggattcccagtttcctcttacccaccattaggggagaaatgttcaaagccagagaaagccaatcagtttcattctaggacctcttcttttctctcctgccccattattttcccttaagtgccactgaccaggataggcagtggaaaaattagttggcagctagctattcgtgctttcttccctgcccccatacctcctgcagctcttgatagtgcagactctggctcctgcagcatcctggtttcctctggctcagcaagaatagggcgtgcactgagaccagcactccccctagggtgaaggcctcagcactgagttccagcaccagcaagccagcatgctgcaggtagacagggctgagaatgcagggaccccgcacctgtttgcccctgcccttttcccttcccacctcctcttgcctccttatcctcccaccttctccttcattgaccagtacctgggaggaggcagttggggcaggccccaaggctgtcttcatcacctcgaccaccaccactatgaaacccaagatcaagttgaaggtgttgaatatcatcatggcccgcacctgccagtgagccagctcagccctgcccagcctaggggagtcattccaacctcaatccccacttgcagcctagctgaagacaaaactcagcttctgcttctcagcctccaaacagggccataagccctcttaacttttttgctttcctcctcagtgattgaggccagtcagtggtgacagctgagagaatgagtcaacacttagccacttacttcctaggctgagggttgtaggtgtctgttttagggagtgggaggacagtgctgcgttttcttccctctcaccttccaaaggcggggtgctctgcgaagctccagagtgacagtcccagtgaggagaccctgaatggtgagaagggcaagtgttgagctctggtcccgttaggaaggggccctgggaccttccaccctcccttgtggtgggtcttactgaggctccaggcccaagaggcagcgctgtggccatgtgacaatcagagttcaggcaggcgactgagacagcaaggggcaccacaaccactgccagccatagctggctcacctgggggtaagggtagggtaattggggaggaactgtcagggattccctcccttctcgtaactcctacctctttagagatcaggaaatgggattgaatgcagggtggaggaaagcagtcaacccagagcaaggacgtgatcattaaaaattaagtatcattt

SEQ ID NO: 950 - DNA, 2451 bp, Homo Sapiens
aagctttcagaaattggattgcatttcttgcttattatacatcccttgactattttgtaattgtgtgtatttgtggaggtcacatgtaaataaacttaaagtgactctactttgtgaaaatgtgaaacttcgtgtaggtactcagtaaatcagtaaattcttactaacgttagcccccagcctagctatggagggtgcatgctgagcccgaagcagagagctctgtaatctctgcattcatcaccaccatgaggaggcctcagaagcttctagcactgtttgcaccttccccacatcacccctccctgccttcctcacagtcttccttctgatcagaagaccctttccttctttctctgcctgtcaaaatgctgctcactcttcaaaccctagctcatatgaaagtgtctggtgtgagcccacttttattgagttgattctgtatctttgatacaactgtatgagggttctccagagacacaacaaatagaagggagacgtaagaaattggtttaaaggttcaattgctaatctcatccaaaaacacccttacagacacgcccagaaataatgcttaaccatgtatctgagcacctcatgatgccgtcaagttgacaaacaaaattaaccatcgcagcagccatacatttaaatatatttgtaccagagaacttacctgattctacctgcacttcagatgcttaagacatgtctgttttctccactttccccaaccagattgtatatctccatgaataacctaaatgatcccccaaattggaatatccggcctaattccagggcggatggtggtgatggaagcaggtggaattatgccctgttggttccaatgctgggattggctgcttttcgtaagtcatggttttcttaaaattagtgttttccaggctgagagtgtggagccccggtgagggaggcagcatggtgtgggagcctgaaggccgtgactttgggacctgccagggacagccgagttttatcccctgcagtgaaccgtgggcaaatcacttaagctctgagcctcagtcttcctgttcacaggagatggataatcatacttaacctcagcacactgcaaggattaagtcagccaaggcgtttagaagcattttgtgtggggtgggttttaataacttagttccctctgaaggctttgctgctctcaagtcggggaggaggttccttatttcaggtgccctcataaggactgctggggaacaaaacgggtgtaaaggaaaccagtgggctgggcgtggtggctcatacctgtaaccccagcactctgcgagacccaggtgggcagatcgagtgaccagcctgagcaacacagcaaaaccccgtctctacaaaaaatacaaaaattagcgagtcgtggcggtgcacacctgtagtcccagctactcaggaggctgaggtgggaagatcagtggagcctgggaggtcgaggctgcagtgagtggagatggcaccacttgccctccagcctgagaaacagggttaaaaaaaaaaaaagaaaaccagttttggaaaaccagtgatgtttaatgtttaggaaatcagtctttgggagacttcatccatgaaatctctgcttggcctggccagaaattctctctagtttagattgacttggcaccactttggggaactgtcagtcacatgcagacttacatccccaccacacaatcaattcactgatgcagaggagtgagttttgtgtttcttcacattccatggttctgggctggcacttaggaacatgagaaactgaataattgaatggaagaaaggcaagactgccctctagttgtagcgatacattttgtgtagcggctttttatctgcttcgatgtctcaggtcagaagttttgctgtagaggaagaggaggctggtaagagcaggtggtttttatgattcagtgatctgcgcagtgcttgcttcttggtgaaagacagggcaggtccacatccaatcctaaggggctgccatgtaaaaagctcatccgcctgcaggcttgggaaaaaaacccttaacacttggagaggctactgttgcctgtggctagggtgagtggattggaaggcttaaaattactctgactaatgtaataattaattggctttgaggctgggagaggccctgaagtgactcattttccatttgtttttcagactcatctcaagcttttatagcctttcatgataactttcacttctgaaattcttaccttcccttcttggacttttgaaatgatgctttctgtccctgaaaagggttgaagaatattttttcttcctggttttttgctgaggtagtgtggtcagagataactgttaacttggtgttcttgtaaggattctccaaaggtgtgttacgatgtgtttgaggttctattgcacataagagcgtaaccagccttcagtgtagtc

SEQ ID NO: 951 - DNA, 1564 bp, Homo Sapiens
gtggactcaaaggttttctccctgagaggcagagcccaggccagctgattcatcagtatcaggatggacatggtagaggatgcggatactttgcaggagtgaggggacatcattatgaagcatgagaaggtagagggcagtctgctccctggagggaggcctcctccagtgcaccctggtgaaagggtcctgggctccctaggagcacagagcggggacaggtggccctttcaccctttaccttggacccctcaccaaggctcccactgggttgcagggacaccaagctgggctgccagcagacatggggcctgtgcctgttggaatctacagcagtgctgattgctttgggattctgcatgagacggagctgccccctgtcactacctggaaggtgaagcaaatgtggcaggagatgagatgaaagagcaagtggatggaaatgctgggagaatgggagacatatcagaacagcaaaaaagtcatgaaggagaagggcaagaggtcctctggacacatccaccagatcgacctggacatgagccggacattaaggaaccacctgttcttcagggaccgatatggagtcaagtaagcctatgggagccacagggtcccagtggagatggggtgaaccagagggatggggacttccctggagcagaagccaggatcacccaggagggatgacagagctgccaagagctctcctgtaccagggagcagctggtaccatggaccgagcacctcccaagttccaagccctgggccagactggaacacgtggggccagaacccaggaggatcctgaggagacagacggcggcaaagaaaatcatgcacaatggtgaaaagtgctctccctgacccacagggacccatggtaggacccacgggagggcagcaggatggagggcccatgagcttccccaggcaacactgacaggaccaaaagcagggggagcttggggtcctggaaactctcatccaggtctgctgggaacatcacacggcacagccactttggcagccagttgtgcagtggctcacaaagttcaatggacttgaaccacatgtccccaaagtgtcaccgatattgaacccactgatttgaaaactgatgtccacatgaaacctgcatgccacattcactgcttgattcattgacactcacacatggaggctacgggaatgaccttcaacacgggaacgcagagaggaagggtggtcctcccttcaaatggcagaagattcagagagaaaagggaacgatctagtgatgcccacatgaacatgggtggatcctagatgcgttttgctaagggaaagaagccaggcccaataagctaccacagtaggattcccattcctagaccattctggaaaaggccaaaccatagggaccgagaactggtctgggtggccagatgctgacggatcagggagaggctggctgcataggggccaccctggagacttggaggatgaaggagtcactccaggaggggctggagcagtggccaggagattctgcacatcggtttagaaccctccttgccctgca

SEQ ID NO: 952 - DNA, 16406 bp, Homo Sapiens
attcagaagctgctatttctactgttggttaatgtatttttgtttctaccaaggaagctgtgaaatccgcgtgcacacccatcccaaatctatccgtggggcgggcgcaggctgagtcattcctaggagtaactttataccgatcctcgcactctggggtcgggacaaagacatcatctctccgttcctcccattcggtgagcttcgttcggcctcggccaaactccactctcccgtttctcgagtccaacacagaattaagggctgatccctggcagcgatgagcacaagtcaagatgcgtcttgggaggttcggacgtccctcgccctcggccactccggcaactaggccgggtactaagcggcagcgcagagggagggatcccaaggctccggccgaggaagccgcaggcagccccgcagcacgagtccgacccacacctccggcagcctagtggagcatcgactcgaaccgcttttgtctccacaggggctgtcgcgccgggaaagcggccagtgggcaacacctgccggggcgggaggcgccggggccctcccgtgcacacacctgcgcgtgggccgggctcaggccgaccggaaccctggaccatgcgaccccggcccaccgtgccagggcccgccgcgcgaccgctgtgccagatgggggaaggggacgcgggcggcggcgacacttacccggcaacgcctcctccttcgccggcggcagcagcagagccagcgacccccggcaccatcttccgccgccgcctagtcctcggcagcggttaccaaccgcccattcggcaccgctaagccgacacaaccgccggcgtcccgggcgcccgcccgccgcggccccgaactctaggaggcagggaggggtccgggcggacaaggacgcgagcaggcccctcggctctgggtctggggccgggggacagaaggccgcggcctgtcagagccgaggggcccaggcgactgggggattctgaggcaacgccgagggctcggcagggccgcggacaccgccgcggcttggtttgttattgtcgactccgtctcttcctccgcggcgcatgccgggaaacggcctgccgggggaggggcgcgcctggaggcgcagagaggcgtctacgcaggtccggaagtcggcagcctgccgggaagggggcggccccgcctccggctctccggccggcaggttggctgtcctggcctgaccctgggagactccgctggggccgcctgttatggtgctagctgccgtcccggtgcgtactttcccaaggtgaatttgaccttctttgcgacagctaggccctgactaaggtcgacccaccaaacactggatcgtccccaggcgaaagagagcttgttcccctcagcctgtcgcggaggagcggagccaatcgagggtctggtgtccccgtcgcctctccaggggcaacctgcggactaggccaaggtctgtaacaggataacgtaccagcgcctggcccaggcgttcctgccgccacctccccgcatatccggaccgccgggactgcacgcagctggcaagcgtccccctgttaactctgcaagggtggggcggcaccatttctcagaccaggtaaggcaagaaaacatgcaagagagaagagagggaagcctaggccaatcggaatgaaaatgtaaacgccacaaccacgttttcagctttacaaatactgaatcttgtagtgggtctagtgggttaggggttagcatgagcaccctaatggttgggagacagtttcaggggactcttgcatttgtgaagatgatcagtcacaggcaatgacttgaagccacgaggcttgaatattaaaatctgatgagcagatgttacacgtagaataattacataatagttctcaaattcctgttatatccaggaatatctggtatgagtgaaaacttggaggtgccttctctaaagtcatcaggaattctgagttgtgtttgtaaaaataggaggcacaagagggcaccaaactgaacaaaatgttaggtggaaactgaaaaacgttggttagcatgaacaatttcagttttcagtcacactgaccagtatctgtaagttaggattgagatgggcttgttttatttatttacttttaaatttgtgctgctacatatcccaaacaaatgtggtctttatcatcactggcaagccattttacttattggttaagctggaattttattacaccaccccagcaagatagaggagaaaagcgaaaattaagtagtaaatggttattatgccttaagggaaggtgtgaactggcaagacaaaagagccaaatttagtagtaaagcatagtcatcagcacacagaaaataagtggtgaggaggagtttggccagaaaattggctaagaaaaatggcagtatgaccaagaatgaaaagaaaaagaaagaaaagaaaaactgcagtatgaggcctgtaaagaacgtattggtacttgcacttcctcttattagtgacattcattattacaaatataacccaatttagaatgtaaaaatcttgctggagctcggtgcagtggctcacacctggaatcccagcacttatgggaggccgaggcaggaggattgcttgagcccaggagttggagaccagcctgggcaacgtagtgaaaccccttctctacaaaaaatacaaaaattagctgggcgtggtgatgcacacctgtggtcccagttactcagaaggctgaggtgggagaatcagttgagcccaggaggtcgaggctgcagtgaaccatcatggcaccactgcactcctagcctggacaacagattgttgccctgtctgaaaaataaaaaaaaatttctgaactatgccagtgataatctggtaaattataaatgttgtctgacttttttctttggaaaatgaattaattcagtcctaaccttctctcttaatcacaggttgcaataaattaccagaaacgactggttcataccttatacacctccagtgtaaatgttaagagtttgtatattcttaacagactcttaacaaacatcagtaattctttcctagggataagtgaaaatgtactaacattaattctattatatatatgcaaatatctagaggaaatactgtttataagttactaatacatgtatccatggtagtaggtcttgaaaagttacttttgttgcctattggacaccctctattctcccttccttaataaaacaaaaaaaagaacaaacaaaattctgtagcatcacttctcaaccaagctttctgataggaagtcctcagtccaatctcatttttggcctactgtgcatttcttacttaacttgcaaacagatcattaacaaggacctccaaattacagtaaattacagtactaagattttacttgaactttctaaagcattcgccattttaaattatttaacttttatactcctccttcccttttgtgctgtttccttcctggcgctcctaaatatctgtccattctttggacctcttccaaattttcagataattataatagtgtgcgaatgatgcaaaggtaatgtgccgtgggagagaacagaagagagaaacctaattctggcctcatcacattattgtttttttaaatttaataactattttagatgcttcagtagatttacagtgagggcaaaagaaaacagttttctttaggagtatggagggattatataggatgtacaataaataccctaagtacttcaaatcagttcagatctttaaaatcctatttttccttcagttctcaacttcaatatcacctactctgggagtcattccctaccatgcttgtttgtttgtttgtttgtttgtttgtttacagagtctcactctgttgcccaagctggagtgcagtgacaccatctctgctcaccgcagcctcccaggttcaaacgattctcttgtctcagcctccctagtaactgggattacaggcacttgccaccactcccggctacttttcatacttttattagatggggtttcaccgtgttggccaggctggtctcgaactcctgatctcaagtgatccacccgcttcagcctcccccacagtgctgggattacaggagtgagccacagcacctggccacatgcttgtaatttctttagattctcacattgtatctttcagtgtcatctaacatgctgactataagctcctttttaaaagatgtactgtacctggtatataatggtatgcactcaacaaacatttgacagtaccccacaacttgttcaggccctcaatttatacctgaattgacctcctatccatctccattatttactccatccaagaccagtctaatcaaatctcttccctgcctaacaactttcattggttttgttttgtatactagatacaatttaaacttttttttttttgagatggagtctctctctgtcacccaggctggagttcagtggcgcgatcttggctcactgcaagctccaccgcctgggttcacaccattcacctgcctcagcctcccaagtagctgggactacaggcgcctaccaccacgcccggctaattttttgtattttttgtagagacggggtttcaccatgttaggcaggatggtctcgatctcctgacctcgtgatccgcccgtcttggcctcccaaagtgctgggattacaggcatgagccactgtgcccggccctgggcatgggtaaacttcttaacctagcatgaaagtctctccatgataaggtatcaacccatctctccagtgtatctcccagcacttttctcccctttatatgtgctctatatgagtttcctcatccaggaatgttcttccccacttgttcacctttaaagtcatcccttaaaacacagcttggatgttagcagcttctaacttctagagtttccactcttctattaagctttgctctgtatctcacaactgtaaatttttctctcccctcttagtctgtgaaactcttaagattaagaactatgcattattaatttttaaattcctggaactttatggagagcttggcagtcagcaattaatacaagatttgctgtatgtaatacattctgcaaatttttatatttatattgatggttgactagaaagttactgtggaaaattcctgccatcaaatatctcataggcttgtaaaggggaccattcaaaacaattgcagtaacaaaggcagggtgcagtggctcacgcctgtaataccagctgaggtgggcagattgcttgagctcaggaatttgagaccagcctggacaacatggtgaaaccctgtctctagtaaaaatacaaaaattagccaggcatggtggcgcccaactgtagtcccagatactcaggagactaatgtgggagaatcaattgaacctggggacggaggttgccatgagccaagatcatgccactgcactccagcctgggagacagaatgagactccatctcaaaaaagaagaataataataattgcaggctgggtgcagtggctcacgcctcatgcctgtaatcccaacactttgggaggctgaggcgggtggatcacctgaggtcaggagttcgagaccagcctgaccaacatggagaaaccccgtctctactaaaaatacaacattagccagtggcgcatgcctgtaatcccagatactcagtaggctgagacaggagaatcacttgaacccaggaggcggaggtcgcagtgagccgagatcgcaccattgcattccagcctgggcaacaagagcgaaactccgtctcaaaaaaagaaaaaaaaaataaatataattgcagtaacaaatttatatgatattaattctttaccaaagtacattcagtttattgggaagatcatggtaaacatcttaattttgtcaactctgcctgaggcattcagcacatgtattaaatatttctcaaacaacttagtgtcattaccctaattttcttttaggcaatgttcaaacaaccagcaaccacaattcacataatttggctttattcaaagtatgaggcacaattattgttcatttttaaaagggttaaaaagatgtacgttttggactttgtttttaaaaccataactaatttggtgtatatgattatgtactatttagaggctgctggcactatgatgattaagttaatgttttcagtactgcttatagacctgaaagctgcccttctcagctggtttgtgggtactcaaacatactaataatgatgatggctaacttaggaatgaccatcttcaaagctagtgatgacttgatgagctcataagcaacactgtttccaatgctgcagcaacatagtcaagaaaacacttctagaatgcttaatttcctgaaagatttaaaccaatagattaagacaaaacatttgtagtcatttttcagattgaaagagatatctttttgcatcatgttttattaggttcttgtctttcattattttgaagagctgcctagcaaagtgtccaaaaatagagctggcactgtttataaaatgccttaaggcagaagttaatcagtcatgtagacacagatacagaactgattcaaatgtcaagtggtagttggacttcaggtggtgactttctaacttttactgtgatccacattaagaaatacagtttcacattgtgacctggtatacatacacaggaaaaagtacttgctgcttgtgatatactctgataccttctattgtttttttttcctcttgctagtcttacacattacatcgattttactatcatccaatggtttcagagatattagattcaatgacttaggccccaaaccttgagattctttgttcctgatttttctgtcagtgccttcctatttctgtcagtgcctcagtagtgtttataaataaatgcttctttttttttttttttgagatgggagtttcactctcgttgcggaggctggagtgcaatggcgcaatctcagctcactgcaacctctgcctcccgggttcaagtgattttcctgcctcagcctcccgagtagctgggattacaggcatgcaccaccacacctggctaattttgtatttttagtagagacggggtttctccatgttggtcaggctggtctcgaactcctgacctcaggtgatctgccctccttggcctcccaaagtgctgggattacaggcgtgagccaccgcggctggtcaataaatgtattttttaaaaagcatgacctaacggagctcatgaaacacttatgggtgtatcttagatgccagacatgggttttaaatttatcaacctgtttagttgtcttagcagccctatgcagtttctgtaaattttctttgattttacagatggggcaataaggcatggagtggttaagttgctaattcaatgtacttccttctagttagtgttcttaaattagtaactgtcaaggccaggatttgaacccaggtaatccaattgtacgggctatatcctatatatcctatgcatagcctatgctcccccttaatttggtgctggtcctgcaggggttaaaaaaaattggctcagcaaggtggctcccagcttacaccagtaatcccagcacttggggaggccaaggcaggtggatagccctgagttcagaagttctagacctgcctggacaatgtggcaaaaccccatctctaccaagaatacaaaaaaaaaaaaaaattagccaggcatgtggtggcatacgcctgtagttccagccacttgggaagctgaggtgggaagattgcttgagcctgggaggcagaggttgcagtgagctaagattgcactgctgcattccagcctgggcaacagggtgagaccctgtctcaaaaacaaaaaaagaaaaaatgtctagcaataggttacagagtttctcaatctcatacctaccagttaattctttgttataaggggctgtcctgtacattttaggatgttgaacctccttggcttctgcccactagatgccagtagcaccccagttatgacaatcaaaaatgcctctggacattttgtaatgttcccagagggacaaaatcaacccctttctcagaattcagggaaaacgtggtacatctatataatgaaatactatgcagccattaatattatattttagaagaatatttaaaacaggcctggcatggtggctcacacctgtaatctcagcactctggtaggctgaggtaggagaatcacttgaggccaggagtttgagaccagcttggacaacatagcgaaaccctgtctctacaaaaataaaagtaaaaatatagaccaggcgcggtggctcacgcctgtaatcccagcactttgggaggccgaggcgggtggatcacgaggtcaggagatcgagaccatcctggctaacatggtgaaaccctgtctctactaaaagtacaaaaataagttagccgggcgtgctcgggaggctgaggcaggaggatggcgtgaacctaggaggcggagcttgcagtgagccgagatcgcaccactgcactccagcctgggcgacagagagaataaaaaaaataaaaataaaaataaaataaaaatatagctctgtgtggtggtgcactcctctagtctcagctacttgggaggctgaggtgggaggattgctcgagccaaggagtttaaagctacagtgaaccatgaccacaccactgtactccatcctgggcaacaaagtgagaccctattctaaaaaaattgtaaaaatatgtatattaattttttttttgttttgagatagggtctcactctctcacccaggctgtaatgcattggcacacccacggcttgttgcagcctcaacctcccaggctcaagcaatccttccacctcactgtccctaatagctgtaactacagatgcccaccaccatgcctggcaaatttttgtattttttgtagagacagggtttcaccatgttgcccaggctggtctcaaactcctgggttcaggctctcctttcaccttagcctcccaaagtgttgggattacaggcgtgaaccactctgcccaaccaaaaaatatttaaagacaaaggaaaacaaagtagcaagctactctgttttactatgtttcgtattttaacatctctgaaatctgggtccatttaacagtggatggatagtggtcctccaagcttgtcaaccaatgccatccatttcctgtgcttactataagacatcaaaaacaccagattggaaaaaaatccaaactataatggtgagagaattgatgaataagatgtgttgtacaacattcccaaagacagctaggtacctagcaccacagctttagttcttttatggattctgtaaggaaatgcttgttgccagtgctttcagtgctgcaaaggataaattctgtggaaaaacccagacaatctctgagtcggaagtaatagttcaaaagtgatgaaattttagaaatacctttaccaatgtaatttgcttgtattttcatttttatgtatgggcaatataataaaaatgtgtctaatgaagtctaagaaagctttctaagtaagtacaaaattaaattctaagtgatttttcctatgtgtatatttttcttcattttccagactacatatttttgaaaaatgtaccattagtcttttgtaacttaaaacgagttctgttgtttatcatataaaatgaatgcttttttcccaattctctgaagtccatttattttaataacaccatttgtttttttgccttcttcctcaaatgatccctttgttttaatcaaccctacctgctatccattcatgcaaaatacttttcccaatagtcattccttttcagtatgatgtattaaaaggaccactgaactgaatgtctggaaacgtgggttccaattctacctcagccttctgtgttgtttccctagtagttcactcttcctactctccatcagattgtctgcactattcttgaatccctaattcccaccccttcccagttctctctttggtaaataatctcacctcctacaacactgaggaaatagaagccatgagaaaagaacttcctcttctgccctgaaatctgcaaacctatttgcatccacaaattctctccaacagtcactattctgtcccttctatttaaggtagtcgtgggtttttgactccatctcattttaccatctcattctgtcattctgtggaaccacttactaagtacaaaatttagttcatgtgtgacataccttacaaaacttaaatatctttaaaattgaaatttatccggtttcattgtttattcatttaaaattaaaaatcaagaagtaaaacactctatcatcaatatgatttagtagaaacaaattatatcttgtagatgttattgaaattcacttattagttgctggacaattgtttacataaaatgactttttaacaaagggtcaaagttaaaactcctaggcagatctcaaaactatcaagtagtatagattttttctttttggttttgtaatatttgtgtggcttttttttttttaacttttaaattttgactgccttgattaaagtttcagttaaaaaattttgctgtcaatttcttttctaaccattactattattgttgttctattgttactgaaactatagaggaatgggatgttaaaaaattatctactctgagtgtcaaatacacttcaccactggcagggctcagggctcttcattttttaataagttctagggggaattctaatacaaggaatggctttgagaaacaagactaaatttttaaaaatcctcacagtcctgctcaatcttctttctgtcaatagatgtcgcccctcccttgaaataagctcctcagaaaaatcctaatctacacacaaagctttctatgtgtttgtatgcttattatggattaatttgaactcatataattctcagatgtgccttaatttttaaaatatgtgtatatagtttatacacatacatcataagttggctgcattaaggagttggaaaatctgggacttcatttggatttggaaaatcagttaacatctataaattcaagttcctcattttgaaactgtgttggcaatatctactttagctacctcacattgttctataggttagaatgaaaaatcgcatgtaaaatatactgtagctctgacatttgtacggtccctacagaaattttacattagccaatcaacactttttgaaaaatctaactccagtggtttttaaaatgtatgaagtgcttgtattttagtacaaacatctagttacatttaaaacattttgtgaaaagaattgccataaaatatttttaaagttcacatctttcttaccgtttacattcatgttataggctttttgtctcctctcctttcatttttttctactcccagagttctggaagctgaccaaagagatacttgtgtgaaatgcttgtattttccctaccatatttaaggctctcaagagcaattttatgctcctgttttaagattttttttaaaaaaaattcaatatcaccaagaaatgaactgaaaatgacaggttttctggaagaaggttcagctaggctttattaagaagttaggaggccaggtgtggtggctcacgcctgtaatccaagtactctgggaggccaagacgggtggatcacaaagtcaggagatcaagaccctcctggccaacatggtgaaaccccatctctactaaaaatacaaaaattagttgggcgtggtggtgcatgcctgtaatctcagctacttgggaggctgaggcagaattgcttgaaccagggaatcggatgttgcagtgagccaagattgtgccactgtgctccagcctgggtgacagagcgagactccgtctcaaaaaaaaaaaaaaaaaaaaaaaagttatgatatgtcctcaacacagtgggtagtacagattcaaaataagtaaaaatgttaaagtccacattaagtgactttaaaaaattatctttttcctatttcatataactgcttcagaagtattgtttttacttgaaaatattttgttgtatttctgtacaatagcaataaacaattaaaatgcaattgagaggccaggcgcagtggttcatgcctgtaatcccaacactttgggaggccaaggcaagcagatcacttgaggtcaggagttcaagaccagcctggccaacatggtgaaaccctgtctctaccaaaaatacaaaaattagctggatgtggtggcaggcatctgtaatctcagctactcgggaggctgaggcataagaatcacttgaacccgggaggcggagtttgcagtgagccaagattgcaccattgcactccagcctgggcaacacagtgagactccatctcaaaaaaaaaaaaaaaaatctgtgaaacattctcttcccaatttcaaaacttttctacaaagtcacagtaatcaagatagtgtagtactggcataagatcagacagatcgaatagaattgaaagtccagaaatgaactaagtttaaagtcaattgatttttctcctgaatcaaggactagcaaaaaataataataataaaataggccaggctctgtagcacaggcctgtaatcctagcactctgggaggctgaggcaggaggatcgcttgaggccaggagttcaacaccagcctgggcaacatagtgatactgtctctactaaaaaaaaaaaaaaaaaaaaaaaaaaaaaaaattaaaaattagccaagcatggtggtgtgagcctgcagcccagccacttgggagtctgtggtgggaggattgcttgagctcaggaggtggaggctacagtgagccatgatcatgccactgcacaccagcctggtcgacagagcaagacactcaaaaaacagaaaaggatatttcaaaggaggaaggaagagccttctcaataaatagtgctgggaaaactgaatatccacatgcaaaacaatacagtggcactcataccatagacaaaatgatctcaaactggaccaaagactttaatagctaaaactataaaattcttagaagaaaacaggagtacatctcttcagctttgtattaggcaatggtgtcttagatattacactaaaagcacacttaacacacacacacaattagataaattggaccttatccaaattaaaaacttttgtgcttcaaaagatatcatcaagaaagtgaaaagaggccgggcatggtagctcatgcctgtaatcccagcatttggggaggcatcagtttgagctcaggatttcaagaccagcctgagcatcatggcgagaccccatctctacaaaaattaccctatgtgggggctcacgcctgtggtctcagctactcaggaggctgaggctggagaatcacttgaagccaggaggcggcagggctgcagtgagccaagatcaagccagtgaactccagcctgagtgacagaatctaagaccctgtcgcaaaaaaaaaaaaaaaaaaaagtgaaaagacaaaacatagaatgtgagaaaatatttgcaaatcacataacaaataaggaacaatatataaacaattcttccaactcaacaataaaaagacaacccaactttaaaaatgggctaaagatttgagtagacatttctacaaagatatgcagatagccaataagcacatgaaaagatgttcaacctcattactcactagggaaatgcaatgaaatcacaacaagataccacttcatatccaccagggtagtcaaaattaaaaaggcaatagcaagtgatagtaaggatatggagaaattggaacccttgttagtgggattacaaaatgttgtagccacttcggaaaacagtttggcagttcctcgaaaggttagagagttaactacatcgcgtagcaattccacttctagagaaatgaaaacatacatcacaaaaaaaaacacaaatgttcatacagcattactcataacagctaaaaagtggaagcaatccaagtgttttctaatgttgaatggataaccaaaatgtggtgtatccaacaatagaatattatatgtgatagaagagtttctgttcctcaaataataagcatagaatgactacgtgatccggcacttccactcctaggttatatactcaagataattaaaaacctatgtccacacaaatgttcagagaagcatacttaagtaggcaaaatggaagcaacccagatatcaactgataaatgcacagaccaaatgttgtttatccatacaatggaatataacctggcagtaacaaggagccaagtactgatacttgaaaacatgctaagtgaaagaagtcacaaaaggccacatattgtatctttacctttatatgaaatgtccagaataggcatattcatagacagaaaatagatgagcatttgccaggggttggaggaagaaagagaagaatgggatatgactgctactggacataagatttcttttgaaaatgatgaaaatgttctgaaattagtggtgctagtttcataacttgatgaatatactaaaaaccactgaattgtacactttaaaatgatgactttttggtttgtaaattatatttcaataaagctgttattttagaatatttaattatgtttttaaaaataagataagcatgaaatcaaccaagagaatagccacatacgaacctgtggctagctctggttcatttacgcctcactgaggtggtactccagaagaagaaatctaatggagcaatgaatgatagccaagatggggtggggtgtccgagtggttacccccgggtacagacgataaaggagtacactgtctatacgattgccatttagcaacaataaaaataactagaatcagtctgcttttattatcacctttctgccatcaaatcctaaacaatgtcattgaaaaaataaactctcacctcaaaaacctggttggtccaagccagggtttctcattctgttgtcattttgggccaaataattgttgtgggaggctgtcctgtgcatctttggatgtttagctgcatccctggcctccacccacttgatttcagttgcactccccacaatggtaacagccaaaagtgtctccagacattgccaaatgtcccgaaaggcaaaacagccaaggttgagaaccattgatttaagttctaaataaatgctgtgattgtctattgaattttagtaacgtgtaagcctcaaattagcacattgttattgcttatcttttaattatactctggggaagttaattcaaagaactcttgattatacaactggtccccaacatacaaggactcggctttatatgtgtgttggtattgaaagtacattcttaacagttctaaattgtttcagcttgttttgtgcacagctcttatctccaacctttggcactatagaaatcctagctttaaatagcagattcataatacacgatagcgccgtgattgtaaaggtgtcaaaacaaattgaataacttcagttctgttattgtataatatatacacaccattttctgagacatataggcagagttccctttctcttattttcacatgtctccctgaacctttaatttttttcaaaaaaacacattcatgtaatggaaaagtattaatttgtttccttttttgtactgtattattttatttacatttttatttgaaaaaatttaatgatagttacaaagtaaaaatcaataaaatatttttcagtgtcttctttctggtctgtatttcatttcatgacttaaaaataattttctcctttagaggaggaagtcatttaaaatgatctgtactaggtgtcaaatgtgctaggcacaccactgatttaaggaaagagataaagtacaccacgatgaaagtagaaaagaagaaaaagtgcattaagatgaaaaagaacataaatagatgaggggccaaggaatcgaaggtgagaaagcagaaaattgagagagaccaggaggcaaaattggcgacttctgaaatgagtagattatttaattgcatttgttctgtttttatttccttatcctttgtttgggcggtgggctaaggtctgtacattatcatctgttcttcccacacatttgaaagattagttgccaattaattactatttttaattcttcaactgctctgtagcttcagctgtgccttgccctgatccacgtcgttgcagaggcccaaaaattattctctaggtgctacgaaggaggaaagaatgcccagaatagggagctaacaaaattgaatggatatgtgtgagatattaggctagatgctttacataccttattccatctctcacaacaaactgcc

SEQ ID NO: 953 - DNA, 1112 bp, Homo Sapiens
tagcaatagactaagaaacatatttgtttgtacaaatgaatatcagggcacattatggttagaaactttaccccaagatgtaaagaagtgattcttgagacatttggtctcattgagcaaataaaggaccaaaaaaaaaaaaaaaagccttagaacagtctcgatatgcaagactgcgatgtgcgatgtacaggaatctcttagggagaaattcttggccagaatttacaacttgttccctattgccacattgctttattaaattggtgtaatggagcatggatttttttatattgtcatatgcagtgataatctaaaattctagagctatgattcatctctgaggatgttttactcatattgcatctagccgccccctacattaaaccaagtgtttgagaagagtttcaagaaatcttaacttcagaaggagttttaggaagttcctattgcaatctctgattaacgtggaaatccattctcttgataaatacttccactaacaaagaggcctctctttaaaagattgtccattccttttctggagagttctaaaagaggataatcaaaaggaaagacccttctttcactggaatttatgtcttagtaagtgttcatttcagatatattcacaagtaaaaagagagtaaactctaagactcaaaaatgggccatttctatgaaataaggacacaacagatcgaagctgaaagatttgatcaaccttatcaattgttgaaagacaagtcttatagaaggaagctcggccaactccaaaactgactcctttccaatgcttagtgatcatctggacacacttgtggaatgtgacattttggtctaacacaagcacagaataacatgtagcatatacccaaatgaaatgaatcactagcgaacggatccttaaagtctacaaaaaccaaccacagggctgtaatgaaagaaagtgatgacagacaagttataacatacagccagccaaattccgaacacagtattttggctgactagtcttggacatgggaagaattatgctgttcaatttacaacttattaaagagggaaagaagtcatcgatacagatggttggttctatatcaaagaagact

SEQ ID NO: 954 - DNA, 13231 bp, Homo Sapiens
ctcctgggccgggctctcctgagcgaagagcatcgggaagaggcttccgcggcagcctgcggcccccgcccaggcgaagaggccgggaggagaggagattcccttctgagaacgttcattgagcgtcgatgtgaaggccacggcattgagagacttgacaggatcttgctttgtcgcccaggctggagttcagtggcgcgatcacgactcactgcagcctcaacttctagggctcaggtgatcccccaccacggatcacctgacccaccaccacccccggctaatctttggtattttttgtagagactgggttttgctgtgttgcccaggctgatctcaaactcctgggctcagtgatccaccctcttcagcctcccaaagtgctgggattacaggagtgagccaccgctcctggcctctgagttcttctcatgggaggctgagaaaagtctgggggtctgggacagccagggccgggtttccccttccaggcaatgagaaagaacaggctctgcctcccaccataagagtcaatcccaagttccagatgtgtcagggaagcgatggagagccccagacttgaggcatctgcagacaggttcctgctcagacatccacgtggagggtgttagtatcctgggagccttcagaaccttgaagcatgccagcagaggagaatgagggaagataaaatcaaagtgacttatcacaattaaggaaatgtgctatttcatgtacaactgtgtgtgaggatgagattcctacctgccatactgaggtattatgataagaactaagagagtccaaattcctacaggatgaacagctgagggagcgatgcattccttaggaaggagtttagcttcccgaaggagacggcagctgagataggttctgagaaatagcattttcattggttccccgggcgccgtggctcacgcctgtaatcccagcacttcgggaggccgaggtgggtatcacctgaggtcaggagttcgaaaccagtcaggccaacatggtgaaaccccatctctactaaatacaaaaaagtagccaggtatgatggcgcaggcctataatctcagctacttgggaggctgaggcaggagaatcgcttgaaccttggaggcggaggttgcagtgagccgagattgtgccactgcactccaacctgggcaacaagagctaaactccgtctcaaaaaacccaaaacaacaacaacaacaaaaaacaaaattgaatgttcactggctgagggttagggtgggtggagagaaaatgccagttgtgtggatctgttgatgtaaaacaaaggcctagagggtggtaaactggaagcagttcaatgggacagtgcttgatgggactttggaggtgatgaggtttgatatagtttggatttttgtccctgcccaagtctcatgttgaattgtaatccccagcgctggcagttgggcctggtgggaagtgtttggatcatggtggtggatccctcatggtggatcccagttctcatgagatctggtcatttaaaagtgtgtggcacctccccaccacctctctctctcgctcgcttgctcgctcctgcttttaccatgtgatgtgcctgctccccctttgccttccgccatgattgtaagcttcctgaggcttccctagaagcagatgtcagcattatgcttcctatacagtctgcagaactgtgagccaattaaacttcttttcttataaattacccagtctagatgtttctttatagcaatgcaacaatagcctcttatgagtttggaaagggatctgagcccatatgccaaggaacttgcctgccaaatctggactttatccttcaggccctgggagaccagtgagagggtggcataatccactcttttggaagggtaaatgtggctgtgtgaagtgttggtaggggaaggcagggggtgggagatgagcatatcttgctgcctccttctacctgtcctccagcccccttaggcctgaccatggctgactttgcatccggtagctctgagatacagtgcctttgccaaggaccatatttgaactgatcattaatcaattcattttgcagatcattggtttaggtgtactcaggagaccaacaacaatatcttctctttgtttgacccctcctgtgtcacatgtatgatcacagaagagaccatgtttttggaagagaaacagaactggctttccattgaggcaaatgagggggctgccccatggtggagacacacagaagggtgggagagggactctatctttcattggaatagtctagtaagttaccagttctaacttggcatctaggacatataaatcatgcatttacttatccagcaaccttttctaagcaccttctctgtgtcaggccctgtgctaggtggagctggaagatatagctcacttgcttgtaaggaacttgaagtctgtgtgggggacaaatgtataaacagaaaattacagttcaccatcttagtgttccagaggaaagaagcacttagtatgaggtaccaggaagaggtggggagaagggagtggctttacatccttaagttctgggtgtttgaagagcagccttagacactagccacggaggtgggcttgggtaggccccgccgtggggtttgaagacccaaaagatgttgggtcaaggaggacatgggtgtctagtgtgggagcaagcagaagggtgagctcaccgaagcactgttttacccactgtactacgtttctattgctgctaaaacaaattgccacaaacttagtggcttaaaacaagggcgttatcttccagttctggagggcaggagtctaactcaggtctccctgggctagaatcgaggtgtcagcagggctgggttcctttctggaggctttgggggagcatccatttccttgccttgcccagcttctagaggccacctgcattcctgagttcatggctcccttctgtcttcaaagccaacaacagtgggtgagtcactctcacattgtttcactttgacctcttcttttatttttctgagacaggatcttgctctgttgcccaggctgaagtgcagtgacatgattatggctcactgcacccttgacctccagggctcaaatgatccttccatctcagcctcccaagtagctgggactacaggcatgtagtaccatgctcggctaatttttctattttttgtaaagatggggtctcgctgttgtccaggctagtctccaactcctgcgctcaagtgatcctcctgccttggcctcccaaaatggtgggattacagacatgagccaccacaccctgcccactctgaccctttctgcctcctgcttccactcttataaacgtttgcgatgacattggacccacctggataaaccaggacactctccctattttaaggtcagcagattaacttcctgaattccatctgcaacttttttttcttttttttttttttttgagacagggtttcagtctgttgcccaggctggggtacagtggagcaatcatggctcactgcagccttaacaacaactgggctcaagtgatccttctgcttcagcctcctgagtagctgggactacaggcacgtgccacaacgcccttcaaattttattttttgtagagatggtgtttccctatgttgctcagggaagtcttgaactcctgggctcaagtgatcctcccgctttggcctccaaaagtgctgggattacaggcgtgagccaccgcacctggcccacaggcagcttaattcccttttgccatgtaacccacatattcacagcttctggggattgtgatgtggacattgggggaggcactgttctgcctcccacacccactttaccttcagggtgaggtctcggcctggcctatcctttcatggtatctacctgtaatcatggggaaaagcctttaaaaattaggcaagggaattaaaatcatcacgataagtaaaagcaggcaaggaacttgctggaggagaacagagatagaataaggcagaagtgtctatgtatggggggggggagtcaaaaggggtggtggaggtgattgaggaataaacagatatgaattgcttatttaaggcttgaacctggtgtcatgagagaaatggtggtggtctcaaaaggggccatggggtggggccacagaagagacacggccccatctgcatgttgaccatactcagggtggtgaggaaaccagcgctgtcctgcagctgggggaacctcagtggtctttggggatgagccctgaacctcaagtcaagaagtgtgagttctagtccaggtttcagccacggtgattgagtcatgcacgtgggcctctgacccctcatcagtaaaccgggggctggtctagatgaccccaaggctctcacattcatttctgcactcttggtctctgctgggcttctgggacatcggttagtatggccttttgttaggcacatgccaggactggggctgtgcaggtgatgtggaagggttcctgattccctgttcccactggagcctgctctacagaaggaaccccttggatgttgctgtcccgggcttcagcactcagaactccttgctctttgtggccatcccagctctctctgtcacgtgagcccttgtccccagctgaatcactatgatgagttgtatgagctttgacaacaggtgggggatgacatgcagtccccctgacccaaaggagactgaaacgaagcacctcttggccaggccaccacggtgccccacagccgcttcaccggctgtcccttgtcatggccacgggcccagacctagttcctcctcagtgacggggggttggggcccctacctgccctcagagccctaccaccagtgttgggcattggggctaggctggagctgggctctgagcccagagctggtggtggtttccaggcctgtgggagggtgacagtgaggctgtgctgccgctatcacctccggagagagcggtgcatgggaggtggaaagcactggacctggactgtggctcagttgagggacacatggcatgtacttttaccacacaagtttatttaaataaaagtgaacacatatgcaggctggtgcccgaggggcagggggtggggagggcaggtgggaagcagacagacaatggggtccaggcagagtttgtgtggtgaaccaggctgctggagggagtggctgggggcctcagggcagcgctgggattcagtgctggggcagggggccttgggtgggtgagcctggtgccaggaggtcatttccatccctcacatgcccccctccctttccctgaccccctgggcctacagcactacctcctcagccccctctccctctcctgacatcagccttccccttagctactgagaagccaaaagacaaaataaattagaatgggtgagtcctaccccagcccccagccatggggaagggaagccaagccaggcacactgcgccggagcccgtgctgtcagctctggaaaagaacaggtaaagtgcaaggagaatccagtaagtaaaaatataccaatgactttgtcaaatacacagctgctggctgtcaggagcaggtggctggctggggcgggtggcagcagcaccctgggaagtgttgggcgacacagcagagagacaacggaaataaatagggtgggtgtggacaggggtcccaccaactgggccagcaccacccaggacgggcttctgcctgctttccggccccatgcccccaagcccccctcgcctggctccccagtgctgcagcactgacacaaagcacccggccgaccgtgttaggaaaggactataatgtgggagtggagcagggagggaggcacggggaagctgtgcagtcagccagggctgcggccgccctcagtactcgtcctggtcttcttgttgatgctcttcaatctcatcgtcctcagggggtgcgaatccttcctggagggtgggagagagaggaaagtggtgggccaggcaggccaggcagggcttctcaggttctgtaagtagctgaagagcaaggggtcaggagtccaggagccctgctaatgggtgaccctgggctagtgacttcacctctctctcatcagtaaatgttctccacggtcccttctggccctatcgcgcttctggtcttagggccaggccagactggggagggcccaatgggcctgggagtgctcacctctgtggcatagaggatgccaatgatgcctgagataacagggctgttttcactttcatgctcctggcagatgagctcgatgtcacgaagtttgctgaagtagaagtcacgttccttctccagcccatccactgtcagcttcaagtccaccagctgcttggggacaaagtgatgttcaagccagaggtccccacctcaggttcccctgcctgccctcctctcgtccctgcagacaccccaagggcctggctttggtgacagggctatctcagctacccttacccatcccactcacctgttggttgagttcaagaatttgggcatcagtctcatggccgccatttcgggctgatggaggattcttccggagaatgcaggggggggccacattgctcagccggccagaggtctgcatgttttttgggcctgtgggggacgtcctctgtggaactgcccagaggaaaagagtcaggtaagtccacgtgagcccacagcgcacgtggcaggagacagcctggtgtgaggactgcgggggcaggcccatgcgacaggcaggcactctcacccccctgcccccaccccaggaagggcatctacagctaggccccgagtcttggccacatggacactccagcagctgggcagccctttggcgagcccgggagagcagaaactatagggaactaaacaaggtgtgaggtgttggggcagggagagagctggcctgagggatagaggagagaaattaggacgcaaatttggggaagtagagttggaagggtgcgggaccctctcgtactcatagctagaggaaaggcagctggcacagggtctttcctaacagaagccccagcccaaagccattgtccctgggtggctgcccctccaggggccctgtgtcaggatgggctcttttgccctctgctgggctggaccaggtatctgcacagtggtggccaaatcagggaccccagctcctccccagcgcagccagcatgccgtggcgacttgctcactagcgactgcacctccctagacagagcgggctgcttctagtgcaaagcaagcaggcgggcgagtggggcaggcccaggcagaacagcagtgcagacagaggaggtggctctgctatgacggggtccgacgcgggctggggctgctcctctcccttcccctcccaacgctgctgcttcccaaaggccctattgcttttctcccttcccctccaggacccagacaaagcctcgtttctagagactcatcttttgaggacttaggactattgggcctttagagtggggaaaggtgtgatccagcttggcaactcctgcccctggccatccagggggcagggggcaagaaggggctgtggtgctggcaccaggctcttggtctggatgcacctggatggagaaaccaagccaccttgctgccccatcatcttgaggcaaacaagttagctcgtgctatgaaacaaagtgccttgggcctcctaccccagttgccaccatggctggtgctggtggctctcctcttagaccaatttgtggagctctctcacccactactttcactcccccggtctaactggccagcaggcggcgtcatccgaactccgtgataacaagtctcctccaggctggcagggccgggccgtggcccagggggcactcctggctatagaggcctgccggcccggccccccacgctccctcccccggctcgggcacgttacctgctgtgccaatgagtttcttggatttgttgaagatctgatcacctgggttaggaggtggcgctacgtcctggccctgccgcgccagcagagggttgtaatcctttccatcatagtttgcgtcaaagaatttcttaaaccactgaataaactcaaaattatcttggaattttcctttcactaatttctctacaggaatgatctgaaatagaccacataagcagagtactttagccacctgctgctgtaggaccgccttcctctgctgagggccactgctctcaggaaagccagcccctgggctgcagcgtcctccaccttctccacttgcccccctcccacggcaccagagcagacaggtaggctggtaggccctagtgtcagatccagaggcatcccttctctacaggcaccgtgtggaagaactgtgtggggaggcgtcccttggctctactgcctgcgtgtgggctgggggtctgcagccaccgaggcagtagagtgagcagagacactttcttgggccctacagagacagagagaggtggaacttcacaggagcggtgcacagagctcagtgttggggtgggcagggtccagagaggaggaagggaaaggaatgttgtcatgatggcatggcaagtgttgtgggcttttccattgtgccttgagcagggggaaaattccctctggagagtcgggaggtggagggaggcacgagcaccggaatgaccccagcagccccagttgcctgggctggtgggtcctcttcttccccagggtcacactgctcctcagggccccccagagcgcaggcacctactttgtcaacacccatcttcttgaaagctgcttgcagcaccttgaagttgtggatgtattcgtgctctagtttggcctggaacttcactttcctcaagtgcacacagccggggaagagcatgtccatgaactggcagtaggctgcccctgtggagaaggatggctggctgaggggtcttgctgctctccttctgtgagctgctctctctcacttccccaaaccccgtctcctcttctctctccttgttctgggccagggaccagtcctactttcaggatagacatggccagaatccccccagctttccaagaataaaagcaatgactatttattgatgcgtattatgaaccagcaccacaccaaacactgcatgtaggtagggcaatcccaacaggaactctagttagttggtgatactatctccatcttatggatgagaaaactgaggcctagggcagtatagtgacttgcccaaggttgcaccaccagaagagctgagagctggacccagagaggtgtggtcagacctgtggctctgctgccatcctggctctcagctccccgctcctcctttccctgcagtccttcatggtgcctctcctgctcttctctttccctgcttccatttcttgacttcagctccagacagtctgactagttcagggcctccagctctcctccttaatctaatcacaagctacagctatgggctgcataacgatggtttggtcaacgatgaaccacatatatgatggtggtcctacaggattataataccatgtttttattttattatcaccttttctatgtttaggtatgtttagatgtgcaaatacttaccatgtgttaaaactgtctgcagtatttagtacagaaacatgctgtccatgtttttagcctaggagtagtaggctataccatatagccgaggtgtgtagtaggctacaccatccaggtttgtgtaaatacactctgtgatgttcacacaacaacaacatcgcctaaggatgcatttctctggccacatcagtcattcagccatgcatgactgtatattccctgttgtggctgctctgccttccgacctttctttcctttccttccagcagggccacttcccatattcccagcctcctacctgaacaaagctgttctatcttggtatagttgaggtgcagggagtcgttgacccatgcaagcatatcatggcgactcagattttcactggtcacagatgtggagtacacattgacggccataccccagctggaaagcaagaagaaaggtgaggtcagcactggggcctcatgtagctccttagctgtcaagagagaggggctgtatgatactgggaagtaagaaacattccctccagattggcctcgcagtttatccccagagggagggtctttattccttagacatttcatgagcatctactatatgctagacgtgcaccaggagccagtaattccaagttaattaagaaatggcctctgccttgaggcatttacagacaggcagatcccctcagtagggagtgatgaggcagtgaaacaggcacataaatgttcagggacagcacaaagaagggtgtgagcgcatctgctgggcagggtcagcgaaggcttcagagcagagatgttggagcctgagaagaataggaattttccagacataaaaagggatgggtggaaggcatttcagccacagggactagcaagaacaaaggcagagcttattccgggcactctgagtcgtggagcaggcccggggagcagatttttctgttggggtgtggcacaatgaggttggcagggacaggttgccaggcccttgtttaccagaaggaggaatctggactttctatttggatgacaggaagccattagagggttttaagcgacagtaacctgaccagatttgtgttttagaaagccagctaacctttgcctctgctccgacttcagactccacattcctgtggctgatgcagaggcatctaaattctgcttgtccacaacctttccttagaatatgcttctggctcctgtattcattatcccagtgaatgtcatcaccagcaattaatcaccaccttagaaacctgcggggtcatcccagacagcttactctccctcatgcacctatcaagtcattcctcaagtcctggaacccgacttcctcaattcgcccttttctgcttaccctcaggatttatgcataccgttgtcccttggtattcatgagggaatttgttccagaacatctccccataccaaagtcaatgcacagtcaagtcccttatataaaatgatgtagtatttacagttaacctacacacatcctcctgtatgatttaaatcatctctagattacttataatacctactaccatgtcacttcgatgtaaatagttgttatactgtattgtttaggaaatcatgacatgaaaaaaaagtctgtaagcaatgcaacaatcctttttttttcctgaatatttttgatcggtatttgattgaatccacagatgtggatcccacggatgtgaagggctgactgtattttctctctagcccaggctagcaggagcctcctaaaaggccttccagcctccagtctctccctcctcttaatccatccttgacattgctgtagtcagaatctacctaaaagcaggtctggccaccgccctcccccacttcaagtcctttcagccagcagtcataaaagagacactccttggccgaatttgccttgcagacttaaactgttcagcactcatagtgttggaaacagttttgaattagtgcccaatattttaaagttcagatgtttaacaacttgggatttctggcttcttttggccactctgaccctatgctcccgcactgaaaccagcagttggagtggagccagcagtgagcctccttcccaccccagaggccaagggtcagctgctgctgctaactgacttgcgctgttaagaaaaggacatatttcttgtaaccacatctttatcagaaatggaaaaacaagataggtcaaaaggactgtgttttccgagaattgtgaggacatgtgtttctggagtgagtgaagaatatttcttcaggtttaatatgtaaagtgtctctgtgaaataagatacatcttatacaccttatattcttacagaaagaatatttccctgcctgtcgcaggcatctgctgttatcatgtgactcctcctgaccacttatcaaactcataaggggaccccacctcttcagccttatctcctactttgattccccagttaggagctataggcagcttcctactcaccctctgtctggaatgccgtccccaccccaaagttcattcattctctgttccatggttctcaattgtggccccagacctgcgcagtgggactatatggggatcagctggttagaaattccaattctcttgtcctcccccagacctaactaaatgagaaactgcctttgaccaagatgcccggaggatctgcaggcacagtcctgtttgagtagtactgctttagacagggaggctcagcaaggcatctgcagagctgtgtgccacttacgttcccacccctgaccccaagtacataggacagagcatgtttaacttaaatgaatgctttgaagaaaaatcatgagagaaaaccctcttctttattcctagttcttcctcctttgaaaaataaaccttgtccttcattgcccaggcaaagggaggccaggcggggccaaaaagccaagagaaacagaaatgaattattgtcttgggagcgcctaaagactcaagacctggcaatttcagagctttccgagagtaatgttgactgcacttgagtttcctcctccacaacgtctctgcgcccactgccctgcatcttggcccttgcgctcaccattggacttgtttaaatgcctgcgccccatgtcttgaagccaagagtggggtatccaggcctgtcacaggcaagacgttcagtaacgttgaaccattgagtgatgcctcatgtcctctcctctttctgaatcatgtctcatcaccttctggcctgggtccccctgccatccccctgccatacccccaccatccccccgccatcctccctcccccagcactcagcctcaggactctgctttagctccaggggactttttctgaccccctctgtgggagacatgtgcccatgatcctacagcaccctgggcacggctcttcatggcatcccacatggtctgttgaaatcatgtgtgtgagagcgggtgcggtggctcatgcctgtaatgccagcactttgggaggctgaggggggtgccgatcacctaagccaggagttcaagaccagcctggccaacatggcaaaaccctgtctctactaaaattagccaggcctgtaatcctagctactagggaggctgag

SEQ ID NO: 955 - DNA, 748 bp, Homo Sapiens
tctcaaaatcacaatgttaaaaaaaaatacaacttttgtaataacactgaaattcagtctgttgatcttcttataacaagtatagctaactaatgaggacatgaaatcactaacacagttgttgtctgcttacgtaagtaaaacagctgcacaagctgtgaaaagtccagagaaagcacgtaaaatgatccatcacacaaagtccaccattctttcccaaatccttgttacagaaaaccaaccaacaaacaaacaaatcaacaactcattctctagaagtacagggtgggacatggcaaataaagaaaataagctggcttgtgcaggccacctgcctgaaatatgaggtcatgattgtcaaacacatttggtcaactccagtaacttcagttcttcacaaagagaaaaccagtcattaaaccatagtggagactttttgtttttattatttttgtttttattatgttttgttttgttttgtttagactgtgccgcaatggcacaagatctgttcaggaggaatgtgacattaaatgcagctttgactttctggaggaagggaggtataaatgaacctatttggtaaggagagataattttagagttatggtggattgcctgcctatgctctctaatcactgacaggaaaaaaaaaacagtacatctcactcagctgctgtgaatacttggtgccttagtatagtcatctcttaaaagcaaatttgaagaatatggaatagttggtgat

SEQ ID NO: 956 - DNA, 1491 bp, Homo Sapiens
gttgacagagagttgaagactcccgtgcttctgggaatagtcattgtgagcatgtggtcagcccggttgctagaattcttcccatgagcagcttcaggggctgactgtggcctcatgcccagtacctttagccattttaatttaccaaacctcattgtcccattctcttttcaggttcttggccataaaatatggcttttggaaaaataaagctgagacttggagttcacggtgggggctcccccatctgtgaacagaagcagaagtttggaactgccttctttactgctcgagagggaaaacttgagtgaaaaccaggatgctggcgaatgttgagtagctaagctgcacaggaaataccacttgatgacctgcgatctggggaagccgcgccagggctctgcgaagctgcggacgagggaggcgtcagtgtgggggctgcagctcagctccgggggggacgcgcctttctccacgggacctggggctcaggtgctcacgaggctggggcgctgcaggccacccgcaggggaaactgaggccctccattttgtggggctggaagacctttccttccaaaagcaggtgtaggcgggagcacctgtgcagtccctctgttcagatcctcacccacttttaaatcaggtaattgcttttcttgttattgcattgagttccttatgtattttagatcgccgggtacccttcattttactcctgaggctgtaacttggacaaagcgctttctgctgctttggatgaaaaattcttttcctccacaggaaacagcagatgaaatgcacagtgtgaaggacaaggattctgctgagagaattgctccgagggttgctcaagtgatcatgggaaataatgcatcaaaccattctttaggtatttttttaaattaggaggtaaaaaatctgtgctgtttgccaaaatgattcttacacagacaagctaggaaaattgctctgaaacatgacacagactcctgatttggcccaactagggtgtgaaggatgaaatccatcctgagcccttcatccctctgctttctctggtgcagatgcagctcaggtgtgccttttcttcgcctgtgcccatccacctgagatggaccataaccataaaagtcagaaggcactgacccttcaggacgtgacagggttaaaagatgctggagggaaagtctgtcattgacttttattcacttcctttctccattctgccatttggaagaaggtaagcaacttaacactattttagaccatatgttgtaaactagcaggaaaatgcctttgagctgatgatggtggcccgaacacagtgaacctgtcttaaatccctgctttaaacccttaagggtgtcacttacaagagatactatttgaagtcttcccatgcatgtgtagggtggggggagtaccaacagctcatcgaatgggctccatttgaaagatctggatggttgcctttatttgtaactagttt

SEQ ID NO: 957 - DNA, 894 bp, Homo Sapiens
actctgtgttagccaaatgccagcttgcccacccaaatgctggactgaagtctaacacgttccaacagcaaatctgcagacactccacccaccaggacagctgctcacgcgtgcaaccctgtgggtccagaagatttcgagtgcagacacgtgggattcaggagactggttcccaggctctctgcatccataggagcctgctggcaaatgtgctgagaatggacatgcctgattcgctccaaggaactgctcctttcctgtgcctctttcatcatggcctgacacaggcgtcacgagggcaaggaaggccttggagccccctcatctgtccctggggcatcttgtacacaggtgggctccacatgaaggatgagggaccaccaaggctgagttcagtaagagaactcccccagtaatgggtaagagcccccagtaacatggtcggcttgtcatcctttgattttaacaaaatggaaggggaatctcactgagctaaaaatcaatagatcattgaaaataatccttaatgacagagaatggatgggccacaatgttttggcatatagctcaggcgttcagtgaaaatggcactgctataacaagactcctctctctccatttatttacatgaacacattttcagacattctacagaaacaaaaagaagcgaccaccaaaaggagggaaaaaccaggagcgcacacgtttctgacaaggtcttctctggaaatgagtcaggtgtgctcatgaactgagtgaaaaaccaccacacccagctcgctaagagatgcatctcagagcaatcataactttttatgtccaacaattatcaaagtatgtaatgtatcctaattgcttgatgtgaacaagtgataattatgataataattccat

SEQ ID NO: 958 - DNA, 1236 bp, Homo Sapiens
aaaacatgtatattatatttatccacctgtcatcattttcagaaatctttattatttctttagattcaaattttcatctggtagcatactctttctgtgtgaaagatttaacttcaatatttcttgcagtgttgatatcctgttgataaagtttttcagctttcatatgtccaaaacactctttatttcacctgcatttttgaaagatacttttgatggctattgaagccttggtagatagctttgattttattcacttttgttttcaatactgtgaagttgatgctctgttttccactggcttggatcattttttgatgagaaatctgctatcattcttatttttgttccttgttatatgatgtgtatttttttttcctttgctttaaatactttctcttcactgccgatggtcagcattttgataatgctgcaacttggtgtggtgttcttcatatttcttctgcttggggttgattgagtttcttgtatctgtgggtttataacttttgtcaaaattgaaattttgtctacaatttctttaaatatttttgtattctctcttcttttcctctcttctgggattccagctgtgaagtgatgagccacttgacattattccacagctcactgattttttttttttttttttattgagatggagtttcactctgtcactcaggctggagtgcagtggcaccatcttggctcactgcaacctctgctgcccaggttcaagcgattctcatgcctcagcttcccgagtagctgggattacaggtgcctgtcaccacatctggctaattttcttgtatttttattagagatgggttttcgccatgttggccaggctgttctcgaacttctaacctcaggtcatccacccttctcggcctccccaagtgctgggattacaggcatgagccactgcatccggcctgatgttcatttcttagactttttttctgtgtgtgtgtgtgtgtgtgtgtgtgtgtgtgtgtgtgtgtttaacttagctggttcctattgctatgtgttccagttctaaatttttcctgcaatatctaatttgctattaatgtcattcagcatatttttctgagatattttattttcaatgtctagaaatttgttttgagcttatttatatcttgcatttatttctacatgattttcatactctcctctcccttcttgaacatgtcaactttatttatagtagctcttttaatattt

SEQ ID NO: 959 - DNA, 15126 bp, Homo Sapiens
ccttcgctctggtgaggtgaaccgcagtctgaggaagacttcgctcaatcgtccctttccacacccagggtactggtttaaggtaattaagcaaatatggagcagtatgttaattgagtctctgacgacttaatgtttagtcgaaatcctttgtggaattgtccagctatttcatattctggtgcactatgctttaaagcacaatggagagccagactcgtgggtttgtatgttgtactcattttaggctggaaatgaactctcatttataaaggatatatagatatataattatattatgtttaaataatttatacaaatatataaatttttatttccatattatttccataggtttttgaggaacaggtggtgtttggttacatgagtaagttctttagtgatgatttgtgagattttgatgtacccatcatcgagcagtatacactgaacctaattttgtagtcttttatccctctcccccttcccaacctttccccgagtcccgaaagtccattgtgtcattcctatgcctttgcatcctcaaagcttagctctcacttgtgagtgagaacatacgatgtttggttttccattcctgagttacttcatttagaataagaataatagtctccagtcccatccaggtttctgcgaatgccatttattcattcctttttatggctgagtagtattccatcattatatatatatcacatatatatataccacatatatatatatatatatatatatcacagtttctttatccactcattgattcatgggcatttgggttggctccacatttttgcaattgcgaattgtgctgctataaatatgcatgggcaagtatctttttcgtgtaatgacttcttttcctctgggtagatacccagtagtgggattactggatcaaatggtagttctacttttagttctctaaggaatctccacactgttttccatagtggtgtactagtttacagtcccaccagtaatgtagaagtgttcccttttcaccgcatccacaccaacagctattattttttgatttttttgattatggccattcttgcggaagtagggtggtacatacggcatagcagttttgacttggaattccctgatcattagtgatcttgagcattttttcatatgtttgttggccatttgtgtatcttcttttgagaattgtctattcatgtttttttgttttttcttgagacagagttttgctcttgttgcccaggctggagtgcaatggcgtgatcttggctcaccgcaacttccgcctcccaggttcaagtgattctcctgcctcagccttccgaccagctggtattaccggcatgtgccaccacacccggctaattttgtatttttagtagagacagtgtttctccctgttggtcaggctggtctcgaactccagacctcaggtgatctgcctgcctcagcctcccaaagtgctgggattacaagcatgagccactgcccccagcccttttcatgtttttagcccagtttttgttaggattttttttttcttgattatttgtttgaattcattgtagattctggatagtagtcctttgtcagatgcatagattatgaagattttctcccactctgtgggttgtctgtttactctgctaactcttccctttgccatgcaaaagctctttcatttaatcaagtcccagctatttatctttcttttcattgcatttgcttttgggttcttggtcatgaaatccttgcctaagccaatgtctacaaggggttttccgatgttatcttctagaatttttatagtttcaggtcttagatttaagttcttgatccatcttgagtttatttttgtataaggtgagagatgcagatccagttttattctcctacgtgtggcttgccaattatcccagcaccatttgttgaatagggtgtcttttcccccactttatgtttttgtttgctttgttgaaaatcagtcggctgtaagtatttgggtttatttctgggttctctattctgttccattggtctatatgcctatttttatgccagtaccatgctgttttggtgacagtagccttatagtatagtttgaaatcaggtaatgtgatgtctccagatttgttcttttcgcttcatcttgcattggctatgcaggctcttttttggttccatatggattttaggattattttttctagttctgtgaagaatgatggtggtattttgatgggaattgcattgaatttgtagattgcttttggcagtatggtcattttcacaatgttgattctacccatccatgagcatgggatgtgtttccatttgtttgcctcgtctgtgatttctttcagcagtgttttgtagttttccttgtagagttctttctccttctttgttaggtatgttcctaagtattttatttttctaataaaacaaaatacttttgccgctattgtcaaaggaattgagttctttgtttgattctcagcttggttgctgttggtgtataggagggctactgatgtgtgtacattagttttgtatcctgaaactttgctgacttcttttatcagttctaggagcattttggagaagtctttagggttttctagatatacaatcatatcatcagcaaacagcaacagtttgactgcctctttactgacttggatgccctttctttctttctcttctctgattgctctggatgggacttccagtactatgttgaagaggagtggtgagagtgggcatccttgtcttattccagttgtcagagggaatgctttcaacttttccccattcagtattgtgttggctgtgggtttgtcatagatggcttttattacattgtggtatgtcccttgtatgccagttttgctgagggttttaatcataaagggatgctggattttgtcaagtgctttttctgcgtctgttaagatgatcatgtgatttgtttttaattctgtttatgtgatgtatcacatttattgacttgcatatgttaaaccatccctgcatccctggtatgaaacccacttgatcatggtggattatctttttgatatgttgttggattcaattagctagtattttgttaaggatttttacatctatgttcatctggaatattggtctgtagtttggttttttttttttttttttttttgggttatgttctttcctggttttggtattagggtgatactggcttcatagaatgctttagggaggatttcctctttctgtgtcttgtggaatagtgacattcttctttaaatgtctttaaatgtcacaggatcagctgtgaatctgatcctggactttttttgttggtgattttttttattaccgtttcaatcttgctgcttgttattggtctgttcagagtatctaattcttcctgattcaagctaggtgggttgtatctttccaggaatttatccatctcctctaggttttctagtttatgtgtgtaaaggtgttcatagtagccttgaatgatcttttgtatttctgtggtgtcaattgtagtatctcccatttcatttctaattgagcttatttggattttctctcttcttttcttgattaatctttttaatggtctatcaattttatttatcttttcagagaaccagctttttgtttctttttttttttttttgtgatggagtcttgctctgtcacccaggatagagtgcagtggcgcaatctcagctcactgcaagctctgcctcccgggttcatgccattctcctgcctcagcctcctgagtagctgggactacaggtgcccaccaccacgccgggctaattttttgtatttttttagtagagacggggtttcactgtgttagccaggatggtctcgatctcctgaccttgtgatctgcccgcctcggcctcccaaagtgctgggattacaggcgtgagccactgcgcccggcctatttcatttgtcttttgtatttttttttttccatttcaattccatttagctctgctccgatcttatttcctttcttctgctgggtttgggtttggtttgttcttgtttctctagtttcttgaggtatgaccttagattgtctatttgtgctctttcagactttttgatgtaggcatttagggctatgagctttcctcttagcaccacctttgctgtatcccagaggttttgataagtcatgtcactattgttgttcagcttgaaaaatttttaaatttccatcttgatttcatttttgacccagttgtcattcaggagcaggttatttaatttccatgtatttgcatagttttgaaggttccttttggagttgattttcagttttattccactgtggtctgagagagtgcttgatataattttaattttcttaaatttattgagatttgttttgtggcctatcatatgatctatcttggagaaagttccacgtgctgatgaatagaatgtatattctgcagttgtttggtagaatgttacgtaaacatctgttaagcccatttgttccagggtatagtttaaatccattgtttctttgttgactttctgtcttgatgacctgtctagtactgtgagtggagtattgaaatcccccactattattgtgttgctgtctatcttatttcttaggtctggtagtaattgtcttataaacttgggagctccagtcttaagtgcatatatatttaggattgtgatattttcctattggacaaggccttttgtcattatgtaatgtccctctttgtcttttttaactgtggttactttaaagtttgttttgtctgatataaaaatagctattcctccttgcttttggtgtccatttgcatgaaatgtctttttccacccctttaccttaagtttatgcaaatccttatgtgttaggtgggtctcttgaaggcagcaaatagtttgttggtgaattcttatccattctgcaattctgcatcttttaagtggagcatttagactatttacattcaatgttagtattgagatatgaggtgctattccattcattgtgctatttgttgcttgtataccttgggttgttttttttttaaattgtatttttgttgtataggtcctgtgagattgatgctttaaagaggatctgttttgatgtgcttccaggatttttttcaagatttagagctccttttagcagttcttgtagtgctggcttggtagtggtgaattctctcagcatttgtctgaaaaaaactgtatctttccttcatttatgtagcttagtttcgctggatacaaaattcttgggtgataattgttttgtttaaggagactgaaaatagggccccagtcccttctagcttgtagggtttcttctgaaaaatctgctgttaatctgatagattttcctttataggttacctggtgcttttgcctcacagctcttaagattctttccttcattttaacttttgataacctgatgacaatgtgcctaggcgatgatctttttgcgatgagtttcccaggtgttctttgagcttcttgtatttggatgtctaggtctttagcaaggctggggaagttttcctcaattattcccccaaatatgttttccaaacttttagatttctcttcttcttccacaagaatgccaattattcttaggtttggttgtttaacataatcccagacttcttggagtctttgttcattttttctttattcttttttctttgtatttgttggattggattaatttgaaaaccttgtcttcgagctctgaagttctttcttctgcttgttcgattctattgctgagactttccagagcattttgcatttctctaagtgcatccattgtttcctgaagtttcgattgttttttatttatgctatctatttcacggaagttttctcccctcattttgttttttgttgttgttgttgttgttgttgtttcttttgtttagtagagacggggttttgccatgttgctcaggctggccttgaactcctggcctcaagtgatcgacccacctcggcctcccaaagggctaggattacaggtatgagccaccatacctggcctccccgtatttcctcttatttttttttatttctttaaattgggcttcacctgtctctggtgcgtctttgattagcttagtaactgacctgaattctttttcaggtaaatcagggatttcatcttggtttggatccattgctggtgagctagtgtgattttttggggggtgttaaagagccttgttttgtcatattaccagaattgtttttctggttccttctcatttgggtagtctatgtccgatggaaggtctagggctcaaggctgctgttcagcttcatttgtcccatgaggtgttcccttgatgtagtactctcccccttttcctagggatgtggcttcctgagagccaagctgtagtgattgttatctctcttctggatctagccacccagcaagtctatcaggctctgggctggtattgggggttgtctgcactgagtcctatgatgtgaaccatccacaggtctctcgaggctctgtgtgtgtgtgtgtgtgtgtgtctgtgtgtgtgtgtgtgtgtgtgtgtgtgtatatatatatatatttatttttttgagacggagtcttcctctgtcaccaggctggagtgcaagtggtgtgatcttggctcactgcaacctctgcctcccaggttcaagtgattctcctgcctcagcctcccgagtagctgggactacagccgtgcaccaccacgcccagctaatttttgttatttttagtagagacagggtttcactacattggccaggatgatctcaatctcttgatctcatgatctgctcaccttggcctcccaaagtgctgggattacaggtgtgagtcactgtgcctggtctttttttcttcttttttttttttttgagatggagtctcacaccatcattctggctggagtgcaatggcacgatctcggctcactgcaacctctgcctcccaggttcaagcaattcttctgcctcagcctcccgagtagccgggattacaggtgcccgccaccatgcccagctaattttttgtatttttagtagagacagggtttcaccgtgttgatcaggctggtcttgaactcctgacctcgcgatctgcccgcctcagcctcccaaagtgctgggattagaggcatgagccaccacacccggccgagtctgtatattttttaacaaccagtttgtgatctgaaattggcataagattcctattgtcacacatgtgtttgcaattaattcaaaagtatggacatgtaactattggataagtttgtcatcacgtttatgaatctgattttaaaagacagatctgttatttgggcaagagttgaatgaagctccgtaagtgctccttccctcctctctttctcccagagggtcatgctgtttggcccaggctggagtgtgcggtggcatagtcatagctcattgcagcctcaaccttctgggctccagcaatcctcccacctcaatttcccaagtagctggaaccagaagtgcatgccaccacacccggctaactttttaaagtttttttgtagacaaggggtcacactatgttgtccaggctggcctttgaactcctaggttcaagtgccaccgcccaccttggcctcccaaagtgctggaattacaggcatgagtcatcataccctgccaaataatttatttttaaccaaacttttaaagtattataaccattatagagttgctgttgtcttctgcttttaaaaggtaatggaggagaaactggaaattccgcctcttgaataattcctgttgcttcccataatcatatagaaaactctaaattgtgcctttaaagttttaggtttttaaaagaatacataaatttacttcagagtatcttatatttggaggaaatactccctatcctgttcaggctggtatgttccatccctgtctcagccagcacgttaactcccaaaatttcctaaatacaactttctcataattcaaagtctttgttaggtcttttctaagaggccttagcagaccgtctttccaaacattttcatgtatttacttcaaaacagttgataatctattgagtttgttttctgtcttatccctagtagatggtaaatcttcctcattttgtaatgtttaatacagttccaagtttatttggtggaatgtcaagattgttcctgtaaatttgtggccagtgaacagtggcacatatttgtatttatgcgtgtgtgcttacactctctgtagtgcagcacaatttttagttagtagcagaaaaacactaaccctgatgtacccaaaacttcgtgtttgagggaaaaaatttagatggctcagaactatgtcgcacatgtgatatagcaggagagcaagcgagatagagcgcgatgtagatatagcttcactttaatccgaggcatttgcaagttgctggacctagatgattctttatccagaggactcccataggggctggattaatttctaagactggggaatcccaacttactttggtagataattctaggaggcctttcaaagtgctgggggtgggggtgctgttcctacttcaaactaagccagtgttgcaactgcaccctgttcttcacaagtctttttggatcatctcagctgcagaaatcctctcttacctctctgatacactttttgttgtttttaagagacagcatcttgctgtgtcacccaggctggagtgcaatggtgcaatcatagctcatcatagtgtcgaaatcccaggctcaaacaatcctcccacctcagcctcctgagtagctaggactacaggtgcacaccaccacacccatctaattaaaaaaaaaaattgaggactgggcccagtggctcatgcctgtaatcctagcaccttgggaggccgaggcgggcagaccacttgaggtcaggagttcaagaccagcctggccaacatggtgaaaccctgtctctactaaaaacacaaaaaaaaattagccaggcatggtgacacacatctgtaatcccagctactcaggaggatgaggcacaagaatcacttgaacccaggaggcagaggttgcagtgagccgagattgtgccactgcactccagcctggacaagagagagagactccgtctcaataaataaataaaattttgtagcaagagtctatgttgcccaggttggtctcaaactcctggcctcaagcagtcctcccaccttggcctcccgaagtgctgagattataggcatgagctactgtgcctggcctggtacactatttatccagcataaattggggtattttaacataatctatgcagcctatcatcagttttttctacacaggtgatacagagaccagtggcagagttatgatgaacagtagcatccaagattcagaagcagcatattacttcaagcagcttacccaaaccacatatacaaaagagcagtcatgactccagtcagagaagaaaaaaaaaaatccagatttagatctagtcctacaataccctagactccatctccatctccagactctgcctctccctcagtactctcaggtcatgttcacctgtttgtcttctaggatgcctacaggactgcctgcttcaggttctttacatttgttctctctgctgaacacttatagcacaaatatccttagagagaccttccctgaccacccaaatacaaataatctccactccatttcccaagtcagtctctatcacattaccttatgttatttcttctactgcattatcactgtctaaaattcctatttacgaattgtctctctactaggatatcatacatggatgtgatacatgaggtcaggagacttcatctgtatttttttcagatgaatccccagtgtctagcatagtatctggatcataataaatgataaatttgtgaatggattgattcacctgaattatttcagcacaaactaaattgtagtaatcacacagttggtttttaataattcttcatatttaagaacaaaagaactaccctcatcttcaaagaaatcagacacaattttttttttgttttactaactcatttaggaattcttttcttttctggaaaataagcttatgctagactaattttcaaggctgaatatttttcttcaaatgaaataaatataaacacatttctatatacacagcatttttattaaatatactctgtgagaaaaagaacaccctaaagtgccagatttcatgtaaatccaataacttagtaaatacaatggtgaaaaaaaatcagagggaaacataatttaaataatcttataaaagagcaagaacatatcttaatcttaagaaaacaatcatcaaaatataaaagggaaagaaatctcttttgtagaagaatatatttcaaattccacctgttgatcatttcatttaaaaaattctattctaaacacatgggcagtctctcttaccaatatatatatttaaatcaatggtagaaagggaatttagactactcattcacactgagataaagtgacatttttgttgcacaacagtattgctcactggcactaacagtggaagatggagaaagtagatttctggattcaattgttagcagcagaaatggactaatgctaaaaatttagaaaaaaatagtccaagctgtagcgatttccaagtaatacaaacattaaccaaacattgccaatttgtaacgggctgtgaaaaacatatgaaaatactctacattgaatactagctttatgttactttctattaaagatattcagtgggcatattctaaattatatagggcttctatagagacctaaactagcaagtataatatgaagctaacaggacagtgtcagcatatcttgggatgttctagccaatgtttggctacaagtatttggaaggggtcaaataactatatgcacattcaaaatgaatacttataaaaagaaatcttaatgtatcagatatccacagactgaaaagtgttacacatgttgtggggggaaaatactgatggttggctgaatgaccaattaaacataccacttatgaaaagctgggtgattcaggtgcaaaaaaatatatatgcacacatatctctctaataacatcctaccaacatatatatgttgcatgacatagttaaagctgtgttaccaaactaggatgtgtaaagtatcaatgtagttaaaattaaattttaagtaaaaagctgctgctacttaaacaagagagtgaactttggggtttattcaagaattagttctcatatataaaaaagtttgatattaataaacaattctggtcaccataaggttttagacagtatagaaacttacagaaaagtgtttttggaccactttaaatagttggaggaagcaaataaaaggattaaactggattatgagtatgaatgcatttatgatcaaaattaacacaccaaaaaaatcaaaccacatttcacagcagaacctgcaaaaacgtttgtattcatcttttttgaaccataaaaaagaatgatttagtcttgtctaatacgacttttaagcaacaaaaataatttaatcatgaagtatcagcttgattatgaatatattctattatctgtatcagttggtaaattaactgtgttacccaaaaaggctgaccagctctaactagtatgaacaggatattgaattcattaatgaatatataactattttgagcatacaaataatctctggttttacacccactacatttcagaatcctgtaaactgtgaggcatacaatatgtttaatgtggcagaaaatcatatgaaatgattattttattctgttcagtccttttcccattaagcatgcaaacaccgtcataaccatctttggtttcacttctacgaggtcatcaggtaatgcatatatccgggcaccgatctttcgagcaactgaaatggcgtatcttgaagagacaagaaaaatatcttggtgttatccactgtgttttcacttaacatattttaacaaaagagtgaaatattttgacaagattagttttacgaaaaggttaagtttgtgagtcttaaatctaagactcacatataagttatatttaaaaatatgaattttaagggcatagtaacttttcctataaggattttagagaattaaagggccatgtattgtaatataaaccataaaggcttacttagcattgttcagcttgtcctcatcagataagttttctctcctgatcatttcttgacgaactgcatttggtgcaatggcatctattaaatctaggacaggtaaacttgtgcttatagatttatcctagaaaataaagcatagatgaacattcataaacatctgacctttaattttcattattttcagactcttctgatcatataactgaaggcaatctacaaattctttgtacttaacctaacgttcagcttttctgcaaccagcacacataaataaaccctttaaaatatacttttccttgaatctttatatataatatagagttgtcaccatatctgaataaggtttgtggacatgatagctcctaagtatgctaactatagtgtccattctgtaaaaaatacaaaacttttgaaagggaatagatgaatttttaattaacaattttataaattctactcacatatttcttagaccatgaatccaaaagccttcccttaatatttttcagaaagaaaaatgaaatagtgaaagggaactaacacttacaaagacattgtcttgttgttttacatgttttagtttatttaatccaccttttaaaccctagcatcttgatagtaaaggaattcttttttaaaaaaagatgaagaatataaagttaagatagctcaaatgacttgtttacacaaccagtaaatacagaacccatgacagtctgactctaaaatgcccaagagtctctccatttttaagttaccaccaaggcaagctaaaaatggacaactaaattatagtgaatagcgcactgcagatgaaatcagacatcctggtctgaactgatttttaccacttatcagtacttgaacaaattatttgttttctctctcagcttgaatagtggccaccactgcttgcctacccagaatctacacactctttacttctttcatacaagtagaacccatatttttgctctatatccatacctccttcacacagacatcagcttcaaggaaagctgacattcatagttccaggagtgaacctaaattaatctaggtcaagcattctcaataggggtagggtgataaccttgtttatgtataaagcatacagtgcataaacaggtatacagtgtatctctgcattaaaatttcatgggagagacaaaaacggaaaaaaaggtctaaaaatattccttagaggataattttcttttaagatttcaaaacactggtctaagccaaatagaggaatgctattctattaccacagtaatttaatttgggcctatgttatggaaagccagcaacccctcctcctggatgtgaatgagagaatgaaacctctgtcacaagcagcaactatcctatgaccaaaaggaaaaccagctttagggtgaagctggcacattagatggcaaagcagagatgggaaaaaaaaaaaaaaaaaagagtcctgaatgacattcttcaattattggttcaaccaatccagaagtctaccctacctctggattactgttattgtagtcaacacctttccttttggtttaaaccacttgaaattgggtttctgttacttgaagccagagcaccctttcctaatctctaaagtagaatgtcataggattcttaggaatactgaggtggtataggtgaaaacatctagtataggctctagccaaatgtcagttcttaatcaatatctaataaaacaatctgaagccatgtgaagaagagtaacagcttctttgagccacaatctatgagccacttcatttattaattttttttttttttttgacgcagagtctcgctctgttgcccaggctggcgtgcagtgttgccatcttggctcactgcaagctctgcctcccaggttcatgccattctcctgcctcagcctcctgagtagctgggactacaggcgccggccaccacacccggctgatatttttgtatttttagtagagatggggtttcgccgtgttagccaggatggttgtgatctcctgacctcgtgatccacccgcctcggcctcccaccgtggtgggattacaggcctgagccactgtgcccggcctcatttattaattttagaaaaatttatattcttatgttcatgttatgatacagatttttgggcaggaatgttcattttatgatacagatctttggccaggggtaatgttcattttatgatacagatctctgggcaggggtaagagagagagggtaaaaataattaggtcctttaagtctatctgatgctggtaatctggatctgctttttgtatcttttctgtttctgagaaatcagtctgcagaccacctacatgaaaatcatgtggggtatttgttaaaagtgcaaatctagccccactcaaactaatgtcaggttatctatgaatgaggctgggaatctacatttttaataagctttctagatgactctaaatgtgtactgtattatactttctaaaaacaatatttcattctagaatgcattttaatttctatgggcttacctttcatatatgtatatgattattttttaaaatacaagtgacttatttaattgtgctataatttgattccttatttacatatttgtgttattttaaatatttcatttagatttaggaaacaagtatttttcccacccattttcttatgagttaccttgcgtaaagcttctactgagtttaatgaagaatttaagtttctaaagattgtatcagatctcttatcttcttgtttccaagaaaatagccctgtcttccaaatcctctgatttgtacattatcagtgaaagacattttacttttgcaa

SEQ ID NO: 960 - DNA, 2194 bp, Homo Sapiens
gaaaatcctaaggaacattttatttttcaatttcatttatttcatttttgtttatactttagtatgcaaggaacattttaattttttcttattttttgagaggaaaattacatgctcattttattcatgtctctaaatgcaaaggcccaaacaaataaaaattaagaaattaaatccaagaaaataaaaagaaagaaatgcaacgaaaatttaacatttgaaaatatttttaattaactctattaatagagaaaaactattttacctttttaataggatcagaaaacacatttaatataatgtagtacctattcatgattactggaaaaaacaaacatataaacctcaatgtattaggttaacttccacatcctgttaaataatatgtagtgaaactggataggcaaacaaaaaacaaaaaatagaactctacagtaaacattatctttaacaaaattgggtcaatttcagaatgataccgtaagccttgaagctattcccagcaaaatggacttataatttccacttttgctcaggcttgtttgaaatatgtttccatcacttgcatcccaaataatgctcacaaaacacaagactccttagctattgccagtacattacaattaaatggaagatgtacattttctcccatgcaggttgtgtgactaactaaaaatgccaagtttattaggtgttgctggagtcatatcaacttagtgtatcaaccttgccttatttcagatgttctgagtgtcagttatatttgtatttcataaaaagaaagataaagccaaaatcattactgcctaagatgtgctgttttcttgctagacagaatcattcacaacctgagatcagtggggaaatacaatgcaatgagtcctgggtgctgaaaatgtcaactctttggatgtaattaaatggatctgtgagtgtagtatagacagaatctgagacagaatttgatcatttctcaagttccctcttttacagttttgaattgtaacttgcgtaccaagcgtgagcttgactatgaggtctcaaagttttgaaccttgtgttctgaattttctttagctttctaagtgaggatgtttcctgagccatatggaactacatagctccaccagggtcctcaaactatagacctctccccagagcctaggctatcaatttggctgttttgtcttctcccacacagtctgaggttttcttagtcaccaaagaattttttttggacgtatgacagaactaagtcctataaaaaggctttggtgttaccaagattatggaattcccttcttagtataattaataaaaacagtagtaatatataaaacaaatgtaagaaatccccctgccccccaccacaaattcttatttctcccatgctatttgaatgttttaaaaacattgggtattcaattctctcaaaaatattttgtgtttttgcttctcaggaagcctattttatggaccatctggcagtgaatgcagttaatccaggcaacacttccctattttctttttctttttcttttttttttttgagatggagtctcactctgtccccaggctggagtgcagtggtgcgatcttggctcactgcaacctccgcctcccagattcaggtgattctcctgcctcagcctcccgagtagctgggactgcaggtgcgtgccaccacacccggctaattttttgtatttttagtaaatacagggtttcacatgttggccaggatggtctcaatctcttgaccttgtgatttgcctgccttggcctcccaaagtgctgggattacaggcgtgagccactgctcctggcccacttctctattttcttttgttcctatctacctggaaaacactgaaaccaattcatgtaaaaatttggccaccagcctaaggtaccagctctacattcttatctgtggtgtttccatcatataagctttcctgcttattttcatcctcatgttgcaggaacaggactgtttgttccctgactctttccttccagaaacttttcacatggtgtctagatagaacatcaattgagtggttaaggaactattctacatccacatctatatcctctttactggatgttctcttcatcagttacctttccagagacctggctcttccatgggaagaggtttctacttatttttttcaagtgggggatgttg

SEQ ID NO: 961 - DNA, 3728 bp, Homo Sapiens
actccatcggtgcctttgggaagcgccgccttctctgttgtacccggccgtgggtcaggtcggcgcggctggcggtggagtctcggacaccgagccctggaccccgactctggaagcccccagccccactgggccgcggcagggcgcccaccctccacaatctcagttcccagccggggagtgaggggctgggcgggtctctccaccgctttggagacctcaggacttggatacgcttttgagtggtcccagtcgtcctgatccacgaaggcgtggagtggaagtcaggaccaggggtcgccccagtgacgcaggaagtcaagcccagatgcggtgaggcgtcgccagccttggacccagcagtgggcgctggtgacagtggcgacctcgccgatgagagggtcttgctctgctgctgacactggccttgagctgctggtctcaagcgatcctccagcctcagcctcctgagttgggattacaggcacaagccacagtgctcgactttttatttaatcttgttagaagacaagacagaaacatgtccgttgtgaaaacaaggaagctgcgggcagatcgattgaccccaggagttcaagaccattctgggcaacatagcaagactctatctctgaagacaaaaccagccaaccaaccaaccaaccaatcaaccaacaaaaaagatcaagcagaggtgctccagaggacgcagcaatagaattccggagcaatgtctgcttggcctcggtcttcattcccatggtggcccctgagttccgtggagctcacttctacatagttccatgtgtgacttcaacaaaataaaatgacgcatttattggttaaaaatcagagattaccatcagatatggaaaattgcttttacttggtaataacaatcttacgcactttttaccaaacccatcgcattaaataactagcgtttcaaattttgacactgcataataaaccctcatttgaaatgactggagaaatactcatcaaatctcatggaagaatgacagaattttctccagaatttatcggaaaggaaaagaggttggactgtcaggaaacgttttcagggtaacatacttactattttctagacagttactcagataacacttgtacgcagagggaaacacacccctgggctttgcaaacacttgtttcctgtgtgtcagactcgcctgcatcctgtttatcaaatggaacggatagttattgaaagcaaagaccagaacaacttacctcttgtcagtcacctgcttttctttacttgtcatacttttagcatttacaaagttttaaaaatgtgtttatcatttggtaattatttttaaactttatttgaaaatatagactgagttctgaacaaattatccttaaatttcttcctctagtagttacacttttcagtatcagtgaagttttatgacgcctctatttttcctacccacacagcatctcaagtttgtctttacagaataactggaagtcctagctttatcctctctctgcgtttctctctcacagccccctcctcttggactctgctcttcctctcagcaccgtaacctttttaatttccagataggttttgaaaacaccatctgttcccctcttaggatccctggggcagatgataggtgaaccccacatcccagacacatggccaccaaagatattcttgcttttttaatgtttatcaagttcctccgcagacaacagaaaaaagtgatccgctgccagcgacagggagacacacaactggtccttattctaaagacccgacccagcctggaatggggcccggcgaggagttcttgcgccggccgcggggactgggcggtaatgagccgctagtctcggaaggtggtgctgttgggtgtgaggggagatccggcttgcgctgaaacagcgagcggcgtgcaaggaggaagccgcgatttccaaggcggattcccttcgctgggacacaactcttgagaataagacttataaggactctgagagtttgaggcagaggcagaacggctctgggctgagtgatggggaggataccagcactcagcgcgggtggcgggcgcggggccgagcgcgcgcatccagggacgccttggggacgggacgcggagaaaagttgccgggcggagagaaagggtggcgctggaaaccaaatggctttcatcccctggagacaaagaggtgccttcttttgacaacagctgccagtgacacacacaccatacggcggggccggcgggggaggggagcccgggaggagagcgtctaaggcggggaccggcactgactttcaataatggggtggttgccatggtgacgggccaggcatctaaaggggcggctgaaagcacccattgttctggggcccggctgctcgggttgtgcctgttcctaagagacacctttagacacctccctccgtgcaggggcgagctgcggcccggggctgggagcgtctccgcgggagtttcacaccagggccccaggccgcagatcgcagcgccgccttggctgcacgcgcgctgcatacggagggcagcgccgcctcccacgcactatccgcccgaaatccgagcgcgacgcgcgcccgcctgggcccagacgcgcaggccgggacacgcagctccgcctgctccccgctgtcccggggagacttcgaataacaatgcggagcaggacccggtgactccacaaataactcgctgaggtctggggcgagggcactcgggaaaaccccgcagtcactttgcagtcgtgctggaaggaaaagcagaacggaatcacaggataaagaagattaaaagtaacagggcagcgttgcaatgttgcttgtaagagcaagcagctggaaacaacctaaaagcccgtccctgggggctgggtgaatgatatggggcgcatccctctgagggaacactaagctgccattaaagagtacagggcagctgtatttgctgagacgtggaaattttccggtgtattctaagtaataaagtgcagaagagtgtgagtagggctgtgtgtatgtggtatgtgtgtttgcatctctggaagtggttgcttcttaggatggtcactgtgggactaggagtggaggagagaaagaaaacttgcttttcaccgtactagaatcttctgcaccttttgaattttgccgtttatactatgtctttacctgtaaagaaaaaagaactttgaaataaagttgcatttgcttgaacactgtctaatgagatgtgccactctccataaagcatctgaactcatttttagtgctttaataaatattaatttttaaaatatatatgcacaaatgctattagcccacagatatgtaaaggtagtgacagtggcaagttagagatgaaaagatacacttctttcctgccttcctgtggtgccgagacggacggagccagctgtcattcaaggagcctgctgtataacccatctattattatatcacattaatcatagggatctcacattaaacaaacatgacattagggaaattttcctagttacaaaatggtatataatcagtgaaatggactattgaacaccaaatgtcatagattttttttttttttttgagacgagtcaagctctgttacccaggctgcagtgcagtggtgcgatctcggctcactgcaagctccgcctccctggttcaagtgattttgctgcctcagcctccg

SEQ ID NO: 962 - DNA, 1681 bp, Homo Sapiens
gaattagcataggtttcctccgcaactgatgcatcttctaaccaggctgggaacacaacacgcgcacacgcgcacacacacacgcacgcacccaccccacccggctgccggacgcaagcgtaagtcaaggacttgcatgctagaatcagacagaaaatccagaaaagccacgttatttaacagaaccctacaaggtcagctttgagtcaaagcaggtaacagtttccttcgatgttttcatggacatttttattcccaaatccgagttctcgccaattctctaaagttcaagcgcccctcctgctttgcagaccacatttctctcggccctcgcgagtgaggtcgccaaatactcgacgcctcaagagcgagccgaggaggcagaggccgaccaagccggcctctcggcagccccgcccggcgccccgcggagaacgcccgggtgcggctcgagggaagttgtgtcaagtcccacgcgcggcccgcggagaacccaggggcggcccgcgcgcgtcggcctagcggggagggctgctccgggacacggtgcggcggccgcgggcgagttggacgcgctggcagagccgggccgaaggcggcgggcgtctccgggcagccatgttcgcggcgcccgcccgcgcagcaggacggagccctgacagcaatgtttgctacggcctccctctgcagtcagcctaaagcaaggagctggaggtagatgaggcaaaggtaaaggagaccaaaacagtattttaaagaaaaaatcatttatcttcaaataggctccaaacctaagatggtgtatactgttagaggacaagaacctgcttctagccatctttgcgtctccaggacctgacttgtgaccattcaataagagtttgatagatggacagactaatgaatagatgaagatgattagaagccaaaatttctgaatcttcctagcacccagaacatggcttaacatcaaggaaatgctcactaaatactgtcataatggaatgaatggaaccgatgcctaattgaaaatcattaggctgtaaaccatttccatgttccaatttcttcgtttatagaacagaaatgatagtgtaaccacctgaaaatccttcacctagacttccaaaaccacacccacctcatcaatgaagtctgactctctagaaagaagcaaatgactgaaatcatggtcctgtgccttgaccaaaataccattcgtcagaacaaaagaagtaggtcagtgaaacggcattagtatatccttcaacaggcaaataagtgatagtgtagtttgcttttgaagtcgctgtgaaaagttttaggtgaacatcacctacaccacattaaaaatggaatcaagtcattttctttaagaaatggagtttgagatatgagaattcttttgggctttttctacttattggccaattatacacccagatatatttctgcaatatttcaaagattctagttctaatttgtataataaaaaaaattaacagccttttccagaccacatgtttccaacaagaccttcaaaggcctcgctcgctatataaaactggctttaaacaatttcctttcccaaagaaggaaataagatatttcggttttgtaaaagaggcaaaaccaggtacaggccacctttcctgctggagagctggcataagtgagtgga

SEQ ID NO: 963 - DNA, 3009 bp, Homo Sapiens
gaacccctactaactgtgagctcctgaggagtcaggcctgagtctgtgggtcatctagcacatccttaatagaatgattgcctggatgtgaccaccctcacccccaaccctcacacaccctgccagcatgcctcagaccttaccccagctcaagataagtctcagattgcaggatacctgctgcagggaacaaaggtgaatgattgtcttgtgagcctcctgttgactgattctgttttacatggctgcacagagcccttgtggttatttggggttggggtggtggcttctgtattagtcacttctgcatgaaccatttcactcaggatctgaggccacagttcctttcttagtcactgatacatctggcagacttgaaattaatcagacaaacattgttcatagttaacatatccttggaagtttctcagctataaggaagaggtcttggtggctagggaggcctttctctgtatcctgttctatccagtgagagcctagagggtgctgcccagccatattctggctagcctcagcggttctcctgaaaaaaaattggcatctgacaacctggatggtgactataggtagtcaaatccagctggctggtctcctgggggttagcttccatggagctgcaagtcccctgaaatgatactggcagtgttgggacagcgtgtccgaaggcctggttttttcagaactggtctcagcaaaatgtctcgccaacttctacagttcccataagtacatgataactgaaacacttctagagccccccagcaatgggcttgtgcttttagtagaatatgtgcttgcttccatttaggggtaagaaggtgggcccctcaccatatgctgcacagagaagagagacaccatcactcatttattcatttaacaagtgctttccaagccactactaggtgccaagcacttcctaggtcctggggatacagtggagactaagatggagccagttctttctcatagggatctcacagcttagtgagtgagaaagccaaagagtcaaaatacagagagggtctgaggggcccattttgagagccatcatagtggtgaggagtgtgagtgctagagtcaggctgatcaaatcccagcctgccattggctagccttgtgactttgagcaagttatcttacttcgtggaacctcaggtttctcatccataaaatggggaagttggatagggtattatgatgattgaaatgcatttatacatgtaaagcataagtactggctcagggtgagcactcaataaacggcagtttattaggcacttttattaggaagtgatacaccttgagcaaaaccccttagagtataaggcatagcattcttacatatttttaaaatttaaaataaaatttaaaacatcttgccctttataatcagtccgccacaaacaagagatggagaaatcacccttccttgttttgtatctatggggtgcaaacatttaatcctcccaactgtcaaaaaagtgagagtttcacagcctgttttacagcagaggaaactgatattcagagaggttaagtaaatttgcccaatgccacacatctaataaatggctgagctggaatcaaggccagctcttacttggctgcaaaatccatgttttatgcagctcctccactatcttggcctccaaggcagctggctttgaacactacccttgcagcccagtcagccaatcccttgctctcctgaagcttttgctggtgggccagccccacctgctttccttgtgcactctgacttggaccctgaagtgagaagagttggcacaggacatcttacttccctgaaaacagtacctggacttttctgtatcttcacatccattgggcattgggcaaatgggtcatgcagatgaaaaccatccaagataagagacatgggagtgaaattcacacccactctggctttcataccatgggtctgaacattagcccatggtgtttcttggccatactgacctgtgccatttcagctgcattcatctcagttggtgttgtctgctggctgctctttctgatttcccacaggagcagtaagaacctgaggaagagtagggtcagaggagtctgggagaatgaggaaatatgagagccccaggaactgaaaaggcctgtgagagactctgagcttcctgggaacaggcgcagtggctcaagcctgtaatcccatcacttcgggaggccgaggtgggcagatcacgaggtcaggagatcaagaccatcctggctaacacagtgaaaccccatctctactaaaaatacaaaaaaattagccaggcatggtggcgggtgcctgtattcccagctacttgggaggctgaggcaggagaatggcgcgaacccagggggcggagcttgcagtgagctgtaattgtgccactgcactccagcctgggcgacagagcgagactccgtctcaaaaaaaaaaaaaaaaaccacaacaacaacaacaaaaattccatgttgacaaggatgggaatatgagaacatggaaacagctatgaaaagacataagagaattaggaggattttctttaatatatcattttttaaaaaaaaacttgcttgtatttgtttattttttaaatagagacagggttttaccatgttgcccagactagtcttgaactcctgggctcaagcgatcttggcctccctaagtgctgggattacagtcatgagccactgtgccccgccattttttaataaacctttctaatggaacaagtaaaacacatgcagtggatgctcagcaggccttgagtgtgtgaatgaaaaatatttgaacttgtttttactggttgatttcattgcttaaaaaacataccttagctggacgcagtggcgtgcgcctgtagtcccagctactcatctcttaaaaaaaaagttttatgcttgttaatttcataaatgctagagggatcaccctaatcaaataaagctactcaaaaataaaatatgaaa

SEQ ID NO: 964 - DNA, 1991 bp, Homo Sapiens
tgaataatatgccaactttcctctttcctctataatcaacttcaatgaatatttctgtacatgtatccttgtgctcatgtcaaaaaaagcatttatgattatccttatgagtaaaattgctgcttctaagggtctaaacatcattatgaaatattgtaatattgctctccaaataaatcataccaatttattgtctaaacaccagtgtatgaccatcactacagctttacatcccccatcagatctggtattgttgggttatgttttgttttggtgaattcccaatatttttaattgggaatctcattcttgttttcatctgcatgaaattgtgaggttgagtatgttttcatttgttaaaattagatgttcatgtttcctctaatgtgaatcatctttttgcacactttagtaatttttgtatttgtttgctgtcaactttcttattaatttgtagaagtttctttttatgcaaccaaatcttttataagtttgtaggcattgtaaatatcttctctcaggatatggcttttaattcactttatttgtgaaataatatttttgttgtctagagaaattttaaatcatatcattttttcaaggtttgtattttttttcttttgttttgaaggtttatttttcatagataggtcattactccatttggaactttttaatatatgagtagatatctaattttattgtatacaaacagctaatcgctccaataacagcaaagagttcatcttttctactgatttgtattgctacttttgccagccatccacttttcatagatttatggatctgtttccaagcttactctcctattctgttgctcaatatttttgtataaacaattcccttcaaatattcctgacagcttatttcctcttgaatgttattctggtctggtccccttaaacagctgcaatttattgatggaacataaaacaggcaaaaggaaggagcaagacacagagttaatttaatatcctgataaaatagatcagcctttagtattttaacagctatatattatttatttagtaattttggttttgtttgtaaacaagcaagttatattgtggtaaagaagaaatatgggagtcaaaataagactttaaagatgtatctaattttgtaattaaaatacatttcctactcaacatttttttaattttatgtaaaatattttaggctacactgtgcatgttttaaaaccacttgattttaaagctttttaatagaagaaaaaagatacaaagctgaagttgtaagggtaagtgttaagtattgaagttttgtgggcctaacaaatgactggtttatataatttgtagaatacttttttattttacatacttacctaatataagtggtgcctaaataagtaatgctttataggacgaattgatgcaggtgggagagtcactgtgatatgagactgtcagaggcctttgaaccagagcaattctattgtgaataggggctggataaagtaagtctgagacctacagggctgcattcccaggaggttaggcattcttagtcaaaggaagacacaggaggtagctcaagacacaagtcacaaagaccttgatcataaaacaggtcgtggtaaagaagccagccaaaacccaccaaaaccaagatgtcaaggaaagtgatctctggccttcctcactgctcattatatgctaattataatgcattagcatactaaaagaccccaccagcaccatgacagtttacaaatgccatggaaatgtctggaagttaccctatgtgataaaaaaagggaaggaactctcagttctgggaattacccgcctctttcccaggaaactcatgaataatccaccccttgttgagatataattgataaataactataagcatactaagtcaagtagcccatgccactgctctatctatggagtagccattgttttattcctttactttcttaataaacttgctttcacttt

SEQ ID NO: 965 - DNA, 3864 bp, Homo Sapiens
taaactgtctccagataagaaagttctagagcaactatcctatatttttgaagaaaaaacaattctatctggggaagttttattcttcagaaagaaaaacttacggaatgggaaaatcaaccctatctaaatcaaccctgactagtcaacccaagtcaactctgagtatctctgaggtgaaagatgaagcatgctgatgggtgtcaaatccaatcttgtatgaataaaataagcatcggggaagcatagatgtcatcttctaaggcaaacattctgaggatctggcagcataaatccatcagttaatttataatataattggacaccactatggccaaagtaaaagacacggccaaatctggatcaccttacaattttcaagatgctttcaagatcccccttgtcctgttatggctgagggaagcagtgatgggagtaggcaccatagtctgtaacccctccccttctgtctcggtacagacaaagcagataagctggggctctggtaatcttacacagtttacttcatgccaatttttatgctccatgagatccaggtaaactgagaatgctgtgcatctcctacatctaactacatcatttctaaatacttagaaatattttaagttttaatacttagaagtattttaagttaccgtaaagactttgaaactgtgacacaggtaccctcccctctgatgtttttcctagtcatcctgggtctcaggtagccacatggcacccaagatgggtatgaagggcaggtcctgtctgagtcctgaatttacgcacagctgtagacctcatgacagaagacagaaatgggaagacattgcctggaggacggaaccctcccaaaatagccaggaggcaaagctagggcaggggaaaaggggatatattgggcttgattctgccttgcagctggtggcctaggcattgagaatgtgtcctcatgcctcactgtgggcatacatccagacctctgactccagaggctcaaaaccaaaaacaagcaagcaagtatcaaattatatttaactgataattttgaagccatttctattttagtaacaatttacaactacctttatttactaaatattacatacaagtaacacatatagacacagacacaaagacagaagcagatattatagcttacataaaggattgtcatttgctggcttttgaatagtttttcttttccccattcagactatcattcttccattacctgtttcattgccctaaggagttgttagctaggcaaccttaaatttgcatttctaatgggacaactcttaggtgaaataaggtagaaaatttatatctcaaaagcacaacctaagactttaggcgtacatattgtaccctcatttgctcaaaccaaggaaaaaatgatgtgagtaaaaaatttcagttaagatgtccagaaaagcaccttaaacaaaggtttgacttgttacataaatttaaaactatggtaaaagtttctaatatacacaggcagacacccttacaaatggagatttcctttatagatgtaaatttcttttacagaagagtttcaggatagccagttaaatgccaggaaggtatattttagttgggtaggtggtttatttgacttagctactgtttcttggctaaaattactgagttcagggtagatggagcccattgaggaatagggcaaagaaaacagtactctgtgcttggactcagactggatagatctaaaaaagaagcaagtctgctttacccactggtttacattttatcaacattttatccaggatatcgttattttcactcttgaggcaggatagtgtttatgccaaaagtttagcagatttaattattcttgtgaattattcacctgagctttttatttgccttttttttttttttttttaaagacagggtttccctctgtgtaatcacaaaggcacagtcacagctgatttgcagcctttacctcctgggctcaagtgaatttcccacctcagcctcctgagtagctggaactacaggtgtacaccaccacatccagctgatttttaattttttgtagagaggagatctcactatgttgcataggcttgtcttgaactgctgtgctcaagcgatcttcctgctttgatctcccaacgtgttgggattacaggcatgagccaccacacctggccctatttgccttttatgaagtcttttaataaagcaataaaaatattgaaatgtttttagaagcttctgcacatcaataggcatccttgaagactaattcaggacccctcatttttaagtgctgtgttgttcattaggaacggtccattgtaattttaagttacaaagattttgccatttctgtaagtagttatttcttctgaggcctaatatttatacattctaccttatagctagaaggtagaatacggtgttcttcagatactaaggatccaatatttccctagaatcctggatttggtcctcagatccccttcatcaatttagttaatgatttttccctacctaagggtacaagaaaaagaatgtagaacacaaaaatctctgcaaatttctgaagtctgcacccactgtaatattaccatttctgctagtttctgcctgatcctggacatctgcagcctcttaactgaatccaagtcagttaattatcagatccaatccaatcatggatccagtccagtttctgttgtgacttccaaacccagttcggatcagaagtttgctcaaactcggttccaaacagaaatctgtcgagcttcagaatctcagcgagaacttaccacgatatcagttgcttccagaaagcaatggacatcgtgagtctgaggggtaccttgcttggtcactccatgctcctgggcatgacatctgttgaaaaccttagacatattaaatttaacagagtttaactgagcaaagaatgattcacaaattgggtagcccaggaaccagaataggttcagagaggctctggtgcagtcccatgattgaagatttatggacacaaaaaggaaagtgatgtacagaaaacagagatgaggtacagaaacagccagatttgttacagttcgggcatttggagtatttgaacatagtttgaacagttggctgcctttgattgactgaaactcggtaattagcacaaaagtaggttacgatctgtttatacatctagttaagtttcagttcactgtgtacagagaaacctttaggccaaacttaaaatatgtaaggaggtggctttaggttagacttaatttaacagatgttatatatattggttttcatccactgttcctgtcttgtaactcccatagcccttgttaaagtctttttgttacaatgttgggtgtgtcaggtctcatgtgtctagacttaatttaacaaatgttacatatattggttttcatccattgttcctggcttgtaactcccatagcccttgttaaagtctttttgttacaatgttgggtgtgtcaggtctcatgggcaggcctcaggaaacagaatttctcagactttctcctatccatctctcatctgccccaagacaagaccctataatcttccctgcctttctgattgggagttataagaccctcctcagagggcgtcccaccctatccttggaggaaggaatgctgatattttgaaatttccataaaaacccaggaggactaggttccagaagcttcaggatggctcaacacgtggaggttcttggagggtggcctgcacaggaagggcatagaagccctgtgccccttcccccatacctcactctgtgcatctctttatctgtaatatcctttacaataaaccagtaaatgt

SEQ ID NO: 966 - DNA, 6098 bp, Homo Sapiens
cccagcccaggcaggaggtgcactggcctcccggcggccttttgaggcctaagagctccaagccctgcccttcgtgccctctgcactagacgcgtggccacagccgacagtggatacctcatggcgactcagagtcctctctttaacctctcagctaccttcttctcatgacgttttctcggtaaaataagtggtgtggctcccctctcctgaccgggctgtgtcccaggacagagccggctggaaacgccccgcttgactggagagcactgcccgggctgctgcaggtgcccctttcacaggagctggagcgcgcctcaatgcagagatggtgtggctgggagggacttccctttcccagtcctccacttacatcacagggcacaagagccattggaaaagcatttagagaaatcatagcgaaaattttccagatgtggcaaaagacatacagctgcagatttaaaaagttaagcaaacctcaagaatcgtaaacccaaagaagttcatgccaatcacatcataattaaacatcaaaaaaaaaaaaggcagaataaattttgaaagcagctggagagaaatcaaatgttgttcatgaggcaacaccaattcaagtcagctgagctttcacctgaaaccataggacgcagaagggagtgactggtttttaaagtactgagggaaaagaactgtcaactgtagattcaatatgtggcaaaattcctccaaggagtgaaaggaataagtacttagcaaacaaaggaaaactaagaaaatttgttgtatctttaaagagtacctaaaagaaattcgctaaaaggaaaggaaatcaacaacaacaaaaggacttggaactttagaaagaaaaggaaaacattaaagtagattttagaaattaggaaagatataataaatatccttcaattcatgagttgccaaattcatatttgatggttaaagcaaaagttatatgaccatctgatacagttctctttttatgtagtgaaaacacttaagctcactatacataaaaagtgggaagaataaaaagacctgaatgacagtaaggtaagatgaaagtagaaggaaggaaaaagatgtattaatgcagacattaattaaagtaggagtggctatattaatataaagtagacttcagatgaaagaaaattgcaagtcaaagagcaacattaaataatgtaaaaggatcaatccatgaggaagatgttgtgatcctaaatgtgtatgctgcagacaacagagccttaaaatatatgaagcaaaaacagagttgataggagagagaaacaattccacaattataggtgggaagtttaacatctgactctcagcagctaatagagctactagacaatcagcaagaatacagaagactgagcaaggccatcaacccacaggatgtaactgacatatagagaacactcccaccaacagcagcagagtacacattttccaagggccgtggaacattcaccaacccatattctgggtgattaagcgagcctcaagcagtttaaaataattgaaaccatacagagtgagctctttaaccgtaatgaaatcaaattagaaatcaataaaataaaaacaacagaaaatatccaaatacttgaaaattaaaagacttctaaatatttcatatatcaaagaggaagtctcaaaggaaattttaaaaatacatagaatgggaagaaaatgaaaatatctcaaaatatgtagggggaaaaaactagagctgtgaggaaatttttagcactaaaaacagaaaatgtctcaaatcaataacctaagtaattcaagtaactagaagaaaaaagagcaaaggaaggaaatcataaagataaaagcagaaattaatgattttttaaaaaaaatgaaaaggtaaccagcagcttaactccataatgcattttaaaactttttttccattttagtctcaagatgtaatcttgaagcaaactgcaacagccttttcccttaaccttaaaatagactgcatgttccttcctttcccactgtgtactcccttcacattcatctaattatgccagtatctaagtatgtgcttacttaggagttcaagggctaaccttgagacagatagaccgagcctagagaccgagcagaattccagagattacctcaaggcagctagtcaccaacccagccattgttcagatgatgtcagcccacactccaggtagacagagatccaagatagccagtgaaaaaggacacacacaccttgcactcaacacaactgcatgtgtcccatacgaagtttctctttataaaccctagccttctccctacaagttcaatgtgattcctttggatatgaatccagccacttccctactgctagtttttgttaatgaagtcactttccttttaccagacctcactcattcttaagacttcgcaagcagcaaacagctggacctgcattcatttacaaaaatagaaaaaaatgaatgaggcaaaacactgtctgtttgaaagaaaatcagtaaaatgcataaacctctagtaacactggccaaaaaaaaagacacataaaaattagaaatgaaaaaaaggaaatcactatgaatcctttggccattagaagaaaaataaaggatatgatgtataactttaaactcacacagtcaacaactgaaaagaaaagaaaaaagtccttgaaaacctaaaactaccaaacctcaatcaagataaaacagacaatctgggcagttctgtaatcttcaaagaaattgaatttgtaaataaaagtttccacaaaaagagatctccaagtctggatagttgtattgaagatttctaccataaatttaaagaagaattaacaccaattttacacattctcctacagaaatagaagaagcaaaacacttccctactaattttatgaggtcagtattacccttataacaagcctacaaaagacaatacaatgatttatatcactcatcaatttagaagcagatattctcaacaaaatattaacaaattgaatccagcaatgtatacaaagaattctacaccataaccaggtggggtttattccaggtatgtaaggctggttcaacatttgaaatcaatcaatgtaatccatcataagttaaatttaaaactttgcgtgatcttaacaattgacacacaaaaaaagcatttaccaagatctgtgataaaaataaaaaagaagggaactttcttggcttaataaagagcatctacaaaaaaccttcagctaatatacttagcattaaaggaatgcttgcttttcctttaagattgggaacaaagcaataatatccactgttatgactctattcatcatactactggaggaagttttagccactgcaataaaacaaggaaaataaataacatatacagatcaaaaaggaagaaataaaaccggacctgcttgtaggtagcatgattgtctacatagatatagatctatgtagaccaaaaaaaaaaaaaaatagaatcctagaactaataagcatgagggctttcttaaactcagatcaatgcataaaaatcaactttatttctgtataccgacaatgaatatgtagaaactaaaattaaacataacagtttacaattgttccaaagaaaatgaaatagggataagtctaacaaattgtatacagaatctgtatgctgaaaactttgaaatgccgatgaaatgaattttttaaagtcctaagtaaatagggaaacatactgtatttatgagttggatgactcaacatagaaaagttgtccattcttcccaaattgatctacagatataatccaattcctacaaaaatcccagcaagggattttgtagacatagaacaccttatcccaaaatgtatctggaaagcaccaggccctagaatagctaaaaaaaaaaaaaaaaaaaaaaaaaaaaaaaaaaaatctgtactaagaacagaatgggaggaattattctacgtggtattagatttgctatgtaatcatagcaatcaagacactgtggcattgaaaatgcaatagacatattgataaatggaacaaaacagagaacccagaaatagacctacacaaatatgcccaactgagttttttataaagatacaaaagcaattcaatggaagaaggaaaatcttttcaacaaacagtgctggaggaatttaacatcgataggcacaataatgaacacaacctaagtctcacagctcataaaaaattaatcaaaatagatacaaacataaatgtgagacataaactttaaaacttttagaaaaaaatagaaagaatcttcaggatctaagatttcttaaactttacaccaaaagcatgatccataaaaggaaaaactaataaatttaacgttatcaaaattaaaaaattttacttagtgaaagatcccattaaaagaatgaaaagacaagctatagactggggaaaatgtttgcaaatgccactaccaatgaagaattagtatctagaattaagaaaaaaaaactcttaaaatttaatagtaaaaaaatccggtaacatgagcaaaagacatgcacagaaatttcgctgaagaggagatacagctgtggaaaataaacacatgaaaagatgttcagcaccactagctattagggaagtgcaaattaaaatcataatgagatatcactacacatcagtcaaaatggctaaaattttaaagatagtgacaccaccaaatgcaggcatgaatatgaagaatacagatcatttatatatcactggtggaactatgaaatggtacagccaggttggaaaacagtttggcactctcttagaaaattatgtatgcaattactgtacaacttagcaatatcactctttagtatttattccaaagacagaaaaacccatatcaaaaaaaaatctgtacacgaatgttcacagcagctttatttgtaatagacaaagactggaatcagttcaggtatccttcaacagatggaaaattaaaaatatgattcatcctttccttggaaaactagtcggcaacggaaaagaacaaagtgttgatagacacaacttagataaatacctagggaattatgctaattttttaagaaagccaatttcggctgggcatggtggttcatgcctgtaatctcagcactttgggaggctgaggtaggcagatcacgaggtcaagagttcaagaacagcctgaccaagatggtgaaaccccatctctactaaaaacacataattagcagagcatgatggcgcacgcctgtagtcccagctactcgggaggcagaggcaggagaatcacttgaatccgggaggcagaggctgcagtgagcccagattgtgcccttgcactccagcctgggagacagagcaagatttgtctcaaaaaaaaagaggaagccaatttcaaaagattccatattgtttcctgtatataagatttttgaaaggatgaaacattaaatattgagaaatgattggatggtttctaagaattatggatgatgagtggagtgagcaatgagggagaggaaaggggaagaaaggaagggatgatgaatgtgcttataagagtgcaacccggggtgggcgtggtggttcacgcctgtaatctcagcactttgggaggccagggcaggcagatcacctgaggtcaggagttcgagaccagcccggccaacatggtgaaactccatctctactaaaaacacaaaaattagccaagcgtggtagcacacacttgcgatcctaactactcagaaggctgaggcagaaggattgcttgaacccaggaagcagaggttgcagtgagcctaggtcatgccactgtattccagcctaagcgatagagtgagacaccatcttaaaaaaaacatatatatatgtatatatgtagaagagagagagagagagagaacaacacaggatccttgtgatgatgagtggtggaactgtcctattatctttacttcagtgaagtaaatatacatgagcaggtatatctatacatgaatctacacgtgtgataaattttatagaaccaaatacacaaaaaatgaatgcaa

SEQ ID NO: 967 - DNA, 10941 bp, Homo Sapiens
aatcaagtagccggcttgccttgcggaggatcctgcttccccctcctccaccccatttttttcctttcacccagtaaaaccctgtttaactcacccttcaaaccgtctgcgaggctacgttttcgtggccacgggacggacaaggaccccatctttagctgaactacggaaaagccctgcaacaccaccatctcatcgctgacttggaaataagctagcagtggctgtgtcagcaagaccaccacatgcagcaagggtggccacttccagctagctcctgcatccacagctgcctcgcccctattggctactgccatccatgtaacagactcttgggaaatatgctcggctgaaaaactgcatttcccaactcaagacctaagaggtggtcaggagatacaagcaggagtccttggatgaggtaatgagaaaagtcatcatgctctagtccttcctctttcttgcctcttgcaaatggaatgactggaacacagcagccatcttgagatgctgagaatggaaaccacacattaaaaatagaaagagggccaggcatggtgactcacacctgtagtcccagcactttgggaggctgaggcaggcggatcccttgagcctagaagtttgagaccagcctgggaaacatgggagatctcatctctactacaaatacaaatacaaaaaaaaaaaaaaaaattagctgggtttggcggcatgtacctgtatagtcccagctactcgggaggctgaagtaggagaatcacctgagccggggaggtcaaggttgcagtgagctgtgattgcaccactgcactccagcctgggtgacaggagtcagaacttgtcaaaaaaaaaaaaaaaaaaaaaaaaaaagatggaagggcctgggttcctgttgacatcagggagccaccttaccgggcctgggttgcttttctccagatatttttatttttaatgagagaaggaaataaactttttctttttgaactgcttatttgactgtagctgtaaatacaaagctctagaatctctgtggtaatgacttttaaaagccatcaagtataagccctgcaccatgtcaatgagagataaagggaagcaacaagaaagggaaaggagagggaaagagaacgaaacagagacagtgcttgatccagggccagaccacctgagtttggaccctagtctatcacctccctactaactgaccctgggcaaactacctaagcttcacagcaccctcggttctctaacctacaacatggggatgccaatggcagtgacctcagtgtatggtgagagttccatctgttaccatgtgtctgtctcgcggtaaacattcaacggcagtcaggtgctctcccgctttgaggctgcctggcagcaggctcctgtctcctagggttgaccgttttctttggagtagactttcactctatcggaaagctgttcctcgggatgaataaacactgcattcccatcacttttggggcctgtctagatctgtttcccagagccatcatgtgcaagactaatttcgctctccatatgaaaagtcttcaagtatttgaagactggctggccatcctgcacaccctgaatcttcactcctctggctgcgcatctggagtgacggagcccctccctcgctgtgcttcagcttgttccttcccttcttcagtgggactccaaggaacgaaggtcatattgcaagtacacttctgtttttgtggccatcctctgatacaaccatgttcggcaggagtcacttggcaactttcagctggtggatggactgatctggaggatctgagattgtttcactcacatgcccagtgccttgcaaggctggctgaagggctgggatcagtggggcctgggaggcagagagctcacctacagcgtctccagcgtggcaaccccagggcatcagaacttctcacgtggcacctcaggactccaggagcgactgctgccacaatccaggaggcactgtatggcctctgtgacttggcctcagaagtcacaccatgtcacaacctttgcactttgttggccgaggcagtcacaaggctgcccagattcaaggagaggagacatagactctacctcttagatggaagaggcatcaaagaatttgcagccatttttaaaacagccagttttctttgactgcatgcttttattttcccctgtaatcattctcagagtgagatctctatatagtaggtgctgtcaaatgacacgggggagtgtctttctcaggtctcttactgggaggtacagcactggtgtagatgggtctttcctccctgctgtgtgtagaaggctgtcacctgggctgcaccattctggatgccacactattactgacccagtctaagacatgattaacccctttggagacaatgtaacattgccgacccacatcaagctcactgtatactacagtctcagctcttcttcttgcttgcttggaagtacctgccctacctgtcagctgctagtgacccccgacccatgaacagtccataccacagtcttctcatgctcaacaccaagctcatttgatttcagttggtacatttttgttcttcctctttatgaggttcctcaaatccaggcctggggaaggcatctctctgctgctccatgaccgtccatgagtcatggagagtggccctgtgatctcagaggggttttcaaaaccagagtgtgtttgccaacaaaaatgatcaacattgattggagggctggagaaggagttatagagtctggaaagtgagccagctaaatcttcatcttcgaaaatggagaggttgtagataatgtctgaagttgacagagcaaggaaggacattctataaacatattactgtatttggagttatgcaggtagccactgaaaaactaagaacagaaatgcttcaaactggttgcctctggaaagagagctgggaggaagagtgggctgggagagaccagctctcctcatgcttagccgtgcagtgcaatgtagtattttaccttgtgcatggattttgtaataagaaatagcgatgtgcatttggatattaaaaacattacacaacaatttagagtgaggcgtgccatttaaaaggtctgattagaggttgcggtttgtcattacattttatagagggttgtcttcttgctttgggtttaagctctgttttcattattttaatttgttttttagaaaatcacaaaattgggacaaaaccaggagagagttgaagacaatgggggaagggggagaaaagctccccagtgaattcagctgccctttctgtaccactctatgtactttgattttatgtccttctggaaaaattaaattggaactccctttatcacttcttcatttcattttttttccgttgtaaaaagggcaagagcttaatgtgccacagagtaaagctgcaggggcagctgggcacacatgggcagatgcccgaggctctgggcagctggctgggtcttccactcagtttccaaagtacgcagtcgtggcagcagctggaacctggcaggcaggtgacaggaagacaagctaagggggtgcatatggcatttctgtcgggtttaatgttttaacaagtcagaggaatacttaaatatcaaaacgaagtatccctgcagtaaatatttatcctttaaccataaaaatatccttttataccctttgagaattgagaggagaggagaggagaggagaggaggggaggggaggggaggggaggggagaagaatggagaggaggggaggggatagaagaggggaggggaggggagtggaggggaggaaaggggagaggaggggaggggagtggaggggaggaaaggggagaggaggggaggggagtggaggggaggaaaggggagaggagggaaggggagaggaatggagaggagaggaggggaggggaggggaggggaggggaggggaggagagagattcttcagaggttgatccaagctactgaaagggttgttcattcactggcagcactggcctcacccgggagcttgttagaaatgtaacatcttcctgttcccctaagtggcctgacaatctgtggaaatgtgaactcaggcaaatcgagaggttcaaatcttcgtgttcattgaagaacacctgtgaaactgctcaggccgtcagggtatgcatatatcaagagccacccagtatctgaaagatgtcacttgacagagacagtgtgtaccattctgacgttacaaaggtggagttggtaggtgcgtccaggccaaacagtgggactggacacagggtcagtggcccaaaaagagtgctgaatgtttgctgcacatgcttaaaaatgcagagtcatgctgaacgtaagggtttacatgtagattctctggtcattgagcatagccaggtgaacaaagtacccaagatgtgtggccagactcacagagctcagggtcaggttaacccatgtgtgagctctgcctgccacagtgagatgagccttattgaaaaggaacaaattgttcctaaaccagaagaggctgcgcagaagaaaaagatagcccagaagaaactgaagaaatggaaacttacggcacaggaatagactcatccaacaataaatggaattaaaagtacaggaaggaaggaaggaaagaaagaaggaaggaaggaaggacagaaagaaggaaggaagaaaggacggaaggaaggaaggaaaaaagaaggaaggaagaaaaggaaagaaaagaaaagaaaagaaaatgtagcatctcaggctccccatcccatggcctcctgctcctaatctgcattttaacaagaagctcaggggattcatgtgcacagcagtttgagaggtgctattctaaggtatagatgaggaattcttagtcaagaaagtgcaagcttgtggttctcagctttagcttagaagcatgtggggcacctgaaaaatactgatgactgggtcccaccctagaataattaaaacaacctctgggggcggagcctaggcatggatgtgttttcaaagcacccaggtcatctcaatgtgcggccaaggcagaaaatatagggtaagtgatgcttagagctgctgagcacattctgtggcaacacccaggtggagaccctgtctccttcatgcgctgcctcctctgcgcttggcgacgtgaaggaaaactgtcatacacaggctcgcatcgaatcccacaactattcacaagatggtctaagtggggtgtctaatcttttggcttccctgagccacactgaaacaagaagaatcatcttggaccacacataaaatatacaaacactaaagatagctgataagctgaagaaaaaaaactgcaaaaaaaaaagtcataatgttttaagaaagtttacaaatttgtgttgagccacattcaaagccaccttgggcccatgggccatgggtttcacaaacttggtctaagacttcatccttgagttagagtaagcctcttgtcactggagaaataccttactgctgtaaactacatgaaacactcatgcatattacaaagtggaatattaaaatctgctgccctaagacattgaacagcttcagtgttatccagcaatgctttactcaaatgtggatggagagtttaactaaaaggaaagcatggacactgggaaaccaatcaatcagatttcctattttcataactgagagacaaaataaaataagggtcgacagaaggtgcacgtgtttgcaatacttttgcgagagcccattgccacagccaaatgttagcctcttgaggcataaattaatttaccacaaatgcatgcctggttgcgtctggattctgctagggcgagcagtatgtgttagacttttggacaacagcttaaagaatgacatttctccaacttgctgtgatttttatcctcgagcagaatgtttttcttggaatgggtttctgggagggtttgcggacataattctggttatgtgtgcgggccctgaagggtgcttttatgaatttagagcagcagctgtccaggcagagggatgctctttacccagagtgtgtgtgccccagtaaacatatgaatggctttcatggagctctccagacacgtggcttgcgccccctgtgcccggccttacctggtactgctgcccggtgcagaggatgaggtggtcgtagggcacgatctcgtccgtggaaagcacaacgtgcttggctgctcggtctatgccggtcattctacccaccacgacattaacccaggagcacagtgacatcagtgcataatctttatcattaaaacagtggctgcaaagagagaagctccgtaagtgacatctgagcagctgacagcgggcattaattagacatctggtgagctggttcaagtcccctagtgggctgagtccgtgctcttgctgtgagtttaccaggactgatactaggagatttttcgttatgaaacacttagttacaaattgacatcttcccattaaagctaaattgttccacctggcttaggtcagcccacaactgggagggtgggaggggtgtgtgtgtgtgtgtgtgtttatctgtatgtgtgtgtgtgtgaaatcactcatactatacctttcttctgcttctacttcagagtggttgtaaatttactttagctgttaaattggtgtattgaccacagcctcaatgggaatgagaaggaagaaagtgacattgttgaggattcccaaagccaggggtcagaatctttgaataccgagaacccttcctattcgctaatacttttcagtaatcactcattctgagaattagcgtatggcttcctgccaaaacaacaaaacccattttacttcaagaatatagcaattagggagttaggttcgcagcaagtacactccctggagactttgggattcacccttcagggcagaggtgattttctaggaacggagacttcgaccgccagcaggcccagggcggccattcatgccatggcttcagcgtgctgtggctgcactggcttccattttctgggctctcttggagtttgagcgctttcacgtagtatgataagagtgggtttcttgtggctttgggtttatttaaacagttttgtgagggttgtttccagaattttctgaaaggattgacctcaggtaaaccaccttttagtgattctgttctgaatactgagagtctaaggtaataggacattaagtgcttcttttaatttaggctgtatgattcttttcttccttttttctcttaacataaaaacactaacatttttatttattcatctatttattatttatttttagaaacaggatctcactatgttgcccaagctggtctcaaactcctgagctcaagtgatcctcctgcctcagcctcctgagtagctgggactggaggcacgcgccacttctatgcttggcagcacagtcctcttcaaaaagaaccctgccatggtctgtgctgctgacaagcctggactctgcatcctcctgctgtcttcagtttcctcacctcttaacacagggtggaactgaagcaagtaatttgcgaagaccattgatatagtttggctctgtgtccccactcaaatctcatcgtgtagctcccataattcccacgtgttgtgggagggacctggtgagaggtaaccgaatcatgggaacaggtctttcctatgctgttctcatgatagtgagtaagtctcaccagatctgatggttttaaaaataggagtttccctgcacaagctctctctttgcctgctgccatccatataagacgtgacttgttcctctttgccttccaccatgattgtgaggcctccccagccacgtggaactgaaagtccattaaacgtctttcttttgtaaattgcccagtcttgggtatgcttatgtttatcagcagcatgagaatggactaatacagtaaattggtaccagtagagtggggcgctgctgaaaagatacccaaaaatgcagaagcgactttggaactgggtaacaggcagaggttggaacagtttggagggctcagaagaagatgagaaaatgtgggaaagtttggaactccctagagacttgttgaatggctttggccaaaatgctgatagcgatatggacaataaagtccaggctgaggtggtctcagatggaaatgaggaacttgttgggaactggagtaaaggtggcacttgttatgttttagcaaagagattggtggcattttgcccctgccctagagatttgtggaactttgaacttgagagagataatttagggtatctggcagaagaaatttctaagcagcaaagcattcaagaggtgatgtgtgtgctgttaaaggcattcagttttataagggaagcagagcataaaagtttggaaaatttgcagcttgacaatgcaatagaaaagaaaatcccattttctgaggagaagttcaagccagctgcagaaatgtgcataagtaacaaggagccgaatgttaatccccaagacaatggaaaaaatgtctccagggcatgtcagagacagcagcccctcccatcataggcctggaggcccaggaggaaaaagtggttttgtgggttgagcccagggtccccatgctgggtgcagtgtagggacttggtgccctgcattccagacactccagccatggctgaaagaggctaatgtagagctcaggctatggcttcagtggatacaagcctcaaaccttggcagcctccatgtggtgttgaacctgtgagtacacagaagtcaagaattgaggtttgagaacctccacttagatgtcggaggatgtatggatatgcctggatgtccaggcagaagtttgccgcaggggcagggctctcatggaaaacttctgctagggcagtgtggaagggaaatgtggagtcagggcgcccacacagagtccctactggggcacttctagtggagctgtgagaagagggccaccctcctccagaccccagaatggtagatctaccagcagcttgcactgtatgtctggaaaagccacagtcactcaatgccagcccatgaaaacagccaggagggaggctgtaccctgcaaagccacaggggtggagctgcccaagaccataggaacccacctcttgcatcagcatgacctggatatgagacatggagccaaaggagatcattttgaagctttaggatttgactgccccactggatttcggacttgcatggagcctgtaacccctttgttttggccaatttctccaatttggaatggctgtatttacccaatgcctgtacccccactgtatctaggaggtagctaacttgcttttgattttacatggtcataggcagaagggacttgccctgtctcagatgagactttaggctgtggacttttgagttaatgctataatgatttaagactttggggggccaggcatggtggctcatacctgtaatcccagcactttgggaggccgaggcaggtggatcacgtgaggtcaggagtttgagaccagcctgaccaacatggtgaaaccctgtctccactaaaaatacaaaattagccaggtgtggtggcacatgcctgtaatcccagctacttggcaggctgaggcagaagaatcacttgaactggggaggtggaggttgcagtgagtcaagatcacaccattgcactccagcctgggcaacaagagtgaaactccatctcaaaaaaaagaaaaaaaaaaagacttgggggactgttgagaaggcatgatgggttttgaaatgtgaaggcataagatttgggaggggccaggggcagaatgatatggtttggctctgtgtctccacccaaatctcatcttgtagctcccataattcccatgtgttgtgggagggacctgttgggaggtaattgaatcatgggagcaggtctttcccatgctgttcttgtgatagtgaattagtctcacgagatctgatggttttaaaaataggaatttccctgcacgagctctctctttgcctgctgccgtccatgtaagacatgagttgttcctccttgccttccaccatgattgtgaggcctccccagccatgtggaactgtaagtccattaaacctctttcttttgtaaatggcccagtctcaggtatgtctttatcagcagcgtgagaacagactaatacaaccatatagctagtaagtctggaggcagggtttgaacccaggatgcctggctccagcatcctctcaccttacctctgcctgtactgtcctgtagatctcaaattgttcagagggatccaaaggtcatctaattcccattggctgacattagctttattacattcagatacacacagttactcaaatcaggataccaaaaagtgtcatctgcgaggaaattctagaggattcctttttaagagcaaaactgctttatatttgcatcaggctttccagagcccaaggcacattcataggcattcacatagagattaatcttctacacaatttatgctagggatagggaagagaccggtttttctgatccacatttcataggtaagaaaatcaaggttggaaatggtaagtaatttgttcaaggttacaaagctcataagcagtgccagctatgaaagaaagccaggcctgctggccctaggcagcgccctgctccaggcacccacaatactccctctaactagtcctacaggtaaagtgcacctaagtagagacttctgaagaactcacatgctcaaggctcactccgtgtttgcccatcaggatttaagatgctcttgctgcaaatccaccccctggttaaagtcagtaaaatttcatgggtgagctgatcttttcatagggttcatgctgatgagatttttttttctaaaatctcttcttag

SEQ ID NO: 968 - DNA, 1477 bp, Homo Sapiens
aagaatttttttttctttaaatatcattcatcaaagacacatttaatcctgttagttctgcatgcgatttaaaaaaattgttctggtaatactctgttcaacactacaagtaattctgcatcaagagaaagctccaaatattctaacaaccattcagcatttccaatgatcttagatccacgcttggtgcgaaaactgaaaacgagagaaaggaaacgctgtggccaggtccatctgatactgtgaaatatttcttatcttgattttctcctggataagatcctggagcttggtgagaagtgtaatgtgtaggggttctaaaagccagaggccttgctaaatttagatttggttcttgcttatgtaattttccctgtgttttcaattatttatacaaatatattatttatatatgtctggaacttgtgcttttagcactcaataagcaggaataatttataggattacggagtgcttcctgtccttacctttcagagtatgttcttttgcattgttaattaattgttatatttcagccttcctttcccagcagtcttgtggtggtgcttaactagtcagagagataggatctatatttatcatcatatgcatgttccaaaatccaggttaattattttattagccattcctctagcctagctacccattgcggggagggggctgcgtgtcggtggcatgacccaacaggtcatgttccttaagtacagtgagagcctgctgaaagaggaagccagcttccaggcctaaatggaagttgcctgtgcttcaggtttcttttttgcctccactttccaaaaacaatctagttcttgacctatccttttctccaccctccctcaacaccttttttcctctgctgccttgcactggcctcaggcacctacccaggctcctgaccatgggtctggatttgggctactgctagagacgctgcctgatttttgcccttgtctctctacagtgctcccttccagttgttccccacgtctggccctccttttccttggttctcaccttgtcttggatttcagagattcaggccctgcaacacacaggactggatgacagctgctcagagtcaacctggcacataccccagagtggtgcttgcatgtaaggaggcctaggcactctgggaatcgaaggcctgaaagtggctccactggctgagggctgggcaaggtagcagcgcaacatctacttctgcctttttctccacagtctcctcagtattccctggagcaaatggagagaggtgttggttgtttccccctgaggctggagtatattgctgtctaatcataggtttcagaagagtaaatatagtgagatacataaactttccctctgtgaaaaggaggacagagatttacaaactgaggtgtgttttttggctactgtcatttaaaggcatgaggctggctgggtgcggtgcctcatgccagtaatcccagca

SEQ ID NO: 969 - DNA, 1799 bp, Homo Sapiens
ccctggtgggctttgaacacctgagctcaaacgatgccttgacctctcaaagtgctgggattacaagtgtcagccactgcacctggccgacattttttatttgtttagagacaaggattccctgtaaagctgcaggggcacaatcgtggctctcactgcagcctcgaattcctgggctcagtgatcctcttgtcccagccacctgagtagctaggactacaggtgcaccccaccatgcctcctattttttgtgtttgtgtggagatgaagtgtgttgtctaggctggtctcaagtgatccttcagcctcagcctcctaaactgctgagattacaggcataagcttttttgataaaggaaaaactagtgagcatttcacattgtagaatccaaaaacatgaaagttaatcttttcctgtcaatttacagttttgtaaatgtacccaggtgaagagactggtctgttactgtagatagaaaagtaccaaaacaaagttttactttgttcagtatactgtcgaggcaactttctaaatgagagggtccaggttcttggttaaagaaggaacttagaattaacaaaatagtgacaaacatttgcggcagcgcgcctcagggcaccagctgcaggggtctgcccacagaccctgaccctgcgacagatgaataaagtacactgacacacagatagtctgttttgccagtccagctgagggtgtcccactgcttacagactccctggagagttctgaaaacagttgcaactaggcctcagtcagctagtgagacttgcatttattcaaaaagattaaggatggcttgagtcaacaccattagagggtaattgatattgtggacttcccaagtaaaaagcacttaaccccccgtggtacatccaagattagtcttaagatcatatgactaaacaaactaggtaaactactctgccttcctttattactactttaatttgtttaaaagtaaagatcaggttgccttcaaccatatctatcaccgaagctatgcaaacttctcggccttccaagaattgtatctgtctctgtaacaatctttaatgtttttcccaccagcctgattgaatcccaacacatattcagaacttaaggctagaacaagatgaggaagatatgacagcccgtgattttaagcaatctaaggaaacccatgcttgcaaagaattcaaatgacgtgagagctactaagataaaatgtggccatgcaccaagccttgacggcaatatttaatctcataacaattcttctttcctcctatataagaagcatggcagcgacactgtgcataaattaaggcaaactgttgttatgtgaaaatgttaatgaggtagattcctttggaatcattagtgtgaagagctggtttttgttttcccattgcctaggccctgactttagtagtgactgatgcagcttttctagtctaacaaccctctcccccaagtaattctttgatgccctgcccttcagcttcatcttttaccacttactattgggttttgccaccatttattttatcattcacttatctgttcctcttcctaagttacaaacgtttctgaagcaaaagaaaatgtatcactgtagagagtctaggacctttagtgttatttggtcgtttacttttcatacactgcagcttttactgttttgaaccttcattgctatagtaggtattgaaaaatactgaacgaccagaagtgatttgatttctcccttatctggtaaataattttttttttttttgagatggagttttgctct

SEQ ID NO: 970 - DNA, 2015 bp, Homo Sapiens
gatgtcccggcctttccttgaaccagtagaccctaatgatgcaccagattattatggtgttattaaggaacctatggattgacctttgtaaagaagaaaaacatgttagaagaaaaatggaaaagaactctgcatgccctcagctcagatgccatctcctctgggagctcctctggcccctgccaaggctggatcagatgccctcagggcacacacgatgctgatccagggccatctgtggcccagactctgggtccctcatgcagccctcaccactgctcaggaggccacaggaacagaggaatcactggcccattttacagacgggaaagctggacccggagaagtgaagcaactttcctgactcacagtgggtgagggcctcccacactctttcccctgccccatgctgtttccaagggacttccacaggcacaggaagcaggctgagtgcatagcaggagtacagcgctgctgcccagggatggagcaggagggccagggagagagagacaggggtgcccctggtgcccacagagacaggtctgtaaagcccatgaacaaactctcagcagggcggggacgggtgaatggggctggggcccacaacccataccacaggcacctggtctacacaggtctgtaggcctgtgcagatacctggctccttgaccaaggagggtgataaggccccacctgaccccagagatttcgccacctggttaggtgggcaggaggatagtctctctggagctctgggtcatggactctcagaggtagggagtgagtcagcatggccaaaaggtggagacccagtcacccacggatgcttgggatgggcgagcctcctggggcgaagccttctagggtctagggtcccacatggtggtccccggagggctttctgttcttccaggccctgcagaggagaccaaggctcagctggcagctgtggggccagattctcctctttgcctaggggagagcccccgcagcaccccttgagagcccctggggacctgcctggggcacaccctggcccccaggaagcccggctctgggagcactgcagccaggatggaggaggcagtcttcagagaggcactgtctaggccagccctgtggggagggaaggccagatgggggaacctggaggggcttgtgaactggttcctgaccctagaaacccagcagaggtggactcgaagcccattctggggagaaggcaccggcaggcttctccgcctgaggtctgccctcctgagggtgccaggagagcacagccctgggaagactgtagcctgggctgtgacctgaggactaggaagcgtttatgacagacatggagaggcctaagtccctgctgaagcccagcatcacatcccattcctgagcaccaaaggccccaggccctgggtaagagaagcttcctaaagggcatcctgagggccccgccctgatcacctcttctttggagaatttcaggagggaggctggcatgggccagacaactggctggacagggaagaggtgggaatatctggacctcgcctgcctctcgccacactccccgcttccctcctcactgtagccaaagttctccctgtgctttccaccgacagttcatggcctgtgcgtgctattccttctgtctggaacgcccttttcccctttgcttcccctttctaattcgtcatttttcaggtctcaccttagaagtcacttcctccaggaagtccttcctgccttgtcctcctctgatctgggctggatgtaagcctctgtgcttccaggacgtcctgcctctcaccctcacccccggatggagttgctggttttcccacctgtctccctctcaccctcacccccggatggagttgctggcattcccacctatctcccctctcaccctcacccccggatggagttgctggcattcccacctatctcccctctcaccctcacccccggatggagttgctggctttccaacctatctccctctcaccctcacc

SEQ ID NO: 971 - DNA, 3184 bp, Homo Sapiens
gagcgcaggcgtactgttgccaaacgctgtgttcgactgtcttcccgcgtggggcctcgccttctgaatcttcttaccctcggcttcctacccggttgctcactgttttcccccaactgggtgtgcgggtgtctgcgcccgcgccgcccaccgtggggtactcctggcatttcgcttccagagtgctggcgcccacaagagccggacgttaattcaggcctttaactttcactctgtacctccccacaaccagacgagggagatgcatctgggggtggaagattgtaccctgcgagagggctgtcactcttctcgtggttgcaccccaggcaggtggagccagctctcagcaaattgtcggcccccagtgcttggtcccggtgcacacaaaggaaactcaggctagttggaaactccaaatctgccttgctgtcctggacccccatgcaaagcagtggtgattccaggattctaacctaaccggctccaggtcacacagctgtaacaggcaccgtgtccgatttgttcttgatggtttgtttgcacagctcctggctctcctgacatgctgcacttcgtaaatattcagggcctcccgtatagtttgcttaatatatgtcttccctaggcgactgtgagctccacgagggcaaggaccttgtgttttgtttcacactgtgcccgcaagtgcctgttgaatacacatgggctcttcggtttttaactattactgaaaaatgtctgacattgaaatccatcccaagcccctaccttaggctcatatttcaggcttctagatattttcacttgaattttcttgtcaccaagcatgttaaaaactgaagtcacacccatcccctaccccccactcttgtactgtctctgtaattggcagtgtcaccacctattcattccccaaattacacctctgagaaccatccttgtctcttcctcttaccccgactccaaatataaataacttaccaagcctcgcagatttttacttcccaagtaattctggagacagtcttcctctgcctcctcactaatgctagccttgcttcccaggtctggatttctgtagctggctcttaatcagctttcctgtctccagtctcactccctccaatcagttctgctcactgctatctaaaatgcaaatccaattcctggcgctcaggcctctgcttcaaccatctcattgctccccatcacccacgacagcatttccctagtgtgctgtgttcagtgttaatagatgttcctttaagaaatgtctcacgatcaagtaagaatgggagatgctggggtgtacacattttgccttccttctcctttcccctccgttgagctgataatagcagaagagtctttatatacagttgcttagtgtgggtgaaactagataaatccatcacaggccctcccttagaatatggaattgggactaagagaccccaacctcgaaagtctcttggacctgggatcccttgggcagactggttccatcctgtaagacagggaacctgtagagaaagagtggagttgagagagaaaaggagagtgctgacaatgtctctctttcacatgtttctgtgcctggctggctgcctctacccttggagtctgagccgcattcctggatccttatggtaaattctgcttctttgcttaagctagataaagtgaatttctgttacaaccaagagtcctactaaaagccacgtgtaagctatagttatttgtttggtactaacaacatgcaagcaccaaagcactttccatacattgtctcatttaatgttccagatatccccatgaacaaggccagcttcagcacaggcacgtgacctgtgcagttgaacaaggcctggggggtgcctaaaaagattctacgattggtttaatgctctgatgtcaccatctagaaagtcttagtggtttttgacaaaagggcccctcattttcattttgaactgagctccacaaattacctatgaggtattatctctatgtgacaaaaggtttattttctgccagacttattagtgcctttaaaatcaaaatatgcattgtaaatatccaagtgagggacataatatgcaatgtgtcccaaccaaatttgaccctagaagacgtttcttcgtggagaatctcttacaggtttggtgctctgcaagacgcagattaaagccccaccctttagtgatctgcctatgtccctatctcctctggagctcatgattccctatgcacagtgagcagtttcttgcttctgtgccttcacatatgctttgcaatctgccatgctcattaagcacttctgattataattggcttctctttagatttacctacaaggaaagaatatactcctcaagctaatgtaaatatctcgtgtgcttggtagttgaggtggacattgtaattgacaccccaacagccattctcgtcacctgggagcttgttagaaatgcagaatcttggccccatgccagatcagcttaatcagaatctgcattttaacaagattcccgggcaattcctatgcacaataaagtttgagaaacattagtaagccaatcacaataattccactccgcttgctagaaactggttctgtaatgggcgtgccttatccattttgagccagtgagacacaaagaggtgctaactcagagcttctggaggaagaaaagccagtccagtctctctcccctgagtgtaaacaagaaaacatgttgccacagttcccgctgacaggcatcttatgaccacaagggaaatcagactgccagtagcctatccagtgttctctctccccttctaccttaacaactggtcctggtgtgtatgcccgtatggactggaggaggcacagaatggagtgtcttgaatttccagcaacaagcattgcgtttgggaatgtgtctcgttggcctgttgagtccagtggttctcaaccagagttgcacatcagaatcacctggggaacatttaaaatatattaattcccaagccctaccaccagagatttggatttaatgggtcttagctgaagcgtggacatgggtactttttaaaagctccttacagccgggcatggtggctcacgcctgtaatcccagcactttgggaggctgaggtgggcgggtcacctaaggtcaggggttcgagaccagcc

SEQ ID NO: 972 - DNA, 1719 bp, Homo Sapiens
aaaaccctgacccatccatcttcagcacattcacatgtgtaataaggtaagtgatttttaattccaccaggtttaaagacccctgacgtgacttattgccattctgctactgagccttgagagattatggtaagtgccaagaaaaaaaaaatgactttgaactgctctttcaccagttaaaaataacactgaaaccaaatgtaaacataaaagaagtggtcagattcgggttacatattaacggtgtttggtcaggctggagctgaggcacagcagcagagaatgccttttacttatcactgtttccaaacctccctacctggactaggcttgactggatttacaagagaccttttgaaaagatgcagagaaggcaagcagcacacatttcctggtaataaattttaaaggttgctaaaacattccagagattttcactcaacattcctctggccaacacatctgcaatctgccaatccttaaaaataggtgtttttgcattttaatctcacaaacatctttgaaaatgcatttcttctctgcccctgtgttggacaaatccagctttttccattttctaaaaaccacagaaatataatgctgcttaattcatacaagactgagctaactggagttaaaataaaatttctgagagtttgtttggctcactcttccctaccagatgattccattcttaaaacggtcctgtgattatattctctcattacagaggtgtccagaaaaaaaataaggagtgcagttctgaaattatataaaagcaaaattattactctaaacgtaagagctgtgatagatcgtgtcattgaccatggttcttttcccctgacacacacgtccccaccacccacccactgtatccatatgccttttgccatatgactttgcagctctccccactaaaggggcagccatgcgatttgctttggccaatgaaatgaggcagtagtggtggtatcctagttctgagcctaggtctcaagaagtcttatgtgtttctgcttatcctcttatacctctgccatcaccatgagccaaacatcccccaagtagcccactggtcccaggacaaggagggagacatgaagcagagctcatccagctgctgcagccccacttgacccagagacctacactgggaagcagagctgcccagtcaagtccaacctggatgtgtggaaccccagccaacctgatgcatgagcactcacggcattggaagacatcataaacattaatggagagcgggatgccagaataagttgatccaaatgatgcaggaatatttagcagcaaggagaaaggaattcacatttctcagtacccactatgtgccatactttgtgataagatggtttccctccaatatatcctcattgtcagcaatgtcgggaaacaggaatcatttccccttctacaggtgataaaactgaagcaagaaacatacaggctaacatcagctgagctgagatttgaactccactctttttgaccctggagctgatgaatgctgcttctagaggttgagtatcccttatccgaaatccttggaaccaggagatttttggatttgggaatatttgcatatacataatgagatatcttggagatgggacccaagtctaaatacaaaattattttgttgtatatacaccttgtacacatagactgaagataattttatacaatattttaaataat

SEQ ID NO: 973 - DNA, 11065 bp, Homo Sapiens
cttttaaagatggatgaggcctcggttcaatgagggccccaggcaggggacggccacacccaggtttttggaggggccggggagggcgcgttcggggatggcactgggagtgggcagggctgacgcccctttgcccccagcccggtcttcctctacggcgacttcgccgcggggcagtgcggggaggcgctcagtgtagagctcgtgggggcctccgctgacagcggggcagggactgggagaagggcggcggcggagcaggtcgcgggctggtgcggggcctgggggcactgccgagcctacactgcggcggccgcggcggcggcggcagcgcgacaagttgccatggcccggctgccgcagctgccctcccaagggtctcgttagctctgcttggccggccaccgccgactcggccctagggaccccggcgacctagcaaacagccgatccgccgggcgctgacgaggctcgggggaagagggcggcagtccagatggcgcgcaagtgagtgccaggccgcgaggatttgccgccgggacccagggcgcactagctaggtgcgccgcccacccgcggcctcacgggggcgcccgagtccactgaatgagcccggcggggccgacagcagcagtcgagcgcgggtgcgccactctgaccgccgctcgctggtctcattgccggggcctgagcgggggctggggtgggtgccaacgaggaaagcacagttgatctgcaagttagtgggcggggagccagtagggagggactgcggagccgcgctggtcctgattcttcctcactcagctattttaatagcaatgaaatcttgaaggagtgctctgaggctgatagagctgtaggaaaaggtcttgggcgttcagatttttggatgcttcgtatttttcaactttattatctggcaacagtctttaaaactcaatgaccaattccagttctagccttaaacccaattaatccttaactatgaaagcagcatcctaaagtctactttcacttgttagcggcatctgtggaagtagccgagggtctcaggcagtgcagtagctctctgaatagcctctctttcctgagaaagggagcctcagctgctgtgcccaccaggcctggtgggagcgtgcgctcactgcgtaatagagcagggctgtgcttgtgaggtccctttggcccaaactgtgcaggatctgctgcctgcctttcctttttgttgtatcgttattgctttggcccagaaagctctgatgctacctgcctgcaaatagctcatctttactcaatacccgggtcctcacccctttatactgtgccccctctggactgtgatgcctgatgcttgtgtggtcagattgcattgacaagagatctcttccttgtcttataagggcactaatcccatcaggagggtcccaccctcttgacctagtctaaacctaattacctcccaaaggccccacctcctaatacctcattgggggttctggcttcagcataggaatttgggggggcacagaagactttaatccacaagagatgggttcctgacagtagtaaccactccccatccacccctgagtgctggtagtcagggtcacgttagactggagtggtatagagaagacttcaccactctgtagaaaaaggcaagaagtcttaactgaaagggaagtttctggtccctttttcaaaattacctccctggctctttaaaatgctgtattttataaaatgttttcgatttccctttcagatgtgcaggccaacctcaaggtgtgggttgcttagattacaaaggaacttgaattctttcatgtttttgtttaaagtatcactatcatcatctaaagccaagattggctgctttgaggaccttttctgaaccgtgtactaggataataactctgaaggagactgttcttggaaaaggctgatgttgggaccttgctagccattttggaattagggaatgaggtgtattggcatgagcagcagcacttttgtggctgtcaggcagagattttcttttcttttttcctttataagtcacccaacccaaattgttatcaggcagatatttttataggggtagtgggaggcagttcccaagtcccctgtccctctctgcacctagtctaccctctaagattgcaaccatcatagcatcttcttacacattacaatgcagtaaacttgggcacattgagcaccagtcatggccgctgtgttcctgaaggtacagaagtggcactggggccaggctgctgtctggaaaatgttagccactttggtggtactgcccttccgacaccgcctcctcacctcccccacccctacacacaaaaaacaagacaagtagagcaaacaaaccacttctccaggtagacagacctgcaggtctgctcatggtgaccctctctttagcctgcattgtttccaaggccttcagctggcctattgtttgctaagggcccacaccttggcaggagctgaaaagagaggatttccttttgctcaggggaggagggtctgtcctgggtttgcagagataggcttcttgtctatgctgctgaagaaaacaaactagacaggagtcagatgtgggctctaccttcttgctcagtctctaattcactgtggccttgggcagatcagttctccatccttattagtatcttgggtggaatactccttaaggaatctttcaagtattgagtgcccccatgcccccaccaccttccacaaccaggcctaggtgaggcaggaaggaagaaaagaaagtctgggtgcagagtgtgtagtatgcctcacagtacagcctgcaggaaggccttggataagaaaggctgagtgatattccagggggtgggacagaacagagtgtggtttgggtgggaagatgacctggtgaacctcaggttctctcaaggctttacagaggtgggagcagggccatgggtaggctggctacagtatccctgctgaaagggaatacttgttggtacaaactcagctcttggggcaaggatcatatgaacttgcggtcatgaaagtgtaagtagggtagaaatatgaggaagggagaggcacttggtcatggccaaggctggagtgtcattaatgtgtgggggttgaggaagcaggtcacaggattgttggatggctcattctacagtcttgtgccctgggagcccctcatgtgggagacaggtggtggatgtcaggaagagctagaggtgggaagggtaggcttgatatttagactatgtgtcaagtagggcagggccagttactgaaataccgaaacactagttgtcatttggaaatggctgaggccccaggctccctgaggcccccagccaccttgtccttggaaccttgctggtgctcactggcccatacactgtctgcccagtgtattccctgggctctgaccccagtccctatgtgtcctcttgaccagggtatgcacctggacgtcagtgggaattcacttccccaggggaagtgctggaatccccatatacacttctggctcctgaggctgtgtctgctggatggtgcctccccagtgtcactgtcccgtggtggcttgtgggaaccctgcctgcactgtgaacggtatcggtcgttatgtatgctgacaatcacccctggtaaaggaaggggacagtagggtgaagaattctgttttgggtgcctggccgctttgcagcggggacagagggcaagacctggcaggcctgcagtcttcctcggctatcgtgaagagggttgtgagtgccaaatccatcccatagggagatcccagaggagactctggcaccccctctgccagagggcaggcccatgagtgcggccctgcagaccaacagtttcttaccctccttccttcgcgagacctggcacagctgcctgcctcactcctgggagccgagtcctactgggagctcgttcctgccaaggctgggatccagtccccctctcccctctgtgggcacttggcaggccgaggtccctgcttccctctgccagttcctgccaaagctaatctccctgcggcctgttcctggcagtggttgcacgtgggtatctctgctgggcaggcctgcttccatcactggcacggaccccatttcccaagaatcctttttgggtggcacaatcccaggcagaattctcccaggaggttcctgagtgcctcccttgctggttcagcacctgatcacgttcctggattccccctgaactcctccagtgtctgcaggatgcttttcagttcacaaagcactttcatattatatctcattagatgctcagcagcccctcaaacagcaagtggtgcccttgagcctgcagggccctggagtgggcagatttcctgaaccatctgctctgactctgcctttgggccagtggagaggcctttgtgagaccaaatcttcaggttctcggtggggcaggtggcagttcagtaggaggtggcctcgggcctcctcttctggggaaggtgtcagagaggggtcaggagactatgtagcctcttgtggccccagtcccctgatcaaaaaccaataggaaaagtctcttagaagagaaacagcttttgggttaatctgtaggggcagtgagaaagggttggggaggttggggcccagctgggccacgtggattcgatcttggcttagagtgggcacaggaagctatgtgatgaaggggagcccctagggaggaatctgggtacaggggatggggctggaatcagctacctggtccgtaagttgtgttgttaaatttggagaaaaactgttttccaaaaatggaggtaaattgaagtttgtaagagctggtgaataagccatgcctccttggtggtttggagcaagacgttttccacgcaggccatttcatcaagactcagtggtaatttgggattgcctcagctctcccagctcggctgcctgttgctgtcagtgggtctggggggcctcagggctgcagaggcttggtggtgtgggagtccttcacctgagggctgacgtgccttttgggggtctggagcatacttccaggagacaacctctcttcctcctgtcacctctgctcctccctcagcctccctgtgttcctttaagcagggggcatgggaagaatttcttctgaagcaactgatgttctaaatttgagagaggggaataccatcatgtggcctgaagttagcagcccagaggctgagggctgtggctctggcaggtgctggtgtccagggtgcaaggaagactccaatgtccagaggactctcatgaaggtgactgggagcagactgtggtggaggtgacagctcagggaggaagatgggattgtcaggactcagttctttgctggaagagacttctcttccatggggtggtgagtccaagtgagaccttggttcctcttcctgggtagaatcctcccttccattggaattatcctaaaggtccaccccactgactcctagcggcctctttcctggtaaggaagtctgattggcttttggcttggctaacctgagtcacttcttccagagctgtcctcatgctgcagccactgctgtcccacagcagctgtgggtcatccttcagctacagatcctcccattttccttgtccccccatcagtgtgcgtgcacacttctgtgtatgcaggtttggggtaggcttggtctgcaactgcgggggccatgcgcagttgagttcagtctggtcatgccacagaattatttacactgaaaccctaaaaccctctagcgaaaggttagatctttaagtcagacttgtttggcaggtcagtgagatgacagggaggtttaagacctgaattgggggatggggcacaaaggagtcgtggctgtttctggatctaaggcctctgtagggaggtgagatccagactgggtagaggctggtgattcttctggagccaactctgtgccaggccctattgtggctgtggaggagcatagttaaaactctgtgctttccaggacttgaagtctgtgcactgcccttactacgataaacaaaggaatgaaagttcctctcccaggtccatgattcagagggctcttaggggtatgtgtgtaggaggcggtttgctgctcatgcagacatttggagaaactctggttccatctcgtcacccccacaccagcatccaggaagacatatgggcagactggtgcgggccagcaggtgtggggatgcttctttgctgtgagcttctgccaggtgttagagagggaaatcgaagtgtccagctgccccagagctgggagtccttcagatttaccagaactttctgattacaaagacttcctgcttattgttttgattcttaggattataatcttacttttgctttccatgctcacatccccagtctgaatctggggctgcttctcaccactgccagcctcaaggcagagaaggcaggctcctctcccatttgtgttccctctaaatggttgcataggtactcgcttgcagaaccattactaccaatagtggaaaaatgagatggggagggcaatatacttttattcttattttatttgagacaggttctcattatgtcacccacacccatgctggagtgcattggtgtgatcacagctcctgggctcaggtgttcctcttgcctcaggcaatttttaaaaaatttcacacttgattggccaagaacctcccctccgacccccacaacaacctacccagcatttactcctcagtctgaggacacgtccctcacatcagcccctctgctgtcttgaaaggctcacctcctggaagctggctcctccctgattcagggcccagcacagcgtcggaaaaatggagcagtgctgcccactgtgttcgaaggcctccctcctctgttttattctgggccccttgggcagggcttacatcagagccagtcctccttggctgattcaaagggacaaactcctgggtcagtcctgaggacaaggaatagtgagtgggtgagggaggggctggcaacaactggagtgtgtctggccacaagctagactgtggctgcagctgatggccatcatcaagctggcgccaaagctgccctcctgcccaggtttccagagattctctagctagttctcttctctgttctttggaagatttactgccttattccaccgctttagtggttatcctacaatttcctacatttttctttgacttaaataagtaaaatctttactccttttcctgagccattcaaggaacttgggttattttaactttactttcctcctgccttacatgattttcttttaaaaacttaattttatttataattccagagttatagaaaatttgtaacagttggtgtacagtatttccatatatcccctctcaagttccatatatattaatatttaactacatataccttataattctttccctccccaacatcatttttttctgaactatttgatactgatctacatatatgtgctgtgttacccctaaatatatccttgtgtatttcccaagatataaaaatattctcataaaattatcacacagttatcaaaagcaggtaattaagaagacacaatgctatactctaatttacaaaccttattcaaatttcaccgaatgtcttagttatgtctttatagccagagaaggaaaaaaatacatatttttcttgtctaggatttagtctagaatcatgttacatttagtcatttctagtcttctttaagccgatttctcttggtctttctttcacttttcttttttgaggggtacaggacaattattttgtagaatgaccttatttgggtttgtctgatgtttcctcatgattagattccagttatgtatttctggcagaaatgccacagaagtgatattgtgtccttctcagtgcattgttatcaggaggcacatgatgttggtttttgtcccactgctggagataataactttggtcacttggataaggtggtgtctgccaggctttgtctgccattgcaaagttaatattttcatttggtaattaagctttgggaaatactttgagatgatataaatattctgtttctcatcagactttacccactaaattttagcatcctttgatgattagtgtttgaggtataatggttgtaaaatggtgaattttctgcttccattatttctcatacatttattagttgttactctactgtaaggaagagtttacctccctccctcccaatccatccatccatccatccatccatccatccatccatccatccacccgcccatccatccatctacctacccacccatcttccattcagtcagtctggattcatagatatttattttatttaattagttatgctttgttactagcattggtgattttgatgatcaaaattatcccagattagtcctgtgagagctcctccaagttgattcttgtgtctttttgacacactgctattactttttgagcacttccttactttctgttactacaagatattccaggctcatcttgtactttcccggctcaaactctgtaatctggtatttttctaagaaaccctgattccttttagcagagaattgtgtataaaaacaaaccaagacctggaataggtctgttcattgccagagtgttgttatttttaggccctgtcatacatatacacacatgtgtgtgtagtatatatattatgtaaatatgcacacacacacatgcaaatccattcatctatctacctacctacttacctacctatctttcttaaaaaccatgagttcatactgatatgaccagttccaatccaacactctagagttcattttaaccttctctctttccatatatgtaatttccttctccaaccgtgaaaaacctggtttcagttacccacagtatatttacttatttgcttaatcctagaatacacagaatgtagtttcagaattgttaactcatgctggtgtgggaaacaaatctattaaacagagttcaatatttgctactgtctttttgccctagcctgagaatacagaggcaaagtactgcttcaaaacttctgttatcaccccctacccgtactgtgttttgtcattcacttaacctacagttcggtacacttgcttccatatgtattcaatgctaatgtttcctccttttatccttgttgattgtatttactgaaaaactgagtacatgaaacattaacatggttgtaaaagtcagaacagatctgtacaaaaacatgaactcagagaagtgtcactgccctccatcttctctaccttgctcccaccatcttattcttttcacccatcaggctaaaaaaagacatcagagaaaaatatatcctaatatgttgagtttattcgggagtaagcaaaaggattataatctgggaagcacagctgtagcaagccataggtacaggtacatcaagccaaaggtaaagggaaatttttactggcaaggagaagctatgtaagctgcttggagacagagttcattggttctggaggctcaaagctagaattagcatcagttcattggtggagatgccactgctaggcatcggcctagcatcttatcagaattgctacagtcctaaagaatgtatagtgataaacctggtcatagaaatatgtgcatgcatgtaaaatgtaaaatgcatgtaaaatgtagatcatgaaaagcatgagatgtataaaagatgaaggaatttctcgtggagttattttagaaagtccttgaaatagtccttatctcagatgtgcaagcatgagctgtgctcctttgtgtgttctggctccagtttgctcgggtctgacaaaagtgacttattttgctatctgcaactttagtcactccatttccacccactcctgtatggaaccaatctcattagtttctgggtttcctttcctaagtttctttttgtatagttgtgcagacaaatatatattttcttattcccctttctttcttgcacaaaacgtggcataccataaacactttctcacactttgctttttaaatttaacagcatatcttgggagccattctatatcagtttatagatgtcatcctcattcatttttatagctgcagactattccattcgatgatgtaccatagttcattcaaccattttcctatgtaaagtcattttggttgtttctaatatttttcaattataaacaatgctacaatgaaaatccttaaacatatgtatttttgtatatatttgaatatgtattaccaggataaattataaaaagggggaaaagcatgtgccattttgtttgatatcatcaaattctcccccattaaggttgtactaatttccattcccatcagaaatgcttgagcatctactttcttcaagccttgccaacagaacgtgttagtgtatgtttacatttttgccaatctgctaggtgagagataatatctcagtgttattttaatttgcatttctcttattatagttgaggctgaatgttttttcacatgtttacgggacattttaattcttttttcagtcaatggtctgtttatgtctttgactatttgaccatttttatatcaggtttttgaaacttctatcgagtagaaaaagttatttatatattagcgatattacatatgtatctgtgttatatattaccgatcttttctctcagtgtttaatttattttgggatttttttttttttttctgcgacagagtcttgctctgttgcccaggctagagggtagtggtacaggctcggctcactgcaacctccccctcccaggttcaagcgattctcctgcctcagtcttctgagtagctgggattacaggtgcccgccaccacgcccggctaatttttgaatttttagtagagacggggtttcaccacgttggccaggctggtcttaaactcctgacttcaggtgatctgcctaccttggcctcccaatgtgctgggattacaggcgtgagccacagcacccggccag

SEQ ID NO: 974 - DNA, 1644 bp, Homo Sapiens
acactgctggttaactgcttcggaagaggacagcccgcagtctggagtgagcagcgaagcagagaaaaggagacgccctttcggacaagggactggttggtttgttcttgtgcagagaacccactcgctcactctcaaacggtagctgttcggtttatttgtccttttgcagtgtatgcggagccccactgtgtggcacgcacttgcttccggcagagatcctgcccttcaggagcaactaaacttgttgcaaataaagtgctgtgaaagttcagaagaggaagatattagatataacggcatcattctctcgttttttaagtgttcctattatgtgccagaatgctggtccagtgagggctttatgaaggccatccagactacaggaacagaattgctaagcacatggggcgggaggcggagggaatcctccagggagaccaaagtaagtacttcagtttccttgaaggcttgtgtgatgggaaggagtgctatggtaggcgtcactacatattctgttcgttttaaattaaaaaaccatgggcacatattgccaaaaataaaaaagggaaggaaaaaggtatagttgggagatagatgaatacaagagaaattaaggacattaatggtttaagccttgaaaggctagaggtggaactataactggacaaggtggactagggttgtaaagtcctctaacccagcggacggggtgggggtgtgtgtgggttggggatgaaactgttccacttcagatcatcaggcattagattctcacagggagccggcaaacctcacatgtgcagttcacaatagggttcgcgtgcctatgagaatctgatgccactcgctaatctgacagcaggcagagctcaaggcgataatgctcactcgcccgccgctcacctcctgctatccggcttggttcctaacaggccactgtctggttccggtccgcggcccagggcttggggacccctgccctcttgggtagggaagtatgggaaagcagtgctttagggccaatgaatctataaaacggctgaaagtggagacagactgttggcaaggaagtcaagtggttaggaaactgcaggcccagggttacttagtagtggaagtaagaagaggtaaatagaatcaatccgtcttcattaaagcaagacttcccagaccactctacccacacccttcaataaatacacttacctgtatcattcatttgatttttattatctaggaatgtctgggaccttatctgttccaaataaatgatatttgcagagcttagctattttaacttccaaaaagcaaaaagaatggaaaataacttgctccataccctgttttctgtagacattctctgaagtttttcataatattgcttaaagaatgaaatgtatacaattcacaactgccattcccctctgaaaagttgttacccaccaaaaaatagtggtccaactcatgcatcaaaagcaagtttggggatcccactataatagtctgttctgactcacaccatctgcccaaattatatagatcaggctgccctgacataaccccagccacacaccagcagcggcccccacgctataacaaatctttaaccaattattaaaatattagaaaatgcatgaccat

SEQ ID NO: 975 - DNA, 1498 bp, Homo Sapiens
ggccccgtggctagagatggactccagattcacacccaggctgtatgtctgcacaacttggactgcacaacccagcacagagaacactcgacccccgctcacgcaacacagcaggatcccgagcttggaacccaggtgttcacaaaggggtcccgactctggaacccaggcctccacagcaggatcccgaccctggaacccaggcgtccacagcaggatcccgagtttggaacccaggcgttcacagcaggatcccgaccctggaacccaggcgtccacagcaggatcccgagtttggaacccaggtgtccacagcaggatcccgagcttggaacccaggcattctagtatccagcctccaagtcttggtcctaccctggtggtttacagaagccgagaagctgacagctttactcacccatgacaaaataagaaaagcacagggcaatgtaggaagtttttcataaagttaaatccctttaatttaaaaaaaaaacagcttttttggttgacttttcccctctcttttctaaaataagggtgatcttatccagtggttcttattttatattcttaatttagcaagataaaaatgtgagcagctgcacgccagcccccaaactctaggggaggtttttctggttcagactgtctcaggttcgagcctccttagggcaccccctttccgtccaccttagcctggaactgagacttctttttcttttgtatctgtccttctcagatctcatatttgtattttccaaaacaatctagttgaagaaatcctatttggtatgtttgaaatctttatgctcccagctcaaactctggattaacaacaaaacagaggaaaactctttttcttattcagcagtcaaacttcaaggcaacttcagccctgggaactcagccagttgctgggaagtaaaggaatcaaaggcttctaaacagtaaaaaatgtctttagagctcggctcagagggagctttggccttcctgcaaattaagaataatgatttggtgagcttgtttatctcccctccaccagcaaggcttggtctccccaggggtaaccggctgcagattcaagaggaagctgggagggctgtctggggctggagaaggaggcagctccaacacgccgcggtcaggcagtgtggggacaaagaggtctccttacttccacagcaccgagtcatcgaagtttacaagacacttctacgttgatctggaaaaaggaggtgttcctagtacatcttagaaagatttccataaaacgggctaaaaagcaatcataaaaccacaacaaaacacaaacaggcaagggaaaggataaacttccatcacctggaagcctcagagacaggagagggtacacaggtgagagccttggctgggtgggaggtaggagtcagaccggaccctctgcagaattagcagtggtgtgcgctcacctctggagctgctcctctgagatgggcctggccccctagataat

SEQ ID NO: 976 - DNA, 4310 bp, Homo Sapiens
tcattttttaggtgacattagaaatccggatcatgttaaatctagtttttaaatattggcaacaaatccacttgttaaaaactgcaatgatcaaacatgtccataggtcaaatctggccataggccaacagtccatgctctccagctggacatgtcaaggaccaaatcttctcaggcaactgctgatcgaacctccatcaagcctcagggactggggcaaaatagggtgtctacctagtggcccacaggccacacaggctattccagaatctggccctcaacaacgacttgagaaggtcacctcaattcctttcactgaaccttttttgttttgagacagggttttgccctgtcacccaggctggagtgcagcagcaggatctcggctcacttcaacctccacctcccaggttcaagcaattcccctgcctcagcctcctgggtagctgggattacaggcatacaccaccacacccagctaatttttgtatttttagtagagacggggtttcaccatgttggccaggttggtcttgaactactgacctcaagtgatctgcccgcctcagcctcccaaagtgctgggatgaaaagcatgagccaccaagcccagccctttcactgaactcttaaatggccctttccaggccaaatagcgttgcctggaaccatttagtaccatgtaccatggttctcagatccagaaacaggatccgatcacctatgcattttctaatacataagccctaagttattttaggtctataaaaactatacgctaaggtgggggtaaaaaatctcacatcaaatataaaaaatttaagtcattaaaggagatgaggcatttgtaaagaacttttaaaaatatcttaagagctggaggggtctttttgttggttggtttgggttgggttttattggtttgtgtttagagtctggagtatttgctttttaaaaaggcagtgaaagaaaaaaaacgaaccccttccaaacacatttgtcatttttatatactatatcatgcatgtttatgctggctacattaggaacaagcttgaattacaacccccggtttacctaatggagttctgaaaagccgtccaatcttcctggaagagggagttgggaggaatgtggtccagtttgcacttctttcgtatggactggagagtgctggtgaaatcagacacatacctgccgggaaagggaagaaaatggtagggaggtcaccactgattccccaactctaaagagacctggaattctacagctctggacaaattgctaatggccttgagagcatctttagaggctcccaccgacgagtgaaactgcttgtaaacctctgaacacaaaaagttcttctctatgtggcaagactgtcttcaccacctggttgagcagtttctaaaagagatgcccaagaggagaaggaaggaataatcgtgaagttgactccagggagcaaccaggtgagagatgatgctgataaatcccccctcatccagataagtacatttctgtgaaagcaggtttgaagaactgtttaaacatcacggtcccatggtaataactgactgtgacctgggataacgtaaggaaggtcatgacatccaaggtacctctgcatcattctcatcctctaaatttagattaaatacccgtggcaaaaagattaaagtttcacggctggcaagtgtctgactttaatgggacagacgcatgaaagtggattcaaagccaggagatcctccctcacaggctgcgttgtttgctctcactgtacacacatacttttccctcacagcatctaaaacactgtaattaaacagcttgtttagacagggcatggtggctcacacctgtaatcccagcaccttgggaggctgaggaaggaggatcacttgagctcaaggagttcgagacctgcctgggcaacagagtgagatcccatctctaaaaaaaacaaaaaaattaggcgggtgtggtagctcatgcctgtaatcacagcactttgggaggccgaggtaagaggaccacttgtgcatggaagttcaagaccacactgggtgacatggcaaaactttgtctctacaaagaatacaaaaattagcctggcgtggtggcgcatgcctgtagtcccagctactcaggaggctggggtggaaagatggcttgagcctaggaggtcaaggctgcagtgggccatgagcacgccactgcactccagcctgggtggcagagcaagaccctgtctccagataaagaaatagcttgtatgatgcttattgctgctgctagactttaagctctgggagaacagagtctgtgcctcatacttatatccccaggaactagcacagagctggacataaaggagggagtcatgtcctctgaaagctacgaaacctgtgcctcatacttatatccccaggaactagcacagagctggacataaaggagggagtcatgtcctctgaaagctacgaaacctgtgacatttgcatgcatcacaagaggccttgccgcttgcccctcccaaaacgaagctctaaatgaggaaagtgaaatgtgaggacccagggcacagccccaaaaggtcagtccatgcagtggagacacaggccactcaatgaaccaactggaagaaacggcttcaggtcactccactgactgcaaatgatcctgctgctccctttacagagagctcgatgctttcaggtggaaagctgcaaaacccagagtaccactgacaacaccttccccttgcaccaagagaggtgacagctttctagggttataagtcccaggaaggagaggggctggcctcaagcacaaactgacaggggaatgttaaggaacatgattgtgctttagccatgggaagttaaacaaccatgtcaccacctctgcaactatggcaaatatccatgtgctctgcagaaagagcaggtacacactgcaggagaaggagttttgtttagccactattctcaggtatggttataagcaaatgctttctctatttcattagctgtcaatccagaattctaaatggtttgtcatgaaatctcagaggaaaagtgtagctttcatcacatcatttttgttcccaaaccctccagctgtttctcacaatacacatttccaattgtcaaccatgtcagagtcaccgtgttaggggctttaatgatatgcttttggttaatattcacaacctccttggaaaggagatattgtcatcatcagtttactcagagaggaacactaccatctctaaggtccccactagtaagtgtccagagctcccatgcccatcacagtcttaatacccctccttcttgaaccaccggttggccactatactctatgcttcatcctagttcgagttaggccaacctgcacctgcctttcctgcgtaccctgttctccttgcccctgcctcccttaatacccttccccaaaccctcctcactactgaacaatgtgccatttgaaccctgctcaagttagcttcaacctgatttccctgattttataagcatcagctattttggtaacttcaaaatcttcccttttagagaagatggcctgggttttccagatatacttttgtacagtttgaatgcttaatatggaaatgtattattttgatttttttttattttttattttttgagacagagttttgttcttgttgcacaggctggagtgccatggcacagtcttggctcactgcaagctctgcctcttggattcagcaatttttatgtctcagcctcctgagcagctgggattacaggcatccaccatcatgcctacctgatttttgcatttttagtagagatgagcttcgccacgttgaccagggtggtttcgaactcctgacctcaagtgatccacctgcctcagccacccaaagtgctgggattacaagcgtgagccaccacacccagcctgatgtttctttttctgcaggaacacattcaggctcatccggccacaccagatgatgtgttcctatagaaatgcctacgtggaactgccctgggaggtgctggatgcccgatggcaatgccagggagctctgggtccaaggagcctccacagttcacagaggcatgctcagtatttctggaacaatcagagacagggcttcaccatgttggccaagctggtctcgaactcctgagtttaagcaatccacctgtcttggcctcccaaagtactgggattacaggcgtgattcaccgcaccaggccaaaggtcctttttcttgttcaaataaactttgttaaatttaacttgtc

SEQ ID NO: 977 - DNA, 16464 bp, Homo Sapiens
gtaggttctttaagcattgacgagctaaagaccattttaaattctaagcctagggaagcttacaatggaactaatcagatgtttttatgtcggtttgttccgagacagtggaagactggaggtcatgtgcttgtgtctaatgtttagcaaaatcttagtgaaacgagggcgataggaatgggggctggggaagacttagatgggataaaaagaggtgcggctggaagaactaaatcactttaaaacttctgaaaataaatgttgaccattgtagtcagaggagtaaaatgttcagagaaatggggatgattaaacaagaacggcaagccagattgagtcagaaaattatcttcctgccagaaattctgtctcccacaacggcatcagggggtggttacttgcccagggtgtagtcagtttttaaaaagcttaagggttaccaacatattcctaaatttcctgaatttgctgtgattccaggattcatttaaactcttgagactgttttactttcggcacgaaatcagctcatgggctttataaatgtagaacctactgcattatagttcttctttttgtttattctaaaactgttagtagcagccagcgtattatatgatttggattgggccatgaacaaccgtaacgagtgataaagcaccctttcctgttccaatgcaaagaacaactatgaaaagaaagtactggcaaatttatcatcttgtagttagttcctggccaaagaaaatggtaaggccattcttttaagcagttaaaaaaaaatggggatgggctcttaaactttggcatgctaaggccattcttttaagcagtttaaaaaaatggggatgggctcctaaactttgacatactaaagcagtcgtcatttaggtaaaatctaagtcttaatggaaatcgtgatttcatatctactgcagcgttagcaatcacataatgataacttaaatcagtaaatcgttgaactcggttctctaatctttgaagaatagaaatactttttatcccaaaagatgttttgagaattaaatttgcagagaattttttaggtctttagttgtaatttatagagctaggtcttttaactttagtggaaaccatgccctccaaacccaagtgactggagtcagaatgtgaaataagacgacataaaatccctatttcttaaggggctgggcgaaagtaatggaacaaaatgtaacgttatgctattgtggcagagatagctaatggaatgtttcatttctaagtctgtaatttcagtaattgttagaggcagttttccatcaataagttagatcaaatggttaaacccaatatgaatttataaaagcttaatttaattttggattgatttaccagatgtttaaggtggttataatgggtagtgttgatggtggtgcttttggaaaaatgagtattatatgcctgctcatccctttacattatcttatcatataaacttcttgattactcgttatgatactcttaaatcgtacatttagaggaaaaatcttaaagtaatctgtaagaccatttctccttaaaatgatatattatgagatgaaaggaaagataaagataatttagaagagatccagaagtggactaaatttctggtaaggagggggctaaagatgttaaaagacatcttaggaaaagcatatgatttataacttttaaaagtgtcatttagatggttaaggatttgtgtttaatagttctcttgaaaatattgttttccaaaagtttaaaagccctagctacttttatacatttgcccttaaaaaatgtacagaatttattacatcaaactgctacaaagaaataagaattctgatttttgcaagtaagttggaaatcaacgtagaggacaaaaagtggcatagctatatctaaacaaaaaagtatgtaattcaaaagttggtccacaaagaattgaaagcctttcaataactaatttaaatgatagaaagcagtatgtatatgcaagtacatatgctccctgtatagagagtggttagtaagtaagatggtagcctaactcactggaataaagagatccttggagtcccaaacctcaagactaggagtcttaatgcagttaccaggctgcatgcctgtacccagagaccatactagaggctgtgggaatcctcgattactgctcttagagcccccaacttgactgtttcttctgtacctggtacttttttcaaatatttcaaattgcagtgatgcatgggagatacatttagaaaacataatgcaggggaataaaagcagttaaaaactaaggacagtttctactgatgaaaataaaaaactgctacagcaacatcttttcatcatctgtaaacatcatacccccaaattttcctaagttattatctaacctcatcagtagcagatggtgaattatttcatagaaaatcctggaatgtaaactctagatactcaagaaaacctcttttttttcaatgaaggtatattatatttaaaataataatgatgcattaaacattatgggataaagaaaatactttccatagaaattaagcaatggcctaggcaaagagaagtaaccctttagcattaatactatcagttagacagtgacatttattgaacattccctgtgttgtgtattaagaattggactacctatatcccagtcaacaattttttctggagtttagaaatagtttatgcttattttctgtgttttttattaccaaattgttattagtttggtgcaaaagtaattgtggtttttgtcacttacatgatggcaaaaactgcaattacttttgcaccaacctaatagaaaaatacaaaatggagaatagttttcaggttccacaaagcatttgctggaaataaatatcagttgtctaaataagtagtacttgatttattactatgattttcgtagggttccatttctggaacaatatcatattaataaaccctttcagtgagaccattgtgtggtattgcccaaaaaggaaaaaaaaatgtaatgagaaaggactaaggctaataaaattccataaatactattataaagaaaagtataatttgactgagatgcacaaatgcttacttgataatgaggtgtttttaaggaaacttctattaaatactctttttgagtttaatatactatgaaacaatgttgtcttttttttttttttaatgaagatttccttgacttccaaagacctttgatgttcaagcaaaatgtagcaatttggtaaaagtaaagggtgcatttcgaactgaaataaacataatgtcctattaagacctgtattatattttatggaatttaacttagaatgtaagatattagctctgcggttttacaagcttgtttaaattctgcaatgtagggcaacagaaaatccaaacaaaatccattaatgactatattacttctttatttttctttttaaatattatatgtggccagtcaggatgaagttttttttaaactacatttcctagttggacagatcaagagtaagctccagttttgctataatctcgttttgtgattgctgacaagtctattactccctcagttcccctatcactaaaaagaaataacattgtggtaaagaggtgttaaactaccaaatccactgaaaaagtatggaaaaaggtcacagatgtggcagctttggcatcttcagaagaaaagatagcaactcaatgtgatactattggcaataccatttgttaattgaaaaaagaagaagaaagcagttactagacatccatgattttatggagaagccatattctgtcatagatgagctatttacagacattcaatggcacattctttgacaaagtgaatcatcactgtctagtctttcttgtatatgaatttgaagtattgattaaagttgtagcatacctgtaattttaaactgtaaaactctaacactcacaaaagaacattgaaagactgcaaatttctagacttggaggttataattccttctgtatgttactactatcagcttataaaattttaaaaaatgtgagtgtagaaacttatataaactgtattcacacatgaaggatagcctaaatgctccggactgataatctgaaggtcattctcacctggctgattgaactacttttattcatagaagccaaagttttgaaaggtacagatagaatcttgactaccttgcattcgcagttacgttttaattgcaaaataacaagctctttagtcactggaaacaaaacacttttagcatttaactttataatacttgaaatcctaccttgaaagcattcatactcattaaaagctcaacacatgatccatgtttacataaggatttgggtgttgcttaaaatgatcatgtaatgagctgcttctctgcaaattaatattcactcccttccctcatccttaatgtgggatctttgaaggaaaaggaagtgaccaaactaaagacatagggaaatgcaaaatcaaggtgaaaagttacccagagggttgttttaattttggccatcaaccccctagtgaataatggtaacagtattgttttgagacccattttgtggcatttacctattgttaaactaaattgactagatgtaaatatattttcatcttcagatatttagaatttctatccttccccattgtttctggattttgatactaatcttttttctttgcatattgtatatatttactcaacaactaatctaattttagatttttagcttatccacatttcatttttgtttatttcattggtatttcatcaatacaatggctctacccttcaaggaaaaaaaacatcagcccgtcccacaaaaacacatatattcaagaaagataaattacattgtgatgattcaatcataaagctactcaaggatgtgctccaccaaaatgaggatatgaagccaatataaaggaaggcaatgaatacaagagacaggcaaagggagttcccaggacataagcaagggacgtcccaggtagcaagtgtgcacctggtgtccagggccatctgtccaggctggagagcaatagggtgatctcggctcactgcaacctccacctcctgagttcaaacaattctcctgcttcaggatcctgagtagctgggattacagggagaagtcagctgccatgtcatgaagacgctcgagtagccctatgagattcccatgtgaacagaaattgagtcctcctgccaacaatcagccataatttgcaagacacgtacatgagctaccttagaagagaatccctgggccccagataagccttcaggtgaatgcagccctggaagacatcttaactgcaacctcatgagagaccctgagccagaaccaaccagctaaggcactgcccgattcctgacctacacgcatgggggtgcatggtggctcactcctgtaatgccagcactttgggaagccgacgtgggttgatcacttgagcccaggagttcaagactagcctggccaacatggcgaaagcccgtctctactaaaaatacaaaaattaactgggcatggtggtacacacctgtaatcccagctacccaggaagatgaggtacaaaaatcgctggaacctgggaggaggatgttgcagtgagctgagattgagccactgccctccagcctgggcaacagagactctgtttcagaaacaaaaacaaaaacaaaagcaacaacaaaaaaaattcctattgaaatttaacttacatgtgataaaattaatgtaacattttatatatattatatataaaatatatacttatatattatatatacttatatataatgcattatatatgcttatatataatgtattatatatgcttatatattatataatacatcttctaatatatgtgtgtaatatataatgtaacctgtatatcagtttcacagatgttaacttaacaagcaaagttcattgaaccatgcatttgtattctatgcactttgttatatatcacagtttaaaaggtccaaagtagagtatagacaggcacagtggttcatgcctgtaatcccagcacttagggaggcagaggcaggaggatagcttgagctcaggagttcaagacctgacggggcaacagagcaagatcctgttctccacagacaggaaaagagaaagtagagtataaatacagcataggatcttgaaaatcagactggatcaaaaggtgaccatgaactagcaattaaggttctgtttaaaaacaactaacacgtgttgggacataagaattagggtagcacacaataaactatctcctggcttatattttttaaatatcactgggtgggtcagtagtctgaacctggttgccaaggcagttcctaaacctggggagtatgactgataagtttttcaccttgacagcagaaagcagttgggcccaagagagggtaggcttgatgctagcaaaattatgaagatgaagccttaagtaccttatcttgtttgtgcttgccccttgctctgcttctctacacctttggattctcagcagcctgctgcttttctacacctttggattctcagcagcctgtgtatttgtgtacttatcccccttcccttcctgtcatctacccatttccaaagccaaggcaggtctaaagtcctgctttgttgacttctggttcaatcaggggtgtttctatcatatcacactggctgaaggtatttgtaccttaaccttgatctctgattatgaatgaaaggttttgggtcctattaaagaaattttcatcaccactgactagttatttgaggtgtattttgggtgaggtgggccttgctgcccctggggtagcaccttgtaagctctggtatggtatgccctggggagaaggtgtcagctaacttttaaaaatcactgcaggtgattcagatatgacaacctgtatcctgtatgacaacctgccttctgtccacaccccgtctctcaatgagaaccaccttttacaggaaggccactcataagcagatatatctatttattcattcattaaacaactatttcttgagctctaactgtgtctggctatgggctagcactggtgactcagggttgaacagaaacaggcataggccatgcatggtttagtgcaagacacacattaatcaaggcaagcaggtaaatgtaaagttaccagtcaggtaagtgtcgtaaatctgggtttactcaacataaagacaggtgaattgagagttagcttaataattatgattttcaagtataagatgaataaattatgtagaggagaatattatacactgtaaaaaagacataaaaaaggaagtttgctgtagcataaagaatttaaggtaatggctaccatagtcagagggcctgctctgtgccaagcatggtgttattttattttatttttttatttttgagactgagtcttgctttgttgcccaagctggagtgcaatggtacgatctcagctcaccataacttctgcctcctgggctcaagcaattctcctgcctcagcctcccgagtagctggtactacaggcatgcaccaccacgcccggctaatttttgtatctttagtagagacagagtttcatgtgagccaggctggtctcgaactcctcacctcaagtgatccacctgcctgggcctcccaaagtgctgggattataggcatgagtcactgtacccagcctgctgttattttatatattaaaaattttacataaatatattttacatatttttatatttttataaaatagtgattatatattatcatttattaaactcatatatattgataaagcctcacagaaccctacagagatttaaaaaagcaatacttagagatattagataatctgttctaggtcacccaacatatatatatttaataacagctttattgatatataattcacataccataacattcacccttttaaaatataaaattcagtgggttttagcatattcatgtacttgtaaattaccactatctaattttagaacatcttcatcacccccaaagaaatcctgtacacattagcttctacctttcattccccctcacctctgccagttcctggtaaccacaaatctactttctttctgtatggatttgcctattctggacatttcagtaatgttttcaagattcattcatgttatattgtatatcagtactttgtttctctttgttgctgagtaatattccattgtatgaataacctcattttgttcactcttcagttgatgaacatttgagttgtctccactttttggctattataaataatgctgctatgaatatttatgtacaagtttccatgtagacatatgttttcagatctcttgggtttatttctaggagaagaaatgctagatcatgtggtaactctatgtttaacattttgagaaccgccaaactattttccaaagtggctgcatcattttacaacctatcagcaatgtatgagggttcccatttctctacattcttgttaacattatttaaggtatcctagtgagtgtgatgtggtatctcattgtggttttgatttgcatttcctcaccagctaaaattcatgaaattcagattcaagttcaggtccaaagccagagttttagccactgtgcaataccatctctctcatgctcctagaagtaaggaagaatacgttgataagattgtaacgcactggattgaattttaattatcatctgggtattcacctctagaagcttttaaaaacaagggcttttttgttgttgttgttttgtttttttgagacagtcttgctctgtcacctaggctgtagtgcagtggcgtgatctaggctcactgcaacctgtgcaattctcatgcctcagcctcccaagttgctgggattacaggtgtgtgccaccacacccagctaatttttgtatttttagtagagatggggtttcaccatgctggctaggctggtctcaaactcctgacctcaagtgatcctccagcctcagcctcccaaagtgctaggattacaggtgtgaaccactgcacccagcccggttttgtttttaatctaggatataatagctatggattaaattcagtgatgagctggtaaatggttgacaaccaacttggggtgccacagtggggtgggggtagcaggaggagctctgatttgtaaccactgcttattaccataatgtgaatactcccacccattaccgatttcaagctaccaacttgatgtctgtcagccagcttgcaaaaatcctgaaaatgtaacaatcagctcttgtgaacagtatgagcctgagccagctccaacatacaaattctataaattcattaaggcactttttgaattacaaatgtctttgtacataagagaaaatgaaatgatcactagttacagaagatataattacatatgtagaaaaatctaaagtaattcatgtaaaattaatataagcaatacacaatttcagcaatgggactagattaaatagttatacaaaaattatcttctctcgcaaaaataattagttagcaaatgtgatggtgaagatttccccatcatagtagcaatgaaacaataacagcaacaaagccttagaatacctggaaatacatttaataaagaatgtacagtttctagaagaataaacatcagaaattcttctgaggggcattaaaaaactttgaaaaaaagggaaagatgtatgctgagatcttacaggaagactcagtattatataattattatttcttcctgaaatattttagaaatcaaatgcaatctcaattacaatcccaacaagatatatttagaaaatcaataagatgaatagaaagttcgttcatctaaaagaaaaaaacaaaacaaaaagaggtgaggctaggaaaattttgaaaaataagacaagagaaggctaatttttaaaacaacaagcatgtatttcagaaaaacaaaatacagttaattgaaaagaaaaagaaaaagcaaacagagagagacaggccagctcacctctggagtgcaagagcattcctcagccatgtgttcccttcctcttgtgaaccaaatggaatgaaagtgtggagggagggtgttaagtgactttctgagctgtgttttgaaatgtatttctccttagtaacaatgttataaacagtgccgaggttccaaggctagcccagttctatcataggttaggtacaggcttctaaggcatatcttataaactcaactaccaaatttaatatggatcccactgtatgtgttctagtctccaacttttggaatgcatcgttacagtcagtagggaactacttagacaactaagtataatgaataaagagtattttgagtgtgaatgtggcatgttatggcaatatgttcaatgtttttaattctctttcaccatagacttttttttgatttctcatttgcttatttgtgtaacttataagataattacatatttaacttagcattgtgagaaacaaaattgataacattgctttaatctcctgaatgtataatatgttcttatttctgaacagatacatttttcaagatatggaggaaataagcagtccaatctccactgagctgtatattttttcagatgtttcttctggagtgaatatttacgggctagatagaatttcttgaaaatagacatgtcacattcttgtttatatgtaacatttattacaactggcaagaaatgataatttaaaactaactttaaaaaatgagttcaggacaggtgcggtggctctcgcctgtaatcccagcactttgggaggccgaggtgggcggatcacttgaggtcaggagttcaagaccagcctggccaacatggcaaaaccccatctctactaaaagaaaatatatatatatacaaaaattagctggacttggtggcacatgtctgtaatctcagctacttgggaggctgaggcatgagaatcacttgaacccaggagggggaggttgcagtgagctgagatcgcaccactgatctccagcctgggtgacagagcaagactctgtcacacaaacacacacacacacacacacaggagttcagggaagtttagtttcgaactaatttatagcttgaatactttgaggtaatatttagatcaatttattattcactaattttgttgaaaatttatatcatgactattctgattccatctcaaggcacgaggttactctcagtggataaaaactcagctacagctgaggttattgaaatgccatgcatataagcatcctggctcattttcaatttgcctatgtatgtgggtagggtgtgtgtgtctgcatgcgcccacaatccttaaaattacgtggaatattaacaaataatatcatgcacatccgatgtttgtgcaataatattagagagaaagaagattattctctgagaccctccaagcatcttgctgataactagttttatcctttgacaccacagtttgaggccgcagcagcctgctgacactcaaacagtgagttagtgacaggctctgcagagaacagagcacttctctgtccacagaattccgggcaccaggacgaacacatatgcactgtagactttgagtatttttatatgactcagtataaatgtatacattcatagcctcatgagcgcatgtctgtaaatatggggtctcaatagcttcatgcattttcctcactagccagcgagttctctggcatacttaatcaatcctctactattcttggataggaagtactaaattgctgaggttttaacaaataccatgtttcacttaggcagtgtagaaattatcccagtataagtacattactatttttatgtttttgatttttaacttttattattttaaaaataacataatgtgtattcataatggaaacatataaaatgcagataagtaaaaagaaaaatatacctgatcccaccatgtggagataatagcaaccataataaatttgatgtatacctgatttagacttttttctatgcacttatatacatgcataaaatttttcacaaaaataaatcatatagatgtcttaaaaccttcaaaccctgcttttaaaatttaatataccataaatacctttcaatttccaacataatatttaatggctgcaagccaagaatattttagctgaataggactgggaattctttgccccaaagatcttacattaaattgaaacgtaatcatcccagggcctggcctcctgagggtaagttgtaccactgtggcatcaaaaggtagccaagaggcactgtttaaggtagctgggtgtctaggtgagtgtgtgcatgtgtgtatggtacttcacagtgtggaactgagctgagagtagaaagaggtgtgaactaaagccctgggccaggaaccaaagacaagtgtctgggtttggatagacccacactgccactgagaattctaaatttaatcccatcttccagataattttgaggcttacattttttaaggaaaaaaagagataatattttttatttagtagtttgctttcataactttaaaacattttggcacatgataggtgtattatccttcatttgtacttgaggcagcccctaaaaatgtcaggagcaggcctgaatacacagattatatacttcctaaatttctagaatgtataataattgttttatataataatttacctttctatatgaatgaaaaggagtattacatgagtgctcatttattgactggctaaggttcaatttaatatgatatttattgaaacttcaccatacaccatattctactgggtacaggatgagaggcaaaaatacataggccagacccttacaggactcccagtcttctggggacctcagactgtgaaataattatcccacagagtgataagtgcatcagacaagtgtgaacatggtacagagccacagagagaaaagagtggacaacttcagggtcaggaccctgggatcaattaatttatctggacaactatagcctcacagaaatctttaaaaagctgtataaaccattccatccaagatgagttattgtaagcctttgaaatagttgaacattttaaatttttgataaatttggtaggttggtcacttgacaaattgatcattcaggaattcacttttagtagatgatttttacctaatcagcctgtttctttgaggggctgatctcaaggtacattcatagaaattccgtccatgctgggatttaaaaaatacataggaaggccaagtgcattggctcaggcctgtaatcccagcactttgggaagccaaggcgggtgaatcacctgaggtcaggagttcgagaccagcctgaccaacatggtgaaatccagctctactaaaaatacaaaattagctgggtgtgctggtgcacacctgtaatcccagctacttgggaggctgaggcaggtgaatcacttgaacccaggaggcagacgttgcagtgagctgagattgcgccattgcacttcggcctgggcaagaagagcaaaactcctcaaaaacaaaacaaaacaaaaaaacacataggagtttgaatgggaaggcatgtggtcagttaatgagtaaaaatactctgtgaagagggaacagcacatgtgtcagcttggaggcacatcatggagtggcacattctgagaacagtaggtggttaaaattgctagaggactgaggtgaggaagcaaaaggagacaaaattggagagaaagacagggctacaacctggagggttttgtggtgctgggttccatggagttttatccaataggaaatggaagccattgaaggattcaaaggcaggaagtgagaacatcagactgcattttagacagaccgtgctggcaaaggaatgaaggatgaattgaaggggagtagtctggaaggggggagttcactgctgagaagggagcatccacaagggtcatgataagggcaaattctgaattcagagtgttgagattcaaaactgcttctatgacttagcaaatgtgtgtgtgggcaaagctggtttcctcatctgaaaaatacaataataatagctgtgaagattaaaagaaacaatacatataaagtgctcaaggaagagcctgccatatagctcttaatacatactagctattatttttaaaatgtaatataattattatatttaggagttcaaaagaaagatattgatggtcaggcagtggaggtgggtgtgggaataagaaatataaggagtggatttgacaggtctttttggcgattagattcaagatgaggtaggaggaatttgggaagacaggagcaagaacaagtgggatggtggaagataatgaattttgctttggacatggtgagttttagatacttttgggtcataaaggatatccagtgagcagattgatatgtaggcctgcagctcagtaaagagaagtgaaggccacataagcaaaatgccagggtaagaggttgatcagaaatagctgcactgatgtacaaatgctatttcatctatttggcccttgatgcatgacgtctgttagtactcagaagagagggcaccttaatagctttcttaggtgcaatctccactataaaagctttgcttatcaacccaactaggtagggcttctttactcttacactctttgttatggactgaatatttgtgtctcttccaccccaccaaattcatatgttgaagacctaatccccaatgctgtgttatttagagatggggcctttgggaggtaatgagggttaaatgaggtcttgagaatgggcccttggtcctatgggatcactgcccttataagaagagacactactctgttaacatacaccaaggaaaggccacgcgagcacacagtgagaaggcagctgtctctacaagccagaagagagccctcagagaaacgactctgttggatcttgatctgatgcttctagcttccagaactgtgaaaaaactttctgttgtttaagccacccagtctatgatattttattttattatggcagcctgagctgactagtatatccttgtataaggggttctttgtatttctcctatgggttggtcttttgtttcactctctttattagtatatgtttcttatcacttcttccaccttataggtagcttgaaggcaggtctttccttatacttatgttagcattccctgtggtgccctgcacaaggttttgcccaaaggagatgttcaataaacatttgatgacctcaagataatgcagtaatttctgtgaagaaggtcacagataacaagcttagggcaggagactaggcagcattcaagacttgggctcaggtagaaacggcaagatataggatttcaatgtgaaatttggagattagcaaggacagaggttctcaacaatgatcagtgagaaaagtgaaatggccaacatgtctccaagtaaggcatattcttttttgagtattttgcactttgcaagccattatgtaaaattatgttttggcttggctgcttcaaattaactttgaaaaaaaaattgtttttgagttacagtttgtctaaagcaaatgagtttaaaggctgaaatcgagaatgggtcatatccttaataattttatgtagtaaaagatatttttaaaagaactaccaatcaactgaaaaatccaaaaatccaacaatggcagccactgccccccaaagaaatgaaatgaaacaaaacaagcaaaacaaaaaatattttgtttattgcacttcaaactctagtttattgggaaccacttaaaattgacataatgttcttaagtggagattcaggggtgatgctgtgattctgtgtattttctgcgggatgccaagtgtgttctgggggtcatggtagaaaacagagagggactttgccataaatgtctcaagatatccctctgtgaggatagaagaagtgggggagatttatttatttattttctctggagcatccttcattgccatcttgctaatctcctgagtgctactggaaacaaggactttctagtatcaccagcgctgaagcccaacagtacatgggatgaaaatggagtaaagttgactctaccaacctatccacctaagagaaaccagcacgtggatgaatggatgtcacagcctggagcaaactcttagacttgtgttctccaataggtgagccactagagccacaattggctgtgagcattcaaaatttggtcagtccaaattgagattgagatgtgagtgtaaaatatgcactagatttcaaaaacagttaaaagaatgtaaaataactcattaatatttgcttattaattacatgttgaaataatattttgtatatattaagctaaaatatgttattaaa

SEQ ID NO: 978 - DNA, 3489 bp, Homo Sapiens
taaaaaaaaaaaaaatccagaaactaacccaaatgactacactcaaataacaccacaataaagcaaagtatcagcaaacttaaatgttggccaatagtattttctcaagtcaaaattaaaaaaaaacaaaaaataaataataaaaaaagcagatcctagattacctctgggattgtattaagcttcctgatatatgtataactggagtcctagaagaaaatgaaaataagaaaagggcagtcaaaatacaaacaatacagtagtcaaagtttttcatactgtaaatagatagataatattcgcagattttggaaactcaccagaatacaagcaagataaatagagaggaaaccattactgagcactgcccagtagaaatctgggaattgagccactgttctcccacagaatggtagattcacagcattaggagatatacctaatgttaaatgacgagttaatgggtgcagcacaccaacatggcacatgtatacatatgtaacacacctgcacattgtgcacatgtaccctaaaacttaaattataataaaaattaatttttcaaatttatctataaattcaaggccaccacagttgaaatcacaatttttttttgttgttgttttgttttcatttggctttttagaggcattttcaattctattctaagaattctatgaaaacaaaaatttctaaaacatctgctctaaaaaaggtggagcaaaacttcctaacccttaagtggcgtgggttacacatagtgacattcattcaaagtgtactccctgaaattaaaactctcaaaatctgggtacaggagaaacataatataataaaagccatatatggaaaactcaaagctagtatcatactaaatgggggaaaattaaaagcctttcccctaaaatctggaacataataaggatgcccactgtcacttctgttattcagcatagtactggaagtcctacttgaataatcagacaacagaaaaatacaaagagcatccaaattaaaaaataagaagtcaaattgtccatatttgccgatgacataatcttatatttggaaaaaaaactaaagattccacaagaaaacttttagatctgctaagcaaattcagtaaagttgaagaatacaatatcagcatacaaaaatcagtagcatttctgtatgccaacagccaacaaactgaaaaagaaataaaaattaagcttattaacagtagcccaaataaaattagtaacaaggaattaactaaagaagtgaaagatatctgaataaaaactgcaaaacaatgatgaaataaattgaagaagacacaaaaatggaaaaatattccatgtttatggattgaaagaaggaatattgttaagatgtccatattatccagtgcaatctacagattcaatgtaatccctatcaaaataccaatgacattctttatggaaatagaaaaaaatctaaaatttatatggaaccacaaaaaaaaaaactcagaatagacaaagatactctaagcaaaaagaacaaaattgtaagaaccactgtacctgatgtcaaatgatactacagagctatagtaaccaaaacagcatgttactggcatagaagcagacacatagaccactggaacagaatagataaccagaaaacaagtccacaaacctacagtgaactcattttcaacaaggtgccaagaatattcactggagaaagaacaatctcttcaataaatggtgctaggaatactggatattcataaccagaagacccatatgtttcaccatatactagacccatatgtttcaccatatacaaaaatcaaatcaaaatggattacagactttaatctaagacaacaactggatgaaactggagttaattatattaagtaaaacaagccaggcacaaaaacacaagcatcacatgttctcacttatttgtgggatctaaaaatcaaaacagttgatcctatagagatagaaaatagaacaatgattaccagaggctgggaaggggaaagaagggagggtgggggtggtgtggagatggataataggtacaaaaaatggaataaatgaatgaataaggcctagtatttgattgcacaggagggtgactatagtcattaattatttaattgtacattttaaaataactaaaagtataactggattgtttgtaacacaaaacataaatgcttgatgggatagataccccgttctccatgatgtgcttatttcgcaaaaatgtcttatgcaccccataaatatagaaagctactatgtacccacaaaagttaaatatttaaaaaaacaaagaacactgtattgaaagatagaaaaaaatgggtaaatttaaagtggaaaaacctgataattattacctcatccagttaatcaaggttagcattaattatgatgtcatgcagatagcatgggtttttgataaaatgtgatgagaatggcacttcacctttctgtccttcatatatataaaatatatgttttttaggattctgacaagtgtgtacatattttatatgattacatcttcaaaatctacatcccaaataaagaacattaaatatatatgtgtatattctaagaatgagaaaacatcctatacactcagttgagagacattttataaactagttggccagcagtctaaaaactgaaaattttccaaaacatgagaagtcaagaaaactatcacagtctacaagaggctaaagggacataacaaatagatgttatgtaacatcatgaacattatcctgaaacatgacaaagcaattagatacatctaaggaaatttgaataaagtatgaaccgtagttaaaaatgtaggtatcaatgttagtacattagttgtgataaatgtactgcacttatgtaccatgtaaacaaaaaattggggagtgagtatatgggaactctctattcctctgtgcaactttcctgtaaatctaaaacgacaatgtcaagtgctgctgaagatgtaaaacaacaaaaaaatatgttgcttggaactgtcctatagagtcaaatatataccaacaataaacccagaaattctagttggaggtatttacccaagaggaatgaaaacacacaaatatgtgtacataagtgatcagagcgactatgttaggaactttatacacattatcatatttagttattccaagatgcttgagaaaaaaagcaatcttatcgcattttctcagaaggaaactaaagacatgatgtttcaatccacgttcacgttgaaatgaagattttacacaaagattgtaaggtcttgtaaggtctaccataagcacaactttattccagaaggagaagagataaataatagggcaaaagcaatttttgaggagacaacgggcctaaaatttcacaactgataaaatacactaatctacagatataggaagttctaagaactccaagcaatataaatataaagaaaattcattta

SEQ ID NO: 979 - DNA, 2185 bp, Homo Sapiens
agagctccagttgtgtcttgttgtctgccaacgctaactggccagctctgacaggaggtgcgtggcccaggaggagccatcaggccagttctctgggatactgctgtgtctccagctctgcagtttgctcttcgtcactcagcggcagacggagaggcagacacgagccccttgtgagccctcctccttaccgtcatctcacaatgctctgaaataaggaggcaaatggctgaggtcccctcagttgtagatgtgattgagttctatctaccagaagcatatgcctcctggaagcctggttctaacacctcccacaaaatccttcaagcacttttttctgttccaaggtttgcttatgggggacccagtgaagtgcttcagagccctagagatttgctgagtcatatgaggggtcagcaaacttttcctgtaaagggtcagataataaacattttaagctttgtagactgtataaagtctctgtttcttctccccctcctcctcctctttctccttcagcttctttcctttaaatatgtacaaaacctttcttcttttccaaaatctgtctatatttgacctgtgagctgtagtgtgctgagtcctgcattagtaggaaagatcttgagtttcagaatgacgatgtaaagcagagaccctcctccccgcacccattctctgcaaccgacacttggattacttttcttttactctttgtctttctctgaagtatagatgtatggttggctttctgaggtcaaatataattaagaggtagccaaccatttggcaaatttgaaccaagaagagttctgatataaagaatgtaggacccattcactcccaattagtctcttcactgaaaggtggcttacaccaggtatatctcatttgctaatttgcttagtccatgtctagggaaccattgtgatcaagccaatatacccaggccagagcagcctgctttagaatcaaagctttaggctaggcgtggtggctcacatctgtaattccagcactttgggaggccgaggcggacagatcacttgaggtcaggagttcgagaccagcctggccaacatggtgaaaccccgtctccattaaaaatacaaaaattagccgggcatggtggcgggccctgtaatcccagctacagctacttgggaggctgaggcaggagaatcacttgaacccaggaggaggaggttgtagtgagctgagattgcatcactgcactctagccttgacaacagagtaagactccaccacaaaaaaaaaaaaaaaaaaaaaagaatcaaagctttaaaatccagcagaagtaaaatttccaagtgggagggaagaggatcaacaggagaatctgcaagagtaaaagaggaagaagatgtgtgctgcatggcacaaaatgaatctgcaaagcatctgggaactgcagaccctactgatgcctggaactcactggagtcagcatgtccaggcagtcattgtagcaagtcagagtggtgtgatgaaatgcttcaggagaaaaacatttcaccacagcctggttcactcagataccttgccagggaaccaacatctcactcgggcctctgatattgtaactgtgggcctttaagaaacaacggaaaacccaactgaataaaaactgacctcctttgtggctgccctgatggaaggggctcaggagcaacagccttcatggtgcccaccctctgggccagaacaacggatgccccacaactgagtttagtgcctccaagaaccacagcttttttttgcagcagtaagagcatacctctgaggcactgtgaagaatctgatagtcgaactgaatgaagccaagtccagtctttacggaaaaatttacacaacacttccaggtgggcagattcaaagacaggatgaatcatggttcagtgcagtggttcctggctgtaatcctagcactttgggaggccgaggcagggggactgcttaagaccaggaattcaagacaaatctggggaacatagtgagaccccgtctctacaaaaaattttaaaaaattagccaggtgtggtggcccgttcctgtggtcccagctactcaagaggctgaggcgggagggtcacttgagcccaggagtttgaggttacagcaagctatgatcgcacatcactgcacactagcctgggtgacagag

SEQ ID NO: 980 - DNA, 2580 bp, Homo Sapiens
ggaataaaatacagaatttagtaaagctgaaaactacattgttgaattagaagacaaatttgaagatattatttagaactgctttcctttgtcctgtcatttctctacaaagttattgttcttggttgaagatgctatatgagcaggagttttaagctactgctttgagctattctttgttgaggcttctcctgcatgatatgcactgcacgtattaataataataataattaattctcttgtgaatctgtcttttaccatgaggatctgtcccaactaagcactaaggataggtacaagtaaatttctgcctcccctacagtgggcagtggcatggggagccagagacactatgtgttccttctgcttgggcgtgggtgtcagatcaactggtgctcccacagcaatgggtagatggaggctatgcaggagctggtactctctatgggaaaggtcaagacagctggcagtgctggtagatgaggcagcatccagtagaaaatgggcaaatgatattaatagtatttcagagaagaaaacaaatggcctgtgaatgtattttaaaatgaccaaacaatatctgaaatcaattaatataatacacctcagcaattccactcctaagtgtatagccagaaggaataaaaatatatatccacacaaaaatatgtacatgaacgttcatggcaacattattcattatagctaaaagtagaaacaatctatgtgttgtatttctttataacattcaaatgatgaatggataaataaaatgaggcatatccgtacaatggaagattattcagcagtaaagaagaaggaagtactggtatgcactaaaacatgaataaaccttaaaaactttatggtaagttgaaggagccagtcacaaacaaccacatattgtatgattccagctataggaaatgtccacagtaagtaatctatagagacataaagtcatcagggcagaggaacttgagggggactgagaaataactgctaatgggtacagggttgctcttgggggtgatgaaaatattctaaaattgtttgtgatggttgcacagcctgcataaactaaaagccattgaactgtatactttaaatgagtgaattgtaaggtagacgaattatatcttaatgaagttataaaaaataaaaaataaaaagtgctcaacctcggctgggcgcggtggctcatgcgtgtaatcccagcactttgggaggccgaggtgggcggatcacctgaggtcgggagttcaagaccagcctgaccaacatggagaaaccctgtctctactaaaatacaaaattagccgggtgtggtggcacatgcctgtaattgcagctactagggaggctgaggcaggagaatcgcttcctcaccctcccaagcagctgggattacaggtgcgcgttaccacacctgggcaatttttgtatttttagtagagatgagttatcgccatgttggccaggctggtcttgaactcctgacctcaggtgttctacctgcctcggcctcccaaagtgctgggattacaggcgtgagccaccacgcctggcctgaccacttttcaatgtctgtagagaaatactgttagggtcccctgaaagccaatctaagtctgtatttccagccttcactcagttcttctttgtaaatatcctgcaggcacctcaaaatccacatggacaaaggttaattcaactttcccacatcctattacatgttctactttccctattccagttaaaatccaagctaggaagttcaaagccaccttccactttctcacctccaaacacttttgccatgtagcttatgtgagttgtctcgatttagcttgtttttttctcatttatcaggtaagcacctttcttaaatttgtggtgaaggtcaaatgagaaagcatgttggagaatgttccaaacagtgccttgacaggagcaaacgctcaggaaacagtggtggtttcatgatgatcccttgccagaagactgcatggactcctaatccatcttcctgggggcagtacctccccattttttccccttggttattctcttctctcttcagggccccagttgtgcacagtatataatcatttgtctgcagaacttttcctgtccttgcctcatcattgtgtgttgagtgtgttgggggcagataacttgtctttttagttcactggtttccagatggagagaaggcacatctgagcacacacagaaacatggggaaccgcatcccactacactagcagctgactgagatgactagaccctggactttgagcagatgccataataggatgtgcccgtggaggcggttgatgattagtgcagtttacatgtgagaggaatgcgaattattttaggtaggaggtggagtgtactagatggtttccaaatatggctgcatcagtatctccaatcccacaactctttgcaaggtgattttgccacttgtctccttaaaaggtggagtctaattcatctcccctagaatttgggctggctttgttacttgctttgaccaataaaatacggcaggtcttatggcttctgcttaaa

SEQ ID NO: 981 - DNA, 2788 bp, Homo Sapiens
agcgttggtacgtgctttggtgcagggcctcttctcgagcgctgatttccagggtgctgttccagatgccatatccaaaataaatgagcagacctgtggggcgaggggaaaggtacagataagtaaactgaggcccaaagaagttaagtaaatttcccaaagtcacaagacaaaggaggggcagagctgtgatttgaagttggtgctgtttgactccaaagctgcttcagttgtcaggatgtttacacggaagaagcactggaccagttatgctgggctcctgtttctactccatccctgtagattcagcatccttgtttctaaaataaaagtattacaccaaagactctcttacggatctcctaactctgaccctctaggattccatctgttatattgaactttgtagtattttttgctgcaaaatctgttgagcacagcttagcttttcttttacatcagttacaatattgttcagtattatggagatgctgtcagggatagtgaagctgtttgtctctacattaaatggcccagtctgttatttattttgagttcctatgtcagccctcctccccttgctttgtaaatgtagctttccatctccttccttgatgtcagactgtcagtttttacttcttgttgctgtcccagtgcttacctggagcagtcagactgcctcttttctaaattgctgcttccaacacctgatatttaaattgttagagtgagtctaaaattaagaggaaatggtctttgaagaaggcctgaagaactcttccatggggaaagtatagagtgtgcacgcattaaatacaagaacctgatgatattttcttggatgccgtgtgttttcagggttctcgggagttgagtttgcacatacggattaggttgctctttcagtgatgtgtgaggaaggaagtgaagatgcaactcacttccctgctttggtattggatccacagcattatccaattactcctatattctatgagcttattctcatcacccaactttaccacctgatattgtacaagatttataagtaaaatcttttccaaatgatgcttttgaagcaggcatcgatttgattgcaaatttaatttggagagccaatatttatggaatttgtgcaatcaaacattctctccataacattcgatctgacaaattaaatttaaaaatacccccattttgccaccagaatacacttgccaagggtaattagcaaatggccaagtcttcattaggtcttgtgaatggaccagtccattgctgtctgaatcagagaaagaggccctggctgtgcatggtataaggagcatttggaatcttagtcatttcccaaggtcctgctggggtcctaatgactgtagtttggggagaacactgggaaaatcaatcaggcactaaccatacaagacaatttctgcttcacgaaatcgttgttttggacacactgtaaaagatcttataatattttaaaatctttctgatttgtttgtatggagaaattcagacttagagtgggtactagagagcatctagcctggcattgaagctcactggtgataattgaatgtttacagcctcaaatatcctgagaaaaatgttctcattcaactattttaaaatatctggtatgtaagaggaacacatttaagagtatctttctaatttcaataagaaattaaaagcatggaaatggaattttattttatttttttaattttttttaaatttttttagatggagtttcactctgtcgcccaggctggagtgcagtggtgtgatcttggctcaatgcaacctccacctcctgggttcaagccattctcctgcctcagcctcccaagtagctaggactacaggcatgcaccactatgcctggctaatttttgtatttttagtagagatggggtttctccatgttggccaggctggtctcgaagtcctgacctcaagtgatcctcctgcttcagccttccaaagtactgggattacagcgtgagccactgcgcccggcgaaaccttggtttttatcctagattatctagggtcctagattactgagtgttgaggggcaagttaccctcttatggatgaaatgagacggccaattagatacagtttagggtcccttctgatgcatcattctttggttttacagctaaagtcaactcttaatcatctagttagtgagggaagccctgtaggaaatactgtatgaaccaatggttctcagtgaaggtggtactgactcctaggggaattttggaaatatgtgggagtgtctacggttctcatgatgattgtgggcacttgtggcattaagtggacagggacctgggctgtttatcattctgcaatgtgactgactcacagaatgaagctctgtcttgtatcatatatgactgctgatggccccagtggacattcatttaagtacaaacctgtttataatttttgaacttgaatttatctccattttacatatacacacaaagcatttttttttttgcatggctttttagacattgaattttccaggactgcaacagctgggtaaattgagagacagttgtctcttgtttggtttggaatttaccgacttgatcatcattttggaagaccatcatcaacaacaatgttattcatggactttgagcatcaaataactgtcctatatgagtctgcatttgtggcagttgtactcacagtggttctacaaatgactgcaaacaactgacgacttcgttgcgtctcctaatgtacgcatgcccca

SEQ ID NO: 982 - DNA, 10481 bp, Homo Sapiens
tctctcagtaatgtgttataattttcattgtataggtctgacacatttttctctaactctcactgcatcccaaatggaagggattggttttattttgcaagatatatacattaaaagtgatatatacattaaaagcaacaataactaccaagtgtacttttaccatcttttcctaaaaggacattttaatgccaaagaaacagatggcatgaggtcagagcagtaacagtggctgaaatctacctatttggcacccacgccggctcctgttctgaggagtcacgaaaactggaaaggcagtaaccctgaggccgacaaattccatgttagttctattccacctccagttcaccctgtattcctctcatctctatggcagacagaataatggcccaaagacatacatggcctgatccccagaacctgccacatgctgtctcacaggccaacagggactctgcagacgggaaggaattaagcattgacacggggaaactatcctaaattttcctgatgggctcaatgtcatcacaggcatcctatgaagtgaccacaggacctaagagggtcaaggtcagaggagagatagggagacggaagcagaagttggagtgcagcactctgaggacagaggaagagccatgagccgaggaatgcaggcagcctctaggacctggaaaaggcaggaaacggattctcctctagagcctcaggaaggaacgtggctctgcaaacaccttgattttgggcggtgagacccattttggacttctgacctccagaacgataacagatgtgcgttatttgtaagctgctgggtttgtggtgatttgttacaacccactttagggaacactgacccggaaggagggtgaggatagagaagccagagtcagcacagaggtgctgggaggcgggagcagaggaggggcgagctgtatcccagacagtaagaggggagagtgtttgggggctggtcaggctgcataagaaggcagagggacaaggccactgagttgggtggcgcagaagccaagtggcagccttgacaggagctgttccctctggaagaaaggaaggacccccggctgctgtggactgaaggcttttgctcgctttgcctcacctagatgccccctttctgctgctacatcccagcacccagcaggcactcggtacacacctacgatgaacacccgactgctctgactcttcaccctcccaccactggtgactccagcctcactgctaacactcccttactcacgggcccctctgctgctcgaggcgcctcagggcctttgcactggctgttcccgtggcctggaccactcttctcagaggtctctgcgtggctgcccgctgctcatcacccaggccccacacagcccccaccgggcacgtgagagtgtcaggtattgaaaggacaatattttgaagacattagggtcaacgagcagattatcaaaactaaattcacctgtttcttttcacttttttttttttttttttttttgagacggagtctcgctctgtcgcccaggctggtgtgcagtggcgcgatctctgctcactgcaagctccgcctcccgggttcccaccattctcctgcctcagcctcccaagtagctgggactacaggcgcccgccaccacgcctggctaatttttttgtatttttagtagagacggggtttcaacctgtttagccaggatggtctcgatctcctgaccttgtgatccgcccgcctcggcctcccaaaatgctgggattacaggcgtgagccaccgcgcccggcctcttttcactttttttaacgtggcgactagaacacgtaagatggcgtctgcggttcaccttacacatcctccctggagagcgtactctaaaccaggatgcaagcttcccctacagggcaagacaggaaatgcttccagcttctcaggctctctgtcatagtcacggtggcaagagtcagccacagatgacgtaagtgaatgggtgtggctgtgcaccaagacttcacaaacacagttgctgggctgggctgggcgggccccagacagtgagtcggcccatacctgctgtgtgaaagaatccaaacctggggccgggcgcggtggctcacacctgtaatcccagcacttcggcaggccaagattaggcggatcacctgaggtcaggagttcgagaccagcctggccaacaatggtgaaaccccatttctactaaaaatacaaaaaattagctgggcatggtggcgggcgcctgtaatcccagctactcaggaggctgaggcaggagaatcacttgaacctgggaggcggaggttgcagtgagtcgagatagcgccactgcactccagcctgggcaacaagagcgaaactctgtctcaaaaaaaaaaaaaaagaaaaaaaaaagaaataataaaaaaagaagaatccaaacctgcccagagagaggcctggcttttgccctccgccctcgggaagtcatctctgagcccttggtgtctcgcgcatgaggagggtctgactgcctggggccctcaggccagcccgacagcaagatggatttggggtggagtttgggccaggtggtatccttgagcttccggggctggaggctgaggtcagccacacagatcggggaggagtccccagtaagaacccgggacaccaagatctgaggagggtccctggctggcaacactccctgcgtgccgggaggagtgaagggagaggacagctgataactggtctccgtggagccttccgggccctcttcctggctgcttccagcgcgtccttctctgtgataagccgtgactgtgaacatggctggccaccgcctcctcccagcttagcggctgacggctgcacacccaggcctgcgtgtcggctggcagcgcgctcagaaactgctccagcaccagcagctccagcatctgctccttggtgtgcacctcgggccgcagccggtcccggcacagggcgcgtagcagccccagcgcctcgtgcgggcccggcgcctcgcccaggtggaagcggcggaagcggtgccacgaggagcccagcgccaggccctcggcctcctgcttcagcggcaccgtcagctccatggggcctcctggacggcagcgcctgccccgcgtggcccagggtgcaaagaggtctctgtgaggggcggcgctcactcgggcggtgaggaaagggtgtctgtctcgtgggatcccacggagtcaagtgccggctctgcccctcgttgggccccttccgcggcttctgtacctcagtcctgcagctcctcccgcagcctgtcctacagcacaaaggctctggagcaaattccagctctgcctcccaccagctctgtgtccttggacaaggtacaaggcaccttttgtaatacactgtctctccatgtccttggctcactctctcaggcgaggcctcccaagcctctttacctccgcgcacatgtgcacagagctcaccggaactcctcttacacatttttgattattcgttgctggtacctagaaatactatttttgtgtattgatccttctagccagtgactttgcagaatttacttattaattctagtagctttactttagatgacttagggttttccatgtatacgatcatgtcttctgggaataaaggcagcattatatcctccttaccaatttcaatgccttttctctcccttgccttgctgcattggctggtgtctccaatagagtgtcgaaaagaagtgccgagggtagacattcttgcacagttcccaattttagaaagaaagcattcgggctttcaccatcattaagtgtggtgtcaaccttgagtttgtcacttacaccctttatgaggctgaggaaattcccttctgttcctaaaatgctcagtttttattacaaatgggtattaaattctgtcaagggccgggcgcagtggcttacgcctgtaatcccagcattttgagaggcctaggtgggcggagtttgagaccagcctggccaacatagtgaaaccccgtctctactaaaaattcaaaaaaaaaaaaaaaaaaaaaaaaaaaagccaggcgtggtggcactggcctgtactcccagctacttgggaggctgaggcaggagaatctcttgaacccaggaggcggaggttgtggtgagcggatattgaggcattgcactccagcctgggcaacagagtgagactcgatctaaaaaaaaaaaaaaaattctgtcaaatgctttttctatatctgttgagatgatatgatggtattgacaggggttttccccttcattctgttaatatggtgaattacattgatattaaaatattaaaccaatcttgtaagtcagggaaaattgacacttggttatggttatatatatatatatcttactggatttgatttgttaaaattaaaaacttttctttttcgaaaccactttattggcctggtgcagtggtgcacgtctgtaatcacaggactttgggaggctgagttggagaccaacatggacaacatgacgaaactctgtctccactaaaaatacaaaaattagctgggggtggtggtgcacgcctgtagtcccagctactcaggaggctgaggtggaagtcacttgagcccaggaggtcaaagctgcagtgagctaagatcccaccagtgtaccccagcctgggagacagagcaagaccttatctcaaaacaaacaaacaaaaaacaaagcaacaacaacaacaaaaaagctgctgcagtggctcacgtctgtaatcccaacactttgggagcgtgggggggggcggggggggtggatcacctgaggtcaggagttcgagaccagcctggccaacatggtgaaactctgtctatactgaaaatacagaattagccaggtgtggtggcacacacatgtagtcccaggtactcgggaggctgagacaggagaatctcttgaacccaggaggtggagactgcagtgagctgagattccaccactgcactccagcctgggcaagacagagcaagactctgtctcaaaaacaaaacacatacacacacacacacacacacacacacacacacaaccagattattttattgagatagaattcatatgccatacaattcaattcacccacttaaagtgtacaattattttagtatatcgtcagatacacacaactatcaccacaatgatttttagaacattttcatcacctcatgaagaaatcctatacttttctctttattttgagacagagtttggctcttgttggccgggctggagggctgggattacaggcgtgagccaccaccgcacctggccagaaatcctatactctttagctgtcactgttgaccctctctccccgaggcataaacatccactaatctaccttatcttcagagtttactgtagagattttattaaatgaaataatataaaatgttatctttgcgactggcttttttcccttagcatgatgttttcaaggctcatctgtgttgtggtatacagcagtacttcatttctttctcgatttgaataatgttccattgtatgatctaccacatactgttcatccattcatcagctgatgggcatttaggctgttttcaccttttatctattgtgaataatgccattatgaacattcctatacaagtttttgtgtgtacatgtgtttttattaccttgggggtatgtatctgggaatgaattgctgggtcatatggaaactctgtatttaatcaatgagagaactgccagattgttttccaaagtgactgcaccaatttatattcccatcagtcatatatgagggtctgatttttgttttctcaccaacacgtacctttttttttgacacagggtctcactctgttgctcaggctagactgcagtgacatgatcatggctcactgcagcctcagccttcctgggctcaggtgatcctcccacctcagcttcctgagtagctgggacttcaggcacatgctaccacacccagctaattttttaacatggtttagagttaactgtttacttcctgggagtggggaaattttctctttatcaaaagttggccctaatattctaagagttataggtaaatgtgaatcaatatgtcagttccccatctccccgctcatctttcttaactttgtagcttaatgacatgaatatacagagcgaacagactttggtctaaatatcaaagtttattgaaataaaatataatctataataaaaaatactacaggtgttattcactggttacagttttaagtatattaacaaaaacagccaacattttaacccaacaatgacactatctttgtggtacaataacaaacatgaaagtaaatgttgaataatactgaataattctgtcagaaatattttatactttaccatctatgtatgccttttaaggaatatcctcccaaagtgaaagttttgaaactgatgacattgtttttaagaattaagtagttttaaaataattagtatttaaaacaaatttatttcacagaaattcagttcaaccctaagctgggtagatggttttaggtatctttatgcaaaaaatgtatttcaatgctctttcctatgaatctctagggttgttattattcctcaattgaaattaaagctggtcataaagcaaaacagatgaattatttcagaagtaaaatgggtattaagataaaaaatgaaaggaggaggaaaaaataggcactcatacgtaatctatatattaaaacgctttgagaactcagtagccagtcttggcctggcacaaagagatctttgatatgtcacagcaaattgacccaattagtccaacaataaagtggagaaagaaaacttgtttctcttccttgctatatttcaagataattttctctgtagtcattataccattccacttgctactcctcaaaatatgtgcctcaatccaattattctgcacaattcaaggaaaagattcacacgcactagctttaggaaatgactttcagggtacctctgaagtttcacaagcaaacatgattccttttgctgactgttttgtagcattcacacaccaatctcctgttatactgtcctacttgtaatgtgtgaatctgtaacaagctgtcatttattaagcaagatagtcttttaacaaaaacctctgagggcttttcaaaacctcatctttaaaaatctgtaaaacaaagataccctatgtaccctgaaaaaactgcttatttcacatatgtgaaaaacaataataaaaattctgacaaaattgagagacatacaagacaggtcttcaaggattaaatactgtttgtcttaaaacatgttgcaattatgttcacaatgtaaggttcattaaaaatttttaaaaaacacattgcattagttagaactgctttgtaaggtatttcagttacaaggcctattttgacagatcactgatttgagaacttaaatgggaatttcagtttcttgacttttttttttttttttttttgagatataagagtctcgctcagtcgcccaggctggagtgcagtggggcaatcttggctcactgcaacctctgccttccgggttcaagcgattcttgcgcctcaacctccccagtggctgggattacaggcatgtgccccaaagtgctgggattacaggcatgagccaccgcaccgggccagtttcctgactttttattttcagctataaaacaattatgagagccaaaggagccaggatcaccttccaaaacattttgttttgtccttctctaatttatgaggcattctttcttctcaaagcaggatattacagtgcagattaaaactggatattaaagttaatggtgacaaattattaagtagtttgaagaaatccttagaatatcagataaagagagacttaatggcagaagaagaagtctactggggttcaaagcttaggttttatatttctgccatggtatctcaacactttctctgggatagtacgatgccctaaaaaatacctgtgttaggcagacaagtctaaatctcctttctcaggacaataggacaaaactgaacttgaggcaatagttgaagaattttaccccgtttttcaagtttaattttcttgagatcagaaaagtaaaattagaaagtagaatccttcatgtaaaaaaatatatgcgtatcacaatttattaaactctaacatctaagagcaaaaacaccaggattaagtaagaacatgcatgaactaaaatttagatagatattcaaagtaagttaaatttaccagagtcctgcatctggcctctcccatgccattatcgctattttgcaatttgttttgttcaggaagcctctgattttaatatttaaagtgtcacctgagaagagtaacctcaattcttcatgttttctcaacaatcttagaggtgttggacatcattaataaaatatactaaattatcagagaacttaagaacgctaagattctgatgagttcctttaccattttcagtcactttctaaaagggatttaacttcacattatcaaataacattttacactaaaaacacaatttatatagccctaaaataatattacttgagagatctaaatgaattccaccaatgcaaacgaagtttatatactgtattagtaatttgataccaccgtattccatggagaaaaaggcaaagagaatctaaatatttagatctgtgaaagatactagaaaaaaatagatttttaaatgcttctgatcctctcaaaatactcttgattttgactctatagtctatagaacacacaaaaaactgtaaaatgcatttgggaagagatcacgccatactcaaagaaaattctacaaattttgacagcattaaaaaaactgacttaagatatattttgttattgagaaaaaagtgtgcacattcaagaacataggatgtgtaatatttgtgataaattaagtcatactttgtgcttatactatgccctttattcaggagtgcaaaacacttaatcaaaaagagcatccttcacatatttaaagagtacattgaggcacagaaagtttgcccaaggcaagatagaaagtcgggtttatagacacaaaatgatctagaattcttcatgtccaattccttaaaatacaaactgtagactatttgtaatgcctccatcttattttatcaaacattagtaattttactattataagtttatgcataagtactgtgtgataggtaatgcccataaggtttttatcatgttttaaggtaacttgtgcatggaataggaaaagttaatcaaatgtaatcaattcgcttttgctttttaacaaaacttaaataaatgagctatttgaggacagttctggaaattcttgccttgatttttctccaagattttagatatgtagttcacatgtgaacattaatatatgaacaattattttatttattggcctctagttctctttcctctcatgatctgtctcttagtgaattgactttctgattcattgaaagcaaaatgctaagaaggttttgtgcaagtgcaaaatgtttaatcttgggttcagtcaactagtctctgatactaacttgcttagttaagccaagatcaagaagtatgagaaagaacttgaaatatgataaagaatttgaaacagaatatgggataagtagtcaatatcagaaatgtgagacaataaaaacaagatatattccaaagcctaatcctaaatttaaatctacacttcattcaactctgaacctgaccttgaaacatggaagaagttactttacctaagcacactgcaccagtgtaaaaccaatgccaattttagctgctttatactgcttaatgtgtatatgtacacatgtattcttaaaatggtgattcttaaattgaagttctgaattcttttgagaatctaacagaggtcatgaaaacttgcttcagaaacacacatatgtaaagtacttttaagtgttgatcatgtactataaatcacagcattgtggatgcaatgggattagacatgaagaaaaattttatatttttaataaagactggttactaaccttaaggaatatacttagactctgaaagtaaaaggaaagtgcaatgaccatatttgttcattcatctgcctattttcaaatctaatgatgatttggttgatgcaaatatgtccctaatctaggctataaatgataaaaacaaaaatgtttaagttctaacttttgttagcagtatacatctaagaattttcaagtattacaaaatacttggaaggaaagactttaatataccactttcaaaatcctatgtacccaaaccagcaatgaagtggtgggatatataacgttaccttgggcaaaatttaagaaaataaagacacaatagctctaattttttttttttttttttt

SEQ ID NO: 983 - DNA, 1480 bp, Homo Sapiens
atgctactcatgcacagtgctgtagtcctggggctaccatcagcctgcagatcaggtcaactccttcaaggctctgcattagggcctgctctaccaataattcatttcagctccagcctcaacttgtctggtgttaactcaggcactaggggatggacagtcatggagaacttattaagcctctgtgcagggtcagcctatcatgactcttaggtgtagggctgctcaggagtcaccaagcatatacgctaaggaagaagtgagttcacacagcagccctgacactgggatgtgggtgactgtggcctgtaagatctttgatgtcagaatttgtacacctacaccaagcaggaggcatcaaaactgacccttacactgatgattcaatgcatcactcaactctgaaagtcaacagctaggtcttctttaatgcagaggccccatcatcatcccccaccccacaccctctccagctgcttatggaaaattacatcaaacccaacccagtcttcactcagaaccatctgcctgtacctagcctggacccaagcaccttttgcctgcatgtagtagaggtaccattgggtcagcagctgttcctgttccaggagaaacaggagttcaagttccctaagcaccggatcatactctgcagcataccagcaactggtgctctgagatgactcacgtcaaagaagtaaaaagtctggagtggaggatagttatcagcactgcacatgggaatggggcacagctctgtaatatgttagccttggctggtcatcagctctgtgaaactgaggcccatgtctgctttgagggagtagactctgaccccactgggactgcatatggatcattcctctgtctcaggccatagactctgaagctcagtggcatatgaggtaaatgggcagcctctgcctggtgaccataccctccattttgggtggtggttcccactgtggtgggtgcacactctgtcaaatggctgggcaaagtgaatgaatgtggagccagaagaaagatacagccactggcaacagtgggataacaaaagcttctttccacatgtggactgggacactgtaggttttgacttggttccatacattcaggaacttcttggccattgcagtaccctaaaggagggagactacagagttaggggaggtgaccaacaagggatatacatgaagtggtggtggcagggctattatctgggggtgtgagtctctaagtgggacctaacctggcaggtggctgagctggatggagattaacagtgccacaagagggcctgggcctggtgtctatggcagccgtaagcacctgtgccagataggcagaggaattgaacattgtttgcaaggctgtggatggcagctatgatgtgcagctatactccagtgtcccaatctggagcctctgaggtgtgctcagcaatgtctggcactgtgtccacatccatgtggcccca

SEQ ID NO: 984 - DNA, 10031 bp, Homo Sapiens
acagtagggaaggtgcggagcatgatggtgctctgtaggagcgcagacgctgaaaggcgcgctgctgtggctgggagaagagcggagccaggagtttgttcccaatatcttagtgctatggcaaaagaagggggaggagtaattgtggggccccccacacacccgctgcggcgatacactcaccctcgccaaagtccttccggaagtctaagttcgaagatggcgccgcctgtctggtcgcggtcttatgacgaaatcttgttagctgctcttcactgacgcccccaccccagtgcacaaggtaaacacgtgtgcttggtccggagtcggtgccgggctagttttctcttagactctgtattccataatgcagcgcggccagagtcaccgagccctccgaagccagccgagttccagggcgtcttcagcggcgccagggacgctgcagggcctcatgggagttgcagtgtcaaaaaggggagatcgacgcctgcgcggccaacgggatcccacgcggcctcgacgggagccgggagtaggcggactcccaggccgggctcgcgctctggatccctgaatccggcctttccggccggactgccgcgcctgtggccggaagagccagctagaccagagagtctgtacctgcaaccctggcggcgtccgagcccaaggcggagtctgggagacaaagaagtcctcgccgccggccgctggaggattctgccagtagtgaagtcagggatgggcccgagagagcttggaaagaggacaaggaagggaaggagtaggagtagaaaagcatgactttggctgggtatggtagctcctgtctgtaatcccagcactttgggaggccaaggcgggggaggatcacttgagcccaggaattcgataccagcctgggcaacatagtgagaccccgtttttatttttatttttattttttcctgagatggagtcttgctctgtccccaggctggagtgcagtggcgcgatctcggctcactgcaaactccgcctcccgggttcaagcaattgtcctgcctcagcctcccgagtagctgagattacaggcgcccgccaccaagcccggataatttttgtctttttagtagagaaggggtttcactatgttggccaggctggtctcgaactcctgaccttgtgatacgcctgcctcagcctcccaaagtgctgggattacaggcatgagccaccgcgcccggcctaattttttaattttttctagagatggggtctcgttatgttgaccaggctggtcttgaacacctgacctgaagtgatcctcttgcctcagcctcccatagtgctgcgatcacaggtgtaagtcactgagtttggccattattccatttctgtacacaaaaacctttctcattctgtgctataactagttagcatttaattgggtggatgtggtataactagtgccttgttgatattgatgcatatttacatggttttgctgttataaacaatggtcccttgctattataaatcacactgctataagtaaccttgcatctaaattacttcaaatgtgtaactatatgggtaggataatttctagaagtggaattgtgaaccaaagttttaggtgcatttgtaattttgatttataaccaatcttttcactgatctacttctctgcctctaatttctactaggtgtttgtttgtttgtttgtttgttttgagacagggtcttgctctgtcacccaggctggaggacagtggtgcaatcacggctcactgcagcctcaacctgccacctcagcctcctgaatagttggggtgtgtggcaggtgtataccaccacttccaggtttttttgttgttgttgtttaatagagatgaggtcttgctatattgcccaggcaggtctcacactactgagcgcaagcgatcctcctgcctatgcctcccaaagtgctgggattacaggtgtgagttgccatgcctggcccggttatctttctaaagcataaagcaaccctgttgatcctctgcttaattttgatgattaagtagtatgttcaaaatatagaaatccatgtattgataatgatcttttaaaaaaagtaaaagccaaaatatcagctactcatcctacaccattgaaagtagtgaccattaaactgctctacctctacctccacctctctacctctctacctctctacctctacctctacccacggtctccctctctttccatggtctccctctcatgtggagccgaagctggactgtactgctgccatctcggctcactgcaacctccctgcctgattctcctgcctcagcctgccgagtgcctgcgattgcaggcacgcgctgccacgcctgactggttttggtggagacggggtttcgctgtgttggccgggccggtctccagcccctaaccgcgagtgatccgccagcctcggcctcccgaggtgccgggattgcagacggagtctcgttcactcagtgctcaatggtgcccaggctggagtgcagtggcgtgatctcggctcgctacaacctacacctcccagccgcctgccttggcctcccaaagtgccgagattgcagcctctgcccagccgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagtgcctcttcccagccgccatcacatctaggaagtgaggagcgtctctgcccggccgcccatcgtctgagatgtggggagcgcctctgccccgccgccccatctgggatgtgaggagcgcctctgcccggccgcgaccccgtctgggaggtgaggagcgtctctgcccggccgccccgtctgagaagtgaggagccaccccatctgggaagtgaggagcatctccgcccggcagccaccccgtccgggagggaggtggggggtcagccccccgcccggccagccgccccgtccgggagggaggtgggggggtcagccccctgcccggccagccgccccgtccgggaggtgaggggcgcctctgcccggccgcccctactgggaagtgaggagcccctctgcccggccaccaccccgtctgggaggtgtgcccaacagctcattgagaacgggccaggatgacaatggcggctttgtggaatagaaaggcgggaaaggtggggaaaagattgagaaatcggatggttgccgtgtctctgtagaaagaagtagacatgggagacttttcattttgttctgcactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactgttgtcccatgaccctgccaaatccccctctgtgagaaacacccaagaattagcaataaaaaaataaattaaaaaataaaaaaataaaaaaataaaaaaaactcattaagctctaaaaaaaaaaaaaaaaaagaaagaaaaaaagaaagtagtgaccaattcctgaaaattggcaaaaaaaaaaaaaaggcaagagtaaggcatttatcttgtctttccagtatgaactctagttcaaaataactgatgagaggaaggttttgtttgttttttgagactgagtctcactctgtcgcccaggctggagtgcagtggcgcgatctcggctcactgcaacctctgcctcccaggttcaagcaattcttgtgcctcagcctcctgagtagctgggattacaggcgcccgccaccactcccggctaatttttgtatttttttagtagagacggggtttcaccatgttggcgaggctggtcttgaactcctgacctcaggtgatccgcacacctaagcctcccaacgtgctgggattacgggtgtgagccattgcccagcccgggatttttttttttttttatagattaacagctagtaattgtgcaaagaatgatagaaaaaaatcactattttgcatgtcccagtgaaataattcaggcaacaatcaccagtggatgaaatccctaaagagcttttaggaagctttaaaatgcctggacccactcatcactgaacatgaaaccaccagtcattgtttgcctcctgatgtgaggcaatataaagcacacagaaccacttattaaacattcttgcccaaaaaattgaataggaatacaggacttaggggccaggcgtggtggctcacacctgtaatcccagcactttgggaggccaaggagggcggataatctgaggtcaggagttcaagaccagcctggccaatgtggtgaaaccctgtctctactaaaaatacaaaagaaaattagctggatgtggtgacgcacacctgtagtcccagctactcgggaggctaaggcaggagaatcacttgaacctgggaggcagaggttgcagtgagctgaaatcgtgccattgcactccagcctgggcaacagagcaagactccatctcaaataaaaaaaaaagaaatacaggacatagggaatgagtgaaatgacaacataagaaagcaaacagtcaaatctagaatgcagaacatttcatatgacaatcaacatggcttctgtaagccaatgtcaatgtaaaaaggggataggagactgctcttttttttttttttttgtttgtttgtttgtttgtttgtttgagacagagtctcactctgtcgcccaggctggagtgcagtggcaagatctctgctcactgcaaggtccacctcccgggttcacgccattctcctgcctcagcctcccgagtagctgggactacaggcgcccgccaccacgcctggctaattttttgtatttttagtagagatggggttccactgtgttagccaggatggtctccatctcctgacctcgtgaactgcccgcctcggcctcccaaagtgctgggattaggcgtgagccaccgcgcccggctgaggagactgctttttaaaaaatgtaaccaaatgtaatgtgtggatttgtttggatcttgagtcaaactaagtcatttttcagccaaggaaatttgattatggattgaatactaagaaagtatgatttaataagtgatattatggtaaatttccatatttcttaagagacattgaagttaaaggagtgaaatgatataatgcttggatttgatttaaagtaacttcatcaaggaaaaacaagaaggctgagtgctgtggctcacgcctgtaatcccaacaccttgggacgctgaggcgggcggatcacctgaggtcgggagttcaagaccagcctgaccaacatggagaaacccccatctctactaaaaatacaaaattagctgggtatggtggcacatgcccataatcccagctactcgagaggctgaggcaggggaatcgcttgaatccaggaggcggaggttgcagtgagccaagattgcaccattgcactccagcctgggcaacaagagcgaaactctgtctcaaaaaaaaaaaaaaaaaaaagaaaaaagaaaaacaacaaaaagagaaagtaaatgtggcaaatttgataactgttgcatctggtcatggagattctttgtatagttctacttttacgctgcttaaaaatgtttgataaaaccaacatggcatatgtatacctatgtaacaaacctgcacattgcgcacatgtactgtagaacttaaagtataaaaaaaaaatttgataaaatggttgggtgcagtggctcacgcctgtaatcccagcactttgggaggccaaggcaggtggattgcttgaggtcaagagttcaagaccagcctgacccacatggtgaaaccccgtctctactaaaaatacaaaaattagctaagtgtggtggcaggcacctgtgatcccagctacttgggaggctgaggcaggagaattgcttgaacccagaaggcagaggttgcagtgagccgagatagtgccattgcactccagcctgggagacgagtgactctttctcaaaaaaaaaaaaattcaataacacacatatatacccaatagataactcttcattttaagctaaccagtggttggactcacagtctggccccaacttacctttgcagtttgatcactcaacaataagactcagttctagcctcactatactatgtgacacttttacattggccactcactttaaggcctattctttgtgttcaagctgtttcttctttttttttcttccctaactgggcaattacttatctttcaaggactaggttagatgtgacttgtaagttttcaccaatcttttgttcatactactactgggttacctcatactgtagatactatcttcttatgccatggtaagcgttccttaagggaatatagcacaaaagttaagggcacagtttctagatccagactgcctgaggtcacatcctggtttagctactgactagctgtgttacctagggcaagtaacttcatctctctgtctgccttgggtaagtaacttaacctttctgtgtctgagctgtgttgccttgggcaagcaacttaacctttctatgcttccattatctcatctgtaaaatcgcatttacttcatagagttgtattattatttttatttttagagatggagcctcgctttgttgcccaggctggagtgcaatggtgccatctcagctcactgcaatctccatctcctgggttcaagcgattcttctgcctcagcctctggagtagctgggattacaggcatgcgccaccacgcccagctaatttttgtatttagtgtagagacagggtttcatcatgttggccaggctggtcttgaactcttgacctgaggtgatctgcctgcctcggcctcccaaatgagccactgcgcccagccttcatagagttgtattaatcttcctaaatgggtaagaaagggttcagaacagtttctgacacacagttaaatattcaacaaatgctaatttataaggttaggactctctttttgagacagggtctcactctgtcacccaggctggagtgcagcggcacaatcatggcttactgcagcctctacctcctggactcaagcaatcctctggcttcagcctcctgagtagctggaacaacagatgagcacaaccatgcccagctaatttttattttttgtagagaccggattgccatgttgcccaggctggtctcaaacctctgggctcaaacaatcctcctgccttagcctcccaaaatgctgagattacaggaatgagtcactgcactcagcccaggactatttgttttcatattcctcctcacacccagtttagtgtctggcatgtagatgctcagtgaatgattgatttgggtagttttggttctttatacgggtcttcaggttagtcccaatgtactggcatggagctagttacttgagcaggtcttcacaaaggtctgagtagcaggtgataaaaggggttgtgaagtctggactcctaacttaagtggtggagatgctaaaagagaaacaaaggcagcagagttgctgagggtagggagtatggcatttattaaccctgtgtttcccccgtcactggtcactgctcttgactcgtagaacaacaggtacagaactgcaagggatcatccccagctccgtgatcaccagatccacaagctctgggggagtcacatcatagactagattcaacaaccgtagggatgcgtggttctgccagttagccagcgcaacatgttctccccgcttacattgcagatcatcagggtcatctgcaatggaaggcgtacccattatgttctttcagaaaagaagttctagtttatccgcccctctccctccctctcaagtcttcacaggtagctggaggcttctcttttgcctccttacctagctcattagagacaaaggcatcagtctgcacacgctcacagaacttgtatgtttcacagcaaaccagcactggtacattatgggctcgagccaccagggctaactgtgctgtccctacccgtgacatcacagacccgttggccaagagtgcatgagctcccaatagcaccttggaaacctgtttcacaggagaagaggaagaaaaaaatgtcattgttgtatcaatgcaaaataaggtcccctacttacaggacagcaacattaagacaagtaataaatctcaacacctgtgaaaagaagggaaagaaacaaaaacagacaacaagtaataaatcttttttttttttttctttgagatgaagttctgctcttgttgcccaggctggagtgcaatggcgcgatctcggctcaccacaacctctgcctcctgggttcaagtgattctcctgcctcagcctcccgagtagctgggattacaggcatgcaccaccactcccagctgatttgttgtatttttatatttttagtagagacggggtttctccacgttggtcaggctggtctcgaactcccaacctcaggtgatctgcccgcctcagccacccaaagtgccaggataacaggcgtgagccactgagtccggcaattaataaatcctttttttttttttttttgagatggagtctcgctctgtcgcccaggctggagtgcagtggcatgatctcggctcactgcaagctctgcctcctgggttcacgccattctcctgactcagcctccagattagctgggactacaggcgcccaccaccacgcccggctaattttttgtatttttagtagagacggggtttcactgtgttagccaggatgattgtgaactcctgacctcgtgaactgccctcctcggcctcccaaagtgctggaattacaggcttgagccactgtgcccggcctaataaatcttaatgatggcttttcttctgtgaaaacacctgaccactgacccaccaaatctcccacaggaaaagtaaactttgaagttacttttgtcttgttccctcttcctggttgctagtttaatgtaatgtttttgcaatagctagactgctgtaatatactgtcagtgtttttccaattaaatagaaacagagctatataattattttttttgacacagggtttcattctgtcacccaggctggagtgcagtggtgcaatgacagctcactgtagcctcaacctcctgggctcaagcagtcctctcacctcagcctcctaagtagctggaactacatgcgcatgccaccatgcccgggtgtgtgtgtgtgtgtgtgtgttcaagcagtcctctcacctcagcctcctaagtagctgtgtgtgtgtgtgtgtgtgtgcgtgcgcgcgcgcacgcactcaagcagtcctctcacctcagcctaagtagctggaactacatgcgcatgccaccatgcccggggtgggggtggggtggggtgtgtgtgtgtgtgtgtgtgtgtgtgtgtgtgtgtgtgtgtgtgtacagggtctcattatgttgagcaggctggtcttgaactcctgggctcaagtgatcctcctgccttagtgctgagattgcaggcattgagccatggcaccaagccagggctatataattctaatatttttaaataattgtggctgggcacagtggctcatgcctatgatcccagtactttgggaggccgagacagggggaactgcttgagcccaggagttccagcctgggcaatgtagcgatatcccatctctacaagaaaaataaaaaactagctgggcatggtggcacacaccagtagtcccagctactcagaggcggaggtgg

SEQ ID NO: 985 - DNA, 58139 bp, Homo Sapiens
attaaagcctctccggtatctgacacaagtcagaatttccactgttccagctgagcttttatgaggagcagacttgagagaaactgccaagattttctggagtacacagggcacacggccagctgaacacccgcttcccccactcgctgctgctgggaagagagcaatggactccgaataccttccagccgaaagtcgtcctcctcttcctcgctgagcgtgtctctcaacacgtcgcccacgagctcctacaagaagacagagcagaggcattgagcaggggttgggggagcccagtgctgggacgttaaaagcagtgccatgaggaccctgggctgattcttctgattggaattcaggtcaactgaggcagatcctattgcacctgaaaagttaagtgccaaggtgggtccctcctgcccttaacataaacccacacgcatcagcacaacattcaggccaccacaggctatggctccactgggtcttccatcatgcctcccacatttcaccaacacacatgccttccggaaaccagcctgattccttgcacacaccctgcctgttccccaccagtgagttaaggatatctgggatctcatcccaaccaacctgaccaggagatgtcaagttagcgaggggagtgttgctggtccacaggctgggaaatttctaggatgtcaacaaaggccccatctgtctgacccaccctagcaggataactccaaatatggaagaagctagaccataccttgtcaaactgtcttctgtatttattggtattctgccagaagagttctatgatcaaagaagattcttttaaacaaagttaaacaagatctcttacagcaggacttatcaggacttttcctatggttctaaacactgaatctccaagtgctggcatattttgcattctccaaacttatttagaccatggagcttcgtttttcaaaagtatcacatgatacgcgtgtcccaagaaacccactttaggaaatactcctgttatgggaggacagacaagggtttgggggatgatgatgctatggtagcggttctcaaaacacaaaatgacaagcaataaaaaagcccaaactcagcagctgtcaccaacttctctttgtgaaaataaaagagaaaaaaaacaaaaacaaaaacaaaacccaaccctctccttaggggaaaaaaaattctacacctcagatgatgcttaaaaaaaaaccagtcctcttcttgatgaacaaaagaaaaaacacggctttgtattgctgatctcatcaactggacacagctggaggtaagcctcttgcttttttttgttttttgttttaaagacaaacagctaacattttgtggctgttctctttcttctttcaaatctttctagggcattacacactctttcttaaaagctgttaaaatgtggccattcagactccggtgtcccatttacttcaaaaccaggctactttattcctcgagtcaggatggcttcctctcctcctccaccaattattataatcatcgaacatatcctgggcttgtaaactggctgtttgtgttaacagagcccgagttgacaggggagctgggagacgatgacaggaaagggatgcacacaggtggcatcattagatggctgggacgccccagcagccaattgaagcccatctttcatgcagaagagagacgggtgccaccgccccctgaaaggctggtaggcagagcttccccgagggaacaggcaacagtcttcaagagaatctgcgcacctcttcatgctgaggtcttctgcagagcggggctctgcgcctgccaccctgactgcactgcagccgggtgacagcatcaatgagacgtctgagtactcgtgtctttttactggcacacttggaagagtttaaagactccagacatcgccaccaacaaggcagccgtgtgggaccctatgacaatgaccgcatgtgctcaaggcaccccagtcaccacctaatgacagcttcagcactccctgctcggagaaccaagctctctgacacactcagaaagcagagttctggcaagttctggcataggcctctcaccactcaacagtaccctgctctggagaacactggaaagctccccggagccatggttcatggacgcactgtactgtgccaatgctcaactttgcaaaaattcatctccccagccaggcgcagtggctcacgcctgtaatcctagcacttcgggaggccgaggcaggtggatcacgaggtcaggcaacctggccaacataatgaaaccccatctctgctaaaaatacaaaaaattagccaggcgtagtggcaggtgactgtaatcccaactacttggggggctgaggcagaagaatcgcttgaaactgggaggtggaggctgtggtgagctgagattgcgccactgcactccagcccaggtgacagtgtgagactctgtctcaaaaaaaaaaaaaaaaattcatctcccccactgagccacacggcccagggtctgtggcgtgcagcgtgcatgttcctagagctttgagtctctaggccagaagccacgcgggatgttgagccaaacacagaatcacatgctggctgtaccgcctgcctcgcctttggacctcagcctacttatttgtaaaatgggcacagtcatcaaccataataataatcaaacagctgacacttactgtgcattttccatgtgtcaggcacgatgctaggcactttatagtcattcctcagtacctgtgggcgactggttccaaaactccctgaggctatcaaaatctgtagatgctcaagtcccttatataaatggtgtagtatttgcatataaactacaaacatcctgccctatactttaaatcacctctagattacttacaatacctaacacagtgtaaatgctatggagatggttgttaaactgtattgcttagggaataaggacaagaaaagtctgtatgtgttcagtacggatgcttttttgtttccaaatattttctatctatggttggctgaatcaacaaatacatagcccatggataaggagggccaactgtgtaagcgtgtatttattagccccctgaatcatcacaacagccctggtctttccatctttcaagaaatagatgcttattaaaatgatttgcaaattgtaaagcgagaggtataatcattactgttattttctacaaagaaagtggcctcaaccctgaagtactgtatgagaccagaaacagttctaatgacagtcacccgtcatctaccaagtgctcacagtgtacgaggtgctgaccaatgggatcttcacgggagactctggagaatggcctccccacagccctgcatctaagtggctaggaggctccaagaggctgtgagaccccctttggatcacctgccagcaaggggcggagcggggacttgagccagctccttcagatgcctcagcccgggctcctactcatgcaaccagggctcctgtgggcatgggagcagaggtggtcaggagtcctggcacctaccagggaccaaggatcacacctaaaggagtgcaagaaaaatagcccagctggcagctctagtgggctcgggaacattctcacattccatcctaatgcctggcgagccagtgcctcaatgtccaccctgggacgatgctcacatgtgtgtccaggaggcacattcgaatccagtgatgtttagggcaatgcacttcctgttaacctgcagtcaggaacaccctggatgccctcaaaggcatgtgggctggatctctgcagaggagtgccacacgagagggacgccaacagaacaagacagacctgcagatctcccgggcagagggccagaccacaggacaggcaaaggagccctcacaggaagacacgcagactgtgctgctacctgtacacagaggagagcaccaaacccatgtatgccatgagattgtccccgtgtgggtgaacatgcggaagacgacagccacggtgacttccagagaggggagggcagacagaggcagagggtgtggggggggtcataaaccccagccttatcagaagtgttctcatgtttaactgatgagtatattacttgggtaattaaaacccaatttagtaaaactgcagataataacccactttacaaaagaaaacaaaagctgggagattaagtaacaagtccaaggtttcatggaaagcaacagagtcaggtagccccctccaggcctcggccccctcgtctctagaatagggaggccagacaagatgatgctcacagttccctggagcacagaccttctggggttccagcccgcatcccatcaatgggcagatctcttctctagggctatacccaggaaacaagaggaagaccggggctgtccattttctgggcctcaagttctatgtctctcacatatacctctcccctgcggacctgttatctctgcccacacagcctccctctcattcccaggcccccagggctttcctgggcctccagagcccactctgcctacaagctcggcaggctgaaagtgctaggaaattacccagcccatcccaacactatacaacatgcaggccagtgatacaaaaataatcctcatcaaagggcagagagatggaaagagggcatggcaggcagccttttgagagggctcctggaggcctggacccagggatgggagaggctgggggcatcctcctccccaggagaggaaaacagacccgcccctccttgcctgggtcatcagaacccaggcctcaacatgctgcttccaaagataaatggcatctctttccaaaggagccaaaatatagggcagagtcctcagccactcccctgaagacccctgagcccaccacagccacaggtcacctggtggtggctcctggctctgcccaccaggcctgtcccctggatgcagccaagccaattggaaccctctcctgggacccctccctcgggagctgacggggacgagctcttctctggtgccaaggctgcatctcatctcatcggcagcttctcagagacagctcactcaaggaggcagctcacacagagacagaggccagtactgggaccagcctcaggcccagccttctccagaaggaggctgcctgtgggcaggactctgggtctgttttgccctcaaacagcgcctggtaccacgcaggcactcgaaaaagtgtctgttcggtgaaccctggggcaggcccaccctaacccgcccttcctaccgatgggacggtcacagaagccactaaacggcctttgctgcttccagcaattcaggttgggtttccgttacttgcaactaaaagctctgactcccacagctcccagaagcaatccacagcctcctcaaagctaaatccaggattcccaggcaagcttgggagccagtggagcgagctcctgctgccctgctgtatcgcgggcccctgcaggagcttcacccgcagactccactcagagctgcggaggctgaggcgagagggaagacaggctcctggggctgcacacacagaccaggccttttgtatttggcctgcaaggaccaggccttcaagacgccaaagacattgagcagcaattaaaattcctcagatttctcctggactatttttatctgcccaagatgcaatcgacatgctcctaactgtagatccccggccttcagctccccacatcctggggaccccagcctgagcctgcttcctgggcttgagagtttgcacagggaaggtggacagccagcaaggagtgggacggcagggctggcaggaaggacttcagaccctgggcctgactctgaaaccaccatactcccttcctccagccctcaggcctgagacccgacagggtactcataatccctagagacgggttgcccaatcctgaacctcagccagcctcagtcaccaaagggccagcaaaggccacttcctgggctgtcacaccagcaagtcgcaggcatccacatgccatggtcgcgccttcctccagagccatgtctctgggctaccatgagtacttaaatgcttctctttaaattggctctctctctctttttaacctagtcttgccataaagcaataagatcaataaaatcacaggtgttgggggccttggtttggtttggtttggttcttagatgggggtctcactctgtcccccaggatggagtgcagtcgcatgatcacagctcactgcagcctccaactcctgggctcaagtgactctcctgagtatctgcgactcccaccgacacaggccaccgtacccagctaattttttaaaactttttgtagagacacagtctcgctatgttgtccaggttaggtgttttttgttgtttgtttgtttgtttgttttgttttgtttttttaaggacaattcatattgaacaaattcagaatcattaaaatataagacacccaccacttgcccctccaacccctcaataggacatcaaccattgaaccatgctttcggaaagacaggatttaaagaacctaccccctggcccccacagtggtcaggctggttccaataagtaggaagacggtgggtgggggagagacaccagacaaggtgggcaccaggagatgccaccaaccttcccacctggccaccctccttgaagactcatggcttcagtgtgatttctgagcatggagaaaaaatgactaatgggggaaaaaaaacccaaaacaccaacaccaacaacagaaaagagtaaatcttgacatcacccagaatgctccctgatctcaaactgctggcatttcagagcccttaagagatgaaccaatgtagggccaattgcccagagccaggcagggcacggggtggggagactttgctgtttgtctgaccacaattttccgactagacagtgttcaaaggcatttctacagtggaaactgggatctgatgggcatgttggggcctgggggtaactgaggtcatgaatataaaggactcagtgatgatgataaccagtcttagtcagtgtgcgacatctgccaagtgttccatgaagcacgttaggggcatcaccgaccaagtgctcccagcagccctagaagctgggctctgcgatgacccccactttggccatgaggaaactgaggcttagagaggttaagtgactcactcgagttgtcagtcaggtctgggtttgagccttggttcttctgcttttatactgtgtgactttgtacaaatgagtctacctgactatgcctcagtttccccagctgaaagtggaaatgacagcccccacctggcagggcagttgtgagaggaatggagagtatgtgtacagtgcttggtgagtggcctggctcaaatagcgtgtcccaagtcacagctgtcacctccttctccctccgggccctggtctttcattctcttccctcacatgctctcttctgccctggtttttgtcagggatgccacagcggatcaaagcccagcccagcactgcctcatcaccccagaaggcctcaggcgaccccacttctggccggctgcagagagcagagagagtgcactcagcgcttgtcggagtctctgccctcccacccactgctgaccacacacacacggccttcccacccaccactgacctctctaagccactgcccaccacaccactgaccccaccacaccactgatcctgccccaccactgcccaccacaccactgaccccaccacaccactgatcctgccccaccactgcccgccacaccactgaacattgcaccactgactctaccatgccactgcacatcgcaccactgatcctgccacaccactgcccaccacaccactggccccaccatgccaccacctgccacactgctgactagcccagccactggcccgccacgccacacagccgagtgctgataagaggagaggcccgagggcctgtggcgtgcctctgatcaccaagcagctggggcggcatctgccagcagttcctggccctgggacaggcccccggtctgctgccagggtctagcacgtgtgacctgccgacagggtggccctgagccaggctgcttatgacaggcagcactgtcatctggccccaaggaagggtgccccatagccataggccacctcactgtggggaaaggatgtgtgctcctgcccagggaaggggcttggggacccaagaagcctggaatttcttgctcagcctcaggaatgaagggcttgagcttcttgcttttctgaacctaaacgaaacagatgaagtaagagcctcttgattcctataccctgaggcctcattttacggacaggacaagagtgtccatgagcacaggtgtgcgcgcacacacacacacacacacacacacacacacacagagtccacccatgcggccctgcagtgccctggagaaaccatcttgcagaagccatgctcctacccactctgatcccatcagccctgggcctcccactctcatctcctggccccttctgtccccttgtccccaaaatagctctaagaaacttgtcaccatccctctcacaggccagaccgcccacttggagcctcccagccctggaccatcctgtccccttcacccggagcgccctcctccctctactgccagtgaagtcttttgcctcctccggagccactgtggatttcgacttcccaccatccccaaccaccagatgaggacataatcaagagggtcacactggcggcttccagaggactcggttcattctgaaactcagcagttcgcatgctgccagggctgtgatcgaaagcctcagtggccacatctataaaatgagggcaccaatcccacccgcctgccacgcagcagtgcacgatgatcacaccaaaggtgggtgtggaaaagccgagaaggtgagaggggccatttgggaatgagggcccagggtccacagtgctgtcagataggaagctgctgaggagcagcctagtccgctcctgtgctgttgataaacaaaaaggtgcgttttccagaatgtttctggaaggccacgctccacttcagaaatgggaactggggcgctgtctccttcagctgtctgattttctgggtgatttgaattttatatttatattctctctttttaaaccaagaacattcaacccttttatactgaaaaaaataataataactttttccaaagcggtttttccattaaaacaaatgatgtggctctccctcctgtttgatgtcaccaagttgctcaacaggcacctcaaacttcatgtgtccaaaccggacgcctggcggcccccaaacctgtcctccccagtgccttccctgtgtacacagggcagctccctgcttccttcactctggccagacaccccagaggcttccgcacatcctgttggctctccctcaaaacacaccctgaaaccaatcattgccacctcctccacttctgccacgcattccaggccacagtcctcttgaataatgacaaccattttctattctctgccctcgtcgccaccccaacccctacccaattccccaaagtcccaccaaagcccatcaaagccccacccaatttgtctgccctatcacctccctcaccccttctgttcctccccattcacccgctcgcccacagccacacaggcgtccttgctgtttctccaacaggttcagctcattccccattcagggtcttcacacacgctgttccctctacccggaagactcttcctctggataacccctccctcctgcccctccttcaggtttgggttcattatcaccttgtcacctaggtgaggtcttcccaaatctctttatttaaaactgcagccccctctcccacaatcccttatttatctctggggcattcccaccatctgacacattatgtatcaacgcctgacggcggaggcactcgaccagcgtgtgttgaaccaccaaatgcagctctgtatttactgactcagaaaaacacgccctgcattttcttgaaagaaaaaagtagttgccaaacagcagagaaaatgtgattacatttcctaacattatctgcacgtgtttccacgcgctgtagtaggaggcacacgtctgcagagacgggcaccaaaatgctcccagaaatggtgcccggtgctggattccaggtcacccaatggtcttccatgaacacacatgattacttctacaatcagaaattacagcaaagtgttttgaaggaaaaaaaaaatgctaaaacatacaaaaatgggcacccaagttggttctagaaagactcacactcagaagtctgctaaaagggtcttggccctagcagtggcaagacctacagcattctggtgaaatgggtggcctcctgattccagctgggagggaaggtggagactccagactttggtccacccagaccccattgctcccttccacagccacacagtgcacccaggccacaaagaggccacagccacacccatgcctgcttctcactgctctcactgtacatgcataggaagccaggggctgtgtaatgcagacagcgctttgattccagaaatggcatgagaccagctgagcatgcaagccaggctgtcatcgggggctcagggggagcagggtggcactctctcctgcccatcccaaccagcacacaccaaattttgctgttgccattctcaggcaaccaaagatctcaaagcaaaaagtatggggatctagaaggccactgcctgcccctgcaggtccagtcaacagcccacatcaggggcccgtgtcaccacagggtggtcacctgggaagccagtgaggtctgggagagtccgtatggtcagcatggaaggtttgaggccactcttgggcctggggataagaaggtcttcatggcagtgactccacccatcacacctgtacctcacccatcacacttgtacctcacccaacaaccccaggaggtccacgtgtgagctattgctgtttttacagatggggagacttagagtcataggggaggcaagagagtggtaaggctgggagaaacggagcactcccgagaggaaggccagggctctcaggacatgcccctgggtgttcctggatctggaagagaggcctctgctgtctgagccccacatttccaccaggaccaccagcatcaggccaggccagagcctttgttcagaggttctgacctgcaagaaggacccagcccctctgagaatgtccccctagaaaaatgccatgcaaagaaaattgcacattgaatttcagggggttcatgaacctccccactacaagtccttttgtgaattttagtttaggaacctctgagagtccagatggggaaactaagggctcaaaaagggacaggacttacccagggtcacaaagccaaagaggagcagagccaggatccgaatatagaggacccacagctggtagcaaagaaccagcgagcgatgagttccctcggggagcagaggcacaggacaagagcccccacacaccctgactgccaagggctggagcacccagaccaacaagcccacctttggacggtttctccacaagcactgtctcaggcaaccaaacatttcaaaggaaaacgtagtgggtccaggcatgggggcccaggacgtttggggaatgctgcgtggacttctcaagcctttccagaccacctgtagcaggcctcccacgaggtgctcacagatcaggggtctccttacttctttagaccctttgatagcagtccacctccccagggcaccgtgtgcacgtgcagatccccccgggtctgtgtgcccccctcccttccctatgtgctccccaccagcagctcacacctgggggccctcttcagaggcctgccctagggctatgtctgcagactcagagaactgccgtgtccccaccccaggtggccctgagcctggtgcaggagaatgaaagcccatacctcctgtcacgacaaactcagaagcataatttataccccagagctcccccagagggtcagactgaagccaagactttgcctgaaatggcacctgtgcttggcttcttcctcttgtctgtcctgcttcctccactgcctcactggcctgccctgccctgggacagtgtcctgagtgaatcactagcacgtgaccctcacctcaggctctgtttctgcagtccctgacctcacagggctctcccctgaactacgcgggtagttggaggaatcctgacccacttggtgaattcacagggagtaggcaggccaatgaattgcaagctggttggtctcagacaaagcaggtggaacatcagtccagcccagaaaggcaatggtcacactgtggccaatccagctacgtgagaggccagggaccctgatgccagggctcaggcctgagaggcagaaaaatggaaatggacattttcttcccaccccaccccaccccatgccagccccacttcaggaaaccccctccccatctttcagagcctaattcaagtgcaagaagcttgttctaagcaccttgtgccccaggaacctctctcattcagccagcgcgtttcaggctggcttcacagactgtaagtttgggaggaagccgaggctgtaggaagctctttgtccctcatctggctcctgcagtgggcatctgaaattcagaagcccctggtctccagcgcccccttcctccttcttctgggaacactttgattttccctggcggctttctagacctcacaaataaaaacataggacattcagttaagtttgaatatcagataacagatcactgtgtagcataagtatgtcccatgtagtatttgggatagacttaaaacacaaaaaaatgaagtgctatttatctgaaattcaaatttaactgtgtgtcctatattttatctggaaaccctgcccctccattcctctcacccacatggtgtgggcaggctgatttctccccgtaaccaccagggagggcacatgacccaggcctgcccagtaagagcttcgcaccacgccagccatggggactggtcagggccgggcacacaacccaagctatgccaaggagaggcaaccccaggacatcttctttctctctgttgactttggtgagatgtgagctgagagcctgaccctactgagagcactttaccacctcacagagaaattctagctatgaaaaaagctaatacccaggaaaacagagccacgaggggatgcaaaaggggtcctgacatcatttgagcccctggatcaaatggtgcctgaagctagtacctcccctacatttttcaatgacgtggaccacaaaatctccccttttggcttaagccagggtgagcttattctcctcataagccagtgagtgagtcctgctcactcgctcctcctcacccttgccacctgggcatgaggctgggcagagtctatgctcagagaacatgtttaatttcactaaggaggatggtgtggggcgatgggagagcctgagctctccagtcaagcaggcacagttcccggccccactcggttccatcctcgttccaagtccttgcacaacaaactctccatgagccttggtttccctatttgtgagataaacataggtacttatacctggactgcccatataatgctagtgccttaaccaggacactttagagagacaaagggagtgctgttcatacccaggttgggagagactggaactgccctgggtaaagggaccagggatgccgtccctacaactgaccctgcctgtctccacccgcttctgcactagccctcccccacagcccatgccttcaattccgccccctccccctccccatcaccaccctctgtgcaggatgctcccctactcgctgcttctcgctgcctcctaattcattcttccagtctcagagaagccatccctggagccccgggctctgtgcgggccccactctgcatcctccttgcagcctttggcgctctgtgagacaactacttgtggcttgcaggctccccagccggctaaactcgttgaggacagggtccgtacatttctccctcattactgaaggcccttacagagctggcatggtgcctggaaaacgacacataaaatagcagacaaaaaaggacaccgctaaccctctcttcctcctctctgcaggctctgtattttctctgtgcatcgataaaaccatcctggctgcgatgccaggcagggacaagtgaaactatgaatcatggagtggggagggcatggggcagggctaggacccacccccagtgggcccaggacatgctggcaatgttctcagagccagtgacttggggacagtggccttagaaggccccgcccagtccagcagcccccaggcggcggcagcagcaacgcgctggccttgggacagctttcattgatccaaggccaatgtggactggacctgagccggctgcctattccagcatccagccctggcccctgctcaaaacacaggcctggcgtctccctgtggccttagccagctctgtcctcagcggcagccaagtcactgcccagaatgcaaatggggcaggtgcaatgggcttctccaatctgagaccaaggccatcacatcccacacacagcccaggttgttccacacacaagcagacagggtccccttgggttgcttggcccccgcccacacagctttcctgcctatccccgggcagccaccccacctatttcttggttcagccaggcatatagcctgaggtcaattacctggagaacgcattgccacaccagctccctggctcgcaccccagcccaggtggcgcacgctcattttattttcacagggccccttcctggctccacagccttcactggctccgtgcttcaatcaactcaaaaccctctgaagtcttgctgtagcttctcagtccagctcactgggaaacaaatggttatggtagggaaaaatgctagcctgggagctgggtggtctgcctcagtttcctcatctgtacaaaaagaggaagcatggcaagagggtatctccaaagactttactgctacaatagagcatgactccacaggctcaggagagggccaattcagccaggccccaggctccgttcctcctctgctgtcttcaggccacccagaagggccactgcccacttgcaaagccaatgatccgtcctcagtaccgtctgtctcaggaggcaaaagtattttgaggagaaggaaagaaaagtgtggatgtgaatgcttccctcaactctgcatcaacccagcacccaaccctcccagcgccagacaccctgcccacaggggagccacagtggctacagatggagagagaagcgcagctcacaggctgaggaacaaacggcaaatatctacctgcatggaacaccaggaaggaccccatcagcctcagcctaacagtcagtacctcaaaaaagaattatcaggttaatttaaaaagaggcttcattctggccgggcacagtgactcacacctgtaataccagcactttgggaggctgaggcaggcagatgacttgaggtcaggagttcgagaccagcctggccaacaaggttaaactccgtctctactgaaaaaaaaaaatagctgggcatggtggcaggcacctgtaatcccagctaccagctactcaggaagctgaggcagaagaatcacttgaaccttggaggtggaggttgcagtgagccgagattgtgccactgcactccagcctgggcaacaaagtgagactccatctcaacaacaacaacaacaaaaaaaaggcttaatgctaatggccacaaactcataatggcagtaaaggagcaaacggcattgccaggtggtgtggggcccagaccatgcccccacatggcctgaggcttgggtcctggctctgtcacctacaggttgtgtgatgctgggcaaactaataaacttctttgtaccttagtttcctcctctgtatgatgggcaaataataatatctgccttgtggagttgctgggagcattaaattagctcacatttgtaaagcgcttggaaaacaatacctagttccttagaagcaccatataaatgcttgttaaataaataaaaatgaaggtgaatataaagtacataaagacacacttgtaatgtaaaagaaggatgaccatctcaagaaaaagaaggatgactgtttctaaacatctttagcattcgttggttttaacatataggagggtgtgaacacatgtggggatttttttcttcctccatcaggcataggccagacttacatgaggatctgatgtgttctaatattatttgaacaaacacaaaagtatcagtatggggagatgaggttaagcccaagagttctggaaaaggttgggcctcctccaaaaatgggaaagctggattggcaggagaggtcacctatagtatcaaggtcaaaagagtgttcagggccaggcacagtggctcattcctgtaatcccagcactttgggaggccaaggcaggaggatcacttgagcccaggggttcaagaccagcctgggaatcatagcaagacctgtctacaaaaaatttaaaaattagcctggcatggtggcatgcaactgtagtcccagctactcaggaggctgaggcaggaggattgcttgagctcaggaatgggaggctgccgtcagctgggatggtgccattgcactccagcctgaacaacagagcaagaccctgtctcaaaaagagaaaaggaaaaaaaagagaagagaaaagagaggagaggagaggagaggagaggagaggagaggagaggagaggagaggagaggagaggagaggagagaagagaagagaagagaagagaagagaagagaagagaagagaagagaagagaagagaagagaagagaaaagaaaagaaagcattcagcaaaggcctccaacatgatccatttgcccgctgcctttataggggagcgtgaactacccagacttgggccaccacctctggagggatgaaccctcggggcggctccactaattacaggttggaactagcaaggcacagccctgtcttaatggtgcccccgaccaggctgactagagtgggctgcaagtgccagctgcccagagcttccaccgtgcagcacctcagggcatgctgggctatagaaaagcaaaaccaaacaaaacccatgaggaaggcgtgggcttaaaaagctctttttcaccaccagtgaagtttaatgcttaaaaaggaagtcaagaaactcgactggtgcttgcgtctgagggactggcgcgaggaaactcatttccgtattctctctactttcgtgtctgtctgaaatgttctatgagaaatagtattaaaaaggggaacttagtctaaagaacaggggcttgagtttaaaccatcttgggagaagcagccaggcccaaggctcaccaagagtcaccgcgcaacgaggaagatctgagtgctggggtcggagaggacattaggtttcctttaggcacagtgaggtcacagcaaaataggaagaccaaatggtgtgccgcactgaccatgtgccagatgccctcccaagcgccccatgtttataactcatttaatcgtcacaacaaccatgaggcagacgttgctacttccccattctacaaacaaggaaactgaggcagacagtagttaagaaatatgaggccaggcatggtggctcacgcctgtaatcccagcactttgggaggctgaggcaggtggatcccttgacgtcaggagtttgagaccagcctggccaacatggtgaaaccccatctctaccaaaaatacaaaaattagccgggcatgatggcgggcgctggtaatcccagctaatcgggaagctgaggtggaagaactctcttgaacccaggaggtggaggttgcagtgaaccgagatcacaccactgctctccaacctgggcaacagagcaagactctgtcaaaaaaaaaaaaaaaaaaaaaaaagcagaagaaaagaaaagaaaagaaacttgaacaagtagctaacaagtggcagcactgggatttcaacccagcctacctgggcatgaggctgagctctagccaccctgctgagctgctgcttcatttcagccaagaacagatctcagcccagtggggtcagatgcagaaacaatggcaaaacaatggattaaagctatagcctcaacagcatagctttggcatgggcttatttgcaagggcagacaagctgataactaccgttacctgctgttagggtatgtgacctgtcattctaaacttgcagtctcagtcccagttatttaagttaacttgaaatcagcatttaaatctttaagaaatactggttcctctattagatatgtaagttgaatgaactgagcaataaacaaaatactgaagggtgtaagttttcctttccatgtatgaatgtggcctggacattaaggaatcccatcagtaccaggccaccagccattcccgtttcatttgctgtccacccaaatcagccacacctgccctgaggacatctgcactagggcagtgatccccaacctttttggcaccagggaccggttttatggaagacaatttttccatggatgggggcaaagggagaggggtcggcagacggtttcgggatgaaactgttccacctcagatcatgaggcatttgatagatttccataaggagcacacaacctggatcccttgtatgcacagttcacgatagggtttgcacttctgtgagaatctaataccactgctgattttgacaggaggcagagctcagacgctcacctcctgtagtgctgcccagttcctaataggccacagacctgtacccacccttggcccagggtttggggatccctgctctagggaactctttgggattccatttactgattcaactctggacttaggtccatgatacatcccagctgtagaagcagagggaagtccagaggtaaagcatctctccttagtgacccacaccttctttcagatccatcaagatatatgcaaactgcagagcaatttttccatgtcagacatagaagccagagaacaaaagttacgtggaaagcctagataatgcttttccccccaaagtaatacaatgttgggctatgttaatagaagtattacacctatattttgggaggtgacgattctactattttctactaggttaggtgccacctgcaaacaaaatctcatatataaagaaagacatagctacaccagccttgcgattcaaagtgtggactaagggctagcagtcttgacatagtctaggaagtggtcagaaatgcagagtctcaggccccatctaccctacaaaatcagaatctgcatttttgcatcatccccacacaattcatatacacattcaagtttgagagaccctggtatagggatgaccagaaagatgactgcatgattacagctaatattgatatacctagcacgtaccaagccctattttaatacatgtgagtactttatatccacacagctttcgagtcgtggagctgatggcataatggtgaaggggtaggacctcaaggaacagtgagaactcacgacgacctgagagatgggatggaagaagccagcttcctgccttcagacagggagagaatgactccctcaccagaggaagaaggacaattctccatatttcttgaaggcagagcaggactaatgacacataaggcccaaattctctatcattccaggagctagagttgtccaacaaaggacaatcaagggagtgagcttcctgtcacaggaggtatccaagcagatgctgggaggccttctgtacaggatgcacagaagaggattcccatttcacaaaggagtcagtcttgatgggttgaacttttctctctaattgcaaggccaggaaggcatcttctatatctactgggaaccagaaggtgggtgtgctcccattccccaccaaaagctgcctgtgggttgctatggcctatgacatactaggaaacctctgtggtctcaaaagtcggaacagaagatggggcctattattaacccttcagccccagcacctccctcaacctagactgcagacacgtggctcacggtggtcctcaggtaataagcagagctaaatgacccctggctggagatgggaggggaggtagggagacagccacccaccccccgcccaaacaaggagacgcctctgtgactcagtgatccacgctttctcaaacagggaaactctttgaagaagtcccccatccactcaccagtgggccaccaccttgactaaccagatcccacgtgctggtatctacaagtgactgcaagttttgctctgttcacagaagaacgaggtgaaaatgaaaaaactttgttgggaatttgccttctaaaatgtcaaaggccagggaaatggacctggcatggaggcagcagggctgagggtcagagtctgaccaccggggtcaaactttcagctccaccctgggtggagggtgaatctaagacctccctgagccttatattcttgtctggaacatgaagatgagaagaatccctgcctcgtgaaaccttagagcaatgcctagcatgctgtaagcaccacatccaaggaacaccaacagtggacaggaacagaacccttgtgaagagggtgctttactgagtatgtccgttaaacagggcacagactcgatgaaatgacaaacacacagtgatcagcacgtctgtgacacccaggggtcacttgttcaatgctagctgttatcacggtccttcccactgctatcagttattactattaccaaactcccaatggaaacaagaccacagtgtcacagagcacagtgtccagcccaggaggaggaggtacagagaggaggaatgcaagactctgagggctggggcgggaatgacttggggcgtggggaaggccctgcctgggtaaacgcttggcggctggatcttggaggcagcaaggcctctggagagccagctccacggcctcagaagtcaggccagctttcagttcccggcatccgggccccacgtcccccatcgggcctgctgcccagggcactcagattcttccaaggcccaggatgcacgtccaaagcagcctctcagactcaggccccgaattccttggccggcagggttcacgtctccatgcggctgacagagcccagctgccgggcgccttctcctctgctcccaccaaggccctaccagcccctgagcccaggaattgggaagtgccagcatccccagctcctgccccagccacgtaatcagtacaagcacccatgagggactttagctatcccccttggttcctctgcacctggacagtggcaggtactacatgttcaaaatcggaatctaatgacaggtttccccatccacctcctttgtgaccttctccagggactggaaggaaatcccatgaaagaacaagttttacagaaaaattaacaaaaaagaatcctctctgttctccaaagcagcataccccaaatctggcagcactcggactcctgaggacagcaagggaaaatgccatgcctgggctcggcagcaggtgccttcaatcgggggtccgtgcagccaggcccacatctcggacctcagtctgggcgcctgggcctcattacgatctacagacgacagcccagagccctcagatacacaggtgctatagggtaagtgtaggggtgtcaagaagctgctgtccacactcataaagggctcagcaggtgacatcctaaatgaaagagacccttgtttatccatggaggtcaagggaaagaaaccaaacagccccagtagctctcaattctccatgtgcctatggccttgggttgcttataagctggctggtattttaataattgctaacatttaccaacggctactctgtgccagacactgtgccacatgctttacatttatccccttttcaaacccttgcaacatcccttctattatcatacccattttacagatgagaaaactgaggcacaggttaaataatgccccaaagttacacatttggaaagcagcaaaggtaggaccttgcccaattctaggacctatgggctgggaaaagacccttcaaccaaactggggcaggctgattacattcatgtactaatttgttcatgcctaactgattccatacccttttgggggagccctcccacactgagactgggcttagccacgtgacttgctctagcagacgggacggtagtgaatgtgatacagaaacttgataaggcactggggagtccacttcctctctcagaccctgtccctgcaataagaaacgcctggcctgctggagggataggacatacacaacaaggagaggccactggtcccagccaattctgatctagaccaggaagctgtggccaactgtcttgaagcatgagcaagcccagcccagatcaacccagcccaggtccatacagctcccacctactcgcagatgtgggaggaataactaagtcttagggtggtttgcaacatggcaacagctaactgatatgccaactgcactgcctgttctcttttgacacaagaaaataactgcctgagaattaagagaatgagtgagaaagacatttaaatcaaagggtttgctttaaatgagggattgtcaaaaagttactgtgtttagatcaggattcaaattttagaattcttgacaatacccatgaagggatcaagccacatcaggagtcacaactctactcgctccatcacacctgtgtcatgtcctttaaatggaaccctttattgatctgttctcctcttttatatacttaaaaggcaatgctctaccatgtgccaggggacacggcatctttcttccatgccagcctgacatgaagctacacctctgtgtcagctatccatcattgtgtaaaaaaaaccgctcctgaacttagtgacttaaaaccatcattttactatctttcctgatgctttgggcagactggcctcagctgggcagttgtgctggtagctcctgagtcttgtgtggttgcagggggaggaaggctggggctgctgtcatcaggagtttgtctggtctggaataccccaaatggctcatgtctgacgccttggtaggggtggctggaaggctgggctcagctgggacactaattgggacattgggagaactgggcctctctcttgtcctgttcggtctcagagcctcactctccacgtgacctctccaagtagtttctccagcaaggtagctggacctctcatagggcagcttggggctctcaaaagcacaaaagcaaaagctgccaggctttcttacacatccctcccactgcctctgttggttaaagcagttacaggggccacctagattccaagtggggagtaaactctacctctcagtgggagggcaacaagttgcagccactttaagccaccaaacctctcacctcctacacgcggccccctctgcctaacacccaagtcggtagcagcacacatcctgaaatggagcaataatgcatttttttttcccgggatggagtctcgcgctgtcgccaggctggagtgcaggggcgcaatctcggctcactgcaacctctgcctccagggttcaagcaattctcctgcctcagcctcccaagtagctgggattataggtgcccaccaccacatctggctaagttttgtatttttagtagagtcagggtttcaccatgttggccaggctagtctcgaactcctgacctcgtgatccacccacctcggcctcccaaagtgctaggattacaggcgtgcgccactgcgcctggccacaataatgcatttttaccccaatgcacactgggcagcaggcctgggatgggtctgcagcatatgcattgagtaaacaaatggtgtattcccagcagaaccacagataattcgtggatgaacatcaagacaaaggtagcagccttggaaccccagaatccctgctgtgtcacgagagtgccccaaggtgccattccagaatgaatgaatgtgtgggatgaccactgaatggcaatgttcctctccctgcacatacacagggatgtctggaaggtatgaggcaaccacattctttgcaaatacctcagtctaaaaatgggcacctgcaagatccagactcccctgggagggtccactttaggatatgtgggagggggcagctctctctcagggcattttgaatctcattttggctggggctctaggcacagacctgagggactgctgtagggaggacagccctgcgagagtccttaatcatctaactaaaaccacgttcaaggcataattagcaaacagctccagattcatgatctgaggcccactgactctaatggactaattaggtgagacatccttgggcgggcaatgcactctggccttctcagaaacatcccagagagctcagcagatcaaggctggcatctggtccatgagctgccttacgatggctgggcaaagagacaaacgcattactgggcaagaactacacacagcttccagagatcaacaaggcaatcccttccaccccagcagccccaaacaaccaatccttgcaacactcagatcctggacacaaaatcctttgctctgagcaatcagcaacatgctctctgcctcctgaaccaccctgccctttccaaatcaaggctaacagcaataaagggcacgcatgcctacacacacaattctgccctccccaggtcccactcctctgtaagctaacagccactgagagctgctacaagacagcacctcatcatcctggatcagaaaaataaatcaccagctctgtggaagccccaaaagtactcagggcctcaaatccaccacagatagcagacacttgctgtttagccagttctctccatccgaggtgcctctgagtaagtggcaggggtcccacaaagcaataggagctggcagaaggcaaagccttagcaaagggaaagtctgcatctttgggaagccctcgatgcctctgacataatagcaggtacaggcaggaatgcaatagacatgctgagtgaatgcaagagaaagcacccgagagaatgagagcactcaaaaccctgcagcactgtttgccaaaggactccctggccagagaagcttgggaaactggtccctaaactgaaggaatcctgagtaatacgaaaactccatattccagattcacaatgcacattaagacagtgaaggctctgagaattcctgcagttaaggaacttatttaatgggtagttgcagcaattgtttcacaacactaattttgcaaagaatctttttttccccagaatctccagtgggataatatatttaggaaatattgtccctggtaagcaatacatcagtacagggcagataccgcaagccccaatcccataggagctaaggagctaagttatttaaataagttaaatgggggcaggtttaatatttgcataaaaggcatatggaaacactcttcatctccatgaagaaatatgctctaatttttcagaaaacaaccattttggttcatcttttctcttccatctttgatagcaattgtttcctatgagagaaatagaaacatttatttaaaagcaatatagttctatagaaaaccaatgtgcaaaggcaatgatgaaaaaaacagagagaaaaatgagaaacagggttggtgggcactgcaggggctctgggggacacaggccctgtccaagagcacagccacattcagctccacttgaatattgccaggctaagaggttgatgccaatgatattagcttttccaatttttaaaaagaagtcagaaatctggagttctgagtgaaattcctcatttttaaatgttggctcaaattgtttaaaaaattgaaagggtcaaacaaaacattcctgggagctagagtcagctcaccaggttgcaatttctgccaaaaatgacagagtaacgctcattcgactggtgctgccacccgtttcccaagcttctctggccagggaaccctttgacaagggtttgagtacccttattctcttgagtgctttctcttgcattcactgagcgtgtgtactgcattccctgcgtgtacctgctattatgccagttgcattgagggcctcccaaagacgcagactttgcctttgctaaggcaccgctctaagcactgggccctcgcctctccttgggcaggccctggcatgtgtgggaaggggtgagcacacagtgtgaggccagaatggccagtccatcaaggggatccatcatggtgtcatgacaacactccctaaggtccttttcagaaatagaattcattctcaaatcaaaactaaaaacagaaagcccacctggagaggccagcaaaggaagacatagtccacgggactgagagagtgcatgtgtagcgggttggggtgcatgcttagtgggttagagtgcatgtgtagcgactagccggtgggaccaagacagtgcgtgtgtagctggtagcctgtgggactgagagagtgcatgtgtgtagcaggttagggtgcgtgtgcagcaggtacccatgggaccaagagagtgcatgtgtagcaggtagtccgtgggaccaaaacagtgcatgtgtggcgagttagagtgcgtgtgtagcaggtagcccaggagactaagagagtgcatgcatggcaggttagagtgcatgtgtagcaggcagcccacaggagtaagacagtgcatgtgtggcgggttagagtgcgtgtgtagcgggtagcccgcaggagtaagacagtgcatgcgtggcgggttagagtgcgtgtgtagcgggtagcccgcaggagtaagacagtgcatgcgtggcgggttagagtgcgtgtgtagcgggtaccccgcaggagtaagacagtgcatgcgtggcgggttagagtgcgtgtgtagcgggtagcccgcaggactaagacagtgcatgcgtggcgggttagagtgcgtgtgtagtgggtaccccgcaggagtaagacagtgcatgcgtggcgggttagagtgcgtgtgtagcgggtagcccgcaggactaagacagtgcatgcgtggcgggttagagtgcgtgtgtagcgggtagcccgcaggactaagacagtgcatgtgtggctggttagagtgcgtgtgtagcgggtagcccgcaggagtaagacagtgcatgcgtggtgggttagagtgcgtgtgtagcgggtagcccgcaggagtaagacagggcatgcgtggcgggttagagtgcgtgtgtagcgggtagcccgcaggagtaagacagtgcatgcgtggcgggttagagtgcgtgtgtagcgggtagcctgcaggagtaagacagtgcatgtgtggctggttagagtgcgtgtgttgcgggtagcccgcaggagtaagacagtgcatgtgtggcgggttagagtggtagcgggtagcccgtgggactgagagaatgcatgtgtagcaggttagagtgcgtgtatagtgggcagcctgtgggactgagagagtgcatgtgtagcaggaacacatgcacaatgacagccttattagaccctcataacagcccatgtgatatgtggctgaggctttatttaaatatttctttctttgtttttaaagatgaggctcatggatgtcaagtgacttctccaggtgatcatagtgacatttgcattcccagagacaaaagcagcccctgatgagataaggcagtgaccgagacatagccagtggtcttgcatccaggccagccagctactaagctgcccaggagaactacaggctgcagaaggcctcctgatcacctgcagaatcataggagatggaatgctgctctcacagatttctcagaagctgactgacagacactgcaatatgagaaatgtacacagtgtgggtatctgatcagaacctgggtgtgagtctctcagcagagcactagtagatccccaggggaacatcactccgcacagtaaaagaggcagaatcttctggaacatggagctggacatggccagctgaagaagcagaagccagcagaaaaggaggctcaggtaccaagggcacctgcaaagggaacaacgactcaagctggtactatggcagagatggctacctgcccccaaatattcctacttcctcttccacagtgtagagttgtcagcagaaggtagctgcccagatgggactacatttcccagcacctctttcatcagggtggggccatgtgattagttctcactaatcgaacatgagcagaagtggtacagaatgattcacagtcagggatcttaagcagtgggaagagtttttctactctcttattcccctttcaccaagtagaagcagagaactcagaggctctcacagatgaacaagccacaacatggaaggagcctggaccactaagtcactcattttccaaccaaggtacctgtattggactggtccatgagtgataaataaaattctaaacttcaatgtcaaggtgtctttactacaacaaccagagttgccccagctaaaacacaagtggaaagaaagaagaatacatgggtcaagaaaataagtcctcactggggtaagaagctcaaggcaaaagcaatacaggaaaaaatctatctgctaaatcagatcagtcaccacctcctacatacaatgcctcccacctgaatgcctctacataaaggtcaactttaagacccctgggtgcttagctatgcctaccttgattaagaatggcttacaaagacaaatactgcgtgatctcatttatatgtggaatctaaaatgggcaaactcaaagaagcagagtggaacggtggttgccagaggctagggaaaggaggaaatggaaaggggtgatggccaaggggtacaaagtttcagttatgcaagataaataggttctggagatctactgcacagcatcgtgcctatagctaacagtactccattatatatttaaaattttctaagagggcagatcttaagtattctttctctatctctttcacacaaataataataataaagagggcaggaggaaacttgggcagattatagacatgtctatggccttgatggtagtgatggtttcataagtgtatgcttattcccaaacccatcaagttgtatatattaattaagcatagctttgtacaagtcaatcatatctcaataaagtgattttttaaaataaagaatgacttatgaaaactcatttagggaaaaaagaaggttatttaccaaatatactctacccacccacccaacaaccctccgctgggaaggtattcctactatctccatcaacaagtgagggccacaaggtcaggaggtgtagtgacttggccaaggtcatgaaactggtagaggcagagcttggttttaacttaagaccctattccttccaccaacccaacctgctctgaatggtgtaaaatatttgtatcatttcccacaaatcactttctgccttgtatagggccagccaggtatggtggcctccgcaacacaatgggcacctcctgaaggcagggactcaggccatccatcagtgcagtctcacagggcccagcaggggcctctcatcactgactgcagggagtcacatgctgcttgacttcatgccctcacctgttgacggggatggtaggaataccttcccagtgggtcactgggtgggtggacagagtatacttggtaaataactttcttcttttcccaaaatgagtttttataagtcattctttaaaaaaaaaaaaaaagcactttattgagatatgattgacttgtaaaaagctatacttatttaatacatacaactcaatgaatttggggataagggtacacccatgaaatcatcaccaccgtaaaagccacaggcatacccacaatctccccaagtttcctgcagcagctctcaggccaaattctggtgcattttcaggatactcaggaggcttccaccccaaatcctgtcctctaacccagctctctccaccaaggataatcagaaacataacaaaaggcactgcttccacttctgaacaatcaccatttgatcatagcaatctggctatggatggataatcttatgagtcattcattatcaatatttaaaccaggaattaccatcactaggggttacatcttctttgctatctggaggaggagaggagagggagtgactgaatgtcttcatgtaattggacatgggggtgagtatagctgctcctcccagctctgctctgaggcttgcgaaggcaatacccacatctgcccaccatcaagcctccatctgaccagggcctgttcagggcctgggtgggaccctcaggagagtaagggcaaactagcatatagtcccaacaaaaggcaggaataagccaagaagctagcaatcaattctgggaactcagaatcttctagaatattcttgagcccaggtaggaggcttggtgggctctgcagcccagatgctcccctacggcagggtttctccaccttggcactgtttacatttggggccaaggtcactctttgttgcaggggcacatcctgtgcactgcaggatggttggcagtatccctgacctccacctgctagaggccagcagcacccccaacccagccatgacaatgagggatgtacccagatatcgccaaatgtcctgtgctaccatggagaacccctgctccaaaggatgcaacaaatggtggccacaccagaatttaggcctggtgttttcccattttccattttcttctatctggatttttatgtgatatgtctccatttttaaagtttggcaattaattaaatatttttatgctgctaaagccaaaaagcatgtgtaaaggtcactggccagagcctccaccaagccctctgctaagtccagatggaaaatgaaaaagcacataacctacttctcagtgttcgagctcctgagttcaagagcaagtccgtccccacagcccggggaaggagccctggaaagggaggcccacgttatttctggggggaatattgccacaagatcacctgtcaaaggggctcttcaaatcccttctcccaggaacacagacaaccccatttgttctttctccccgaaaatacaattaccctcgcgctgatgttctgaaaaccaggccctaagccggctctggcctatgaagcaaacacttgtgaaccacccgcctataaaaccagccagcctctgggcactggtgaatcttttagtgccaacgttaccccagaagactggcctccctatctctcagcccctagttaaagaacttgatctgagcaagtttcctttccttccagcgaaaatctgggttactagggggagggcagtagagaatctaataaatcttagaatatacttcttggctaaaggaaaaaaaaaaaaaacacctacttactggtgtcatgaaacaactttccagctctctcagaagacagctgggttcagaagttactattgtattcaagctgtattaaatcaagctgtgagaagcaccagggttatgcttttaaagaatgccctaagccaattctgatgtttaaagggaaaaggaaaaagtttccaaggcttccataaattccaaggagaggaagtttcaaacttgggtgttcacagaccatggcccccacatagaaacagcttggtttcatgtatttggttttactgttcaaactttagggtcttttaactttttatttttacagggctcagaagaaaagggagagggagccatttgctcaccaagtgccaaagaaaacccaagcgcctccctcagagggcctctgcctgggacgacaacgaggcaaggaggtggggaggggaccccctggctcctggcacgccccaggcacagctcctcctgcccgctggaggccaggcctgcgaggccagctgctaatgaactccaacaagatcaatccaaggcgagaccacgctgcactgccattcggccgtgcctgggcctcggccaccagcagcaggaggagcaaaatggagagtttccaaaaacaagatgaggcccagccaagtcccaaggaatcctaaatttagtccctgggggaagacggctatgtcgactcagccaggacaccagtgaggcccagcatcctttgaaatgtcaaccaaactaaacaggccctcccaggacacctcagcccccagttctgactcacacccacatttccaatccctagcccccactgtccaaggcctgtgtacctaggaggttgggcaagacaagggaggtatacccatttgacaggagagaaaattgagtcccagaagaggtagtggtgaggtagaatgaacataggcagtcctgcatttggatccagcatcaagttctatcacccaatacccatgtgactaggaagaagacattctgccacttggagcctcagttttaccatctgtaaaacgggagtgagactatttcaaaaagtactgaaaagacataaaattttaaaatttctatgtatatatagacacacatgcattatatatacatacatatatgtcatatacatgtgtgttaaaaagagactgctgggctgcaccccagacatatatagtcaacagctgttgtttgtgccagctcagcaccctcacccccgcccctgctcccctctcagcccctgtggctgaggccagcccaacccgtttccgtgagagttctcagacacctaactgaatcagaatcaccaggagctgaacccaggttattcaattttccccaagctattctaatacacagagacacttttaggagcagctgccagataaattcagaagatccaagtggctaagctcagagagggtgcgaccctcctcctagccctcaggaagcggtacatctgcaaagggtctcagattctaaagggctgtcagggtgggaccctctcccagctctgagccaagatgcagaacccagaaggggaggtcctgaggggcagagaccagcagaactctgatctgaccccagaaagcacttgctggctctttccccgcagcacccggcttcacactgcagggcaggtcaaggggatgaagaagagcccagaagctccaaagggcctcgctttaacctgatggggggagaaggaacagggaatgtccacctgcccacagggcaacttcagcatcaggaggtctccatagcaaccctccagctggagtcattcagccacctggagaccagacagggtgcaggggggcaccacagggattgagattgtgtggtgctgaaggtagaggtacgggttccagcaaagaaagaaataacaaagaccttcccatggcggggaaaagacttccagaaaggactttcttcttggagggaatgataattagtcataagagcagccttactgagcacctccaggccacacagttttactgattcacacaccaactccaggaggaagattcaactactagtttcgctttacagatggggagactgaggcctcagaaacattaggaaagttgcctacatttgcacaactgctaggcagcaggcccagaactcaaactcatctgattccagagcccactctcccaccctcttctgcacggggcaggtcagcaccccttccgacctcatgatcctgttggctccagagactgactttggtcagcactctttctaacctccacatctcctgggcttgaaagaaactggctttggatctgtctctgtcggactcagggacaagctcaagcccggacaccgtgctgcacccaagctgggtaagaagacgaaccataggggtggtcagcactcatttttagagatgggcaaactggtgcagagaggatttctctgattcccagagtcccacagcagatcccctgaaccccttctcaccaatctgccgcctcccctgagttagagcacaaaagacagggcggagcagacaactccactacccccagccatcgagccaggcccacgtaacacacggggttcattccccaaaaaaatccaagatggaagcaactacccccaccctctagtttacagacaggatagctgaagctcagagattgaaagaacttgtccaaagcacacagcaaagcactttcattctccaaggattaacagatgcctatatgtgtcaggccctgtgcaaggctgtggagccccaggagttaatgacaatatcctgccccctgccaccagaggggtgacaataccctgccccctgccaccacaggtgaataacaatatccacaactccttgctgttcctgtgggaggtgagcagtaactcaactgccacatgaataagtcacaaatgaccaatggtggtgagcattccaaggaggcagaaggaacaggatgttaggagaaggaaccacagtgaaagctgctccaaggcacatgtgagagctccatcctggagggtgagctggggagaacaagggagagtactgggaagcatctccagctgcaggaatagagcgtgcaaaggccccgagttgggcatgtgatgggtgtgttccagaagggagcagggcggctgggacggagtgaggtgaagggcggccggggatgagaagcaggaaaggggcaggttgtgctcagccttatggaccatgggaaggaatttagatgttcctctaaggactgtgggaagccgcagtagagattcaagtaggagagggagtggatctcattgggttctgcaaagtcagcctggctgaggcagggagaagaaattcagaggctgttggagtcctccaggagcaacaggatgatggcttagaagaggatggggaccatggtgagcagtgggcaaatctgagattcacagagtcatagattgacgaaaggtgtccatctggcagctctgcagggaaggaaggggaggagttaggaatgaccccccaggatgcctctctgagcaacagatgaatggagagcccgtcactgggactgggaggctgggagcgcagatgggtctcaagagttggtggggaaggctgcttccgacaggctgtttgggtgtgtgagcggcagtgagtggagggcacccaggtcttcggagcacttgaaactcccaaggtccctaccaacccccaaagcctccatgtgcacaaaccctggttccaccaggctgtgcggccagctgctcgtcctcatcctggctgcattgctgaccttcccctctccggatcacatctccccacaggaggcagagccctggcctctgtgtctctcaaacagtgatctccaaagacagaatttgggtttgttataggagggctgccacctgcagccccctaggccagagcccatgtcactgacaatttccaaggccttgaaagggacctttaatccaactgtctgtgttgagcaggccatgggcagcccctccttcccctccactttcctctcagctctcccttcaaaggcagccccagggaggagatgtccagcacagcctggccctgacagcgggacaggtgcacacccaggagggtccgccatgagcccagtgaaggataccaccagccagccctcagtgcagaagcctccctgtgcctggcacagggctgctatggctggggtgggggctacatcactccaatacctgccagccacattccaccctcagcacaaggtgctgtacagatgttaccgcactcctggcaacacatttcccagatggaaaaaccaaggctaatagacatggtcactccatagatcctgggagtggaagtcctaccccgttctgcctccaaaggctggccaagcttgtcacatagcacgtgaataataactgtcctacgtatcacctgctttctgtggctagctacggagctaagtgtttcacaggcattctcatctgatctacatgacagcttcacgagctaagcaccattttcactgccattttacagatgaagaaacagagacacagagaggttaaggcactcgcccaaaggtcacacagctagtaagtggcagggccagcatctgaatcggtcctggctatctctggggccagtacagtgtatctcagttcccattatcttccctcttcatacagagcctgtgtagaccataacattttaatatcacaggtattctgtggatctgtttatatactggatgtatatctgtgttttatacttaaaaagactaagactcctttgccccccaagaaccaatttctgcctccttggggtcaacatcatccccatggagtcaaggccagtgctgtgtgacaggaacagaatacaagccacacatgtaattttaaatgttctagtagccacattaaaaaacaaagaaacaggtgacattaattttaacaatgttatttaagccaatatatccaaaataccgacatttcaaaatactatcgttacatgtgatttttttaaattattaataaaaaaaagttgacatacttttccttttctacgttaagattttgaaatcccctgagcactcccaatccagacccgccctatttcaaacgttcagtggctgcatcacgacagaggctgccatggtaggcagtgcccgcccggctccaaccactctgctaaagcaatgttctgcatcttccccaaaactcctgaaaatccacctatgcgggacttcctccatccaaggaaccccatcactcctaaccagagggttccacttaataagttcttggacctcctacagacaagacaccatgctaaaaagctcacaagatacaacaaggagtaagaactggcctctaccctcaagcagcctacaatctaagtgggaggagaggagtgaaataattaccaaccctactgcacaccaggctctggggcttctcacccattctcttaatcttcatactcatcctgggatatgggttctattattaccatcccattttattggtaaggaaattgaggcttgacagaccatggattttgcccagggtctacttatttgacttggccaacccagggcagaacaaagatgttagcaaagccatgtggaagcttttaagaacaaggagggcagcttcagagagggcttcagggagggcgtgagtgaacttggaggcagcatgaaagggaagaaggaagcagagagccaaggataaagcaggggtgtatgtatttgcagggaacacagaagcaataagtgcatttctcatgggcgaaactgcacaagcagaaccttggaagcaggaaaaggggccagaattctgggcgctaaaacgctgtagcatgaagctggtgcacagcgcatggtatgaggatagtccaagttcaatcacccagacatgggaaagcatccactgcccaacccatagactataatgtcagcggaatctgacttcccaaaatatttatcagaaggcgctgggcaccagattccattctgtaaacctggatgctgttccaaagctgagatgatagatctcccagagaaccagataaactctccctcacattctaaataatgaagggaaggtggggaagagaaggagacaaatcaaccttctccaactgcccaacttaaagggattatggtcagaagcaagacgggagcaagggagccatctccttatcaggcacacggctgctccagacacagacaaaacttctagcatgcatccttcttccacattgggggagagaagcacccagtcctaacacacaaaggtcagtcccatcctctgggggggcagaatttcaagccaatctgtttccccctaatttccaagaaagaacagtcccttccatgtacagaggtgctgactggagctcaaagaatgaggcccataaatctccaacctgctaaggaggcccagatttcaaacctcccagtgcgccggcccactgcactcaaaggcacaagcaaaggaagctgtgggatgagtagattcaggaatgtggatgaaggaagacccccctctctcgctgccaacgatcaccatagacattatggactgaataaatgaggaagcgcttgacacagatgctctcacttaattctcctgaaagcccatgaggcaggtcctgctgttatccccagtttacaacaagaaatgacagaatcacatggctgggaaatggcagcaccagctctaacctggacttcctgtgtctccagctggggccccccataggctggcctaccactctcagtttcttcccctctctgatatgcggtcctggtttcaagcccagtgctaaccacgtctcttccctgttcaacacccttaggcttccgtgtgcttgcaaaataagccccaaatccccagagatggttaagaaaaggtaggcgggtgctcaggggccccccaggccttcgcaagccaattcatgtcacccactcccaactccaaaaaaatgcagcccaccccctcaaagggcccatccaagaagcgggctttctggcatcatattttcctcccacagaacgtgagaataaagggctctttgcttgtctcctgaaataactggctctcgccataaagcaatcttctgcccagtaaaaatatttctgtaaaacttggtaactctatctgcggttccttttctgaaagtcaaaaatcttggggagtgaaatatggcagaggccagttttatgacaagctcatgaagtcatgtctacccgagacaggccctccttaacactgtgattaatttgctgttaaccacagggactttgtgtcttaatatactcaaagcaaagcaccagttcacatttctaccagaacaatacccaccaccccagacctggtgtccagccaggcaggtagcggagccatggctgggatctggggccagaaaggactcagttgagatcggggactctgccaaagggccataacacacaagggagctgtcacctgtggcctgtccttggccaaggaggaggtacagcttataaaataagtgaggggtgtcccgagatcagagtgtaaaaggcactcacagctaaaccaaactaactccaagacacctagagaagcccctgaaacctccctagggctgggttttcccatctataaatggggagcaatcatctcaggggaactcctgagcaatcaaatgtgatgtcccctctcaacatcttcttctgacaaacggcaatcacgccccttccaggtgctattttcggccccaaagaaatggagaccggtttactgggaatctttcagaacacagcagcagatccagaggccttaaagggctactgagtacatctgctgggtgctcactgcatgctaacacttcagtggccatatgcattacttcatcatttaatctttgaaacaactccaaacggtgggcattctgttcctctttttataggtaagaaaactaaggcccagcgtcaacacggttcagtataaacccaagtctgaagcctggtcctaagctctatgcacccctcaaattgggagatcacatagggaaaaaggagtgaagtaatgcaattaagtcttaaaaaaaaagggggggggccataaaaactaaaacaggagttcctaacctggggccataggtgccctgaaattggaatgacggatgtaagagcatttatctaaggagagagacacaagagatttggtggattcccaaaagtgtcttgttactcactccttgagggttaaaaatcatcaacctatgatcatcatagagaggtcagaagcttgaaaggaaggctgtaacccaggtgggctgcatggaggaggtggcaaaccacctaggttcttccaagatccaatggcaatgggtgggtcaatggtcagctacctagctgccctgtccttacccagccttgccagctgctgaccagagccttgttcagtgattctgattccagggaccaggccatccacagctgttggctccacccatacagtgtgctttctacagccttctcctctcaagtcagtttctcattagggaggttcaagggatgcggggacgggggtgatcccagcctccactccaggacaggcatgtgacccaggactgtcagaggcacagggatgggttccgggatgtgacccaagtcaaaacaatgggagctccgcctgggtttttgctggaactttcttctctaacaactgaagctgggagtctggactgctgggagccaagttgccattacctgggaagggtgtgcctaaggatgaagccaatctaaaagaaagcagagatgaagacacagattgctgtcctgggacatagtttgggctggtggatccagctgtaactgaagtccactccctggttacacaagccaagaacttgactgtatgaaacagttgacaagggcttgaaatccaaaaggtcccaacggatccacagagaaagttcacacctacttaaccacaagctccccctgaagctgctttcctcctcgattttgtagacaccagccagaaggaaaaactccagctttgccagaaaaatagcagagccacacctggtgatcatatcaggatgtgcagtgtgtgtcgggggcacagggcaaggggtggaagcagaaatgcacactgttgctctaaagtcgaccacaggcagaagcccacaaatgatctaaatgcccagtagtaaggaatcaatgcaatgatggtctatccttataacagaaggcttgatagccatgaagaacaataagattatacattctgatatgaaatgatttccaagataagtttaaaaagttatgtattaagaaagcaaggtgcggagacagatgtatacatgaatcttaagttaaaagaaaatcttaagttaaggtctgtatcacttttcattgtagttgctgagagacatggtctcgctctgtcgctcaggctgaagtgcagtggtgcaaacatggctcactgcagcctcgaactcctggccccaaaccatcctcccgcctcagcctcctaagtagctgggactacaggcacacatcacaaacctggctagttttttgttgttactgttgttattttaagagatggggtcctgctacattgcccaggctggtctcaaactcctgggctcaagcaatcctcccactctggcctcccaaagtgctgtgattacaagcatgagccactgcacctggcttctatatcaccttttttttttttttgagacggagtctcactctgttgcccagactggagtgcagtggtgcaatctcagctcactgcaagctctgcctcccgtgttcacaccattctcctgcctcggcctcctgagtagctgggactacaggcccacacctgggtaattttttgtatttttagtgaaggaaacacggggtttcaccatgttagccaggatagtctcgatctcctgaccttgtgatccgcccaccttggcctcccaaagtgctgggattacaggcatgagccaccacacccagcctctatatcacttttttatggttctccaccttaaatgaatttttcaattaacctgcaaataccaatgcttcctggtcttgttggccaagacagcttctgctgtctgtgcagggataagcatgcacaaacagagcatggctagaagtatcttgaggagcccactacagcagatacctccaaagggggaagctgggaggtggaggtgggcggaggcttcctgtgtactgcataccttcagtactattttggattttcttttcttttttttttaaccatgcgtacgacttaatttacagaaaggaaaaaggtgaggaccctttctgaagggcagaggctctcttcaaagacacagaacagcctggctccataaaagaggtggggacttggacagaacagaacagaatccctgcctctctggctgtgtgccctctggccaagctgcatggcccctctgaacctcatccacctggaaaatgttcttgaggatctgccatgtgccaatcagtgcaaaaggcccagggatacaagagtgagccacaaagaacctgacctgtggactttacagtctggcctcagtttccccataataataattttgatcctggccacatttttgtgaatattaaatgcctgacaaagccctgtgaggaaggctttgcaagccataaagccctgggtaaatcctggctggaaaacagccacccactcaatgctgctgcctccaactcagcagggagtttaccttccagtgccccagacccagagccaagaggacgagacgccagtagcagctgctgagcagaacctccaaggttaagaaggctagaaaggccccgatttgtgacatcacaagaaggtgctctgatccaaccatctagaaggaagaccatgatcattccccaccatggccatggctgcggccagccagggctaaccaagcctgaacacagctatgttacaaggaagggggctctggacaggccccaaagacggttaaccagtacttcctgtgggggagagctttctttccatgaccacctgctgtgaatcactcctttgcactcctttgacgcctccctgcccactgaggatggagtttagcctgacacacagggtcttctccatgcatccagggctgtgcccactgaggatggagtttagcctgacacacagggtcttctccatgcatccagggctgtgcccactgaggatggagtttagcctgacacacagggtcttctccatgaatccagggctgtgcccactgaggatggagtttagcctgacacacagggtcttctccatgcatccagggctgtgcccactgaggatggagcttagcctgacacacagggtcttctccatgcatccagggctgtgcccactgaggatggagtttagcctgacacacagggtcttctccatgcatccagggcttgcccactgaggatggagtttagcctgacacacagggtcttctccatgcatccagggctgtgcccactgaggatggagtttagcctgacacacagggtcttctccatgggtccagggctgtgcccattgaggatggagtttagcctgacacacaaggtcttctccatgggtccagggctgcgcccactgaggatggagtttagcctgacacacagggtcttctccatgggtccagggctgtgcccactgaggatggagtttagcctgacacacagggtcttctccatgcatctagggctgtgcccattgaggatggagtttagcctgacacacagggtcttctccatgggtccaggactgtgcccactgaggatggagtttagcctgacacacaggatcttctccatgcgtccagggctgtgctgtccaatgaggtagccactagcctcatggggctatttaagttcacatttaaattcattcaaataaaatatatcttaaaatttaggcagtctctgagtcccagtggtcacattctaagccacaggttcccagaggggacaatgcagacacagaacatttccatcatcagaaagttctactggtcagcacagtctagaggtcacttctacagccccttcttctacccattctacggcggggggggggggtggtggtgggacctagcagccctttcaagagaggcaggtgtcagtgactgccagggtagctctaaatccgcttgcaagtttaagcagccacagttatggggatgtgggaagaggagagagaaccatggagcgagagcttgtcatgagtgagggcctgcactggcttctctgtagggtcgctcattaggtcccgctacactacaaatggggagtgccctcctcccccctcatccctctccaactcctgcaccctcctctctcctttccttcagggtccagtcggcccagctgttgcctagtacagaaaggttctgactcaggctcaggaaaccccaaggagtctacattttgaatagcacccaagagattcagatgtaggtggtcctcggccgcatcgagtctccccaactccacaccctctggctgctgtcttctctctccactccttctgataaagcttctccatacagttgcctacacatgctgtttcctcatctgtcattcacttttaaaatacatcacctttttgaaaaatacaaaaagtagcacatgctcattttttgtaaaatcaaacaacctaaaaatgtacaaaatgaaaagcaaaattctccattcctcagggaaatagtccttgacagtgtacccttccagatctttctctatgcacctgcagatacacagtgacacaggcctgaatagactttttcacactgtaagaaacaggaccatggcctatgaatgttttgcagttgctttgctcattcagcagcgtctcagggtctctttcctgtcagcaagagaggcccttactcgctgggctttgaccagttgcagagagctcaatgagaagtccacaccactgttaccttgtaccctagtgatggatgtttgagttgtcaaaaacttttcattcttccaaatgcagccatgaatgttcttgtaagtatgtgcttctgctcccctgcacatatttcttagtcccttcgtgagccacccaagtctcacctctgctgtcacttcaccaagacagttcctgccagacccaactgtgaccgccaggatcctaaacccaagggacacgtctcagtccttttctataactccactctctctgcaagagaccacctactctccggtagactgtgtggatggcccccagtgaatcccacttcccagtatttatgcccctgtgtagttccttcccctaaatctaggctggacctgtgacttgctttaatgaagagaatgtgttgttgctaattccaggcctaaaccttaaagagtcctggccgtttttgcttctatactcttgggaaagacagccaccatgtaaatctgattaccctgagactgccatactgtgaggaagcccaagctactcatgaggtgaggccaactagaagagaactgaagccccagacatgtcacttatttggagctgctgcagtcagacccttgctgttagagccaccctaactgtgctacatggagccacagacaagttgaccctcccaggcttggtccaaagtgcatactcttaagcaagtcacaaagtgatcaagtcactaatctttggactttttttttttttttacagcagtagaaacaaagccttctcctttcctttaatgcatttttgagaggaggaagcagaaggcaggagaggtcataatagatacctcatagctaagctggaggcacccccaggctcagggttcccagcgcagcattgtgtccaacccctgatgactgagccatgtctgtgtttctcctgggatgaagctgctgctgttggcttctcaggggagaagccatgggccccccctccatgggactgctcatcctcttcattccctaagcaaagggagtgagccagcagcaagcacccacagcatccctgggagcactgacccaggcccaaaagtcaacaaaccaaacagctcagaaagcacagagaggtcaggaaagttgccctaggtcacactgctagtgagaagtagagccagggctcaaaaccaggcattcaggctcagggcctgcaccagtgacccacaccagcgtttttctaatactctgattatgacctatagtaagaattatattttacaatatgcctctgctgtagatagatagatagatagatagatagatagatagatagatgggtttgggtataggtgtgtgtaaagtgtgtgtatacattttttttaactagaacaaaaaattacacaaaacaatatttactcttactatatataatgttttctcatatttttactctatttcattttggtcactaaattgatgtcatgaaccatgaatggggctgagacatacagttgaaaaaaaaaaaaaaactcgcctaaactgatttaagatggctctaaaatcacactgagtgatctgaatttgaatcttgctgaagcaagattccacttccaagttaagtgaccttgggcaatatggttgacttctttaaagcctcagtttccctatgggtaagatgggcataataataacagcggcctcataacagtgctctgagaatccagcactatgaacagtgcttggcccagagcctggcacacagcagacacgcagcaagcagcagctacgctgttaccacctcctcctcgggctgcagctcccagactcagcacggggctatgcacacagtgggcagctcgcgggcacactgagcctgcagccactgagaaagcaggcacgtgcccaggaccagctgaggcagtgggtgcctttggactttccagggcagggaggaagcagagaaagtccccagtgcccgctgaaaaggcaactttgttcctggattatagtagttctcttcaatcatctttttgcctttgaagggggaaagaagggtaaaacaacaaagtcagggtcaaaaactgtcctggaacaaggctccctctggaaaccaggcatggaatgggcatggcaccacacaccagcacccccaaacccactcactggagccaccgcaagccgaggcctctgagtgaggggcccaccagcccacgcagccttctgaagttagaaaaacatcctccggcctgagcccattagggaggctgtggcctgagggaagacagccccatcctgctaacagggtccttttatgctctgcctctcccctcctcaggaccccagctctatgctcaaggccagaaggcttgggcagcccagcaggccagccaatccgctccagggtgacactatttcttgtgactgagaggttctcctccctacctcttccaacctgaccagaaagctggagtccacagacaccagtaacacttcatggaagacttgcggcaaggagacaaggcctcatgacgggatgcaacatacagtggtaccacccagcccagcaggcactgcccactccctgctgctgcaccacatagttctgctctaacacctcagagactggaatgtggttccaagtcagacaccgagaaggaggctgaacactttctctgtgcaccaaccctgcatgcctcttgccctttgcacatcccgtgccttctgcctggaatatttttaataaacctttccccacctagctatttcctatttattctttgggtcttaacgacttacgcatcactccctaatctgaagtagaatcctccgttattctccttccccatccttttccttcactgcacttagcacactggtaccacactgagcacacatccaggtgatcactagcaaacaacactggcaagctgcaaaagaaggggtgacatctcctttattctttaacttgctgaaatgaacccatttctacccttaaaacaacccaatgaggtaggaaccattactctacccattccacagatgtgaaaactgagaatcagagatgagccatcacttggcccaaggccaccgagctggggagaagtgcagctgggactcagacccaggaagtctgattctgcaagttctaagcacacctctggcaccttctatgggcacatgctggtcttcagcataaagtctcccagcccacatctttgttttgttgtttgtttgtttgtttgtttgtttgagacagagtttcactcttgtcacccaggctggagtgcaatggcacgatcttggctcactgcaacctccatctcccgggttcaaggaattctcctgcttcagcctcccaagtagctgggattacaggtgcctgccaccatgcccggctattttttttttctttcttttctttctttttttttttttttttgtatttttagcagagacggggtttcgtcatgttggccaggctggtctcaaactcctgacctcaggtgatccaccaacctcggcctccaccaacctcggcctcccatcccagcccacatctttacttacccttcctgtgcctcccacattgctctcccaccagactgaaatacactgtgcacagcttcctggcaatgagcctttgcttggcctgcactctctgccttggatgcagcctgcatccagctctccctggctgggctagtgactctaatttgctgggcctgcctcctcatctatgcgatagcggaataatacctaaggcagttgtgaggattctacaagagaatgcatggaaagtattaggcacaatgttgagtccatatgatactcactcgtgtgtccttttatcactaacatactgcttctctaccaccaccaccatcagaatcttaaaggtctaaatcagcaaacacaagccagtgtactaacaggccaaatccagtcgtctgagtcacccaaagaaggtgttttctaaaaattttaattggttaacaataattttttaaattggaaaagtttcacataaaaattcagacagctggattttcttaatgatcagcccgtgtggcaacaccagggccatattcccacatggcagtgattggctggggttgagtggcactgcccccttgaggcagggtgtgtgttccccgggggcaccccggttcccacccctctcagatgtctcccactgagcctgtggcattcattcatatgacctctctggcccctgtaggtccttaagtttctaacccctgatctcagtcttaccattcttcaaatccctactcacatgcccacttccttcaaaaaaaccctccccaacctccacagccctgtgcttcccttatggttttataactttaacagttaacttgcactgagtacttcatgcaaagatccaaagtaaaatattagcctatcaaatgcggtcacatttaaaagaataatctatcatgacaaagaatttcggagggccaagaaggttgcactaggaaatccagcaatgtaaatcaagcatacaaatcacacaccacattagcaaagaatgatgcattccatctgcatcccaacagcatgtgacaaaattcaataattattcctgattttacaaagctcagaaagccaggagttgaaggaagctttcttaaacaaaaagtatcatacttggtagttattaaacagagtatgagattctaaccaatgcaatgagattctaaccaatgcaataagagaagaaaaatcgatgaaaggccatggggagagcttagttccactctcacagaggcaagaactatgtcctagtcctcacaatttccacaacaccctaagcacagcacgtgggatagataaagcagtcaaatatttgtggaatgaaaaacaccccagatgagttctgatccctggtacatgttctcaaaacatccagtactttttggaggcacatatcacaacttaaattgcacaacttgtttatgaaaatatttctgttttcctacaagatggtaagttccatgaaatcaaggccttcactctaggtaccaagcacaggtgtccctggcctaaagcaggtactcaatgcccactccaagagacatgagggcctactggagggtgcagggtgggaggaggctgaagatctaaaactacctgttgggtactgtgcttattacctgggggatgaaataacctgcacacgaaactcccatgacacacaatttacctgtagaacaaacctgtacatgtaccttgaacctaaaataaaagttaaaaaatatatataaggctgggcacagtggttcacgcctgcaatcccagcactttgggaggccaaggcaggaggatcatttgaggccaggagtttaaggccagcctgggcaacacagtgagtccctgtctctaaatttaaaaaaaaaaaaaaaaaaaaaaccctactgcagatgcatgaatgaatgcactcaatagatagtgctaaattatcatgatgttattctacttctcagctggagaatctgaagcccaggcagggagcctttggctgaggccacaccaatgtgaagccctctcagtaccctggtgtcctctgaaaggcgtcggccacacgcacacgccacagcccatgtgacttaacaagtaaggaaagcaaagcccagacccatgcctcagagccctctaaacaaacacatccaggacccaccccggcgggccaagccgccaccgctctgaggctggggatgacttcagtgcggagacctgaggctttcctcccagagccccacgactggtgcccacaaggctaaacagctcccttctgccttcccaggaagctatcaaagaattacttatgtctctggaagtgcttgtttagaaaaggttctccaccccacctgggcttggcaggagcgcagcatcaccaggctgcccttcggagctgctcaggcttgcctccagcccctggaggagctcagccatctttcacacagagagtcgaagccatgaagcagcgggaagcttcccaggataaacggagcagggtgacatcaaagtcctccttccagattaaacaactgaggccttcaactctcgcttgcgttccttccaggatattctgggctcctgcctcagttctccctccgatggaatggcagatattttgtttgtgagagactgaattttttccttcctcagggagagggtgggggggaagggacgtggggagggagaggaagagaaagaacgtctgtgagagacaagagcggcaaaaagaacacgtgtgagtgggcaagagagagggaaggcagggaggcagccagaagtgcctggtttggaatccaacaagtgatgtgaaaagtccaaaagtgtctaaatccaagcatcttgtgattcgcagccatggggctgcaggaccccccagctcaccagtaccggggggctgcacatcctgtctcggacagccctgctcagcccacatgggggaccctccttccataggcacaggcgcgctgcagttctggggcatgattagctctctctggggtttgctggtcactccctcttgttccctggtccctgaagagcctccttcttgagcagcaacctcaccccacaggtcctccgcagccctgacagctaagcttccagccctgcagctgacctcctcccccaacacaacagcagggccaccaaccccaacaggccaggttgagcccccaaggacctgtccatgacacaggggcagcacgctcgctgactgcccgccctgctccacccaacatacctgtccagggggacagacaggtaactcagatgtgccaagagccaccaatgcacgaggctttccacagacagtgccaggaaccacttccagttcccacaggctgcagagccatttggaggccacattcccttcttgattacccgcttgattccacacagaagcctcccggcaatccccaaccccatcctaccagggcagcttgagcctggggcctcggtcagctcttccccccacctccaactccttcctcctctctcctcagcctcagcggcccatcctgccccctccctcccagagtgcctctgtgtggtcctaggagtgggcctgggtactcactgctgctttgtccccttcatcagactggatgccacaggagggcaggaaccacatctctcttattctccactgtatccccagagcctggcccagttagggacttattaattcataattaataacaaggccaagtgtggtggctcacatgtgtaatcctagcactttgggaggctgatgtgggaggatggtttgaggccaggagttcaatccagcctgggcaacaaagcaagacccgatctctataaaaaataaaaatgaattagccggacacagtggcgtgcacctatagtcccagctactcaggaggctgaggcaggaggatcactgtgaggccacagtgagctatgacgccactgcaccccagcctgggtggcagagtgaaactatgtgtctaaaaaataataataataaacaaagaattattgataataatttatactaattcattaagctgagtgcctaaaagaaaaagcctggttccacccttccactccagacagaaggacctgggaaaagatggaatttggaagcaggaattaaaggaaagaagctgaccagggaagaggagctggggaaaaaggaggcagggagggtgacctaatctatcttcatttctttcttctttttttgctgctgacagttcagccttgatgtttcctgccctcgcggggacagtttgatcccagagtgtacctgagcttcctggtacaaacaacaacactgtccatcgatccatccatccccaccttccaacatccccactgggcgagcagaggaaacatcccctgagttctaggaccttgcaggacccacagcaggtgcctcctggatttgatttcccccaggtttcctacaaaaatgtgaatgaagagggtgctcttgggctctagagaacagaaggcatgcacagtctggctcaggggcatccagcctccttccccaagaagaaaagtctcaaagtgaggacaagacactcctcgaagcctctaccggagaccacatcacaaagacccattaaagcgctaagaagatgacacccatggccgccacccacccatcctgagggacctatggaaaaccagaaggtccccccactccccagcactctgcccagcccaagctctcccagcctctgcctcccatcccccaggaggaaagacagtgcccaggctgggccaggcagctggccctggtgcccatgagcagaggggaccctccctggagaactcgaaaatgccagtgaacaaggcccaaacacctccatcctgagtccttctccagccttaaagcaaatcatcttttaatcctgaaacaccaaatatttaatttatgctctacctcaaatgtcaagcccacctcccatcacatagctttgaaaccacgtaaagaagcctaacactttccatatggcaaagacatggggccttttaattgtgccaactggtatcattcaagggtaattcccttggaatctggcactcgggcaacagctgggccagcctccaatctcatcacccaaccccacacgtccccatgggctccaagtaagcctgcaccctcctcatcttctccaaatatcaaagtgcactaggtacccccagtcaaattaccaaactgcctggcagccgcctttgatccagaggcgggcttgcctgcaccacggctctcagcctatttcttcaggcagctctgctgtaaaggaacaaaagggccaaccggggccatggggagattattttaaatctggttgtacatattcacaatcagcctgtgagcatatacagaggcacacaggtcttcaccaagtgtttcccacctgatacctgagtccactgcactatttaatctatctattaagctttttcacttgtccattctattttccacacccagtgtttccaattggttttcttctctaactgcctgttgctgcttcatgtttccagcatcctccgtttctctctgagtttatgatgcttattttgctttctaattgtttaacatggtgttctttgccgcgtgtgctgatcagtttattgctcctcttccacagtactcgtgcgcctcccatttctcattccttttctcctatgagtccatattcccttggacttgctcatgtccccatggaaagggcaaaagcccagcccttggcctgcgtccctccaagtgagcctgccatgacagtgggggaggcagagagcctctagcattcttatcccagccctatcactccctgtttgtaggcccccatctccaaccctacaaatgtcttcagtgaatctcccagtaggttcccttccttcccaggttcaacagttataatcccatcataacccgccagggatgaaaatattattacacccattttgcagatgagctaattaaggtatacaagggcaaaatggtttgcacaggtgacaaatcactaggacagagcctgacctcatttatttctgtatttaagagggcaggcttagtttaatgccagcatggtcaccctttcacatctcaggaccctgcaggcaacttggactcatctgggacatttcccaagcccctcagacctcatcaggaaggaagagggcaaacaggggccactcctgcttctgcctgccccacgactggctcatctcgaagcaccccctctctgggagttttgtatgtagcaccctccaggcggatgccctggcacagggcttctctacaaatggcttctcctagaaagtgctccagaaagggagaaacacacagtccacaccagcgggctgtcaacactacaaggttatggggaggattaagataatgtaagcaaagtgcttgacacatataggcacttaataaatactagttatcattgcaataacaataatactagttggatgagccactgtgtctccagccacttagttgacaggccacgtaaaggactagaggcagagactagccccaaaacaggcctggggttggtgggaggacctctgccagcccttggaaaccagcagactttggagcccatgccctcctacatcctgatgatatcatggaagaacctaccagctaccccttcggcaccagagggaatcagggaaatgaactagcctgagggttgcccattgctgtcctgttcaatatcttagtgcttcccaaacttggggcattccattcccacattcacaattttgaccacttgtacttaatatttttctctgaatggacttcacgttagactcttttttaacttagcttcatcctaagcaataaaatctgcaaaatcatgggtttgatgtcctagttatttttttttctggtaaaaaaaaaaagataactattaagatttaaaatgttcccccagattccacctgaaatcacctggaggatgcctggagtgctgttccacaccctgggctccccctgaagttctgactccttatccctacctctgcagacacactggctgggccatctggggccaaggttggtgaaaacccaggcgtctgggtccccagcagcaagaacaactcccaaggagacagaggccggccccctgcataacaactttgatggctgcggcccaccctccaaccacctgacacatgtcatgccaacggctctgagcctcacatcttcaaaagtactttgaacaaacattaatgacctctcagcatttctctgagagagggggtgagggagagagggggacaggcaccatcccatgctgtcctcagctgggggaagaaactaggcaacagaattccgtgacttcaccaaagccacagacttaagctggggccccctccccaccctccctcacttcccccaatggcaactttagtggcctgcattcctctcgctgggaacactactatttaattaaaaacgacagacttttgttttcctctccctctttcctcctccctcccatcctcccagactggatgccaaggagacccaccaaaaacatgcgggtaacatttgttatggctttgaagataaaagtcaattgaagtaagccctcgctgtatttcaagttttccctctagcatggagcaagctgcctggcagtttagaaaaaaaagaaaagaaaaagaaaaaggagggactgcaaataaatgtcattctgcaggaatactttgtaaaaataaacaggctgaaaaaacccaaaacttgattaatggaaatccactcagttggcctctgtctggagctgtaaatgcatttgttcatacggctaaattagaccgttttcgttggcctttaaataaataagtagatcaaaaactagaaagggcaggggaagaaggagaggtttgtagttctctttttaaagggccccaactgcagtgccccccgcccaccaagatttgacctttactaggggacagcagctccaagtccgacccggccaacagaagacagagaagcccccagctaagcagtggcggtggaggaggacaggggagcttctcctaggcccagaggttatttcatccacacacaggaactgactttatccacaggtccacctcccgacaccagcactgcaagcgagctgccaggtcccaccacccaaatacaaacacatctgaagtctccactggcctctccccagcccatggataagaccaaagaactaaccagacctgagactcagtctattccccctctaagttaaaaaaaaaaaaaaaaattaaatgtcacatcaaaaagttgattcatcctttgatcctaggcttgcgcgagttccacgcagactgcctgaaagccccgtgcagagttccggagctcacaggacatctgtgaacgccaagtcccaggccaggagctggggctggactcactcattcccatcacacttagtgctcctccaggaactccagcctcagagacacacggggtgaaggctcagggctctgcccaggctacagtggaatgaggccctctatctcatatgccaagtaaggggtcttccaggtctcagtccccctagatctgctacccagagggccgcctgctctactggggttcctgtacaggtggtactgatgaatgccacagacaatcagaacatattcagatcctggggccagcacagctctgccttccacccagacacccctaatacccccttctctctagcccctactccacctccacctttgaatgctggtggcagaaacaaggtagaagtcagagcaggcccccaaatcccgccggtacagacacgattccccatcaactggaccttcaccacctccccacctaggacctttcccccaggcagccctctgcctccagctgggcacttcgaggttctccaaggcatgcgggcagagggtcgcgttggtggggcagggggcagctgagaagagattttcagacccagaagctgtgcaggaaagtgctcaaagttggggtgcatgggtttggggacccatctctgaggctgaaaggaggccaggaggtggggcaggggtggggaatcatacccgggtgcttcggcctatggtgcccgccaaccgcagctgtcggggtcccgagacaccgcccgggcagcgctgtctcccgatccactcctcgatgcccttccgagcccaggcagcgctcacggcgaagctgtcacctgggacggggacgacatgaagcccctgagtctggctccaggtgccaaaagttacccccgcggagggaagaaggaggcgcggtgggaggcgaaggaccacggcacgggggccaggagggggttcgcgggctggggcaggagccaagagagggacgcgggtaagtaaaggggggttcagcgaagccctaggagcgaggagccagaagggggcaagaggggtgagcagtaccccaggaggacgggtttaggatcagaccagggagcactggcagccaggactgcggaggagagggctgggggtcaggagaggggccgcagtaggtgcaggagccaggatatcggaagaagggccggggggcaggaagagggggcagggtcttgcggggaggcgcttgggggtctgaagagagggtgccgtgagagccgagggcagggacgcgggagggggaggggttgagggtcagcggtgggagcgcaggaccgcggggagcgggtaggagggacagaggagggggcgcgaaggctgctcagggagcgggcttggggggccggtggccggaactggggcttcggggtggccctggtcataagacctggcgggctgggccgttctgccgcggccgcggtgtcccccgcgtccatccccgaggtctgcgccccgcgcgcccctaccttccgggctctccctgcgcttgcacacggcggctgcaggcacatcgcgaggcggcggcggcggcggcagccgcggcggcgggagaaggaaagaaaggaagggagagagttagcgaccgcggcggcgacggcggcggggcccggggcgagcgcgcgggcgggggcactgacccggcttggagtgaagtttccccatgctggggctgcggcggccgggagcgtccctaagccatgcgcccggc

SEQ ID NO: 986 - DNA, 3873 bp, Homo Sapiens
gaggctaaagcgcaggggagggctagagaccttcagcgctcgccgacggcccgcccctttcgcccgctgcgattggctcaaatcctcgacctctcttttgattggcgattagggcagtcaaatttctctcggctctgggtgcgcggagagtagggcgggggattggtggggggcggggagaggagtcaaactgacgtgtgaagcgggtgagccaggcccggctgctcagtagccactttctgcacgccgtgccaactccgaggctagcctagttgggtactaggggctctgggttctcgcatttatgaagcagtgggctcctccactctgggaattcgagctgttggggagactcatgggcgagatcccccgcagccgagggcagtgaggtcagcaggtttggcagggctgagtctggccgagctgtcggaactcagccgatcccagctcgcatctggcccccaggtcagggcgtctggcgactcctccgagagcagccccggacaagcttcatccctctcccaaatgtaacatttgcttgaaactttccatgattggctactacccagacgtgaagtgttttggaaaaaatgagcaaaatcctttcagctatgcgacttaagccatgggagggtggaggtggagggagggcgacgagtggcgaggcggggtgggggggttgcggaatccagaatacgacagctttcttttttaaaaattattttttttaaatgtacaccgatacttcaaaaatagttttgaatagcaatgattccgttaacgctatttgcttgaaagcaaaactgtagatacttttctattttaaaaactgcttcactgttttaaaatagaagcgttggaatacgggttctctaagttatttcagcatcactttatccatttatccttttggacctgtggaaaaacagccaagaacctgataaactgagttattccctgaggctacatacacattacattccaggacaaaaaaatgtttttagactatttcctgaaacaattaggtttaaatggagtagatccacagagtttaataagatgttttgggggttggtgtgttgttactgtgttgttgtgtgtgttcgttttgagaaagggtctcactctgtcgcccaggctgaagtgcagtggcgcgatcacggcttactgcagccttgaactcaggggccccggtgatcctcccacctcagccagcacctgcttttttttttttttttttttgtatttttggtagagacggggtttcgccaggttgcccaggctggtttcgagggatctgcaccccctgggcctcccaaattgctgggattacaggcgtgagccaccacgcccggcctaatgaggtgatttttatgaaactagaagggtgtatgtcaggtgcatcattaattgataaccggatttagtaatctagtgaactgtaaaatatttcaatagattaataattaggaaatctggctgtacctacaggttatgtgacctttggcatgttacagccttgccgtgttttaagttttttttttctatctgctctttaaccagaagaacatggaaaaaactatcatgtgtaaaacatagtcaccttttttatttaaaaaaaaaaaagcaggacaatgggaaagtacttagatagcttttattactaatgttacttgtccaaaaatgttgatgaatcaaagtaatgatatattcaggaatagagacatcaagtttcagaggaaaggtaacaaatattacccctgcctaaccctgacttgttaatgacttgcagactttaatattgtccaatatattagctgcaattagttatcaattttaactgcctcttttttctcaacaacacaaagcaactgacaatccagttactgttttcctctcagtttctcccttaatttctctgagtttcttatgaaaattgttttagatatttaaaggtttaaaggctttatagttcacttaacaaataagaaagctaacctagtaacagattattttctagagtttctagtttctagagttttattttctggtagtttccagactttctgcttttggtgagaatggatagatattactcccaaaatttggaagaattgagtccactgaaatttaaccccttgtttgagaaggctaatgaaaaggttatagacagcaaagaaactattataaatagaataaaaatgtgactcaatactttcatttgattcttttcttcatcttatataattttttaatctttaaagatatttttatctacaactttgtaaccattacacaactttgaagtttcagttatgttaaattgaattatatcattacataaactcatgtaatcatcatgtaaaaagtataaaaacatttgtatacatacaataagtagtccaccaaaatatctacaaatagaaaaatgctctccacattaactatggttgggttgtcagatctactcttcgacttcctttttgctcctaagtgcagctacactacaaagagttgctgtcccatagccatcatcaggtaatcagccatcaaaaggaataattggaatttgtgcactttgtgtctgttctaacttgaagaaaggttcctgtgcttctatgttcctgagcttctttgttctgtcgaagattacaaaaggctaatgtttcaagatcataataaaatccatatataggccgggcgcggtggactcacacctgtaatcccagcactttgggaggctgaggcgagcagatcacaaggtcaggagattgagaccatcctggctaacacggttaaaccccatctctactaaaaatacaacgattagctgggcgtggtggcacacacctgtaatcccagctacttgggaggctgaggcaggagaatcactcaaacctgggaggccgaggttacagtgagccaagatcgcaccactgcactccagcctggcaacagagcgatactacatctcaaaaaataaaataaaataagataaaataatatatatatatagaaattccagattgcgccttcacaaaaactagtagattatttgttgacctagaactaaaaagaaagtaattttcctttgactaacagcttaaaagaattgcctaagcctttttttgaaattcttctgtttggagaatagagtaaggttcaggaagcctctaaacaagcttctgctactacttccctttcttctgttggtttcctgctttaactggccaaattcctagcctcactgataagccctgccaaacatggcttatttttccaatactgaatatagatgtgtaccaaagtaagtatggtaaatccctcatctataaaaaggggataatatggccaggcaaggtggctcacgcctgtaatcccagcactttgggaggccgaagcaggtggatcacctgaggtcaggagttcaagaccagcctggccaacatggtgaaaccccatctctactagaaattcaaaaaattagccaggcatggtggtgcatgcctgtaatcccagctactcgggaggctgaggcaggagaattgcttgaacctgggaggcagaggttgcagtgagccgagatctagccattgcactccagcctgggctatgagagagcaagactccatctcaaaaaaacaaaggggggcggataatattggtacttatagggttgttgtgtggaataaataaacaacacatataaagcacccagaataatgacagtagcactctgtaagtgttatagctgttattatcaaaccataggtgaataaattttgacatgcaatgtgatcagtttttacacttattgttgaaaagccaaacaattgttttaaaccatctaataataaaataccatttaagggg

SEQ ID NO: 987 - DNA, 1372 bp, Homo Sapiens
atgctagcaattattgtacccacaattatacttatgccagtgacacgatattctaaaaattctaaaatttgaattcacacaactatgcactgcttactaattagtttcatcaaattattcctcttaagccaatttagtaaaaataacctaaacttttcattagtttttttctccaactcactatcagcctccatttcattatactaacaaattgattacttcccctaataattatagcaagttaacatcatctctccaaagaatcatatatatgaaaaagctacatatttcaatattaatctttctacatttattcttaatcataacatttactgccacagaactaaatctattttacattctctttgaagcaacactaattccaactctaattattattctctgataaggaaacaaaagagaatgattaaatccagggctctatttcctgttctacacactaattggttttttacctcaactcgtatcattaatttttatccaaaactccacatactcattacactttttaataacctgttactgtgttcaaactcagctcttgacataatagtcttttatgattagcatgcattatagcatttatggtcaaaatacccctttatagtttctatctctgactaacaaagtacacacagaaactccaattgctgaatccacagtttttgcagccataaaattagcaggctttaatataatacgaattactataattccaaacccactaatggaatatatagcttatccatttcatatagtatccccgtgatgaataattataacacactctatttgtttacaccaaatagacttaaaatcacttaatcacttatcacatattcatccataaatcatatagcactaacatttatagccattttcatccaagctcaacgaatttttataggagccataaccctaataattgcccatgccctcacctcatccatactattcttcatcacaaactcaaattatgaatgaatttatagctgaaatatgctcttcattcaaggactgcagacattactccctttaataacaacatgatgagtattagctagcctaaccaatctagccctaccaccaaccatcaacctaatcagagaactatgtgtagtcacagcaccattttcatgatttaattttaccattattattaataggacttaatatattaattatagcctaatattccctctgcatattaattacaatgcaacaaggaaaatttaccaatcacattaataaattagccatcactcacattagaaaatgctttatacatctacctctgctactcctatcacttaatgacaaaattattctaggacctacatactgtttttaa

SEQ ID NO: 988 - DNA, 2590 bp, Homo Sapiens
ctttctggagtctgaaatgttaagtatggaggcaaaagctgaagctggagcaacagtctcagaatatgacaacaaccatgagaatggaggccattcatagcagaactacgagacaagaggagcctaggtccctgagctgcagaactgcatactaacctgatgagaagactaatgctcagtgaggtgaactccttcagggccacaggctgtaaagatctaaacaccatctgatccagtttcaatatgactgcctggatgaagaaggatttgagactaagtttattcctccaaagcaaaccaactgagaatgcagggggtcttgctatgttgcccaggccagtctcaaactcctgggttcaagcaatccactcgccttggcctcttaaagcactgggattacaagcgtgaaccaccatgcctggctgaagattcaagtttttaaaacatctgatttccacttgaaaccttgaattgtatcattggcaacaaataatgtcagttattttccttgagatgacaacttcacttagttattttcaagaaaactgctgccatgtagccaactgtgaatgaccacagtttgcctgtcagtcattctgtcaagtaaaatggtgctcctcaaacaaagcagcacgtttagctcacaactcaacaaccacacagcagtcttcctcccacccaccatggcacttatattaatataagcagcagaggtgctttatgtatgagtattgtgtgaaaatactcaaaagacctgtaaccaagggtcaagattactacaattaatttctactgcttcctaagggcattcttaagtgacactagcatattttacaagccagagtgtaacaatgagcacaatgactgctaccacagcttgctgccagccattgccttgacttgtcctaaaacacagccattttcatccgcctccatggctactgcatcatcagtgcaaagtcaacccagtaaaaaaggcaaatagcatctccgtgttatcataaaaatagttttgacctcatggctccccttaaagggcttggggcatcacagagagccactgctacagccaactgagagagaactctcaaaagccaggctttttctgtccctgtccttctcacagtgaaacacttaacgcactctctgattgtggctcttaactcgccaggtaaaagtccttctgtgtagtctaggaagaagggcaagggcaaagggaggactttgtttatgaagcctaagtagaatatgctctgctagataatcagtcctggaatgaaggaggggagaagtgagtttctgattgtctgagcccaggtctgatgttgggaaatgccagcattccaacccctgatttccattcccactaccagacttaggcaaagttactcacccgttcttgaccacataaatgtatgtgtgatggctaattttatgtgtcgacttgactggactaaaggatgcctggatatttctggaagagactaagatttgagtcagtagactgagtaaaaattgccctcaccaatgtgagtgatccttatccaatctgtagacggcccgaatggaacaaaaaggtagagaaagggagaattcactctctctaacccggaacagccattcagccattttctccttcccttggacatcagcacttctgattctctggcctccagattatgactgtgacttacaccatcggcctctctggatctcaggccttccagtttggactggaattacaccaccagctttcctgggccttcagcttgcaaacaggtgattgtgggactcttcagcctccataatcacacgagccaatccctcataataaacctttcctggccaggcgtggtggctcatgcctgtaatcccaacactttgggaggccaaggcagccagattacttgaggacaggagttggagaccagcctggccaacatggtgaaaccctgtccctactaaaaatataaaaattagcgaggcatggtggtgggcacctgtggtcacagccactgaagaggctgaggcaggagaattgtttgaacctgagaggcggaggttgcactgaactgagatcatcccactgcactccagcttgggcaacagagcgagactctgtctcaaaaaaaaaaaaaaaagaaacttttttttcatatctctatatgtgccattggttctgtttctctggagatccctggctaatacactatataacaattactccctttgaaaatcaggaactcacagatgattcaaagtgtgacctacacttttcttgctgatgcctggccataggcagcagcgcaagactgtgtctctctctcaatctctctctttcacatctcaggtttctatgcagttagaaaagctacttttctagaatcactttttcctaagtaatccatatcacatctgttaggaattactaattaataagcaaagttaaccaaaaaaagagagtattataaatccatctttctattagattgtgataactgcccccttctattcattatttcctgtaccaaactcattttgtaaactaagatcaagtctaataaaaaaattcttttttgttaagtagcaa

SEQ ID NO: 989 - DNA, 1789 bp, Homo Sapiens
acccattatacccactgcagtgccagcacacagtggttggataactgcatacctctgagatgcatgaaaagcccaccccttcttgctgggactatctgagatagtgagtgtaacttgaagaaatggtacctagcctttgtccaggcttaggatttgaaaaaacaaataaacataaaatagaagactccttttttactttccttcttatctttaaatcttaacctaaaatcttttttttaatttttaatttttgtgggtacatagtaggtgtatatattttgggggtacatgagatgttttgatacaggcatgcaatgtgtaataatcacaccatggagaatggggtatccatcccctcaagcatttatacttcacattacaatctaattatactcttttagttattttaaaatgtataattaagttattactgactgtagtcacactgttgtgctatcaaatagtaggttttacttctttctgtttttaatacttattaatcatccccacctttaccccatacccccactacacttcccagcctctagtaaccattcttttactctctatctccatgaatataattgttttgatttttctaagaggacatgataagtgtttagtttctttgccaatcagtatccccgtaattttggaaatgatgattctggaggctgggcatgtcatttttgactgaccatctggttcacttactggtgccatgaaaaatctgcatcatcttaccgcatcattgactacaaggagaatgtgtcaggtctagatgtgttttagcatgaccatcaacactgctaggactctggcatagttgaatgaacaatgcatccagatactagatgtgggaagtccagacttggttctgacgtgtgggacaagtcagctgactcttccaagccaccaagtccacttgtgctaaatggtggcatcatcagattcagtgagctattccttcctttgtccttgtatgaaagttgagatttactttttatcagttatttaaagatctaaattacacagcaatgacaaatgtgcttctatgttcaacttcaacctttggaattaactagctttccaggtcttactttgttaaacttaggtcatgatccacaatgttctctccaggttgatctgttcaagtcttggacagattttggtatagctcttctaggttcctccagacaccccttcccatttccacagtccctggaatcagtttcagtatacatccttcactagacagcaggaccacagcctacaggctctggagtcatcttgtcctgggggtgagttctggctctatcccttgttagctgtgtgatttcatggagatttccaaatctccctggaatgcagttacctcctctgtagaataaaactaatcccagctatccgtcagagttgcaatgaggctaaatgaattcataggcacaatgaatttgcccagctaatgctgatctactcctacttgttccttcattctcccaaatgccctctcttctccctcctgactcatcttgcttgctaagtcatccactgtttatttcttgtgcctccctggaagaaagatgacatctgcttcttgtctgtaagcctctgttgtgatttcttcactcttctctacccacaagtatttcctttctggactcaccaacttccttaggctgggatgcaccaaccttcacattctttgaagaagagcctgtggggactccatcccagtgctttgagcagcctatccctccttgctcagtctctacaattgcatgctagc

SEQ ID NO: 990 - DNA, 6262 bp, Homo Sapiens
agttgccgctaggcgaaagtggggaccgccacacagttggctgcggattaaaggaaaatcaatgtgacgttaagcaagacatttattgtgcccacagcttcaccattctggtctctatgattccctgcgaagattgctgttatcccccagagacacagctgagctgtctctctaaagggcctgtgttctactcctgaatctggtttcccctaagcttttatctcaccctggtgacagctcagaaacacacaaactctgtgttaagaaaactaagaagtcattcatctgcacatttcccgaaatcccccagaagcccgtattagactgaatggtgtccttattgcaaactctccactttagccaaggtgcaaagtcctcccagtcccccaggagcttcccttctctgagcggtacttaagttttctgtaaaaccactcagttcaacaaatgagcttctcaatcttagtttctgcttgttgactttaaagttaatctataataaacacactgcagtcctcttccctgactcattgtccactttgtccatttgtgtcctcataccagattgtctcaattctcttaactggtgagatattatgaactcaaagcattttgcacaatgatattccaacatgctgcatgcaacaagcagacaataagtaactagtgagggaaatattccctcatactcaagagaaccctttatacatttttaaatattttagggccaggcttatgcctgtaatcccaagtactcgggaggctgagatgggaggatcacaggagcccaggagttcaaggctgcagtgagctatgatgatgacagtgcacttcagtctgggtgacagagtaagactgtctctaaaagtaaaatatcttaatactgtacctgacatctgactagatgtacccagcaaccactatgtgccataatctctggataaattctatgaacattcacttagaaatagctgcaagtccctgaagacagtatgacaaatactgaggcccacagtttttgggtgatcagttgcataaaatgctaaaatagatggttcctgttttgaatgtcactttcaaacatagaaaaaaaaggaattctgctgaaaaatcatgaatggaaaaaaatgttcatatttgttgaagctggatcatgcatagagtttattactatttgtgtttccacaataggctggatgtggtggctcacgcctgtaatcccagcacttttggaggccaaggtgagcagatcacctgaggtcaggagtttgagaccagcctgaccaacatggagaaaccccatctctactaaaaatacaaaattagccgggtgtggtggcaaatgtttgtaatcctagctactcgggaggctgaggcaggagaattgcttgaacccaggaggcggggaggctgaggcaggagaattgcttgaacccaggaggcggagcttgcagtgagcagacattgtgcgccattgcattccagcctgggcaacaagaatgaaactccgcctcaaaaaaaaaaaaatccaccatcaagttattaaaaacatataaatatatgggagaattccaaaatcaccccttcccatgacccatatggagggacctacaaacatgaaaggatattaccagtgattaggttactttacctggcagttaacttgaagggagattaccctcattgggcctaacctaatcaggtgagtccttaaaagagttggggctctacctggaggagactggaagtgtgagagggatttcacatgagggagtttttctgtttctggctttggcgatggaggggaccccatggcaaggaatgctggcatcctctgagcactgagagtggctcagccaacaaagaaatagggacctctgtcctacaactgaaaataactgaattccaccacaaccctgaaagcctggaagaggacgccaagcccccagataaaatgagaagacagcctggtcgacaccctaattccagcattgtgagaagctaagcacagtccaggtaggcatgcacacctgcctcgctttgacctgcagaactgtgaaataaatgagtgttgttttaagctgctaaacatatggtaatctgttgtacagtgagtgaaaacgaataatatataatacacagagcatgaagacaaaataaatctaaacaaatgccctgtttatttatattttattaataaagacaacagaagaaggatgaggtttcaatattttattcaagttttttaagtgttgttaattacagcatttgaaggggaggatctaattccaacaaaatggaagactctaaaatgtacccattaaactgctaaaaaacaaattgagtggtgagaatacaacagaagtccaatttagattctgagtgttgtcaccatgtgattacaatcacacagacacttccaagcttatagctggagctcctggaagctatttcatactctggtgcaagggccaaaaaaaaacacaacacaagaaggaataagtcctgaattattggcttcatcacatccaccttctccaccccaaaatggcacaaaagaaacagttaccacaccctgcagaccttttggtgtaaaagagatgatgatgaactggggtgggaacaggtcatgaagatctgtctaaaaaagtcccattcaggtgagtttgtacacaccatcaagcagcgagcctctcatcaattagggttagggaaccaaggttcgattctcaggaaatcacaatttcattcatttactcaatatgaatttacaaagtgcctacatattatccgcttccacttgcagccatttctagataaaaaagaaacctggcatctcaaaggggccaccaagttctccccgagtctaccactgaaaggaccttttttggaaataggtttcttctgtacctctggaagggtaacatcttaaagctgaatcaactttaacctggagggctaacatatttagcaatacttgcatcccagacatacaacattaaaagatacactaaattctgaaggtagctatgctgcaaaatagtttaaaattaaacaattgtacagtattcatttatgcttgaaattccagtcctagaccaagcttgtggccaccagcattgacgttcttgccatccagaagagctgacagtgtcagtttaatacctggctttagagtctgagtgtatcctaaacctatcaggctggagttgttcactttagcctaatcaaggaaatgacaaaacagagaaaacattaagtataatactttgcacttccatctccaaaattagagctttttagtcaaccaaccttggactttagaatcaaaatttttcatgaccaccttgttcatgagattcattaaattcaatacaaaatacatcaattttaggtgcatacctttctgttcaaagggtgtgctgagatctgacacccctcataagaacaaagcagagagaaggaaggcctcttaggggccagtgtccttttgctcatataaataatgaggctccttttctcttgtttttaagtgcttgctgttaagggagccaaattcggttctagtttaggagacttaaaaagggctgtccataaattacacaaaccagtacagacaccattctgcaacatgagattccctcatttcaccccaaagagatacagccgccagtgccctgtgacaacagaaatgagcccaataggatttactgcaaaaactgtgtagtagttcgagggcctgtgagcaatgccagagactctgcaagatgccaactgactattgatttcttaatatgcaatgcaggagctgaaaaggagaatgaaaagtgaggcggggcggggggaattatcaattagaaccctagatttcagagtgccccttttaacagtccgcatgatagaacaggaactggtattaatggaagaggcttaacagtaagccagtctggttcaaatccagctcccagcactttcctgctgtgtacctttgagcaagttactcacctaagtttctagttcctcatttgtaaaaacagagatgattggccaggggccatggctcatgcctgtaattccagcattttgggaggccgaggcaggcagatcacctgaggtcaggagttcgagaccagcctgaccaacatggtgaaaccccgtctatactaaaaacacaaaaattatccaggtgtggtggtgggtgcctgtgttcccagctacatgggagggtgaggcagtagaatcacttgaacctgggggacggaggttgcgcagtgagctgagatcgtgccattgcactccagcctgggcaacaaagggagactccgtctcaaaaaaaaaaacaaacaaacagagatgattggccaggcatggtggctcatgccttgtaatcccaacatttgggaggttgaggtgggaggacagcttgagcccaggagtttgagaccagcccaggcaacagagtgagacattgtctctactaaaaatttttttttaattagccaggcatgctggtgtgcctatagtcccagctacttgggaggctgaggtggcaggattacttgagcacaggaggatgaggctgcagtgagctgcaattacaccactgcatccaacctgggccttgtctcaaaaaaacaaaaaataaaaaaaacccagagatgattaaaaaaccaaagcacctatttcaaatgggattaaacacagtaatctacacaaaaggctctgcacagtgcctggtacccataagaagtactagtagtatgatcactgtactcatttggcactcttttcaaagtgagaacatctctcactttgtttttgtttttttgagacggagtcttttttttttttttgagatagaatctcactctgtcacccaggctggagtgcagtgacacgatctcagctcactgcaacctccgcctccccggttcaagcaattctcctgcctcagcctctcgagtagctgggattacaggcacacgccaccatgcccggctaatttttgtacttttagtagacagggtttcaccgtgttggcgaggctggtgtcagactcctgacctcaagtgatctgcctgccttggcctcccaaagtgcagggattacaggcgtgagtcacggcgcccagcagcatctctcactttgagtaagctgaagcacagcactccagcaaacctgaaggattccaacataaagagcagatgggcctgcctgtgagatgcgtgattccacagatacccaccgagaagcaggcgtcagggtcaatctgatacttggctgctattccgaagcgcgtgttactgtttcctgctgtccaggcaagattgacagcggtctccaacttcttgttcactttctggtaaatggagccgccaaactctgtcccgtcattcctgcaaacaagcacaggacagatgctgagcttcccagggaggtgagctgcagcccagacagatccacccaagtctcccagaagacagggatgacagaaatggactgaaccaatactggtattaagggaagtcagaagttcaccaaatttcacaaaacaggtactaaattacaggaagtctgataagtatggaacaggcacctagccaggcacagtggctcacacctgtaatcccagcactttgggaggccgagatgggcagatcacttgaggtcaggggtttgagaccagcctggccaacatggtgaaaccctgtttctactaaaaatacaaaaattgaccgggctggtgccatacgcctgtaatcccagctactcaagaggctgaggcaggagaatcgcttgaacctgggaggcagaggttgcagtaagccgagatcgcgccactgcactccagcctgggcaacagagcaagacattgtctcaaacaaaaaaagaaaaagccaggggagagggggtacgtggtgactcacgcctgtaatcctagcattttgggaggccgaggcagcaggactgcttgagcccaggatatagcttgggcaacagagcgagatcctgtctctataaggaaaaaaaaaaaaaagaagcagcaagtagagcactgagattctgagtgatttatttttactgctactgatgttattacttttataaacgattctaccagaaaaatggcatggaagtccgggtgcagtggttcatgcctataatcccagcactttgggaggccaaggcgggcagatcatttgaggtcaggagtttgagaccagcctggctaacatgatgaaaccctgtctctactaaaaac

SEQ ID NO: 991 - DNA, 4518 bp, Homo Sapiens
aggagagcatggaacacaaccctcatttgcatcccacaccctagaatctgcaaggacatgacagactggaaaatatgctttcacaaacccaccagaagtgaagcttaggcagcaaagcccgcagcttccgggacagtcacatgagcctgagcccagatcgcagcacatccagagaccagagccaggccttggagttctgtgacagccactgcaaatgactgtgggcaccgcaggtctccaccagccctgtgccaagccggtgaggatgccctgccatcttcaaggctcactgaggcggcgggctctgggtgccctctggctgctgctggagccccctgcagagcccagatcattgcccacagagagcttctcattaagagctttcagtttataatttcttggttcctagaattttgtagagacttagattgacaggattctggcatgaagttaatccgcatctgcaacaggctccaaacacgacccacatcccggccccaggcatggggctagggcccaactgagctgggcaagatcagttattcgttgtcttcagaattcatgtttgtaaaatgcgggacccatgtcttggaggggtgacaggagcagtgtttagagcatagcacagggcccgtgcccatcaggcgttattgctgtgagctgcctttattcgtgctcaagttatcgaatgtgaacaagtttagtgtcaaaaacaagaagtccaacaccgtgatgcaggattcatcgaatgtgggcgtccctgccacctctccactggcccctgtgacagtcgatgcctgatgtcacctgtcagttcaatgtgtaaaagcacaaaagtagattcctgaattgtgtcaatgccacagaacggaaggggatggtgctgcaggttattcctgtgtttctaggaaggcaacaactggatagaatcgggcagaatggattttgtctagtgtttgatggaaataataaccccacatggcttgtcatacacacaaaatgcagagaaatatgcagcgttctggagtgtcctgcacgctgtcacatgggacccccatccactcttcctatcaaaaggctgatggatcatggtctctgcagatgcaggaactgagctcagagagaggccgtgtcttctccaagacccccagccaatgagagggacccaggcctgagcacaggtttctgaatcagagtcctgcctctcaccttctcaaacgtccttgcttcccttcccaccaagttttaattgagtgcaccaggattgcggtcttccaaaggcatttatgtgattgccttttcctcttcgatttctcaccagttagcttataaatgacaaagtctgccccgtggagagagcgttctttagattttaatagaaagacatcaacatcgccatgaaaagatgaagacaatgaaaataattatttagtaggataataaacggaatctgggcagagtcgtgctgagcagctatgacttgcatcagcgcatcatggactggcagcaactcactgcgcagaatgtccgggccacaggcttgggctcccccgacaccccgtttcccatgggcattttccctactggggactaacatcagatgggttcacactcgtgaaagacgctcggcaccaagaaacaggtgcctgcagggctggtgcgacacagggactctgtggtgtagtatgtgtggctggtcggtgtattagcgaggatggggacacgggtgtccagtaaggagtgcttgaacgaaggtccttgattcacaaaacaggaacagtgctgaccgcccgccctcctttatcccaggaagaactccaactgacatagttacaaacagcatggaatccaaaccttaccctcatcacaccgtaaataacatctttgtacagcactttatgatttttaagtcaccttggcatataaacatacatttcttttacataaacacatgtgcatatgaagaggatatgtgtgtgtgttcacaaaagtcacgtctatatataggacatggggctggttttggtaaagccccttggagaagggcctaggtgggagtcctggctcaacccccaggtcagctacttgtcttcgggtctgaccctgaagccagcttcccacatccccaccctaaattgtatcagggatcctgagaagactaaggcagtatggggctctcccagcagggaacctgttcctaattcagagctttgcacccagggcctttgggcgtctgtgtgcctgctgtggatgggagaccctgcccctgcatcttccacggagagggtacgtagctttcggcagaccacaagacgctggaagtgaaggacacccctcctttatttactctgaaagttctgtttgcctcactagaattctgcatcataagaactcccggacttgtatggccccactgtgatggctggatctcagctccccacagcccctctgaggcagccagggcaggtgtccttatcccctttgtatctgactcctccaacaaccctcagggtcaatgatccactagaaggattcacagaaccttaccatttattacagaaaaggacatagattaaaatccgcaaagggaaaacgtacttgggacagagtctaggagagaccagctgtgagctgcccactgtcctgtcctgagggagccacgaatgcacttcattctcacagcaacgactgtgccagtgtgcacacagcaccacctgccaggggagcccccgagccttgggatccagggcttctcctgggagcgggtcacataggcctgcatcatcccgctggctaatcctagtcacccagtccagctatcccagaggtcacactgatgtagcgtggctctaggctgcacacaaatcactgttaacatgaactccatgaactcttggccatggatggaggtcgctggtaaacaaagacactcttatcaagcaagataatccaagggctcaaagggtatcctctgggaaggacagggccagaccttcctctgaacgtgcagggtttggacaccccaagcctgctgagtcaaccctttactgcacgtccttgtgcaaatgagaaggcgcaccaggaagtgtaatcgctttcccaagtaacacagttcttgaggccagtaaacaataaggccacagatactcccaatgcatatttaggaagggtgcagtgtaggatgccttgaggttttccatgagcattgctgaatactcttaaaatccagagacctgtgtcagccggggtattgtttcccgaggctagatataaggctgacatagtcaaacttgctggctacctctcaacacagcctgggcccaggtgcgcacggtcctaaaacaaagaagtacgagctactcttttgtagtagaggaggcttctaagaaagtaaaatataaatgactgtattggcattttcagcatctgttgtgaatctagtagttcccacaatgggagaccaccacacacctgtgcagggcagggccgatgcttcacacctggagaactgaaccaggtgccagtgggaactgggcggacagggacggcagcctcactggggctttagaatccagagaagcccatcaggccaagggaagggagtcccagtccccaggcctcatgtggggctgtggtcaaggcacaccctggagctcaagggtgaagggtacagactttgggatgggaagtgtctggctttcaatccctcctactccacccccaagctgcacagccctgtgccatggcttcccctctttagccacagctttcatctctaaaatgagtgtaataataataataatacctgtgtcgtttttctgagaaataaatgaagtagactgcatgccaatgtggaagacagccgtgctgggagggtcgtctgccttcagtcagccctacgcggccccttggacccaggcctcagcagcgtaagaccaaggccctgagtgctcacaggagatggtccagccagcctcaggcctgttgggcagctgcccaggctcagacagggcatagctgctcgggcagtgaggacaggtggttggagcttttctccagacacaggtgcagtgaaggcctgggttactatgaagcatctaccgaggggcaggtctcagggcctccaggacctgagctcttccctggtgcgggccctggagctggtgtccatcgaagactacggggcacacgccctgggaggtggagaattagccccgctccgtcatgctcctgtgtgtgtggtgcgtgtgacttccttttaaagagaagagtgtgcggaggggaagcttggcgggcatgacctccaccaggtggacaaggtcagcatggtcagtgacaagtcacatcgacagcactgcccttgactgcctgtgacaggcatagagctcatctttggggtcctcctccccgaaacccacagccccagtccgatcttgagaaaaaacatcagacaaaaccctcctccaaacagccaaggtcattagaaaccaggaacgtctgagaaacggtcacagccta

SEQ ID NO: 992 - DNA, 3485 bp, Homo Sapiens
acttagatatgcagctgaaggggttcctgggtttatttctcctgagaactggcatgggctctgagttttgccattcctggcttcggtcctagcattctaagctgcctgaccttgggcatttgtcaacctgtctgaaccttagtatcctttcctctctgtagagtgggaagagatggagtctgtgaagcgcctggtgcaagctgtactaatacacctaacaatgagctcctccctccctgcctccttgcctccctgcctccctccctcccatggggaggccagaatctggctgcttgctgccacctagtggctctttggggtcatcttccctcataggaaccacagatccagtagcctagagcagaaagggaaggaagattcaacctaggggtgtttatgtttaccgtgtgtctggcactcgtggagatagtgcatgggactacataagtaagacagcatcgaagaggtgtcttggagtgtggttaggagcgagggctctggagtcagacaagctacagactagctgagtgaccttggggcaagttatttcatttcactgtgcctcagtttccccatctgtaaaatttgtataacgataacctacctcgcgtatctacagtgcctagcatagtgccccacataaatgtgttcactaaatgtacgtcgttattaatcataggagcttgcagtctcactagggccgactggaaaactattaagtgatcctcaaagccacaggcgctcagagactggagagatcaaggtgcagaagactcagggaagggtagtcttgagggcagctgcccttaaagggtgggcagcatttagtgaagcagatggagggaagttgaccggcatcccagatgtggggaagaggccagcagcctagtctcctccacggcccagcccccactgtcttaccaaagaacagctttaaccaaacccctctgggcatcaggaccaccgctacacctcttgccaggctgcagagctatgcagtctggaggcccagctctcgtcagaagctggggcatgggctctaggggaacctggggtcggatgagcccctgagcaggtggcaggtgcctacatgtcccagtgtgggttcgtgtttgtgtaaggctctcctgcccccacccccaggcaccagcacagcctttgccttcactctctcccctcccctgtccctgggggattgaataagggaagctggggttggccgtccttctagcttgattggcagcaccagcgctgtgacggaaggatgtgttgtgccagcagcctcttggccgcaggacaaatgcacatttaaagagataacctttttgtgtcctggctgggaaagaggtcagtgcagatgtttttgggtccaggtgttggctgtgagttttcctttcctctatgaactgacctcagcagcctagtggacagtcacctccttacaggtgtaaaatccaagccagtcaaccatagcaggtggcagacttagctgccttccctgtggtgtggtgcagaccatgacccttgaggcaaatgggtgagctggccccacctcgcctgcagcctcctctgaggctcccctgctgcctccccactagccgccctgaatcacctacttcccagcacccccagcccgtggttctcatcccgtcttccatctgtgatctggcactcattcttccagagccaaagaggaatcccctcttctcatgcagaagacagtcatgcctgcccttgtgtgtcaaaagcattgcatttatgccctgttagaacccctgtcacaagcatggtgcctgaacacaggtgcctctgtggtctcttctcatcctcacccaatgggtactatgctagccccattttacagatgaggcaaacgtggcacggagagctccactaacttgcctggatgattcatgcatccatccattcacttagcaaatacttatttaacttctgctttgtgctagctagtggggatgtggcagtggggatgtggcagtggggatgtggcatggggatgtggcagtgaggaagacgacagacaggctccttgggaagcagagtaagcaagtgaggagacaggcgggcgtggtgaggctgcgcaggcgctgagatcgagttgctgggggaggcctctctgaggtggtggggcttgagttgattctgaaggacaagaagagccagccctgggggtctgggggaatggtattccaagtggagggaacagcaggtgctgggggcagggaggtgacagatgtgtcccaggtacagagaacagagtgaacaggagagaggagggggccagggcattccaggtggggaaaggcagcaggtggcccggtggtaccacctcttttggcgagggctttggaccttacccggtgtgatgggaagtcctggaagtgtgttaagcaggggagtctttttgatcagattttctagaaaacgacagtgggctgctgtggacctcagagaggcatgtgtgatagtgtgtttcgggctcttcccacgaaactcggctctgcacagtgagacctcatttcctggttctgtttgatgagtgagcgaatgcacatggcaggcggtcatgtcccttgggcctgtgaggtgaggaagggtccctgagccctgtggggatagagactcttccaccattctgacatgatccgagttagcaggcagcactgtccagatggaaatggggatgggagacagaccatctctctcagcgggtccagccatgagccagcagactgtttcccattggcccccatctttcagagtgggatgatctttctaacaaagaaacccacacaggaatttggtgtgtgtgtgcgtgtgtgtattacctttcaggatggaagccggtggggtgtggagcgaggggctggcatggttggcctcgcccagctcctgtaccctgtgtgtgcctagagcatgcacctgctccctctgctgggctgagactcagaggacactgggcaggtggtggggggtaggagggtcgtggctgtgttgggtggggccacatcaggtgtgtggcacagagggggagggggagggggagtggcagtgtgttccacccagcagtccctgtgtttgacctcttcgtacactctctgttgtattagctctcagaatgaaaacgagatacttttccccaatctatgtacgttgttcttaagaatgtacacttggccaggtgcagtggctcacgcctgtaatcccagcactttgggaggccaatgtgggtggatcacctgaggtcaggagttcaagaccagcctggccaacatggcgaaaccccatctctactaaaaatacaaaaatcacctgggtgtggtggtgggcacctgtaatcccagctactagggagactgaggcaggagaattgcttgaacccaggaggtggaggttgcagtgagccgagaccgcgccactgcactccagcctgggcaacaagaacgaaactctgtctcccaaag

SEQ ID NO: 993 - DNA, 1967 bp, Homo Sapiens
tgtcctggctgcgtttctggggcccgtggcccctccttacgtggcagctattgtgtctcctagtggcaattattgtgtctactagtcaaggaggctccacatctggtgttggtcaaggacccgctccagctgacctctaacccctggggtcacctgagccctggtcttcccgctcctcccatctcccatgggaatctcctcatgcacctgctcccccagcagccccaggggactttgattacctggggccctctgcttcctcacaggtgtcagccctgccccaggaatcaaatgaaaatttggttccattcctggatacggattcaggtggagagctgcccctggggccagagcagttcttggctgcacatcaggatttaaatgacaagcggactccacaagaaaggctcccagaggtggttccactgctggacagggatcagaaccagaccctagttcagcttcctcgcctcaaaagtaagtttcaaactgcagatctagatcgggctgcaggtcatcaggcagatgaaatacttgttccgctagacagtaaggtttcaaaaccaaccaaatttgttgtttttccaaagaacttgaagaaagatctagctgagcgttggagccttgctaagattgtcgggattccacaccaattatacaaacctcagcgtcagaaacagactttgcagatgaatatttgagtatggacacactgtattccggcagcctgcctccagaactccgggtgaatgcagatgagcctccagggcctcctgagcaagttggactttctcaattccatctagagcctgaaactcaaaatccagagacccttgaagacatccagtcctcttcactccaggaagaaaccccagcacagcttccactgctccctcaggaggtagaaccttcaacccagcaggaggccccagctctgcctccagagtcctctatggagagtctagctcaaactccactgaatcatgaagtgacagttcaacctccaggttgctcattacaactttcccaacgttacagtcaaacctgcagatgtggaagttaccatgacttcagagcccaaaaatgagacagaatcttcccaagcccagcaggaggccccaattcagcctccagaggaggttgaatcttctacagccctgacgactacagctcctcctccagaacaccctgaggtgttcaccttcagacaagggtcaggctcagctttcacacctgaccgaagccacagttcaacctctggacctggagcttagcataactacagagcctactacagaggttaaaccatctccaaccacggaggaaacctcagctcagcctctagacccggggcttgccataactccagaacctactacagagattggacattccacagccctggagaagactagagctcctcatccagaccaggttcagactctgcatcgaagcctgactgaagtcacaggtccacctacaaagttagaatcttcgcaggattcattggtgcagtctgaaactgcaccagaggaacagaaggcctccacaggcaccaacatatgtgagctctgcacctgcggagatgagactctgtcatgtgttggtctcagcccaaagcagaggctccgccaagtgcctgtgccagagccctacacctacaatggcatcttcaccaccttaaatttccaaggaaactatatttcatacattgatggaaatgtatggaaagcatacagttggaccgagaaactaattctcagtgaaaattatttgactgaattacctaaggattcatttgaaggcctgctatccctccagtatttgcaataaaatacggtatattgaaagacaaacatttgaatcactaccatttttgcagtatacaaatctgggctgcaatttaattacagaactgagccttggaacatttcaggcctggcacggaatgcagtttttacacaact

SEQ ID NO: 994 - DNA, 1712 bp, Homo Sapiens
taattctcctctttgcttttatctcctgacccactgagacaaatcagctcattaagcagtgattcccggagctcagacagcagggagagtgcctggaaagatggggcaagaatgcggagcagcttctcagccccttggagctgacaactttccctcaaatgtcctgtaagaaggcctccttaggagtggaccactagatggcttggaaggggccccaataggttggagcacccctgggtcggaaagaggagttcatgttcaagtcttctcccatcacttactgccaggcccaggatagatgaatgctgatgttcagaataggcaactgtccttttctgggactggtctccttctgggcccaattctccatggggcctctggggctaattacattgccgctagatcagatcattttcaaggctctggtggacacctctttctgacagttgaagggacagctggtatagcccagggtgccaaggtgagcttgaaaacaaacctctctgtggggctggatggccctaggaggttcttcccatccctggtgagaaggcaagggctattgcaaggagcagactgacatgtggatggtgttggagggcagcctgctgacccattgctccctcccatctctctctggctctgatcaccctcccccacttccctttctcttgcctggctccttgctctccctgaggccccctctgaagcagtaggagggagatcaggctctaaataaatccaacggctcatctccctcctctccttcccccgtgccaggcaagagaggagctgcagcctgcccacacactcactaggcaaggggggcaccaccagggcactgtgccaactcctggcagctccaaagtactgaaactctggctattttggcgtagcagggtacaggaaaggtaagaccctagatcatgcttggcagggcagccctggcctccccaagtaatactggagcactagagatgagtgagcctggaggacttgggagtaatggagagggggttccattctgagcacaactcattaaatatttaggaagagatcctgtgattcccatcccagggtgagaggtcaggtaagccagatgcctcaggcgttatgattactaaattaggccgccagcggtgcctcacacctgtaatcccagcactttgggtggccgaggtagatcacttgaggtcaggagttggagaccagcctggccaatatggtgaaaccctgtgtctactaaaaatataaaaattagcccagcatggtggcacatgcctgtagtcccaactactcaggaggctggggcagtagaattgcttgaacccgggaggcagaggttgcagtgagccgacatcgcaccattacattccagcctgggcatcacagtgaaactccatctcaaaaaaaaaaaaaaaattactaaattaaaccaggcatagagactcatgcctataatcccaatgctttgggaggctaaggtaggaagatggcttaagcccaggagtttgagaccagcctaggcaacatagcaagatcctgtctctacaaaaaactagtaggcatggtagcgcatgcctgtagtcgtagctactcaggagacaggaggatcgcttgagcccaggagttcaagcctgcagtgagctacgattgtgccactacactccagcctgggtgacagagcaagacctgtctctaagtaaataaat

SEQ ID NO: 995 - DNA, 1292 bp, Homo Sapiens
ccacactgtgaccttctgttactattacaacagatggttcccagtgagcacaaggtgatatacttcctctgtccacgtgggcccaggtaaccagtccagaccccacaccttgttcccattttaaggatgagcaaactgaggctctgaaaagccccacaccagcatgcagcgtggaccaaaggcacaggaggcaggagccagagcctctcggcaggtggtgcacagtgggaagaattcagagctctccatggcccacctctatgttttgccttgtaaatgatgatgacatcttctctaaagactttccctcttgggagaatatcgtcaatgctgacactgacatgaatttgtctgatggtgagggcggtaggggcacacagccaagttcctggagagcaggggcagcacaggacacatctctctacccacagcgctcaccacagaggctctgccacattcataaggagggagagaagaggggatgggccaatcctttgcccaagatcaagtctttagggctcaggttcattcggaagttagggtaagaggtgaacttcagaccagtactcgattggagactagaaatgagaatagggtttaagattcatattaaggaagggatgatgattcgagctgtacttcagattgatatggattcaagtctagattctggtgagagttctgtttaaggtggactctagggactaggttattgttagccctaaggctcaagctaaaatgcatcttagcattaggtgtgtctgaaaatcctggggcttgcagcaaggttcagtgctgtgggctggggcagaagctctgcaggtgacaggcctgacagccagctggagaggtaggtgtggccaggcagccagggccagataggctctgaggccagcaccgtggacagctccaagggaagcaccttagtaagccaagaagccactgagatgttcccagctgccaacactgaccccgggaagaccaagatggcaccatatcctccagggagttgggggtcttggccagacaatctcctctttcccttcaatattgccagatgccatgtcacaagaagaggtgctacggagcagcgacaggctgaaggaaatcagatactgcccacactcagccccatgtcctgcaggtcatagataggcaggacttccaaagcataccaacccagcccctcagaataggggacaaggtcaccaatgtgaactgaccacctactttgtgccagacctagtcaacattatctcattgcatcataaaaccagcccgagtgtagtagg

SEQ ID NO: 996 - DNA, 2378 bp, Homo Sapiens
caagtacttatttttcttgtccataatctgtgaatcctgctgaaatcagctagactttgctccaggatgagggattggtccaattctgttccatctttccacgcatctttcatcaggttattaggaaagagtacacttcactggctgctctactgggaggctttatctccattaagtgaaccacagagaaaaaagaagagaagagttttacttctgtcatctggtgatacattgctttggtgaatacaagaaaccacaggataagcaacagggctctttggtaaattccacaggctctcctgatagggcagccaagtcttttcccagtagccagccctttgcactaaaacatgtggattttatttctatggatgttgtgagtgtggacctaaacttctctaagagaacttgtatttctcaagcctaaagatgtattacatttttttgtatttgtatttgatccacataaagaaggggaaaaaaatttgtgtgtgtggatagcattccaagaaggaactctagccccaggaaagctgctatttctgctcttctccagctacctgccaacaatttgtcctcaaaagaggctctttctgactatttacagatctgtcacttacagattggcaattttcatgcatttcattctgctttgctttacttcatactggcatcatctttatcagaaggatatataaatatagatatatggatatcgtttgtcttccctttctccacattaacatattccatgagtgcaggaagtgaaatggcatctttatttcattactctctggtccataatacattccctggcacaaagggaacacttaaatacttaactatcaaaataaaaaaataaataaaatcactggatatggaacatgctcattattaaatgtttttctagcactctaccagaaaactatcagccactgttccaccacggtgctttccctctcttgcttcttgcacctcctctgatgttcttcctttttgttagttccagttccacatcacagtcacgcaaatgtaagagaatggagaatgcagtcctttctcagctgggcacaaagtaatgctgagtgaaacagaagttgttattgtggaagaggtaggtgcctgaactgggtgtctcctgataacctttctccccattgctctgtgtcccatattcagagtagactcaccaaagttctcctttgctttctagcttccagtcgattttgaaaaattcagagcatgggcaagacatagcagaaaaagaaattgtgattgattggagtatttattttcctggcttcctccatgtggagttgctaaagaccggctgcatctttcagctgcaatcacagctcctgcctggcagccttctcggtctccaggaccccgtatctgaccagtttccaactcatcttcacttgggagttggctgtgaagagacaggcaagtctcttcatcaagcaggaggaaaacatacagcgggaaggaaatatgaaacgacctcatttctagtttaaccctttggatctcctttgtaccacgtctccttggatgagaagagtctccctctcatcagcacattaaggaatctaccatacaacttcagtcttcagtattgccaaagactagtaacctatgctccaagagttaatgactataagtgcatcactgaagcctgtagaaaaaggccctgatgcctcctgccctaataatttgtatgtgtttatttttttccatttgcaagatagaaaacaaactggtctggttacaactaaccatagatttgcaccaactattagaaatggatttttttatcatcagttttttttcatgttgtgttcatgctcatccctcagatatttatgtttcagtcttgggtaatttatttctatttactttaaatttccttatgaaatagtttcaattatatcacaggttgttataaatagttggtgttaaattatatagaggtattacattgctacttaatgcctgcatttgatgtggttattacaatggtgacgctatagatcaccgtagcaacaaaaacaagaattcatagcctgtttcaaacataagaggctgaaaatatttcatagttattgaaagctgaggtatgaagcaatttaaacatttagctgctgagtaattgggatctagaaatacatcaacctagatactgaatttttagaagagtcaatattgaataatagcacaggtcatttacttttaattgtctagccatctgaatgcttgagcatgtgaacagtaacttcacccatgtagcttatttatctatgtttcataaacaggctaccttctgagagttaattgtgtgaacaggaaaagtcactacctaataaattgatgttcac

SEQ ID NO: 997 - DNA, 1037 bp, Homo Sapiens
ctgtagtccaggttggagtgcagtggcgtgatctcagctcactggaacctccgcctcctcaattctcctgcctcagcctcccgagtagctgggattacaggcgtccaccaccacatcaagctaatttttgtatttttagtagagacggaatttcaccatgttggccagactggtctcgagctcctgacctcaagtgatgtaccctccttggcctcccaaagtgctgggattacaggcatgagccaccgtgctggccagaactttgctttaattgttatttaaaactagcaaacattgctttttcttccaataacatttccttctttctttactctgaaaccctgtgattcaggtttagccagttagacaaccccattcctttggccaaaagtgattagttcaggaatgggaaaccatccaagttggaccaattagagtaaatcctgtggcttctgtaaaaacaactgagaaaatctactcttgttttcctgctcaacttgagtttggagagatgaagacctgggttcctagcaagtcatactgccacctcatggagcctgaaaacaaaatcaaagtgaaagaaagtacagctgagagctggagaaatgccaggttctgttgagatcacttgatgccttgaatctacctgtgtatcccttatcctggaaggtagtcaatacattctgttttgctgaagacaactaaagctgtgtttgtaatcatgtacaactgacaaattccagaatatacattaagcataaatgtgacgtccaagatatatccatctaggcctactttataaagaatattttaaaatttaggaatgatattaaattttatcaaatgtttcttttggcttctttagagattactgtttatttttattttcccccattaatataaaagttgtgctatagacttcccaatattttgttcttgaagttttgttcactgctgtttccctagtattatacatatatagtagcatatatagtaggccctcaataaaatattcagtgaatgaattaactgctgta

SEQ ID NO: 998 - DNA, 1132 bp, Homo Sapiens
cgacagatatgcagctacacaatgtttttactatcttgagttctttttacccagattccatagctaaatccagatgtattaataggtagagactacttcagaaaggatgagactattttcttgcttaattatccacacagtaattcagaaatgtatattgaacactttttatatgccaggcactgctgggcactggaaatataaaagtaagcaaaaatgaaaaactatcctgtcctcctgaggcttagcatctaagggagacaggcattagtcaaccccgtgtggctgtgaatcagccatgatgctgagtgctacaagagaggactgtgcggctgggagggcttataacaggatttgacctagttagggaagatctgaggaagtgatgaaagaatggaaatcaatatgtaagagctcacaagtcagagtgagatgtttcttcctatactgcctgcttctaatgagcatccacttcattgaaccacctcttcattgagccaaacctaccatacagggatacattctctggaggaaagttgagcaactattgcatttgggacattagagtatgggtgggctgacaggtatgtgtatgtttattatccaagacagccaaggtgtttatcctgttacaacatcccagaggacagaggctcttatttgtgactcttttttcttacctgtaacaccagaggcataacgtacatcataatgctgcatcttgttgacgcttcaatgctcacaattcaaaggtgatttctgaagcactttgttacactggggacagctcctaaatcctcccactctttttttgcctcaccttggagtcttgggctctgttgatcactgactctgccaggtctttcagcaggcaagacagctcagttaaattgagtttggactccactgtagtgcatgcatgagacagcacccccaatccccaacacccacacacaaactttaaatatttgtaacagaattgttaccattaatattgcttaaaggctaacacattagccagaacctagatgtcttctggaaattttttattgcaatgttacttcatctacataaagttgtccaatcactgaaacctccaactgaaataaatggtaagctttttgttctcaat

SEQ ID NO: 999 - DNA, 2820 bp, Homo Sapiens
agtactgcagtgtgcggcgcatggctgcgagggcctgccgaggggcgggcgcgagtcggaaagacaccgaccagggaatgggcgacgaggcttgccttaattcggaggaaacccaggacttgagagagccatacaatttgaaagacgaagcaccgtgaaatgcagaaagttgtggttcggatagctcagctgattaatttcatgttgccacagtttgtcagtgagttttgcctttttattttctcagttcctttaaaggcagtgcattcggtacttacctgataatgtgaaaaacgcgagctttagaaaaccgaataggtgtacatggtttactgtaatgacttgttctccaaagtaagagtaccaaacgctggaagcaaatagtatttcagtcattcgaagagtagtgcccaagcatttaacattgaagctgttaaaagggcaaagtaggccccaattttagatctaagccatcaactttatggaacagtcctaagggctttttgaaaaggagatttaaaaacacatttcagaggtggtagctgagttgaagaagtgaggaaagacttggatagggaggaaatagtttgacactgaaggatgttaggaagtagggattccttgtgcaacttaagagttttgtaaataagacggcttggccttgtgtcaagatacatcaattggttatagcttagtgcttggaggcccacattataggagtagactagttctccctccgccccgcccctggaaaatctatttcaagaccataaaccacattgctaatccttggaaatgcagaaggtggttaggtttaaaatgtggctttaaaatggtcctaacagaaacgtattgatgttactattcagaatatctgcccagtatacgaggaagaaaaaggttaaacctaaaacactaaaaattcatagttcatattcagttattagcctatgaagatttggtacagccttcatccttcattttagacaaataacaaatctatatggtttataagtgtattttgtaaggagttatatatatctatatatgtgtgtctccacccatctgaacctgacctgcaaaccaagaggttcttgtttatttccgatagttttggtagtcttgttaaaggcatttgattcaaaatccaaatttgcatacatttttccaactggatagaggaggcaggaatatatttgaatattgttctcacttattttgtccctcttcttattctttaaaaaaaaattaagcctgtcaattttagcagtgggggttgcatatcaattttagtgatactaatgttaataagttctgataacccactaccattggaccacccccactcttattcctaaaacgaatctgaaaataattagcttgctttaacgggaagaatgaatgttagggaaccaccctgctgaactccattttgctgtcggctctgaataaagctattttatccagaaaagctatctctggacaaatattttgaatagttcagtaaccgcaataggtttctgctagaaccattttgaagccaccctttaaccctaaccaccttatgtatttccaaggattggcgatgtagtttatggttttgggatagatttttctgggggaggggagaacctcccttctagctctctgcagattatcagagccgccactgcagggatttgctcccgtgggcctatatgtctccccagataccttcctaaaactattagcttttatctgtctgtgtattcccctgttgtgaatggggaagtatttgagggcttgtttttttaggttcttgataataaatacctcaggtttcacagagtaatcaaactaaaagaaaacttcttttttatttcattttatttttttgaccgaaactccatctccaaaaaaaaaaaagggtatattgttatgtgatattgggacatccgaacattttgttgtcataggagtttgtccttgccagcattaataaactgcttccttagctgtaaacatcttatgaccatgggttgtatctggtaaggaataggctttgctagtctaaatttagaattgattttgaaattgtgttatcctagcccttttttctttttttgagacacagttttgtttttgtcacccaggcaggggtgcaatggcgtgatcttggcgcactgcaacctctgcctcgtgggttcaagcgattctcctgtctcagcctcccaagtagcagagattacaggcacctgccacaatgcccagattatttttgtatttttagtagagaagggatttcacaatgttggccagactagtctcgaacttctgacctcaggtgatccgcccacctcggcctcccaaagtgctggaattacaggcgtgagccaccgtacgtggccatgttaccctaactcttatgttcctgtttccctaacataatacctcctttactcttctcctctactactctaatcttaaggggagatgaagggtgaaggtcattttttgtaacttcttcctgctgacagtggacgttgatctttgggacaggattctcttataagaatttgcagttggtgggctgggcacggtggctcatgcctgtaatcccagcactctgggaggctgaggcaggcggatcacgaagtcaggagatcgagaccatcctggctaacacggtgaaaccccatctctactaaaaatacaaaaaattagccaggtgtggtggtgggcacctgtagtcccagctactcgggaggccgaggcaggagaatggtgtgaacctgggaggcggagcttgcagtgaggcgagatcatgccactgcactccag

SEQ ID NO: 1000 - DNA, 1181 bp, Homo Sapiens
ggcgtggtggtgcgctcctgtagtcccagctacttgggaggctgaggcaggaaaatcgcttgaacccaggaggcggaggttgcagtgagccgagatcgcaccactgcactccaggctgggcaacagagcgagattccgtctcaaaaaaaaaaaaaaaaaagaaaaagaaaatatagagatggcaaatggcacataacaagatggtcaatatcaattcctagtcactagaaaataggcattaaaagtgcaagataccaccataaacctatcggagaggcaagatgtcaatgccggactatgctgagtgctggagatgatgtggaggaatgggagcgttcatatgcactggtgaaaacgtcaaatggtaccaccttgtaaaactactggatagtttccaaaaaagttaaatatactcctgccatgccatccaaccattccgccatttatccacaagaaaggaacgacatgcccatataaagacttatacgcaaacacttacaggtgctttatttgtcatggacaaaaactggaaacacccaaatgtccatcaaataggtgaataaacaaattgaggtatatcaaacaatggaatacgtctcagcaataaaaggaatgaaaggaataaaaggaataaactactgatacgcacagcttgcagtgagccgagatcacgccactgcactccagcctgggagacagggtgagattccatctcaaaaaaaaaaaaaatgttaatagctccccagatcgatttatagatttaataaaatcataagcaaaatcccagcaggtttctgttgttgctggtctgttactgaaatcgacaaactgattcttaaatgtatgcggaaatgcaaaaaccaataaaatcttgaacagcaaacctggaggcctcacgttaccgaatattgaattattttaaatctagtgtggcactggcattaggacaaatagaccgatgaggaaatacattgtgctaggaccattggatctctatatggaaaaaattttaaccatctccctcataccatgcacgaaatagattctagatgattctacatctagccatgacaggcaaaccattcctagaaaataacataaaagattcatgacctggccgggcgtggtggctcacgcctgtaatcccagcactttgggaggccaaggcaggcagatcacct

SEQ ID NO: 1001 - DNA, 2648 bp, Homo Sapiens
gcttcaaatgtcagacataactaatctctttttcccttcttcccttttctagcaaacttccagaaacaaaacagacaaaactttgtgatgataaatatcacagttgccacacaggccagcagaaacccaatcacatccaaagagtggtactggaaccaggcatatgagtacatgctcagcatcatgagccattttaagtgctgtaagaaagactatgaaaatgcgatgtgagaattatcatctgtaagttcctaaaaaggaattttatcaaggcacctatgatgttgagacaagttcatccagaaagctttactgatttgcttgtcataaggcagacatcatctgctctaatagttttagttaaagatgtaggataaacttcaaatttaagagtggatgcatcattgggatcaaaaagaatggaagctgaagatgccagtacagtcacctcatgacctctctgaacaagctctttcaggattgtcttcatattcatccaatggctgtattctgcggcccacaccagcacttttccacaactcccagagctaaagtaacaactgagatgtatcagcagaagaactgaagtccatttcagagtcatcctggtgcaatgcgatcattcttttccagtcactgtttctttctcatacttatatacagagataaatcaatcaagttaaaatataactcctccaatccaaagtaaatatattataggagcatcctgagtacatggatggcaaggagacaaacaaagttcgattacttcatatttactcaaggatgttttatgtttcttttatgtttatattcactgtcatccacctaagattaatgaccttgcaagtaccctgttttatgtaacctactttataatagtgtcaagaacagtggcaagtgagagagtcctgcagagcccttgacacagaataagagatgaaatgattgtacaatgcaaacagcatttttgaatatcgtggttcaatgaatatcttgtaaatctttgttggagtataattcaaataccatatgattcatcaattagtatttaaaattaagtatttcctagtaaattcacagacttgtgcatccaacgtaacaatcagttttatctaaaaaaacaaaaaactcctgtgtattagttctcatctccccaccaaatttctgcatccaccctgcactaggcaaccagtaatctaatttctgcctctagaaacacacctattcaggatctttttaaaagtaaacggaacaatatagtatgtggtcttttgtggctggcttcttttatttagtttaatgtttttaaaggaccatccgtagaatagtgtaaataaggacttcatttttattgccaaattgtatcagatgctatttataaacacaatttatttattcatttataagttgatagatattgattttcttccacttttggccattatgaatagcattgattaacattgatgtgcatgaattctgtggacatgtttttatttttcttggggatatgcctagaaaggcaattactgaattatgtggtaaatgtaaatataaccttttgaggaattgctagactttttcagagtgagtgaataattttctattctcaccaacaatgtatgagggtttcaatgtctccacaaccttgcccacccttgtctttcacataaccaaaaaagttattttttattttaatttataaacacactccaacagacccaaaaaaggaaggtttccttccacatattggagggaaaagtgaataaattaaataataacttacctaatacttcactgtaaaactaatctcacttctttttgttaaaaatctcaaatgcaaagtcaaaatgaagaaaatgcaacagatttttcacctttctacaaatgtgttttggtactaagttctgatatgacaacagttacatcagaaggaggtaatgtaagtcctccacagagttcttggtacatactgccagttgtaaatggatgatagtagaccaaatgtataacaaatgtttaacagactaagctgttcagataacagctcactactgagaactgacatctgcaagaatgacataaattctggaatcttgttgttcctcataattttcttgttcaaaacagcatactcaatgagcttttgaacagtatcagaacattcatgatatgtagtttttgcatctttgaatcatatgccaacaatgtactctttggaaacttatatgtccacatcttgatcaatttcataaatatgaaatcaagttccttctgagtaaaagatgtgggataaacctcaaatttaacagcagattgttggaatcaatgaggatggaagctgaaggtgacaagcacagttacctcatggtgttctgagcaagttcatcaagtatcaacattaaattgatacaaagactgtatttcatcggccacaccagcacattctcgcaggattcagggctaaaatacaactgtcagcataagaaacaaaaaagcccatttcttagacaacttgttaaaatgctatctttctttataactttctctaacttggtacatatcaatatcaatcaatgtcacaatgatttaagtattgacaatagaggttttggaaagcaagtgaataaagaaaaggatgaatg

SEQ ID NO: 1002 - DNA, 7017 bp, Homo Sapiens
agaaagagtgctttcgccgtgggtgcagagggtgggcccgccgggttgggtggggggcgtgtgatgacggtaatggcgacgagatgctcaactcacgcggcctcttttaatcctcacagcagctctgcgtggagaaactacagtaacgtgttaccacgttaaggcgggaagctgaggcatgggagtatttagtaacgttcccgggccgtagagctgcggtgtgcggccgcctgatccacctgatctgtatgactcccgtactcaaccagcctatgtttcctaccagcgaatttttttttttttttttttttttttctttttttgagacaatctggctctgtggctcaggctggaatgcagtggtgcgatctcggctcactgcagcctcgacctcccaggctcgggtgatcctcacttctcagcctcccgagcagctggaaccacagtcgcctgccaccaccaggctcggctaatttttgtattttttgtagagacggggtctcgccatgttgcccaggctggtctggaactcctggactcaggcgatcctcctgcctcggcctgccaaagtgctgggattacaggcgtgagccaccacgccgggcctttccccgggaatgctgtggtagagggacccgcagaggccccgaggctgcctgcatgtgtgtgttgggaggatctgcgctgagggtaggtaggagttgggcaggccaggacaggaaggaggcagagggcatgtcccatgcccgtgcagagggaggacacgcatggtagaccaggacgaggacaagggcaggctcagtgtgtgcaaaggggacagtggtttgggatttgcatgcagatgcccgagcctccaaaggacctgtgggccacagggagaccctgggggagttcaagctgaggagtggagagggctttgggctggtcagcaggtgctcagaggagaggggctggccctagagagaagggaggtcttgggatggtggcccacacctgaccctggcccttcatcaggtgattcctgcgtggatgcctgcggggattcctgcgtggattggggaagtcctgcagcattacagaattgttacccaacgccagggccttggtccagagtcctgttgctagatgcacagaaagcaaatcactgagatgtaagtattgccagggaagaaggctttattcaggtgacatcagccagagagacaggagacgaaactcaggtccacccctgtccctcttcccgactaaagttgtaggttgatatagtctaaaaagaaagcaggagccaaggaagaggaggtggcccgcaggccgcaggagcagcctctcattgtccaaatgtaggtttctcaagcatccggcttgttaggaaattgggccagtttcagaatcatcagcttgttcaaaagtgggacttgggaggtgagaagggttgtcaggcaggaaaccctgcattctgctttggctgagtggatggggcccaggaggatgagcagcatggggaagagtatgactcgtagtgggcaccatgaggataaagagttacaagctcctctggcatgggctggagggaagggagaccctatcgcataaccacagccccacctgcctggagagaagagggaggcggccccgctccgtgccaccccactgagaaagataggacacctggagctccagctcagcaatccctcaatccctcaatccttcatttcatccttgcaacagtcccaggaggttttttttttttttttttttaaggcagagcctccttctgtcacccaggccggagttcagtgacgcaatctcagctcacggcaacctccacctcccgggttcaagcgattctcctgccttagcctcctgagtagctgggattacaggcatgcgccaccacgccaggctaatttttgtatttttagtagagacggggtttcgccatgttagccaggctgatcttgaactcctgatttcaggtgatccgcctgcctcggcctcccaaagtgctgggattacaggtgtgagccgcctcacccagccaggaggtatcaatggttaattctctccactgaacaaatggaaaaactgagactcagagagggcaggaatggccttggatgcagtgattccatggtgtggcctgagtcagatgccagggcccctcggacgcccgctccacaggagaggggtgactcagaggtgccgtgtctgtcctcttctcctgaatatgggtggttggtgcgggggcagggggtgagtcactgcactgtttcccatgcctcccacctcggctctcatggttgggagcggctgagggaggaggctgaggcagggagagggaagacccaggagggaggaggcaggcgctgctttgaggggtgccctggagccttggcaatccttttcctcctcgggcccgggagcccaggccccgtctccaccagccgcaggcgacagctgtcatggtggtctacagcctgggcctggggaagggctcagagcagtgtgcagctgcagccttgggcctccatggccaccagcagcatcctcaggcggcgcggcgattgcggcgggtagcggagggcgttgagcttctccatccccgggctgcgcaggaggcaggcgcgatggtgggagaaggtgtcgaaggagaacttgccatggtaccggcccatcccactggcacctgtacagtggcacagaacacaggtggtcaggcgctgggggtctcctagtcacagacagtggggcctaggcgggctacttctcccctctgagcctcagtttccccatctgtccagtgggctgatcatgaggcactgtgtgtaaagggcttggccccgagcttggcaccagctcagtaagccctggggatgccagatgccagggcaagataggcgggtggtggtcaagggcatggattccagagtcagactgccgggggttaaactctggccctgctgcaaacaatccatgtcaccttggactgtgcctcagtctcctctgtcgtggggtgacaagggtacctccctcctaaggttgtggtggggattgaggggatgttgagacccctggacccagtaggtgctatgtgcagtgaactctcctcagcgtctaggttgggaggcagacgaggccccaggccagggcgttcagagcacagcctgggtggagtggggttggctggggggcttcctgcagtgagtgagctccaaggatatgcagttaataagacgaagagagtgggtgggggcaagagggacccaggcttggggagccttagaggtgggtgccatgcggtgtgttagggacctgggcagagctcaggctgtgggagcagcaggtggggaagccggggtggggccacggccaccaagaagggtcagctcgggggcctgggagctgggggaggctttcttgagggagcagcagggtcagatgtgcccacagacagccccgactctcctccagggcagggaggcgggttgaggaggctggggctggggctggggaggcagctaggtggggtcgggggcagccgcccaaactcgagccgagccaggacagcagcacaggcactgttgtgcccctggctgccctccaggaagggcatggacccacctgaggcagcttgcctggccctgccatcgttcactgtggtgctgagtgtggacaggtggcgggactgcctgtcacctgctcggggcctactgttctctgaggaggaagtgggctcagaaaggggagatgtcacctgggccacagggccttcagcgtgttgctaggaccatctctgaggcttcctgactcagaggccaggactctgcagtggcatcggggctgctctggggggtggaggattggcactcatccgggcctctcagggtggggaggtgttgtactgagagctggaggggggatggggttagaggagcagctgccctggagtaaaggacaccggcggcattgctgctgaggggcagacaccaggtcatgctgttggggagaagagcaaatagcatcgcagtgggcagtgtgatcatagttgtgtggtatttttaaaaattcactaaattgtgtgtctgtgcagagatggtctagaaggttccaccacagacttttttttgagatggggtcttactgtgttgcccagattggactcagaccctctggggtggggagcaggatgcgggttctggggtgaggcctccttgcctgtccctctacattgaggtggggctggggtgctttggcagaaatgtatgcaggtaacactattgcaatttgaccaaatggtaacagaagggcagggtagcaggcacctacccactcctccaaaaggcaggctggccagggtcatgtgcatgaagccgtcgttcccacagaagcccccgctgctggtctgggtcagcacccgcttgaccacctgggagagaacaggatgtgcgtgaggctgccttgagccccatcaggatcctcaggacccagagcctgttccatgctggactctgtgacactgatcttgcctcagaaagggtctgaggccaccatgtcagctgaagggcctgtgatggtacaggtggggcagggggttgtgtagcagctcctcatgaagcttccaacttgggacatgtttcctggacatctgctcatgtgtggtccatgctgatggcacagactcttagggctgggggtaggggcaggaaacctagtgttgcttggggacatggagggtgtagtggcagcagggcagtactggacagtagggaggcatcccaggagaggggtgtcatgtgcctgctgagtggagggactgggagggacagaagttgttcaggcaaagagggcactgcagacagagtggaggctgaagagctgtgtggtgtgaacacagggacatgaaaacataatgatgtggtcagatttgcactttagaaacagaagcttggcccttgcttgaaggtccttgagaaggaccttcttcctcaatctgtagacttatttgaagactgaaaggaaaaaaagattggtagacactaaatagttgctgcacaaaaacttcagtatatttagttgcaatcaccgtgaacctctgatcacagctgggtcagggcttgtctgatgtggggaaagcggactgcccccagtggattcagacgtcacttcatggcatgagaccagcattacccacaatggcagtggcagcagatggaggagatggagcagaaggcagcagagggcgtcccaggtagtacgggcaagccaccttgtgcatgacttgtgtcttaggtgtgactgtgtgtcctgggatcagttctgggtggtcagaaaagtttgaagccagatgactccactgtcaaaaaacctctgtagagttttctaaaggtgaaagtatccagatgaagcagggctccttgaaggaatggctgcttctggagttggagcaggggagatacaagatgagcctggagctgcttgtagcaccagaggggaaggaggtggtcacaacccaagaggctgggacatcttacatgggcttctgagcccgagcctcagacaaaccacacgaccttggattacagcccctggagtcaaataaatatacctgagtccgtagtgacctaaataaacaattcaagagatgaatctttcttacagaattccaggaaatagatgtagatactgctgttagccaagaatacggtatccagctaagactatgcttcgtagatgaagaaataaagcctttcccagacaagcaaaggctgggggaatttatcactactagatcagtcctgcaagaaatgctcaaaggagtcttaacataaaaacaagttggtatttgccataatacacacaaaagtacaaaactcacaggccctataaaacaatcatacaaaggaggaagagaaaggtatcaaatggcaatacaacaaaattccaccaaaccacaaatggaataagaaaagaatgtataaaataactagataataactaacaatatgatagagcagcatacagcttaattacctccacctggtgagggtggggtaggcttagagacttgcttccaaataataaagaaacaaacaatagtagcttcccagggaaaccctggcagataccgtcctgacccggtagtgaaggttccactcactagccacgtgtgcatctcaggtgccccagatgtggtgtgagaggcaggctcacctctgtgggattctctcctaaaaccagtaacctttctttaatcatgagaaatacaccagatgacctgaggctggggatgttctacaggagacctgtccagcactccttaagctgagagggttattaatgcaaggtgggaccctggcttggatcctggggccgaaagaggatgtcagtggaaaaacagcaaaatccaaataaagtctagagtgtagttaatagtaaagcactgctgtcactttttttttttttttatgggtcaggagatccttccacctcagcctcccgagcagctggcattacaggtgtgcgccactatgcgcaactaatcttaaaaaaatgtttcatagagacggggttttgctatattgccagcgctggtctcaaactcatgagctcaagcaatcctcccaccttggcctcccaaagtgctgagattacaggtgtgagccaccgcgcccagccctgccatcacttttttagttttgacccatctaagcaccattaaatgggggaaattaggtgtggggtacatgggaactctctgtaccattttggcaacttttctgtaaatctaaaagtatttcccaatacaaagtttatttaaaaaaagttcaagtggccgggcacggtggctcatccctgtaatcccagcactttgggaggccgaggcaggtggatcacctgaggtcagcagttcaagactagcctgaccaatgtggcaaaaccccatctctactaaaaatacaaagaattagccgggcatagtggcacacgcctgtaatcccagctacacaggaggttgag

SEQ ID NO: 1003 - DNA, 10522 bp, Homo Sapiens
gttatctgccgacagcgtaatgcgaggcaagtgccagccgttccgcccggcatacaagcttatggagcagccccctttgaagatctccaggtagacttcacagagatgccaaagtgtggagatctgattcctagattgggactgcccttacggatcagctcagataacgggcctgcgtttgtggctgacagtacagaagatggcaaaggtatcggggatcacatggaaaccgcatgccgcctcctggtctcagagttccggaaaggtggggcggataaatcggactatccaaaatggtattactgtcttccccgctggatattaaaaacaattccacaaggggcgtcaaaccacctgccaaatttgagggaatgttatcctctcccccgccccccgtccccagatattagagacaataacacaggggtaatgtatacccactgctttattgggagtaatatcatcctctcccttcttggatattaggaacaatatcacagtgtgcgtgtacgcctgtcgcgaaattcaatgtaatgtcatcctgtgcctctgtggatatgacgaacaatatcacgggggatgtaccacttctgagatattgggagtgatatcatcctctcccctctggaagttagggacaatatcacaggggtagtgtacactctctgtgatgttgggactaatatcatcctcccgccccctggatattgaaaaccatatcacaaggggcgtgtacacacacttcgatattggtattaataccatcctctccctctttggattttcagtgcaatatttcaggtggggtatacaccacctgcaatattggaagtaatattattttctcccactgtggatatcagcaacaatatcacagggggtgtgaaaaacccctgcgacattcagagtaacatcatcgttcccctcatgaatattaagaacaatatcgtggtggggggtgtacaccccctttgatatttgacatcatcctcttcccccctggatatgaggaacaatatcaggaagggatgtacagaccctgagacatttgctgtcatataattgtctctcccctagatattaggaaaaatgtaactggggatgtgaacacccctgcgatattgggagaagtatcatcctctcccccgttggatattaggaacaatatcacaggggaggtgtactgcctctgggctattgggagcaaaattatcctctcttcccctggatattaggaagggtctcagagggggagggtgtacattccctgcgatattcaatgtaatcttatcctctccctcccagggtattaagaacaatattacaggaggggtgtacaccctctgcgatactaagagtcatatcatcctctttggctctggatattaggagcaatatcacagggctgtgtacaccccctgcgatattgggagtaatatcatcctctccacccaggaaattactaactaggtcacggggggtgtactccccctgcgatattgggagtaatgtcgtcctccctaaacctggatgttagcaacaagatcacagagggggtgtacacaccctgcgatattggaagtaatatgatcctcttcccccccaccccagatattgggaaaaatatcacagcacgggtatacatttcctacgctgttgggagtaatatcattcttttcttctctggatattaggaacaatatcgcaggggtggtgtacatttcctttgatattgggagtaatatcatcctctctccattgggatattaggaacaatatcccaggggggtgtctaccctctgcgacattgggagtaatatcatcctctgtttccctggatattagactcaatgtcacaaaaaggtgtacaccccctgtgatattgggaataatatcatactctccttccctggatattagaaaacaatgtcatcaggggtgaacacccgtgcgataatgggagtaatattttctctttcacaggccattaggaacaatatcacagagggtgtttacacaccctgcgatattggaggtaatatcatcctctgccccccggaatattaccaacaatatcaaacagaggttgtgtacacttcctgtgatattgggagtaatatcattctctccacccccggatattaagaacaacatcccggcggggggtggtacaccccccagtgatattgggaataatgtcatcctgtccttccctggatattaggaaccatatcacaggggggtgtacaccttctgtgatattggaagcaatatcatcctctcccccactggatattagaaaaaataccacacatggtgtacacccactgtgatattaggaagaatattacagggtgtacacccactctgactttaggagaaacagctacctaaaatgtcacaaacaatatcacagggtatacagtaatatctccctaggatattacaaatactattacagggtgtacacccactgcgataacaagagaaatacatcccaaggacattaccaataatatcacaggctgtacacccactatgacataaggagtgatatttccctaggatattacgaataacatcacagaatgtacacccatggtgtgcacccatggtgatattaggagtaatatctacccaggacataaccaataacagcacagggtgtacatacatgatgtacacccatggtgatgttatgagaactatctccctaggatattacaaataacatcacagagggtacacacatggtatactcccactgtggcactaggactaataactttctaacatatgaatagcatcacaaaatagaaacacatggtgtacacccactgtgatattaagggtaatatccccctaggatattatgaataacatcacagggtgttcacccatggtgtacacatgctgtaatactaggaataatatctctctaggatattatgaataatatcacagggtgaacacccactgtgatattgggaacaatatctctctgggatattacggattatatcacagagtgtacacacatggtgtacacccactttggtattaggagtaatatcttcctaggacattacaaataatatcacagagtgtacacccactgtaacattaggaatcgcatctccctagggtattacaaataatatcacagggtgtacacccactgtgatattaaaagtcatacctcagtcagatattgtgaataatatcacggatgtacaccacgtgtgcacacccactgtgatttttaaagtaatacctccttaggatattatgaataatatcaaggagtgtacacaccccatgacattaagataacatccctttaggatattccaaataataacccaggctgtataccccatgtgacattaagagtaacatcttcctaggatattacgaataagatcccagggttgacaccccctgtgattttaaaagttaaatccccttagaatattactaataataacacagggtgtacacccctgtgatgttaggagtaacatcctcccaggatattatgaataatatcagaaggtgtacacacatggtgacattagtagtcatatcccgctagtatattgtgaataatatcacagggtatacacacctgtgacattaggagtaacatccccctggaatattctgaataatatcactgggcgtacacctcctgtgactttaggagtatcatcctgctaaaatattacgaataatgtcacagggggttagcctgtgtaatatcacagggtgtacaccccctgtgacattaggagtaacatctttctagaacatcacgagtaatatcacaatgtgtacaccccctgtgacattaaaagcaaaatccccctaagatattccgaataatatcacagggagtacaccccgtgtgacataggagtaataatccgtgaggatataatgaataatatcagagggtatatacgtattgtgacattagtagtaacatcctgctaggatattacgaataatatcacaaggtgtacaccccgggtgacattaattgatggaacagtcccctagaatatgaccaataacattacaaggtgtagaacacctgtgatttatgagtaagagttctatagaatattacaagtaatatcattcagtgtgcaccccgtgtgacattaggagtaacagcccacgaaactgtgacaaataatttcaaaaggtgtacaccctctgtgacattaaaagtaatatcttactaggatattacgaataatatcacagggtatacagcccctgtgacatgaggagtaatgtctttttaggatatcgcgaataatataacaagatgtacacaccctgtgacattaggtgtaacatccgtctaggagactatgaatactatcgcagcgaacacaccccctgtgacaataggagtaacatccccgtaggatattatgaataatatcacaaggtgtacacacattgtgacttcagtgctaatatccctctcatatactgtgactatcacagggtgtgcacccctgtgatatgacattaggagtaacatctccctagagtattatgaatactatcatgagggtacacacgcctttggtttaggagtaatattcccctaggatattacaaatgatatcacagtatgtacactcactgtgatattaggagtcccattttcctaggatattatgaataatatcacagtaggtgttcacacataatgtgtacaccatgtgtgtacacccatgtgatatttgaagtagtatgtccctaggatcttatgaataatctcaaaaggtgtacaccccatgtgacattaaaagtaacgtcccttttggatattccgaatgctatcacagggtgtgatattaggagtgtgatattgggagtaacctcttcctaggataacccatgtgatattaggagtaacctcttcctaggatattacgaataacatcacagggtgtacacccctgtgactttaaaagtaacccccccatagaagattatgaataatataacagggcgcactccccctgtgacattaggagtaacatctccctaggatattatgaataatgtcactgggggcacaccctctgtgatattagcagcagcatctacctaggagattacgaatgatatcacagggtgtccactcactgggatattagaaggaatatctccctaggatataagctatcacatcacagagtgtacacacatggtgtacacccactgtgttattagaagcaatatctccctacgatattatgaaaaatatcacggggtgtaccctctgtgggatactagaagtaatgtttaccatggatattacaaataatatcacagggtgtacacacatggggtacacccactgggatattaggagttatatctctctaagatattacaaataatatctctctataagattacaaataatatctaagggtgtacaccccctgtgacattaggagtaacatccccctacaatattgggaacaatatcacacggtgtacacccctgtaacattaggggtaacatccccccagaatattactaataatatcacaagatgtattgtgacattagtagtaatatcctgctagcatattttcaataatatcacagaaggaacacacctgtgacaataagaataacatccccctagaatagtaagaataatagcacagggtgtacaccccctgtgacattaggagtatcatctcactagaatattatgaataatgtcacagagtgttatcttctgtgacattaggagtacagacccctgggaaattatgaatactatcacagggtttacacccctgtgacattaggagcaacatctttctagaatatcatgaataatgtcacaatgtgtacaacctggtgtcattaaaagtaaaattgccctaggatattatgaaatagaacacagggagaacacctcgtgtgacattagaagtaacatcccctgaggatataacgaatatgaggcatttgtcccggtgggacgccccccagagcagtgtgtggcaggcccccgtggaggatcaatgcagtggctgaacacctggaaggaacaggcacttggagtctgcacatctgaaacttggtaagactggtctttgaaacttgctcactccgtttgagtggaagcgtggcctgatcacccacggcgtgcctgtacaggcactttggttttggttttgacttggtttgaattgcttgacgggactggtcttgagaacttgcccactccatttgagtggaagcatggcctgatcacccacagcgtgcctgtaccggcactttggtttttgtttttgatttgacttggattgcttgatactttggttttggttttgacctggcttagatttctggttactctgattttggttttgatttttgtttggtgcaaactgcaaaactgtgtgtgtgccctttttacccatttttttgttttgtggtgtgcgtgtggagtgagcatggtattttgtctcaaagaagcataggtcaggcacaaataagcccaccctactaggaactatgttggaaaatttcaaaaaaagaatttaagagagactatggagtactgtgacactaggaaaacttaaaactttgtgtaagatagaccggccagcattagaggtagattggccattagaaggaagcctggacaggtcccttgtttcaaaggtatggcacaaagtaacctgtaagccagggcacccagaccagttcccgtacatagacacttggttacagctggttttagaccccacgcccccaacacacagcggttgagagaacagcagcataagcagatggcagaggcaaggaaagagcagcagagagagagagaggaaagagacagagaggaagagaggaaaagagagagaggaagagacagagaggaacagacaaagagggagtcaaggagagagagagaaagagagaggcagagagaggaagagacagaggcaaaaggaaagtcagaaagagagagacaaagtcaaagagagaaagaaagaaagagatatacaagtagttaaaaaaaagtgtaccctattctttaaaagccaaggtaaatttaaaacctataattgataattgaaggtattctccgtaaccctataacagtccgataccactttgttgtcagtgtaaacaagggcatatcccgaaagcactgaggccttcctatcaaaaatccttaaccccataacccgcggatggcccaaatgcattcaatctgtagcggcaactgcttcgctaacaaaaaaaaaaaaaaaaggggaaaaagaataacttttagaggaaacctcattgtgagcacatctcaccagttcagaagtatcctaagggaaaaaaaaaaaaaaaggaaaaaaaagggggcgggtggaatttatataaaaagagtattatatggtaaattcttgtcctgaaataaattaactggttgtttaaagaaagaaatatttgtaataagtcagaaagttgaggcatgtggaagaattgtctgcaaaagtcaagaaagagaaaaatgttataaaaaagaatttatgcaaaaaatgttgtataatttaaaagtaactaggcctcctgaatgtaaaactattgaaaaaaaaaaaaaacaacagtttatgtgcaaggtgtataagaaaagtaaaatatatctttggtaaaaggattataaggaggcataagaatgtacatttttacctacattaaaaagttaaaaatttattgttttgaaggtttaagcaaattttaaaacattaattgtaaaggaaattctgtgtataaacatatttgctaaagttaaagaagtatcatccagtttttctgtgaactagacattaaagtaaaagcataacaggtttttcttaaagcaccaacctgctctttagcaaaaattatgaaaggttaaaaagagtctataaaatcgtaacttacggtcaaacattaaaaattagataaatatgtctacaggcttttattaaaattaggtttaacattaataacacactaatataaacataacatttagcttatctggtataaaaatcatacaagaagcattgttaaatgtaaaatggtatttggctttctttggtttaaaaactaataaaaataggtgctaaaggaaatttctcagtaaaaagacactaaggactataaagtccactgccaaggtccccacatttaaaacaaaaggtcagtttcttaaaaattatatacttggtttatcttccactttcctttctctcaaaaactaaaagtcttttagcacatgtaccaccgctagaatttccagtaaatcagcaccagcctgaagatcacgttctcatcaaagggtggaaagaagaaaaacttgagcccgcctgggaaggaccctaccttgtcctgctaaccaccaagactgctgtttttacagaaaaaaaaaaagatggactcatcacacccaagtcaagaaagcgccaccccctccagaggtgggggccatagtcccaggggaaaaccctaccaaactaaagctaagaaaaatggaggaaacttcgtgttccttggagacctgaaaggatgcagtgaagcataagaattttcaagagcttatcaatgaggcagcccttgttcatccctgagcggatgtgtggtggtattgtggtggacctttactgggcactctgccgaataactggagtggcacttgtactttagtccggttggctatccctttcaccctggcatttcatcaataagacatcataaagcgagagaagctccttaggggtctttcaactctcatgtctatttagacgcaattggagtcccacgaggaataccagatcaatttaaagcttgaaatcaaatagctgcaggatttgagtcaatattttggtaggtgacagttaataaaaatgtagattggataaactacatctattacaaccaacagcaacgagcttttcatgagttaaaagaaaactcacgtcagctccagccctgaggctacctgacctgacaaaactcaacattctatgtgtcagaaagagaaaaaatggcagttggagttttaacccagactgtggggccctggtcaaggctagtggtctatttctcaaaacaactagacagggtttccaaaggctggccccacgtctaagggccctggcagcaacagccctgttagcacaagaagcagataaactaacccttaagcaaaatctgaatataaagaccccccatgctgtggtaaccttaataaataccaaaggatatcattggttaacaaatgatagattaaccaagtaccaaatcatgctatttgaaaatccccacataaccattgaagtttgcaacaccctaaaccccaccacatttctcccggtatcagagagcccagttgaacataactgtgtaaaggtgttggactcagtttattctagcaggcctaacctctgagaccatccttgaacatcagtagactgtgagcagtacgtggaggggagcagctttgccaacccctgcaaagtgactctgaagaagacgacaagccctactccagtcacacctggaagctgactggtccacacacagccgaagcatgagaaaacccattgcgggactcatttttcttaaaatttggacttttacagtaaggacttcaaatgaccttcctcagactaaggacagttcccattgtatacatcaagtcactgaggtaggacaaaaggttgctatggtcctattattttatggttattataagtgtactggaactctaaaaagaacttgttcgtgtaatgttattctatacaaagtatgtagcccaggaagtgaccaacctgatgtgtgttatgacccatctgagcctcccatgaccatagtttttaaaataagattaaggactgaggactggtgtggactcataaatgatacgagtgaagtgttagccaaaacagaagaaaaaggggtgcccaaacaattcatcttaaaatttgatgcctgtgctgtcattaatagtagtaagttaggaataagttgtggttctcttcattagaaaaggctatatggcagaaaataaatacatctgtcataaattagcactgtgtggaaataaatgtaaacactggtcttgtgtcattttggccacttggacaaaaagaaaatgaaaaagatccagtccaccttcagaaaggaaaaaatggcccttcctgtactaagggacaatgtaaccccttagagctagtaataaccaagccccttgaccctcgctagaaaaacagaggagcgcgtgaccttaggaattgattgggccagactggatcctcaactaaatatcttggttcaaggagaagtttacaaacgctttcctgagccagtgtttcaaacttcctatgatgaactaaatgtgccagtaccagaaatttcaggaaaaacaagaaatttgtttttgaaattagttgagcatatagcccagtctctcaatgtcacttc

SEQ ID NO: 1004 - DNA, 27605 bp, Homo Sapiens
ggggcagcaagggcgcgctggaggcggcggccaagactcccgccgccgccgccgccaacagggcgagggctgccggcaactctcccgccgggcccccgcacccccagaagccgaggtccgagcagccgccgctgctttgggtggggggctgacagggctgcgcgcgtcgcgctcttggctggggctgcgcgggcccggggcgctgcgggcggctcagcggcagctgccgcgctctgcgcctcctctgggcgcactgcctgggagcacgagactggtttgtctgatgctgctgccggagctgaggtcttgcctggagatccgaacgagacaccacgtcaaccggcgcggggagtcccgtgaagacatgagggcgccaggagcgcaggccgggctttcctcgcgcctgtcgaaggccggccttcccgctcgggtgtctcgccctctcgcttctccgcagggcaggaggcagtggcgagaaaaggagctgccggccggagttctagcaccgagaaggagagatgaggacattgaggatcagagatgttgaaaaacttgcccaaggatgcacaagtggaatggtaaagacaggatttgaattctgacctctctgactccgtgtcacaaactcctgaaagtgtgaaaggtttaacacaaattccttccccgctctttctctctctccctcccccctccaacttttccctttcaacaaatatttgaaaacttactatgtactgggcactattttaagcaccacatagcaaagaaacaattttggtcctttttgatcctgatgatcccccatccctcccttaaatgtttttccttccccaggtccttccctaacttttgtggggccctgcaagtgtaaaaacagaggctcatataccatacctaaatatttaaaagtgataaatcaagctggcaaagtgttaaataaaagatgctccatcctcctgccttgataaagacacttgtgcacaagggctgctgtgcactgagcatctgtgggttttggagcaccatggaggaatgtggtggctcagagggtgtggacatttagcccatggcctgtggcctgtccctcatttcttcccaccctggcagtccacataagggggtggtacacatatgtgtgtggacatcctagcctacacatccaagctgtatcccacaaacagcacctcatggcttaggggtgtgtgcactggcggtgtgacctgccgtggagagaaaaggcctggggaaagctctggaagtggacttaagaccacttggacaggggattcaaggtctctcgtagccaagacatagtctgaaagaggagaggcaggctgcagcctccaggtgggtacatctctgtgcccctcaactcttcactccataggaaagggcacaaccagaggagtactgtgggtgcccctttcctgggcctaagagtaacagcgctcctccccgttctattttgtcttccaaatcccacgttcacatgtggatattttttgagatttggccatctgaggatttttataaaggaaaatgtggaattcaaacactctacttgtttaacagagagcaggtccattgaggtgggcagatgttagatgttactggaagtggaggaatgggattttggagagacccgctggcctctctggagctacatggacttccctgcattcagcagccctagtctacagagggagaagctaggctaccccggccttctgtcttgagaccttgatgggttcatcccaaacctcgggaagtggatgcagtttagcaggatcagctctgcgccctgttcacttctccagccatgaggactgcagctctggatagactcctaaagcacacacgaaagcagtgcttcctttactgggccagattctccccgggggagcagacagaagccctctaacctgagcagtatgtgctcatgccagtgtgcattttcctgtctcccctggggaaggtttaaatcctttatttattaagaatttaatttctttatttattggtttaaattctttatttattaagcctgcacaatgtgatagaacactatagcagacagtcctcgatgtttaattcttaagaaaataggaaactatgtatacatttccctccatttaaattctattcacttctctctttgtgttaggggaggtactgaggaacgctgttttcatttgcttttacttttaatatggtgttactcagaaccagtagggtatatctattaatatatctgtatctatatctatatcacctatatctctatctatctatctatctatctatctatctatctatctatctatctatccatctatctacctacctattatctacccatctatattatctatctgtctgtctgtctgtctgtctatctatctatctatctatctatctatctatctatctatctatctatatctgtctatagatagatacatgagaggggatttttttaaggttttaattttgatacaggatctccctctgtcacccaggctggagtacagtggcacaatcatagctcactgcaagcctcaaactcctgggctcaaacgatcctccagcctcagcctcctgagtagttggaactatagatacacaccactgtgactggctaatttgtttaatttttattttgtagagatgggtggagtcttgctatacctcccaggctgatatcaaactgctggcctcaagcgatctttctgcatcagcctctcaaagtgttgggattacaggcgtgagccaccgcaaccagctggaagctggatttttaatgtttcaaagtagagcaagtggggtcgcccattagggaacacatcccaacaccttttctcctctgggtggctcccatgttcatatctcacaaggtgctctgtgcttcaggatgtctctgcagttgctcttcagcctcctctcactacacgggccaagggcactgtttgatgtttgcagcgtgtcctcttgcctcccttcaacccttcaacttatctctttccatttgcattatccctggccagatatatgctgggggtcactcatacggactcacaaaggccaatgttaaagtttcaggaatgttgtgaaccacttattaaatacagccattataaaagtgaaatggcctaaacttacatttaaatatatttcattaaaaacaaaggtagtaataataataataaaaattcattacttacaaattattttactatatgttactattatctatgctgttggggttatttcagtctattttaactgcagggtggaaatattgtataacagtgtgctctgctatgcccttttcccaactgtgtgtttcaaaatgatgtctcgttggagcttgaaatcagccatggttgtagtatttatttcatgtaaattggtaaacattatgaatcaggagtccctcccttatccagagagcctgttgttaacatttaccagcacaccatgatctgtagctctcaaatccttagatcagagtttctcagttctagcactattgacattttaggccaaataattctttgtttttttgggggtgtcacttgcattgtagaatgttgagcagcatttctggatgccagtagcttcccctccccagttgtgacaaccaaaaatgtctccagatgttgccgaatgttttctgggggataaagttatctccacttaagaaccactggcctagacaacattatcctttaatgtaagtgacttgctattcttcccttttaaactttaacatgcatctgacaaatattcagtgcccattatgcatgtaaatacaatgatgaacaagataagcattgtccctgtcttcatagaactccagtctaaaatcatggactaagctggaaatatactgagtatccactaggactagaacatgctatctgcatgctaatgtgctcagtaggtgatcttgatctttattaattccattaacactaattgcaacattgtataatgtttgcatttccccttcaggtgactgttgtctcttgggcacaggtagctgccaacaggtgagcctctcagcggatccctgatagaggtaggatggcaaatagcttctttaatatgacagcctcagtgtagtggctggcaaggagctgcgattgggaggaactggaagtgacacccaagctcattgagcaagcatgctgtgagtgccatgagtaagtagtcccagctgatgagcttatcagggggttgccagcgggggtactgcccagggtggagatggaatgggagacatagccatacctcagaaggatatgcagctcctacgaggacctaagtggagctgggtcagcatggccccagtaagcacacagcaggcagatcagccacagacttcagcatcaaggccttccagggtgggaactagatgaactggaggacaggccaggaacctgcacatatgaatcatgtgggccaaggaccttcctcccctttcctaccaccatgaagcagacccttcccccaggagtcatcttggagaaaaatgggaaagtggagcagtggtagggggcagggggtgctgcaataccaaaatatccagaaggcatttaaaattattggactagatgacatttaattctccttctttactcagtaaagtgaagagctcaggagaaagattggatcaattatagaaaataatgaaggtacattttctttgcataactaaatgtagggtaagtacattttgaatttgctaaaattgtctttgctctgcctctgcacacgtgtgcacacgtgcacacacacaaatggcacttctgggagtttttccttgctaccacctcctctcaataatcaatgctcacgaaagcatttgtgagaaatgtggagtttactgtggagattcaaagggaagatgatggaggtttcactgtaacccccacaacagattcatattccactttgatactgtgttcatcatttccaatatatacctttttcctagttgagtatttgaaatcttggaaaccagactctgtcttgctgtgttggtgtgtcatagtataattggcagcatgtttcctttggtagcaatacataagacaatggtgtgtcttatgttgatgtcttcttatatttgataaaatcttttaagtctactgctttgcagtccttcctcaactgcaagcagaggcttccccactgaggccattgagtaaagtggttcaaagtacagtctggagtcagaccatcacttactatctccaccattcacaagccaggtaaccttgggcaagttactgaagggttcaggggctttgtttccctacctgtgcaatggggataatattattaactacttcatcggattgtagtaagaattaaatgagttgatatatatagagaaattggaacagtgtcaggtggtggtgacttctagaaaagtagttgttcttatacgtattacctctttagtcccctcccacataggccctgcctcctgttacctattgctttttctttcctcccttattttataaataatacttcagtgaccgctgtttgctatttgaacacaaccttgagatctctcctctccttcccaaatggcttacctaagtatttactccaaacaaatatgttgtcttttagagatactctgataagtaaagattgctgtatgtagtaacatatttttatcattatttctgatgcatctatggtagatgcaagagatagtaagatatgagcttgactggagctgagctagcttgttggggagcattaggaaataggatggaaaaaagataggttggagacagatggcacttgaagaatctcccctttgaaatctttggtaaagtctacaatatgatacctctccatacatctctaaggaggctttgtattttgatgacagccttgaatgctagggacacccagccacacgggctaactcatacagggcagagaggactttcaccctctttaattcaccgtgtatgagtggcaatgtttcttcccaaatatatggctggccctaggagacaagtcagggcatgtgagctgtggatgtgaactgagagaacagttggggcttaggtgaaaagtggagattcaggaactcttcagatatagtggccttagggaaagatagatgtattaggccattcttacattgctataaagaaatacctgagactgggtaatttataaagaaaagaggttatattggctcatagttctgcaggctatacaggaggcatagtgctggcatctgctcagcttctggtgaaacctcaggtagcttttaatcgtggcagaacgggaagcgggaacaggcatgccacaagttgaaagcaggagcaagcgagagagattggggatggtggtggggggtgttacagacttttaaatgagcaggtctcataacaactcactcactattgtgaagatggcaccaagccatgagggatctgcccccatgatccaaacacctcccaccaggcccctcctccagcattagggattacgattcaacatgagatctgggtggggacaaatatccaaactatattactaggcagtaacaaagagacacccggcccttctgggttcaaggtgtgccacaggcctgcatgtcctcctaagcttttcttaggtggtgccagagtttgaatggctgcagtcctggcatattcctcagtgaggctggaaaaaataatccactcctgcaaatggaaaatttcttctgtgtagggtgagcacttccagctccagaaatgaaacatgctaaaggcagcgtgtgacttggcatggggtgaccagtaacccaactgatcggtcctctaacctgttagttcattttgctggtgatcttgtccataagggcaaacaactttctagctggtcacctttggaacaaagtaagagtttttgaaagaggatttaaaaaaattcttttttggtttgttttgggtttaatgagtcaatgctttattttactatgagtgtttataaccagacctaaatgtatgtaggatcttgaacctcccccacaactatttcctatttgttcccagaaaaattccaatgccagattttgccatagcaaccagaggcaaatatcaagacagcaataaagagcaagctggaaaagggtttccctacaatgtggcttgagtttctgtagggcattccatcctccgtgtggagctctggaaggcaagagggggccctgcggttcctcgtgggggggtctggtagagtccagatttgccagcatccaggacccactaggaaatgtgtctgtcaggcagctgggctggagcggaaggatcagcttgcctgctcctcgggcttggcacctgttgtgtgttgatctttatttttgtacgtcaatttttcaaaattaaaggtattgaattattatttttccattatgcttttcctctgagcagtttagtaaacaagcctgttctgtatttcctaattgtcccctcaagtgctctttggaagaaggcagtgcatatttaaaagtaagcaaatgaaaccaaagaacaggagattcttccaatatctgcccacgatgtccctcattctgtgtccttcctttttgtcatggttgttaggtaatgttaggaagtcccacttctttcccataggtaaagtcatctcactacagtatagccttcttgctgaaagaactttgggcttccgagttacttcaggtgctggtttggattagcggtgtgttgataaatgtttaacaactcgctcgcagacataaaattgccttgatttgtagagctgatttgctgatttctgtggtgtaaatcctcccaccatggcagatttcatcttaccagagtgacctcatgaacatggaactggaaagagatgcacacatttaactctcatgcactggtaagagctggctgccccacactgctggttctaccgatctaggcctgggtttctcaacctcagcactattgacattttgggcagaatggctgttggttattggtggctgtcctgtgcattgtaggatgtttagcagcacctgtggtttctactcactagatgccaggagcaacccttccccactaagttgcaacaaccaaaaatgtctccagattttgccagatgtctcctgaggggcaaaatctcccttagttctgggctattctgcactgatagtgcttagaaggtccattcagcaggcagtaggcctgcactgttagcttttccatgaaccactctgaatatgcacccaaagaagttctctcttggcattttggatgtggtgcattagtctgttctcatgctgctaataaaggcatacccgagactgggtaatttataaaggaaagaggtttaatggactcacagttccagatggctggggaggtctcatgatcatggcagaatatgaaggaagagcaaagagatgttttacatggcagcaggcaacagagcctgtgcaggagaactcccctttataaaatcatcagatctcatgagacttattcactatcatgagagcaacatgggaaagtcctgcccccatgattcagtcacctcccaccgggtccctcccacgacatgtaggaattatgggagctacaattcaagatgagatttgggtggggatacagccaaaccataacatgtggtattgcaaaacactgaaagtgtgcttccttgggtagtcttgagaagagtcatgctgtaaggacttaaggcaccaaaaaattaagacacagcagggccagtaggagagcatcagggtaattccactataggatatatcctatatccattataggatagttttgacagactgcagaggtcccttaggcaaacctttcctttgtatgggtgagaaattagactcagggacaaggtgtgacttgtccaagggcaaggtgtggatgtgcttggacagtcacaggggtgttgtggtgaatgctgtgagacgcctgtgtgacatactgggaattagaactgactccaacttgtagctaaatgtgttttgcgggcttttcaatgttgggtttggatggatatattctgacatctccctgtcccctacctctctgtccctttggaaatatctgcttatgaaaaccatattataatgagggatttctgtttcagatagaattattcccttcagcttcaggagtgagttgattattcacatgttctttttagggggtttaagctgctagtccttaaagaatagatgctgaaggttgtcattgattcctctttccttcctcccacgtctgctctgggccttctcattgatgtagtatcttaggttacttccaaaataatttgagaaatggatttatagaagaagctagctttccagtagaaaagtttagatgacaagattaatgtgataagaactaagaaagcccttcctagttttcattgaaaatgtgtttttaatgcccagaggtgcccagtcaaaaaggaaatattacagaaggattattttcatcagcagagttcttgggcattgcaagttccagtgtaattagggaaatcacatgcgagtacatcaatacacttcagatgccaatacattgggcttaatgaggacaacaagcctgcttttattaggggattgaataaaagtgaaaggagttcttgaaaagaattggtaattttggatgggataattcatcacttcactccagatcagtttttcacagtaagaagtgctggctcttcagaaaatttggcataaccaaagtttattgtcactatctcctccttctcacattgtcctttgtcgcacccccagcaggtccacagtgatcctgcgggccacccccatggaccctgcccgttttcttccatcgggggctatcttacgtcagtctttcaaggtctcctcagtaatgcaggccagttggatttttgctttcttttcccagaggacaattcagcctcagcgtcttagtctaaaaggattcatgcaagcgtgtcagatgttttattaggctaagggggaggtattttgggttgtggggagcacttactgcaaccctgtatgaaattccctactcagtgatgttcaggctgcacgggccaacatggaaagggcttaagggagatgacaaaaacaaaatctcttcttccacaaagattttcagttgatcaattttgttacttttttgtgatgaaactatctgcactgcagctaatgatttttttctgaaggtggaaaaggtaggagcaacagctttcagttctaaggatacattctgttgaccttcataagccctaggaactagaggggcaagattgaggaggaaatagagaaaataatttgctctatagtattttccccctgagctgccatctggggctttcagagcttagcactgcactcttgcaatgttgcacacaccacaggagcaatatcaagagatgtcaaacatgagtggtattggtcactggaaacagcagattccaaatagctgtctcaccagactattctttcagaagattcatttgtgccaactacttctttgtcatggatccttcctggttctgcaacacagatgtggaaagtgaagagaacacgtcatggaattccatttctaagagtggaaaatatacaatttaccatgggatgtttaagatattaatatattgttcaccatgtgtatccagagctttagtagaagtaggttaaaagagccgtgcatgtatacacggtgctcctcattgtcaaacgctgaagcctgttacaggctgggtttgggggctgggggtacttacgggacaaagtctgactctcggtctgtaggctgagtgccttcttagtgtgttgggactcagcatgtattcaccccatctgtactcacaagcctaattcattaatcaggatgacttactgggctgtgagccctttgaggacaggaccttgtacctttatcttgtgcctctcatgcctagcatagcaccaggcatgtaacacgttctttttaaaaaagtgttttacagctttatcaaggcatacatgatgtcagatcaactgcatgtgtttaaagttttacacttgatgagttttgatatatgtctatacccgtgaaaccatcactgcaatcaagataataaacgcattcatccaccctaaagtttctcgtgtccctttgcaagccaccccccttcctcccattgttcccagacaaccactattctgctttctgtcactgcagatgagtttgtgttttctggaattttatataagtggaatcatacaacatgtactctgtttttctggctgttttcactcagcataattttctcaagattcattgaagttttatatattaatagtttgctacatttcattgctgaatagtattccattgtataaatcataataggcacctaacaagtgtttgtggctttacactgacttgaaaattaatttttaagaatataattgggcaaaaagtggacaatgggataccactctattcttggtgagtgggttcactcaggaagtggaaataagaatcaggagataatttggcatggtagagacttttgttgtcatccaatatctatttttccttctttcttagtactggaatacctgagttttggctgggcacagaactgtctggaatacagactgcaattcccagccttctgtgcagttctgtgtggccatgtgactaagttgtggtcaatatgagtcacggaagaatagaagaacaactcagaggaggaagaagtcagacatagccagacacggctgctagcagttccaccaatgaaagaggagaccaggatgtttaaaacaggcaaacacaaggtgcgaaaaaccagaagcgaaaacttctgaggtcatttaagcaaggactatcgttatccccggaagcagagagaagttccctttgcccaacatcacactgcaagcacgtgttggagctgagattcaaacccaggcatccagggtccagggcccatgcttttaatatattccatatcttaggagaatttcccctatttaaacaataaaagtgcaaaaatcttgtggctagccaaaattttcagttgtttggaaaacttatttatccaataagtggaaaactcacttgtcctccaacaattctggataaatgaaagaacgaattgaactgagactggaatccgggtctcccagtactttgtagttcctatccatatggcttgtcaggaaggccacagggaggttaactaactctgcgtaaccagaaacaatcccacatcagactgttggcagtgggagtggaacactcagagctgaaccgcatgcaagatggttgcattttcatttgcaatgtcgtcatcttcctcatggctaaagaggtattttggagttgacatgaaggctactgtaatttttagaggcattttctttctggcctgtatttacatattgtggtagaagagtcagaagacttcaagcttcaaaagtgaatcttgttgcgagttacaaaagcaccacccggtggggtgcagctctcagcatgtgtcaccacaggcactgtgatttccctgtcttcatccaactttggttgctgttcttcatgctcaggaattctgcaactgctgtagcttttgctgttgttatgtctgtaggtatggactcatttctaccattctggaatgaaacattatttcaagggaagcttctcattgtaaaaggtccacacattcagaaggaaactgggagtacattttctcataggcctggagcattaactgactatgcatctttcccctcagtgttgtcatcatgttgtaaggggatgagtcatggacaacattttcacacacatacgtgaggtccattgaccagtctttaggacaactagaaatcttttctttctttgttttaaaaaggaagacaagtcaagatacagcaaataaaaatgctcagcacatttgctgaaatcttagcaaaatcaaattactagtaatttgttaatcacactatacctgttttgagccaatcctacttaacccaccctccatcttcctcatgcttgcctccctggtgaactcctatttatgttacaaagctcagtgtttatgttactacttttgtgctatttctgaacgttaaatgtacctctattatagaacatatctcatggaatagttattattgcatatccactgcccttgttaggctgtgagtgagctttctttctttctttttctttccttccctccttccttccctacttcctccctccctccctctctccctccctccctctctccctccctcccttccttcctttgctccttctctctttctctctttttcatttcttttctttttttttaaatttgagacagggtgtcacaaatatgaatgggacctgtgaatatgatggctgtcactctctgattagattacattatatggctaaggtgaaggaattctgcagatgtaattaaggtcccagatgagttgatattgagttactcacaaaggagattatactggatggccctaccttaatcagggaaaagcccttaaaagaggactgggcctttcctgaaggaggacagtccactgctggctttgaagcagtaagcagctgtgttttaagggggcctatggaggggcccatgtggcaaggtcctgagggtggcctctaggagttggcagcagttcccagccactggctagcaagaaaacaggtggttcagccacatagccacaaggaaatgaattctaccaacaatccaaatgagcttggaagtggatattttccatggtcaagcctccagacgaacaccttaactgtaacatatgaacagctgagcagaggacctgcttcagccatgcctggactcctgacttgtggaaactgagataacaaatgtatattattttaagctggtaaggttgtggtaatttgttatgcaacaatgccgaatacagtaggcatcttaaatgtttgttgaacttaatttaatcagggaaatataatatttaaaaggaatcttttctaaagttttagccaatttaatgaatgtagatatcttaaagaattgccatcttcctttggatcttctagccatgcaatcgacttcacaaacttccaagttttcataaataccagcttctgattgtctggaaacaggaagtgagattctctccagccatcatttggcattcttgggagatagaatggataaaaattgatgttgaaatgagaccaccatcatttttcagtctgctcaccacgtacagagctcaggatgattagaaaatgtaaaacacatgtgagtggctcaaacccctttagttaaatcacatttacatagatcagttttcccaagggatataagttagctgaacttaagcaattaaaaaaaataaaactaaactaaaaccttttgctaaagccaaaaaacatggatgagttaaactgtatcagatggaatggtttgttttgaaaagtgtttggtttgttgtctatatacgtgcgtgcttttttaaaaggcagatagaaaagcagaacttacaagacctttagctgctgaggtggaaagccagtattacttctaccacagcagttgatatcatcggtctcaccagcaggtcacggatttgttgcttgctccctgtgacaatcttgaaccattgtagggaccttggcatatagagggacggtgaacagggctgaaaacaaaattgaactcaatcttgagcttggtattccaccgagagcaggttttctgggctttgaaataccgcctcagagagaccttccttgatattctgccatgttgagaacaagaacaaactttttggccctggaacctcttccctcccagtgccaacatgttcaatttcatttgcccttggctaaatgtagcttcctgtttctaagaaaagaagcagaaaggggcttttgaaggcctcacagacagtctcagaaggcttcatgggcagcagacaactcttagcaaacaacaatttgatgagttaagtgtaaacggctcagagacatatggattacattttttgggaaatacacatgggcttacaatgtaaaactgggtagtgtggggtggggtggagaagggaatgcttggaaaagtgtggtttgggtcttgctaattgcaaaatatttgaaacaaataatttgagatgttttgctcaacgtacagcgcggttggatttgccctttccatctatttacgtgtcattttcagattcggctcacataccaatactggtttgggtcttgagttgatttttaaaaatgcagttattttgaaaggtcatgccatgtgatttctgtgtagcctctgagcataaagggtggggtggtataggggaagaactgggcatttagaaacctctctgcctgtaggtcaaactgctgctcagctcttctggtatattctacttatggaggttccaaatccaggctgtgttagtaagatgcagcagcctcagtctccccacctgtaaaatggggacagtaatacttatcccagaacccatggcgattgggatgctgtgtggtgtggagttaaagtgtggaccctggaggcatatacctgtgcatatcccagctctgctgctgatgtgagcttgggcaagttcttcagcttccctgggcttttgtttcttcatctgtgtaatgaggaatatcttagcatccaccacatagggttaccttgagaattaaaagatttaacccagtccccggcacacaataagtgttcagcaaatgctaacagtggctcttgttgtttataatttatcttgttctattaagtatatgaatacagtagataataaggcaaattcacctccaggctggggagaggaatagccccttaccaaacagtgagggtctccttcagcttaccttctttttcttattgtttcaacctatggattaattacctagttttgtgaccccaaaataaaagggtagattccttgatctaaaattagactcatcttttccctatcctaggaaggatccgtttctctcttctattttaccactgtctagcacctggagacacttggtttaagagcccagctagtttatactagagtgtgagggaattctgagggctcaggtggaaggaaagcatgattccagagtgttgttgggttaatgcattgcttctcaacccttcctgcacattagaatgaattgagaagcatttcaaaaataatagaaatgttagtgtggggcttcggtattagtacattttttaactccccagctgcttctattgcgcagccaggactgagaaccaccctggctaaggcattcagtggcattgtaggtgcttccctgggtcgtttctgactcgccccttttaactcactggcccctcggactctgatttctgcccttcatgcagtgggagagctttcctctggggcttgccttgaggtctgcaggagcaaggccacttcctctctgaatcctagacacaggctttgggtcagtactcccacccacgtggagcccccttctgcccctctgctctgggggatcttgtctgaatccatcccttctttgcctgccttatgccttctagctactattcctctgcccttcctttcttgatcagcacaattctgctgctttaagtccttttttccattaaccattgactgccctttgctctgtcaaacatagttttggaggctgtgtagtgtagtgaaagaacagggaatttgaggttggacctgggtttaactctctccttgattgctgacaagttacttaacctctactcatttgtaaactaggaataatctgacctggatgagactgctgtgaagatgaaaagaggtaaaggaggggtgatggtgtggtagtggtggcctggtgagaatgacggtggtggagtgatggtgataatgagaatgatgataatggtaatggcggtgttgcggtgagggtgttgatgtggtggtagtgctgattttcgtggcaggtgatggctatagtgataggggtggtggtgatgatggtggtggtagttgtaatggtgactgtgatggtggtgttgatgatactggtgatagcagtaatggtagtgatgatggtaatgatggtgttaatgatggtggtttgatggtggtgaacatgacagtggaggtggttgtagtaatgatgataatgatttggtggtggtggtagttgtggtggtggtggtgatggtggcagtggtttagtggtaaaagttcagtcaagaaagaagaaagctggaggaaccaacagtattctgatcagaggaaccacatgggaagcattgacagagggtctttgcatttgctaaggccatgggagtagctggttgtatcagttagcatttgatcaggaaatcagagctactctgtatgacacggaataagggattaatcatagggattaaacttacccattatgaaaactagtaaaaaagtctaggcaaggctgttgcctctgtatctggtgttgggcttgacgtttctttgggtcagcagggcttacagatgggacagaaagtggatggaaaggggagagcaagaacaaactggaccatgtctctgactctcaccacctgcagtggtaacacagtgacctgcaggaaaagccaatgcctctcatctcaggcctggacatgcacctgggtcaggactctgggctggaggagacccagggagccggaggtactggagccctgctccatcaaggtgaggcagcaggtctgagatatatgtgagctgctgctgcgccgggtccctaattaaacctcctgagtggaatggctactgcttcccttctgccttccaatcttctcacagatttctcttgttgccagctttaatctggaaccatagaggaaggaactttgggaaatgtggttcctgcttagttctggtggcacagcacaagtcactgccgaggggtccccatgtggattggatgggttaaaagcttcagcacctgtagtggcctgtgcagtctacttgctctgacatttcaagcctggagaggcaagggggacaagagctgagctgagggccatgccagggaactggacaaggaaggccttggcactctcaagtcagggaatagcctcgccatttcatctcatccccagatgctggagtgcgttggtctcccttctaacctctaaccactgaaagggaccctctgtacaaccaatccttgactttggaatcatgggctgagtaaggctgaaacatttagccgtctttgggaccccagtatttccctagtctcactctagtgtctcttgaagtggctgtctttcaaggtgttgaccctactccctgtttctaacatctgcctgctacataatccagctggacttctcaggtatccctggtggctgaactccttagaccagggagctcccctagtgcctctagtgctgacaaagtgccactttgcaacagtttctgcccttttcccggttctctggcttctaaagccttcatttatccacagatagaaatacaatcaatcccatccttactctttcttttgacaattttcttcatcagatatacacttagaatttaactcaactgtgttctctcctattttgtcggtcactgctgtaacttacatggaatcatggttgggtggcagggactgaagtagttagttctcacttatttactgtgaaatgaatagtttgagattcggtcagtagtcagaatggtattcttcacttcctccttttctttatttactatgctacctggtttgtgaacattttctccagctgcaagcaatttacacaaactgtaaactctttatccattataatccctgtaactatgcctagagactggaaaatgaccagttgtcattacattcggaaaagcatagaaaggatctccttacttgtggccctacacctggtacttttcagatagtagatgagttattaggatgatttgcacctcagttttcttatctgtaaaatgggagggttgccttgcatttcatgctgtgttctttgatgccctgggggattgccggattgccagaggactcattgggaatttggggatggggaagagcatgtgtctagagggccttcatccctcattcaactagcaaaaagccacttattctgtgttatatatttggtttctatgagagattggattattggtcagcaataaaaatcactcccttccttcttcctcttggagcagaccgtaactcccctgttctactgactttgggcttggctatatgactaactttggccaatgaaatgtgggaggatgtgatgtgaatagaggctttaaatgtacttgcatggtttggcttacctcttgtactcttctgtttgctgtgagaatatgctgcagggagccactggtccaaggagaagaagaggggtgtagaacagacctaaacccaacctgtagcctgaaacagagccgagtccagcctagatccacttatagtcaacctgttgatctgttagcacaaaaacacatgctgccataagctgttgtgttttgttacacagctatagctgtctaattcagcttacaaataagttttgtccataatcatattttttggtttaaaaaagtttgaaaaccactgggtttgctgagttttcagctttcccatccacttctactgtcctgtttctttctctttgtgtatttaggaaagagagggagaaagaaagggttttggaaacaacacagtctggtagaaagaaagaaaggataatttttttcttttgaggaaagagggacttagggagctgggaggagagataggcacattcatagttaaagtatgttttgtttcttttttgaaccctcaagtaaacatttctccactgacattgttttgcactgttacattattttgttcactttagtgttccatttgtacaacctctgaaattccaggaagaaggtgaaagaataacattgcacatagccctgggttgtgctgtgtttacttcatgatggaccgttcacttgggcttaaccttaaactgacctttctgattccagacgagacagcaaagctttgctcacagattcaaaatcagggaacagaaacagctgacttccctggccaaggatgttttccattctcattatttttgtccgtggtcacaaatgagatgctagggaagtaatttttaggaattcctggagtactttacttctgatgtgcatgcacagataccctggggtcttatgcaattggtaccccaccccaaagtctggatatattcgttgtaggatgaagagagggaggaaggaaggaggactgaggaaggtcttaggctattttcaagctcttttttgctccgcactttgcaacatggttttattttattcttataagttttgagatcatctcaaatataaatacaaaaccattgatcaaaggccaagaataagaaatatttagatgccctctattgcagtgaaaaagcaaatggttgctatatcatgcgtaaaggtaatctcttcaaggattagcactttaggtcagatcatggaagcctggttttgtttctcagaaagagtgtctttctggggcttgggaggccaacacgaggcaggctgagctttgtctatggcaggagctgagtttgagtctatctctgccattagcctgtgctcaggttgtgtccctacactgatggccatcagaatttgggtatcaagtgattcgcttgcttgtactagattgagctcctttgaggacaacaggagccattaatattttagagccagaggccaggcatggtggctcacgcctgtaatcccagcactttgggaggctgaggcgggcggatcacaaggtcaggagatcgagaccatcctggctaacatggtgaaaccccatttctatgaaaaatacaaaaaattaactgggtgtggtggtgtgcacctgtaatcccagctacttggggggctgaggtgggagaatcacttgaatccgggagacagaggttgtagtgagctgagatcacaccattgcattccagcctgggcgacagagcgagattccatctcaaaaaaaaaagaacttagaatctggactggtataagccttaattcaaatgccatctttgccctgtacaaactgtgtgaccttgggcaaataaccagttctttgtttcttcacctgtaaaatggggataattagtacttttctcatagggatgctgtgaagagtcaaagatataatggttgtagagtgctcatcacagagcctggcatgttgtatctgctcatatatgttagctatcaccatcattgctgctgctgctgtttttattaatctagtcctgggaatttatatcatggaaaaaagccaaaaaagttatatgcttaaaaatgtgtattgcatcttgtctatagcaatgagaaattagaaacaatctaagtgcctcattcattcagtcaatttaacaaatattttttgaagtcctattatatgccaggcactgtatcccactgtttggggtacatcactgaataagagagacaaagatccctgcttttgtgatggagaatgggtagctaaactatgggacaataattcaatggaatgttatacagctattaaagcaatagcaatgaagacatgggaagttgtttgtcgtgtcatgtaaaatcaaaaagcagaagaggaaaacatagatgccttaaaatatatgtgtgggtggacagagactagaatggagcatttaaaaatgcaagtggttgttagagtgatggaatcatgttttttgtttttcagtaatgtttgaagtggttttacaacattatggaaaaaatacatatatatgcataaataattgagaaaaatgaactggccctaagagaagtttcttatggtttaggaatcaaagtaaggcttataggcagaagaggaaattgcctaggtagcaaggaaggaaaaattgctatttcaaaccaaaaatgactgttgcagttccactgtgcactggaagcatggaattcatgccaaggatgttagttctttgttaaggaaaacctgttaagcagatgagtaaaagaggccctgaagcctctggagagaggagagttcagacttaaacgtctttgtataataaagtaacagaagatttccattttccctcagcagtttggggatggaagggagaaatagagattcagaggctggagaactgggagaagatgagtaaaggaaagagccagctaaagaggttggaagagatgaggccacaatagcaacttgaagaacactgataactaatactcaattttaagagattccctgtcccaggagaccatatgtctccccactcttaccttccctcaggagtctccaagagggcactgtacccccatgggataggggttgttatggtttggatgtccccaccctaatctcctgttgaatgtaatccctaatgttggaggtgggacctggtggaaggtgttgggatcaggggggtggatccctcatgaatggcttgggccatccccttggtgataagtgagctctggctctgagttcacagaagatctggccatttaatagtgtgtgacacctgcccccacccctctctgtcttgctcctggtttcaccatgtgatgtgcaagctcccactttgccttctgccatgagtaaaagctccctgagggctccctagaagccaagcagatgctggcaccatgcttcctgtacagcttgcagcactgtgagcctgaaacttttctttataaattactgactttcaggtatttatagcaatgcaagaatgacctaacacaggggcttgggtcattttgtttggttattaaaagaaggctgatgtcatagaatattcagggttcacctacacaggggggatctgaggggtcagaagctacctgtttcaaattgactgcttttggggcctgaaatggcttcattgccaccactagcaatatgatcttttgcaaatagacaatctaggatccctgattttttaggtgcagcaaggtctgggagaagtgttgctcttccatgaagaccttaaggagaatgattctgacagatcattgatcttctgaggcaggaggctgagcaggtttttattaatgggtggagaagggaacagtgagcacacaggagagtgatactggggcttggagactgggaggcgggaggcaggtggtgggaggaagccttctgcagcccaaagtctcttaggacaactggggagtggtctctagactctgaatcctgctcccaggagaccctgtggctatgccccttttgggaatggtacttaacttaaaggcctgtagaataacaaccttgtatggccttggaaaaccaaggtgggggtggggaggagctgtctgccccaggtgcaggctacatttaaaaatgctaataaaataaagtaaaacaaactgctttttattatcaccatgtgccaacagtcagtgataaactacccctccctcctggggcagatggtttgggccgtccgcatcccctagtctggccaggctgtgggatggcaaacagccaaagtaggggatccagaaggagcacgtgcaggaagaaaacccagattcctcacactggtaaataagaggcttctcaggactgaacttgaaaaacatgagccccaccaagggcgggacaagaaaatcctcagaagacggctgagcagaggttaagcaaacatcggtgccaagccagtggcagctcggaaatgaaagcccagagatgtgatgatttttaagagttgaactgagctgcaagcttgtggatcatgtaagtgctaacagaggcagacggagaaggaagatctgtcatgaagtgctacggtgggaggtgcgtcagcttggggtggaggggtcccaggtggccccaggagaagaggcctctgaacaaagaagacaatgcttgggttacggtggaagggacacggaagggtctggaatgctggaaggagccaagagcagatgccatcttggtgatgtgtttcatcttcaggacctgagacccatctggtcaaatatttgtgtgtatatgcaaaattttaggtcatttgttaaaaggagctcatgaatacatgtccttgacttcccagagatggaaaaaacacttctctccgccaaagaacttccaaatagtgcttctagcctatgctcctcatcagtgtccatgtctctcagatgtctctagttttggttgaggaatgaggaaatgtggttgcctccttttattggctgattcgtctgctgagctcctaacttcttagctaatctaggtgaaaccaacccttgtcctggaccctgggcttttgtggaggactgtcttactgttcacaaatactccgccttttccatgagaagctaatttatccctgcctgttgaaattgggcatggacaatgacttgcttggttgtctaataaaatgtgagcagaaaggatatgcgtcacttctgagccaaaagttttcagagccagtgcatggttggccatgttttctcttgcctttgtaggcacacaataaatgtttgttgaaaaaagatgaataaaaggaaagagccccaattaggagctgggttagctgaggcctattcccagagtttccactaactagctgtggcataatcatttggctactctactggccataaatggttctttgttattttgaaatggagtctcgctctgtcacccaggctggaatgcagtggcaaagcctctgctcactgcaacctccacctcctgggttcaagcgattctcctgcctcagcctcccaagtagctgggattataggtgcacaccgacacacctggctaatttttatatttttagtagagacggtgtttcaccatattggccaggctggtcttgaactcctgatctcaagtgatctgtcagccttgggctcccaaagtgcataaatggttcttaagatttctttttttttttttttttgagatgggggagggtcttgctatgttgcccaggctagtcttgcactgttgggttcaggccatactcctgcctcagccttggagtagttgggattatagacgtgagccaccatgcccagctcaggattctttcatttctaaaaccctgtgcagatattgcagaagtaaagtgatgatttttggatgcttattggaagtcttgttcatgctggtgaatggggaaaagactttgggtgggggtagggagcactgattggcaagttattttgtgtttttaaaacaaaaatcgctcttcagggtggtgcactattcccagattttctctggaagctgtgttccaacacctttctcagacttccccacactccccctcaggacatcagaaggagggcccccgaattcattcttgcagcaaagagcctcaagactctgctcagaccaggaaatgagggacctgttcctacaaattgctgtcaaaatgtattcttaatatttgttctctggagtcactgttttggtgacctcagtccctggaggctcctcctgggggcgataggatgccttcagaggggagctgacagccctgtgttgtgtctgggctcgcgggaggccatcgctgtgtccattggagccagatgttttcccagcccttaacctgctgtggtttcttagctcaacgtctccagtgcgactctcccataacacccagcgccatcttgtagacgcgctcatgcttccggaccgcgggcgccccaccgggaagagcgctccacgctgaagaggaaggaaacttcacacttaattcatcaaattcaaactgagctgtggtgaaaggaacggggcagagtgaaaggaacacccatatgccccagaagaccccggggcatcgctgcctttcagcttcttttgcgctttctgcagctcgtgtcacattccaaggacactcagctccgcacatgcacagagggccgcgtctgtcccgggggcgtgttacctaaaaccaggcgctgacctccaggtcaggaactcttgagtatttaatctctccgccgttcatggctacccgggtggcctctgaaatattacttaatgtctctgggttctgatttcctcaattgtgtggtacccagtgaccttacgatgacatttcactacctacgaaaaatggcgccatctgaatgtttagtctttacctagaagtataagaaggggtttcttgcctgggaatgatcctgtgaagctgaggtcacagtttatcttctcaattagggcagggattagtacaacagaaggtcattcgtcaagaaaaaggaaagcttctccctttccaaaaatgcaagtagtgaaacttacatttctcacttttccctgattgctcagaactaaatataaaatttaattggcaagtattttagcacttatttttaacatattttcttttggtcataatttttaattttattaaccttactgatttgacagggtcaaatctaaataaataataatattttatttattatacaatacataaatttctgcatagcttgaagggaccttgtggattgttaaatccaactatgtagtttacagattaagcagttaaagtctgcagagaagggacaggactaaatgtcatcagcttgttagttccaaagctgggtgggaaaagcagttcttccttctgattcttagaccaataattcattcctccattccataatgacgattcttagaacgtgaccttacctgtaacagtagggacaaagcaagacaattgtctttgagtttcaggaacagactttttagaattaaatagtttcaggtacatgctatagggaattcagttgatttgtcctggttagaaagcactttgttcacacctatacatatgactctaggttatgggttcttctggagtcttctgaacctgctgggcatttctgactggatgaaaattaacaaaagtctatgttcatcctgatgaaaattagcagcagttcatcttagtttaattgccacaacgtgcagctatgagagtatgtatattttcattcacgtatttgaaatatttatggattgtctgttatatgactagtactaggggttctataaatttacccatataatgtgtatgtgttaaatatatattattaatatgggtaaatgtaatatgtttatataggtaaatgtaatctatttggtatgtagatacacaaatttagagtatataacagatatgtttctgtatagacatatattttggagacattctgttgtctggcttctttatattcccatatgtgctcaatttctgtattccctttcctgattcatcgttttcttctagtattgaagtagaataaaggcaaccatgtattgtggagcagggggtacacaacacaattttcaaggactcatttctacctctacagccatgcacagcagccttgcagttcaaatcacgaagctaccacccatctgatgacattttgctgtcctaatcggaaagggtagctttagacaaaatgaaccatcttttgagggctgaacttgcaaatatgttcgtgtgtgtgtgtgtgtgtgtgt

SEQ ID NO: 1005 - DNA, 787 bp, Homo Sapiens
tgctgaaaggaaagatggccaaaggaaggaaagtggccccagaccctgccgtcgtgaggaagcaggaggctaagaaagtgatgaaaccgctgtgtgagaaaaggcctaagagttttcttaggcaggcattggacaggacatccagcccaaaagggacctccgctgctttgtgaaatggccccgctatatctggttccagctgcaaagagctatcctctataagcagctgaaagtgccttctgccattaaccagttcacccaagccttagacccccaaacagctactcagccacttaagctgatccacaagtactgaccagagacaaagcaagagaagaagcagagactgttggcccaggctgagaagaaagctgctagcaaaggggttgtccccactaggaaatcacctgttctttgagcaggggttaacactatcaccaccttgctggaaaagaagaaggctcagctggtattgcacatggtgtggaccccatcaagctggttaactttctgtctgtcctgtgtcctaaaatggggggtcccttaatgcattatcaaggggtaagaaggcaagactgggacatccagtccacaggaagcaccactgtggccttcacacaagttaaccaggaagacaaaggagctttggctaagctggtggaagctatcaggacaaattacaatgacggatatgatgagatctgcaatgtcccgagtccaaaatctgtggctcacaatgccaagctggaaatagcaaaggcagaggaacttgccactaaactgggtt

SEQ ID NO: 1006 - DNA, 7063 bp, Homo Sapiens
gtaaaaacttaaggtcttattcaggtcattactgggcctttgtctttccctaggcaggtatgttggctttctaaattctctcacatatgcaattactttttagtctccaaaaacaggtgtatcccttttgaatcccttggtggctacttcagtttatggaggttggataactggtgaccagcctacatgcccacaccacatttatcagagaagcactccataattagaacacagagccctggtgtttggaaggccaggtctttattgtctaccctggctccagcaagacctttcacccttgaatgtgggttatggaccccaatgccacatgacatgagactatagagactgtggttgggggatggtagttgcaaccctgctcgtggcttaaataaagcaaagattaccataatgtaccagccaagctgtcccctggaagctgcaagtgttcaaaataaactacggaggtttaaaatgtttgcctcagccaatttcttccaatataattgtgcagatagagatggatttttggtattttgtactttgccatttgtcttgacttcattctcctaaggatcagttttaatagtgaagcataattactctttgaagcatgttagttttcctgtattggaagtcctaatttgttcctcttttgttaaatttaaaatgtgtatgactcattatattggcatcctgaaataaataactctttgtaatccagacattttgattaatcagaaaattacactaacatcctagtcaattaaatgtctatgcagcactgtggtcccactttgcagagtgactataattgccttgctttgccattagtaattgttctagagtgtgaaataattgtaagtgtatgaaagctcttgtagagagaacttcacctaggcttgtggcattcactattaaagcaatgagtgccttctggggacagtcagctcaactgacttcaaatttttgcagagtgtcatcacaaacactaagtatagatttcagtttgaaaaactttaaatttaccttttattgcagtgtttggtggtataaatgcagctaaaagcatgagttaacaaagtgagatttagaaaggaaatgtcattgactgcctgagctatgtacttcatggaatatgtttttgtaataaagcccctagaaaatcgggaaacttatgaaacaagctttacatatgtatatgcatacatatatgtttaaaacttatattggactaaggttagaatacttagtgaggtctaaaatgacaaatggggtgtgagaatgtaagcaaagtaaacaaggactgtcagttcttaatttattagcagcacatgctcaccaggaacccgttgtcttaaagccaatcccctgagaacaaacagcattgagtctgaaattcaaatttcccagaatggaaaatgatgagccctagaattttagagtcttgtcattaaatttgcaaagttcagttacaccacagcccagctacttaccaagtgccttattactcttctctttgggcctacttaacccaactaaagaatcagggagtcagactaaatatccataaaggtcctcctaaagacacatcctctggttcattttgaatatctaacttaacattctgtccctgcaggtgttcttttttatagcatcattttagagctgtagcctatctgcagaggaagagctacaggcaggtttggagtgcatgagttcattacaaataccgtgttttataaattgatgccagtgttcttgacctgtcttgtgaacaactgggaccttatttcctgtgtcactctctcccctttgcatcttaacactttcagctagtcttagaggtttccattgagttctgaggacagactttcagaatcctcattctcttgcttcctttcctccagagatatttctgttcattattgtccttattatgtgttttttttttctgattatgaggcaactaaaatcatctgattattgatcactgtgttgaacctctaactgtatttcttcaatggtttgatatatttttcctttttttgagatgaattctcattctgttgccaggctggagtgcagtggcatgatctcagctcactgcaacctccgcctcctgggttcaagtgattctcctgcctcagcctcctgagtagctgggactacaggaacgtgccaccatgcccagctaatttttgtatttttagtagagacgatgtttcaccatgttggccaggatggtctggatctcttgacctcatgatctgcccacctcggcctcccaaaatgctgggattataggtgtacaccaccgcacccagctgacatatttttcatagttaatattgctagtcagtatgagtttttaaatgtgcatatttcgtttactatttttcttccttcaagcctctgaaaatattgatggtgtctcaaaattaataatttattgattgaaaaaattccattgatctattcatatttatttataacgtaccaaatctagtgcaataagtagtcccaggaatttggttcccatttgggagttatacttgaatttcatttataaacccaatttctctcctctggcacatgtattcataatcatcttagcatgcttttagttgttacagatgaggtaactgcagtttgatgtttactctacactctttttcacctgcaaatgttagctagagctgcgtggtcctataagtttgctgtacccttgataaaagaacttacattttataatcattgctatggctgtactggatcgtggatccataactctacaggtttgtcaaacactaccaaatgctacaccacaaacactgatctttattctttgcttattaaaacaagcaaccaaccaggttaatgtattccaagaggaaaaagaaattgaccaaactaactttggaaaatggtaatttgactgcataaggtttacacaaactgagctgtgtgtaaacacggtatctagttggtaattttatcacagggacaaaagttaattctgacattacttttcattttcatttacactaggctagagaaaatgaataagttgtagagaatgtgagctagattcctcactgttacagaaggaagttataagttagaaagggtacaagactagaaaaaatcctgtggtgccagattagagttaaaaatatcaatatatacgcagatagatatgtagataagatagactcacagagagatggtagttaggcagatagatagatagacagatacatatacatagagattgatagatgatgtatatacatgggttaggacacactattgcttgttctgtctgctaagagatacatgcatcccgtaagcaatgagcataaatcttggtttctaaataacattctccaatataatgattcagatctctggagcaatgtttgcttctaggactggggcagtgaaaacataagatgatcctggagcatcctgatgtgccagcaggccagaaagtgctcaaaacacaaggatgtggcatgcgtcgtaatccaaagtaaaatataaagagacgtgagtccatactatgcaaatacattgttaattaaatgaatgagaaggaagagactaatctttcccatggaagaatttcaaataatttatgtagaaaacatgagggcaaagaaaatcaccattagaacactatagtgatagtggctgttggcaagatccaatgagggacccatattagtgggtgaaacttgaggaggaaacagggtatttgcaaagcctgaaagtatctttaaccgaatatttactaattaccatggttgttttaatatacactcacaaatatattgttatttctgccttaaagaggtggagtttaattttcctctccttaagtgtgggctggatttagtgactcaattttaacatatagaggatggaagggaaaaataacctcgcagaggagcaacctggcagacacaagctaaaccgagtgattgcggttcatgtcaccagtgatgccttatccccataggatgtgatgaaaaggccacctcacctctgcaacattcttccctcaaatccataatcctagtctagtcagacaaacataaaccaagggaactccacacatatccaactggttttcagcaaaagtgccaaggtcatgaaaaacagaaaagattgagacactgtcacagagtcaaagacactaacacatcatgatgagcaaacatggcacagtaccctgtattggatcctggaaccaataataataatagaaaagtggcaaaatccaaatgaattgtatagtctacttatagtattataccaatgttaattcttcttagtgttgttaaatatattatagttacatgagatgttaaccttaggggaagttaaaggcatattgaaaccatccacactatctctggaactcttctcaaaatctaaaattacttcaaaataaaaattttttaaatcaggaaagaggctaaagcgggctgggtgtggtggctcatgcctgtaatcccagcactttgggaggtggaggtgggcagatcactctagcccaggagtttgagaccagcctggccaatgtagtgaagccctgtctctactaaaaatacaaaaagtaaccgggcatagtggtgagtgcctataatcccagctactttggagggtgaggccggagaattgcttgaacccaggaggtggaggttgcagtgagctgaggttgcgccactacactccagcctgggtgagagaaaaataaaagaggctaaagcatcaaaagggggagcagggaagcagggctctcttttgtcttaataaggaagtctgagaagttctggcaccattgtcatatgtttctagcagagcagaatgccagggctgggccatgtctggggaacagcctcaggatagagtagacagcatataagggaactgaggccagaccccaggaagaacaaaaaatatatatttatgcagagagaacaatataaacaagcttctactgctctgatgataaatgtgagatgattcacaggacactaattcatatctactcttaccatcagaaaatataaacactattaaaacaaaatgtttacatagatccaagcttatattgtgaaaatagaacttctcattgttctctacatgggggtgtgtacaacactggtggaccccgcaagcttgctcaggtacaactcaggtacaggatcatttgggaaccctgagcatggcccctgagccaatgtataacatgattggtcaggctggttctgccttgaataacacagattccactttagctgagagaaggtaatatttttttaaattccattttggtttatctacactgttttagaatgtatgggtttctctagatcctctgttacttcaggtgtgacattttatgcacgtcacttgttgcagcccactggtgtccacattctgccatgtgatgtggaggatcctcacctccatgtaggcccatttctccttctcactttacaacataatttacatgcatgaagaactatatcagaccatggagtaatttttgcttcaatcatcaaacacagtttagaaaaactcaagaaggccagtctgtcgtgtttatccatgtttttattatttctatttttcttcattcctgatgttatgtttccttattttatcattttgtttctgaattaagaacttccattagccacacctttaagaaggttgctgtgtccttccttgagtcccaggtccccctggcagcccacagtgtggatctgggatacacagggtgagcacaggctgtaggagttcttgaaattctggcaggggttctgcacttgacctaagaggtaaggcaccagcacttctgaaaccagacagaattggatggaagctgtattttaaggtgattgtctgtatttatgaggattaatcttttggataatctggaaggcctgggggactcactggaaagatatggtaataatttcaataaatatttaagggctataccaagttgaggctggtaggaccagggagaagcagctgcatgctacatattgagatcatctaaagacagcaaattgatgttttacatgaggttgattttgaagagtaaggaggcatatctggtccccagtctcatctctggaaagaactgcaccagacccaatccaccctaattacctgttctctcctgattgtgaagtctatgaaaagaaacacataggtcattttcagaaaatgaagacatggtgttagtagcaaaatctcactgtggtgtgaatgagcatttatgaactgtcaggaaggagcccttcattgctctgttgtcaagaatggcagacactaagagctcagccagggctttgacttaagctccatgtgaataaccttggcctatgctccctggacatgcagttcactgtccgcagagtgtggccagtttgtctgatgggaggaatcacatgcactgtgagtcaccccttgcagcaagaagtccacaaacaggactttttcctggcaatagtaagtgaggtcagctggggtgtggagctgcccaagactggctgcacactccagggatgggagttttagtgccctggagggagcctccacctgtgactgctttagcactgccctgagaaccatggtccacatggcgcctgtgagcagagatgggggaaagaggagacatcactgggctgcagaggtcaacagggttgtggaagtgtcttttattgcaattaagttttctagtcatgaaacctcttcgaggtatagaatcagctctgaaattctcaaagtgttttgatcatagtatttaaggatttatttttttaactgagatttacattactatgtatttgcagtaatgtttttgttaaaagttgtatcgtaatgtatttagccagaacttagtgtctgtgagaaagaaaagatactagaacttcttactaccttctaagatataaagtttaaaattatataatgtaaccagtgacttccctgttttaaaaaatcacatactcaaaaaaataaacttactgtctgtata

SEQ ID NO: 1007 - DNA, 3311 bp, Homo Sapiens
gacccaacaccaggccatgggggctactaagtctggcggagtcaaaggaacgagaaaagacaagttaaaagagaaagtgggaccatgcagccaatgctagtgtggaggctgcaaaggccctgagctctgggatcccacactatttattgatgatcaaacaaagaaacaggcagtgaagatgtgggggttgaaaggaagcggtgtatcaagtgaatgagctacagctgtgacggtttagcattttctttgaaacatacggctacttgagataaagggagtgctagaagcaaggagccagcaagtctagacacattccaaagaccacgaggggttttaatcctagaccctggacgtgttccaagccctgcctcagcttctctcccaacactcagcttttctcccaacactcaacattggccattgagagccccttcagctggttgcagtgtttgataagcaagatctacatcatggaggtgatgacatcagtgccagctccatgcatacccagagcccggagagatttactagtgctagtgagcttggcaccaacaatgtctcagcctttcagtctgatcaagcagcaagtgaaattgaggtcacatcttcagtacttcatgcaaatatacctttggagcccaacccttctgaccatccaaaggcaagcacaatattcctgagaaaatctcaaacagatggtatctactgagcattttactcaacaatacagttcatgttcgacaatattccttgatgacagcatagccagccagcctcatcttacaatgacactaaaatctgtgaccttggcactatattatcatatcaagcaaagcgaaaagaggttttggaggaatattttaagtatgatcctgaacacaaattgatcttcagatttgttcgtactctgtttaaagccatgaggctaacagctgagtttgcaatcgtaagtttgatttacatagaaagacttgtaagttatgctgatatcgacatttgtccaactaactggaagaggattgtcttgggagccattcttcttgcctccaaggtttggagtgatatggctgtgtggaatgaggactactgcaagctctttaagaacattacagttgaagaaatgaatgagttggaaaggcaattcttgaagctaattaattataataacagcattactaacagtgtttatagcagattctacttcgatcttcgcaccttggcacacaacaacggcctgtattcaccagtttatcttcttgacagagaaagagcttggaagctggaggctttttcaaggatggaacaagacaaagttttctacagtgctgccaagaatgggtctctgagtgcagatgatttaattcatcttcagcgtgctaaggccatcctcttctgaaggaagaaatgaggagtaatttaacatctgaacccctcatcaaaaaagacaggaaaatatcacctctcctgctaaagaactagaaaagttggtattttctaaagaagaaacacctcaattcaagttaactcaaggacaactaagattgcacttcgtagtaaagaatgggaccttgtcagggcaacaacacactcttacactcttctgtcctgtttaatgtaaacagagttataaaaaccacttcaaagtgaagactcctgcccacgtacagatatttgcttaatgtgtgggctgatagctgtgaactatgtaaggcttttaaaacaatagtttaactttttagattttaaagataacttttctgtttcttttatgtttttttcttttccccaatattcctgcatatgcatttggaatcagtgcagtatcactgttaaaacatgggagtctaacaactcctaaagccactaggagcagtcccagcattgtcaggtatggaagggctctttcttcctacttttaccatggaagctacagttactggcgatcatcaagcaaaagctgccaattaacatttgccattcgtatcctttgtaagcccttcttattagcagtttagcatgtttgggggtcataaaaagagaaagtattggttattgattatctacttttatgaagctctatggtgtatttcttatgaactataatggttctcatttgctgataaattttcttattaagtaaatgtattcaaagatgttttcatagtgccaagcagcatggtggtccagtggttatataaaaataataaaatacaaggtgtcctgaaagtttcagggcagtttttagctttaatatagtgtgcctgggccctccagaggactgcagcatatgtatacatgctgtaaatctttacaaaatatcatttgaaagtgtaattgtatttcttctttttatttttaatagatgatgcctcactatattgcccaagctacagtgcaatgattaatcagagacacaatcatagcacaccacagcctgaaaatcctggcctcaagcaatgttcccatgtcagcctaccaagtagctgggaccatgggtgtgtaccactgcctctggctttattttgcagaatttgaatgttaaacttttaaccttttgtttcagtcaatatctgctatcttcaagaaggactgaaacaataaattaaaagcttaatactcaggagctaggcatgcttgtagtcccagctactcatgaggcttaaatggaggatcacttgaggcctagccttggaggctgcagtgcactgtgattgtgcctgtaaatagctattgcactccagccttggcaacataatgagacactgtcactttaaaaaatggcaaaactaaataaacgtaaaagaaatacaacaagcttttcaatgatttgtaaatgtttgtagcattgttacttctacaagtatcaaagcttaaaatttcactaagacttttggaattcttgtgtttttataaagtgcccttttctcttgtaaagtagctctttgcaaggcttttatctgcattgatcacctcagattattttccctagatgtgataaagaggaggatccatgttaattcatatgtaacaaattagaaggaattggaccctaatagtagtaggtgatgcaatacattttattatcccacatgttagcctggatgcaggtatcatatttcatgtcctgctatttaaaaagaacttccataaaccttaggaatcctacctcctgaaaaagtatcatttatggaatgcagagcttagagattggagtattgattgcagttttattttcaaaataaatgctacaattgatgtggttttcatttctcatgtttatattaaaagaaaacctagtaaactaattaaaa

SEQ ID NO: 1008 - DNA, 2040 bp, Homo Sapiens
acgcgcgcggggcaacctcgtctcgcctcccggcccgacggagccctcgcctcaccttttccagcagctccgccgccggcccgtcgtcctcctcgcctccggtcccattcgccgccgcagccgcctcggcctgacagtcgcccgtaggggagaactgaggtcgcttgaagcgcttcgtccggctcttgcccatggtgacgtgcgctgggcggacagaccaccgagagaggagggcaacagcaggcggtggaggctgccgcgccgttaacaaggtccgttgctgctgctcagctgggccggctgacggctgcagcacacatgggcaagccgtgcgcaggcgcacggcgcgtcgtctgccgggtcggggttggggcggggcggggtggggggaactggcgcacggagcgcgcaggcgtggaagagggcataggcggggccagcttcggcaaaggggcggagccttgtgggtttaccgggtaagtaggaggttggactagaatagtaacgccgacccgggcgagaggatcacttgaggccagaagttcgagaccatcttgggcaacataggaaaacactccactccctgtcctccccaccaaaaaaattaaaaattatctgggcatagtggcgtgtgtgtgtagtcccagctacttgggacgttgaagccggaggatcacttgaccccaggagtttgaggctgaggtgagccgtgatcctgctactgcactccatcctgggcgacagagcgagaccctgtctcaatcaatcaatcaagcaaccaataagttagtaacaccggctacaaataatcaaatgtgattaagaatacctaacttgcaaggttattgtaagttctgtaaagttcataaagttctgtaaagtgcctaacaccaagcctgatatatagcaggtactcaaaaagcattaaccacgattttattttgtgtccccagcacctcccatagctcctgtcgtagacagagactagttaatgttttggaacgaatgtgtgtctatatttgataaaacagaatcgcttaagaacctaatctccctgccttagtttcctcatcagtgaagtggggacatcgatagtatatacctcatggagttgttacgaagactaaatgtgttcatatgtttaaggtgctaagaacagagactggcagatactaagcactatgtaaatgtttggaaacgtatttaacaaagagattcttttgcagatatttgttgagtactaggtacagtgctgggcattggaataaagcagtaatcaagacagtttggttcctgtcctctctccctgtccttatggaatttacagtccagggagagatctgttgaatatataattatatgaataactttggttataattgtggtaaatactaagcagagggaaaagtacaggagaatcttaggtggtctttataattagacatgtaacgagtgagtactcaatatatgcatagctttgggtcaattttctttttttctttttgtttttgaaacagagtctcactctgctgtccaggctggagtgcaatggtgcgatctcggcttattgtaacctctgccttggagttcaagcagtcctcctgccttagcctcctaagtagctgagattacaggtatgtgccaccatgcccagctattttttttttattattatttttaggagagacggggttttaccacgttggtcaggctggtctcgaactcttgatctcaaatgatctgcctgcctcagcctcccaaagtgctagtattacaggtatgagccaccacgcccaggctcaggtcaacattctactggagaaaatttccattccatggtaaccctactgtcaaagagttgactgtccagtaagggaaattaattactatggcaaattttagagagtaacagaagtgtagctcatgttgcatttgggcctatcaaagatcaatcttgggctgggcactgtggctcacacctgtaatcccaccactttgggaagccaaggtgagcagatcacctgaggtctggagttcaag

SEQ ID NO: 1009 - DNA, 262 bp, Homo sapiens
ccccgccacacagtctgcacggcctccaccgcagctctggtgagcctcttggccagctcctggtgacagcgtgcacctccctgctctgagaaggtctccctctcctctctgcccaccctgtacagagacatctttcaagcccatcccagaggagagtggcctctctcctcaaccccaagaggacggcctctcatgtggctgtcacccatctgacccctatcacagacctgaggagtgggcagagtccttgaccgcattctag

SEQ ID NO: 1010 - DNA, 2297 bp, Homo sapiens
cacccctttgactttcccgacttctggtccgagtattcgtagcctgggaaggagactcacattgggggcagtgccgccccttccgcaggtcccccagcccagaggaccaccctcccgcccacctcagtctcctggggccgctggctttgccggggcagcctcacctccgcggcgcctgcgggcggccaggaggacagtgaccagtagcaggatgaagagcagcagcgtggccagcacgtagcccagctgctggaagaagtgggctcggctctcggggacgatgacattgatgacgttgtggccgcgcgccagtgtggggtctgcggggaacgcggggtcggggcggcgtcaggtaccagcaagacctgcgccccgacccgggccacggcccccgctgggatccgcgggcctcgggcaagggacagcgggcgcagagcaacccccggtggggtgggctcccgccttcccgggtcccagggaggcctccttcacctgggcctggggcgccgctgtggctggagccgttgcccggagagccccgggggggcggctccgcgtggggttcggcgaccgtcaggtggaagacgcggcgttcgtgcaggccacagtaatggtggtgcaggtggcaggagtaggtgccctcgtcggcgacctccagcggctcgatacgcagtgagaagtcaccgcgctcaaaggcatccgcgcccacagccacgcggtcgcgcagaaaaaggggcccgtaggcgcggcgctcgcccgacgcgtagaggtccagcaggcggtccgcgcggtcgtgcgggaccccgggcggctgccggtcccagtgcaccacctgttgagcctcctccacgtgccggtcggtccacacgtgcccgcggttcacgcaggcggacggccaggctctcgtagaggtggcagtagtgatggtgcaggttgcaggtgtacagccccgcgtccgtctcctccaccgctgcgcacccaggaggaagccgcgcgtgagccttgcggtgcccccgaccccgcggccccggacccctgccccgaccccgcggccccggtccccggtccccgcaccgcggatgagcagcgagaagttgccgtcgtcgaaggccgaggccgagagctccaggcggccgcggtcccgcgcctcgtacacgcgctgctcgcccgccgagtacaagtccagcaggcgccgcgcggggccacccccggggccgcgcaggtcccagtggagcacgcgctggcggtcgtgcagccggtcctgggtccacaccatgcgcgggctctggcagcgcagcaccgcccgggcgcccgcctcccagctcaccgcggactcggacaccacggagctgccagcagcggcgggcccgcgttgctgcttgagggactctcattgtcgtaggccgcctcggcatccactctgaatctaggctggactttctctgaccggaagcggggctgccacccgggacagtttccaattcacatcccccgtcctcgagctgatccacccagacgcccgccctacgcactgtcccctggtgaccaccccctgtgtccccacagaccccacgccccacatggactgtgcagctgcaccacggagtccccccacagtcagcgtggccccacggggctcgtgccgcttgccttaaacccaccagttaaaactcccccaccaggcatggtggctcacgcctgtaatcccagcactttgggaggccaaggcaggtggatcacctgaggtcaggaattcaagaccagcctggccaatatgaaaaaccccatctgtactaaaaatacaaaaaattagccggacggggtggtagtgggcgcctatagtcccagctacttgggaggccgaggcaagaaaatgacttgaacccgggaggtggaggttgcagtgagccgagatcacgccactgcactgcagcctccttggcgagagagaaactgcctccaaaaaaattccctgagggaaacctgtatgcagaacgccctgatcccaataaagggttggcctgggggtccctgtctctctccactttccctggcctcccagcagtctgtgcaccccagggcccgtgggtgataaaagctgtttctatcctgtgtctctagatcactgggggctgctctccctcacatagatcctatgtgaaaactgccccagagatgtggccgagagcctgggagcttcccagaggaatgtgcccggtcagcagccagcccaggcctgggagcgggggctggaacagaccccacagttctcaggtccccttcaatcactgacccac

SEQ ID NO: 1011 - DNA, 800 bp, Homo sapiens
ggctcctgcagtgggcccgagatactaaggcacgaagctaacctaagcccagtggggtggggcggggcaggacaggcttggagagctgcgccccaggcctgcaaagcacagtgaccgagcaatggcgacggtctgtctgggacaattcggcacaggatggaggtgcggggtgagccggagtgcccatggctcttgctggaaggggctccatgccctggccgcctctataaaggcctgcggagagcggggagagccctggatgcggctggcacagcagcgcaagcccaggggccaatccggggccagagtctgggagtctgacgcccggctggaaagggcgtgtgatgatgccaaagtgccggagccgtcgccggcaggtcctcctccgcggggatcttaaggaggcagcaggaatgaggagaggagagcgggcggaggacctgggagctcaggcgccctcaggcaggtggcgcaaagatgggcgggcggcctcgcgcttcaggggtgtctgcgcaggccggggcgcgcgagggccgggcgcatgaggttctcggtgatgtaggccaccagcaggcagatgaccaccagcatgacgcagatggagccgcccaccgccgtcatggccaccacgatgtcctgcatgccggccggctcggcggtgaactccacgcactcggccggctcgggggtctctggcgcggcggcggcgggcccagcgcgcagcggcagcggctgcaggcacaggcggtagaggacgctgtcgtgcacgtcgggcagcaggacggacagcgcccacccgg

SEQ ID NO: 1012 - DNA, 906 bp, Homo sapiens
gtgggggggaggagggggacgcagcgaggcggccggagtgccggtggggctggggtgcgggcaggggcgcggggtgcgggcagggccgccgctctcccggcttcccgcctagtgagcgcaccttggacccctgcggcttttccgagccgaaactcacgggctgtggccggcttcgtttcgcgtcgtgcagctccgcgaccgcccgtggccacaccagtcggggacttcgtgctttacgatgggggcgcagcggtctggcacgcgcaggaccccgggccttgcaccccaacgctggccgccctggacccgcggcggggacccgcgcagtcagggacggacagcgcccacccggaggaaagcctgacagatgagacttcgcaaggtgttggattccagctgctgtggccctgaaggtgggtggtgggaagaacgggagaatgaagccagccttgggagaggtaggacgccagcccggcccagctgcttccagcatctggatccagcctcacctgaagccagccacctcctggactgcaaagtcattgtcaacaccgaaacacagggtttctgaccattgcaacccagggtcccggcgtgtcgtggctgcagaccctgcagacccctatgaagatggtcctgcctgccttgcatcgggcctctagctagggactgtggttgcagacgtagttctgggactgagctcctggtgagaggccagtggtgagggaagagagaccagcagagaaaagagtggagcctcgggctgctagcagagtggcagaaaccgagcctgcgagaggaaaacattgtttcccgcggcctcctgctgagccatggggacccagatattgcgaagtccagctggggccaaccctaaggaaggaaggagggaaggggacagggagg

SEQ ID NO: 1013 - DNA, 739 bp, Homo sapiens
gtcctcacctgcccgcccgcctcaccgcggatggcgccggcgaccggggctgcggggtgcgcgcgggctgctcggaggcgctgtggcgggcgagggcgcgggtggctggagcacccggcccgcggcaaggaccggctggcggcaggcggggcgcgcggagcccggggctcggccgagacggagcgaaagagaaagtaagaccgaggaccgggcagcctggccggggcagctctgtccccgccgggcccggctgtgccagcgcagctcggaactggccctttaagaaaacattccgtgttcggcgctcccgcccggggcccgcaccccggacactttaaaaggacccaggtggccccggaggcgaggtgactatccccccaccctgcccctgcgtcgcggcgcgtcgcgctgctgctcccgccccagccggggccgaagatggggcggcggctgcggttttccacacgacttccttggatctcggggcacacgcgccgatagttcggacgcgagtccgggctggttttgctccgttttactgcgtttgattactaatttaaaagctttgcgttccccgtcgccccggcccgcttttctcctgcattctcccctcggcccccgtccccgccctgcgatcgctggagggggcgtcggggctcgcgcgccagaacccggctcctccgaagccccctccgggccccaccgcccccctcgcgcctcccggcccccgcctcctccc

SEQ ID NO: 1014 - DNA, 819 bp, Homo sapiens
ccagtttctgacggtctgtccctctcttcagaggcatccaggacagggtgacccagtgtggtgtgtggacctgtcactcccctccccacaggcaagtagaagatcgagctgtgcacagatgcctcttctgtctcccaagaggttctctggagtcgctgtctccaggggactacggtttgctctcatgaccagccatggaggcagaagtcccagactcagggcagcccttggagtctgatccaggtcagaagtccctggtgcaacacctgtgcctgggagaagctctggccatggcttctcacccagacagtctttctgggcaacttggggaagcccctgttctgctcaagtctcaccccatggaagaggtgggggaagggggccttggtttttcaggaagacaggttggagagcacgagtcactacaaagcagtaaaagtgaatggtgtctccaggggctgggtccagaacaccacggagagccccagccataaaggtgtgttccgcctctggcctgcaggaatctctttgaatctctttgattggtggctccaagagcaatgggaagtcaacagccaggaggctggactgggttccctgggaccccgaggtcccagaggctgctgggcagtggttgtcggcaaagaagaaaggtccaagagggtcaggcctggccaattagggatcgacgaaggagactgcgatgtagcgggtgcccctggtggtggggagcccctcatggtaatgcgtgagtcgtccagggtgcatgagggtccagcccttccttggggctcggatggaacagttgtagcgcaggaa

SEQ ID NO: 1015 - DNA, 547 bp, Homo sapiens
gaagaagttttaaatatcctcaatttttttaaaaaatagagcaaaaagatagcaaaaccaaaacacatgaatgtcattaacaaattaaattgacaaaaatatgattttggggagacaaatcattaatagcaacaagggcccacattatatcagccataatttagcaggaggaagctaaggggagaaacaaagcagttgacatgcctcaggatccccaaatgtccaacatgtactcaatggaaagtagccaaaactgggagaggctttgtgtactctactagcaggtgaataaaaagagttaacagtaagatctaaaggagtggaatggtctgggtttcttgaacatttgaaacttccttccagggtagtcactcactgaggacaaactgttgagagcaggacccaaactgagcagtataaagacaagggaaagagaaggtaaagataaaagtggaagaagtgcctagagtagagacgggatttcaccatgttggccaggatggtctcagtctcctgatccacccacctcggcttcccaaagtgctgg

SEQ ID NO: 1016 - DNA, 4867 bp, Homo sapiens
atagcaaccccattatgtgacagtcaacatcatcagataattgccaaatgtccttttggggatgaaagcattccctgcttgggatctgctggtttaagggactaacatactgtgcctggcatggagtttagcagactttgggatcccttagatagaactcttggttattaatagtgcgttgtattattgaactatgaattctctcccctttgacttactaataaaaccactttatttccttagctgatttctgtctcccaaagacaagattgggtatttttttccagaacccaggtctttctcctgaaccttctatgttgcttagaagccttgctcccaggatgagccgaacttcctatgatgtcctgttgagtgtgcgtcctagccttttaatgtataggtactctagacttgcattcgaggttatggtcagtatcacaagtgattcatacaagaaatcatccagatatcttcaccatgaaccaaagggaagggtacagactgagaagctcaactcacagaggctggcaggctgaggccggggattgtactctgagggaaaacagatagtatgccgcaaactcccaccaacaaaatgatcatttccctggtgagcaggcacacagtattaacattagccaggggccagttttcaatagtttaaactttaatcaagatggctattccataccacaagttaacatctggatttcatgtttctgccatccatattcccactgaatagtgattcctagtgtttttaatgaagagagaaagaaaattttggctcctacattttagtagtcatatttttgctatctgttggagaaaatacataaatgcaaaagattacaatgaattcagtagctttgtcaaatggttacagcttcggtattgcatatatttgaaaactaatggtacatacatgcaagaaaaataattcattgtgcccataggcagcaggttggagatgtgtggattttggacttctcgtcaccttctctggccacccagagtctctgcggcccacaggttgggcccggatcagtgcagtgctgaacaatgtcaggtgcagtgaggtgcttgacaagtgccttggaaaactatggcctctgccctgggactttgagtcttctgccgattttaagggattcctctgttcttcaaacccaactctgcctccctgtgacacaactgattaacctgtaatttgggcccctggctttcagaaaactctgcaaaatttctgcagagtgacttcctggtatgaataccagaaagcaccagttatggtcagaataacagaactggccccatgctagatttccgggaatacgatgcaattggccaactgccatcactaactagtgtcaccctgcctcatctccagcaatgtcctaaaacccctcaagcatgtgatccgtcatatcattttctcatttatgccaacactggataatggcctaatctctccagcagcattcagatttattagagaagatggcatttacaaaaccatttccctgttcctctgcaaacaccctaagctgtcttataataaaccactctctttatagtaagccttccttttaacagtggtttattccctgcaattaaaatcacctggaagagtccagaaactggttttcatttctcttccttcgtgtttggttcatctttggctggagggctctgcaggacttgggagtgaacattagagagaggcagaggccaaactttgctaaggatgagagctctgcagcaggacatggtcagtatgaggctggacccagcctgggtgaccatctgctgggcctgctggcaaagcacctcccgcgctgggtttagatgttcaggagaaaaatacatgcgcaaaaccaaatgtgatctggttgggaggacttttccgttcatggtgttttgctttcaagattgaccactaaagaaaatgacaagtttggcagccacggtatgttgtcatttgaatacaacccagagaaacattgagagacagtaatttctaggacaagggcctcccgggtttttgtatgaaagatttgtttgaacaaactaagatgctgatgcagggaagttcagcatctatagcacaggacagagatctctggagtccattgccaagtgcaaatgctgtctcttaacacttcctagctcggtgaggcgggcaagttgctttactaaaataggccttggtttcctcgtagggataatgctggtcctgacctcccacggctgttgtaggattcaggtagaatgtgtgtgatgtgcagagcacagtacttggcacttgccaattcccctgtaaatgtcgttaacaaatgttcacaagtctccagtatccctgcaggcactgaggaaggaaattgagtttattctttggtttctttgtcagctaacattcatgaagcactctatgattgacagagcactgtgatgagcgcccaggatacccggacaagtaaggtgccgaccacctgctggaaaccagaggagggaagagcagcagaggaaagccccattgtgggatccagagacctgggttctagcctcgagcctgcaactaagaggctaaagaagagcagagtgggccaggcatggtggcgctcaacacctgtaatcctagtactttgggaggccaaggcgggcagattatttcaagccaggagttcgagaccagcctggccaacatggcaaaaccctgtctctactaaaaatacaaaactacccagtgtggtggtgcacacctgtaattccagctacttgggaggctgaagcacaagaattgcttgaacccgggaggcagaggctgcagtgagccaagatcgtgccactgcactccagtctgcatgtcagagtgagactccatctcaaaaaaaaaaaaaaagaggagcagaggggacttctcacttccatgagggaagtgaggcttgtggttccaatcgtatggccaacgtgtaggctgtggcttcgccaccagcctccgcaacttgcaagaggcatcccgggaagtggcgtaggaactgagacactggttcagtcaaaatgagggcatttggcatttggtaagacttctctgaagtccctcccatttctgaatttctacaacttctgactattcataatatcacccaatccatcagttccaccttaaaaaatttcttaaaggacaggcagttcgtcttggggagtgtggtctcacctggcttgagcagaggtgatgtcagcctcccaactctgccagagacatgcgcaggagagacacttgaaagctggggtggagagaaggtggcaccagagggaagtgcccatgtgggttatggaatgacgcaatgcctatacaatccaggaagggacactgaagacagcctcatctggtctttactttgcagttggagaaactgaggctggagagcgcaagtgagtctgctgaggctatacagcactttataccagaacctgggctagaacaagacctctggcctcttggtccaatttgtgttaccctgacccccaagcttcctcatgcggtgtcccagctgctacacagatctgtgccgcagatcccagcagaacctttgtgtgccatcaactcatcctttctgtgccctcaaataacttaaattctgaaacagacaagctggaaacagaggagtcctctggtatggagtttatggcttggtctgactttctagggagcatagaagagggtgatttagaaaaaaaaaaaaaagtacaagccagaggacaagaggcaatgagtggggcagaggggctatgttctttgtttacatctcatttctctttgggtcttaagtttgctgttttgaaaaggccccatggcctgggcagctcaggaggttgaagaagcaaacctccgtgcaggagttctgaacttagaaaacttggatgggctctagggtttctggaaaatgctgatatttttgcaaaactgtgtgtgtgtgtgtgtgtgtgtgtgtgtgtgtgtgtgtggatttctctgtgaagagggtttgtggctttcaccatgtcctcaaagaggttttatggctttagcaattcgcaaaaaggttatcaaccaagtgccaagatcccctccaccaccaaacaagatgaaaacccaaaaactttgctcaggatctcagagcttcactgactctccatgaaaccccactcacaatccctgttttgttttttctcaaggcaggaattgggaacgtggtatgtatcgtgggtgatacacaatacacagagtatcgtgtatcgatagattagagttggtgatacaccgaactcaactcacagtcttcagtcttctgtctggtattctttttgagagtcacctggcggcaaaccattgtaattgaaatgtaacgtggccctttcgccatgctctgtgaaagtgtttaacgtgtgcctttggtctgtgcccaccttttagtatcaccgtcatttcttactgttttttctttcttcccctgaaaagtagaaaaacaggaattaatacctgagatctgtcctaacccactatccccctccattaaagaaattttgggggtaatttttggcttacgatgttctagaaactggctgtgctaagcacataggattttgtaaaaataatctgacagttaaagactattgtttattctcatgttacagataaggaaactgaggctttgagagggtaaaaattttcctaaggtcaggtggtatgtaaatagtagggcaaggatttgaattcaggtatatattgggtctttgagagtactccctgaaaactacaggttccttacactgcacacatcatggaggagattggtcaagagtaggttgaccaggctgggcgagg

SEQ ID NO: 1017 - DNA, 1271 bp, Homo sapiens
tgtacatacagatattttgtttatccattcacctattaagattgacatttgggcagtttccactttctggctattatgaataatgctgctataacattcacgtaatttttaataaggacatatatttctttttttcttttttttgagacagagtctcactctgtcacccaggctggagtgctgcggcaagatttcggctcacagcaacctccgcctcccaggttcaagcgcttctcctgcctcagcctcccaagtagttgggattacaggtgtgtgccaccacgcctggctaatttttgtatttttagtagagatggagtttcaccatgttggccaggctggtcttgaactcctgacctcaggtgatctgcccatctcggcctcccaaagtgctaggattacagacgtgagacactgcgcccagcctcatttcttctaggtatacctagggagtgaaatttctgggtcatataaatgcttaatcttttgaaaaactgccagaatgttttccaaaatggttgcaccgttttacagtctcaatggcggtgtcctaagtctcccatttctccaaaccctcaacacttgttattttctgtattttattgactctgatgatcctagtgcttagcagatttgaaggggttttgatttgcttttccctgataagtactgattttgagcagctttccatgtggttactgaccacctgtatgccctctggaaaaaggtctattccaataatttgcccattgtttaattgggatttctttcttttcttttttttttttcttttttgaggtagggtcttgctctgttgcccaggctggagtgcaatggtctgattttggctcactgcagcctccacctcctgggcccaagagatcctcccacctctgcctctcgattagctgggaccacaggtgcccgccaccatacccgactaattattttggtattttttgtagagacagggttttgctgtgttgcccaagctggtcttgaactcctgggcttaagtgatccgtccgcctggcctcccaaagtgctgggattacaggcgtgagccagtgcacccagatggggtctgactgtgtcacccaggctagagtgtaatggcatgatctcggcccactgcaacctctgtttccggggcccaggcgatcctcccacctcagcctccagagtagctgggaccacaggtatgtgccaccacacacagattaattttttgtatttttggtagagacagggtttcaccatgttgcccaggc

SEQ ID NO: 1018 - DNA, 1045 bp, Homo sapiens
ctcccaaagtgctgggattacaggtgtgagccaccgtgcccagcctaaaaattctttatcctcaagttcaacagtcatttctaagaatgatatcttttgtctgcttcatgtaactgatgcccagcagaatcctacctggcttatcaacttgacagatgcccccatcacagggtttctcatccactttcatctcttcctggttatttgctaaatggtgaaacagtttgtcttcagaggcccctgaacttctttctctcactctttttgagacagtctcactctgtcacccaggctggagtgcagcggtgggatcttggctcactgcagcgtcaacctcccaggctcaagtattcctcccacctcagcctcccaagtagctgtgactacagatgtgcaccaccactcccagataattttttggtatttttttgggagatggagttttgccgtgttgcccaggctggtcttgaactcttgagcttaatcactctaccttggcctccaaagtgcagggattacaggcatgaggcacctcgcccggccccctgaacttctctatgatgtctattgtctcaactcttttcaaagactaaggaaagttccagccatcaaaattttatatcactgtatctgtttctcaagcacagagtcttgggttggggcctcagaatatgcatttaaaaagatgcaactcaagtgttatggactaaatgtttgtgtccccccaaaatgcctatgctgaaatcctaagacccagtgtgacagtattagataggcctttggaggtaattaggtcacgtgggtagaggcttcatgaataggattctccctcataagagaaatgagagttgctcttgctccttgttctccaccatgtgaggaaatgagaggacggcagtctgcaaaccaagaagagggccctcaccagacacagaattggccagcgccttgatcttggacttccagcctctggaactgtgagaagtaaatgtttgttgcctaagccagtcagtctatgacggggaaacggagtctcagaataggg

SEQ ID NO: 1019 - DNA, 1250 bp, Homo sapiens
ggcctctgaagacatacccattccttttcttctgagcccgcagaagacaaccctgcctagcttctttgcagctacgtggagacatgtgactagtttggccaatgggatgtgagaagagatgatgaaactcggaggagaacttgtgagatcgccgtgactgcttttcccctgccacagtggctaagaggataaggctatcaagggtggagcctctctaggcctgggttcctgggtgcctgtgtggagccgagaccccaggctaactcacaatgaacacgccgtgtgaggaagacgtaaagctttatgtattaagccactggagcttagggtttaatttgttactgtggtgtagcctaccctattctaaccaatacaaggatctttggatgactctcctccaggaattcatatacaaaaacatcctccctgcatgagaactccctatatggttccagcagtatctctcacctgcaatagtgactaaagtcaagactctctgctggctatttcgtttctactgaactagaatataaatttgagcaggacatggaccttttcaatcttgcctaccctcatatcccagtaacaagtggctagcagagtacctgacacatcatggatgctcaaaaaatatttcttgactaactggatgaataaatgagtgaatcatcatcaggattgctgctcgtgaacccctcctcttgcagctacctgcctttgaatttgccctcaggcttcctagctagtttcttctttagcctttctgacccatcgttccttccgtagagttcaagacaacactgctcctcctatgaaccaaaagaaagtgccagcggctgttggtgacgaagctcttcttttctaggcaataaagccccctccagttgtagcagttttctctggaatggtaagtccctcagatctgggagttaattgttactgtggcagaggccaggccaccctgactgatagaagaccttttgggagattcttctttccctggatgaggttgtaccctgtttatgttggataaacaactcaaaaccagtagcatagaatgttagtgccagaggggaactgagagactaacatgttttccttttgcaaatgaggaaactgaggcagagagaagggagggaaattgattaaggcctttggcttattggttcattcctttgatcgctgtgatggatgtttccctgtctttttaacccccctggcttgtgtaccctgttccaaggaattctcca

SEQ ID NO: 1020 - DNA, 214 bp, Homo sapiens
cagaacaaaaagcaatccttcttccttgcaggtttcggtcccagaggtaaagagaaagggaagtccacactctgggtttatggccttgaagtcgagcaagctatactaagagaacagagccaagaaaggtaaaggcctcttgggcctgtgatcaaagagtcaacacttaaggttttggcgatgctggtaatgatgaaataagacaacactgggg

SEQ ID NO: 1021 - DNA, 472 bp, Homo sapiens
gaaaaactgatttggtggagagatccaataacaaaaagttgggaaataggtaaaataataacttggggtagaggttatgcttgtatttctccaggccaaaatcaacagctgatttggatactatcaagacacctgaaaccttatcatgagccagatgccaaggaagcgactcctggaggatcccgaggacccctcagttgcagccatgttgaggctgacactgaggaggaccccaactctcatgagcaacacctgtcaaacacagccacccacctggggacagatcaagaagctgtcacagatggcagaagaaaatctgaggaaagcaggacaaccagtcacaatgagtaatttaatgtctgcagatgtggatcctgactcctgtgagaagtagctcaccgtgacaaagctgcctttgcatttatcgatttgcaaatcaaagaagggggacatgttgggagtagcccccccc

SEQ ID NO: 1022 - DNA, 2329 bp, Homo sapiens
agtcaactctccatcccaataatccagcatagtgcctgcacagagttaagtacccagtgattatttgctgagggaagtaatggatagatggatggatgggcatatggatgtgcagatgaagcttctcctttgtaagaatcatttctgtgtacaaatgggggttggtgaatggaggttggaagaggttggatgcagatggactttgatgtatagggtaatcaacatggggcatgggcaggtaagtcaagaagccctcagaagaaatgaatctaggattggatcaagtgacccgggtcaaggacctatcagtgctgggcctattgactgacttggtctgacctggcgctccagcttggaatcaacactacaaatgggagccagaggagtagctgaactgggatcagaaaaaagaagctcccaggaaggccagaagcctgaagcaccactgggttagggtctccccaacagagctggtcttggcaagtagcgtccatcgtgggggctcgaatccaggtcgaagggtcgccagagcaacggttggaaaacatggaactaagctggaggacacccgagtactcttaaagcaatccccatggtgagtaagaaggggagttcgaaatcatcagagtaacaatgggacaagtgtggggtctggttcatttcaccttggaactttttcacactgatgatgaggaggaagaagagtatagcgaagaacagaagaggttacaggtttatttgccagctaaagcagcaaaggaaggagaggttcatccctacccttctgcaccccctcattattattttaaaggaaaagaccctccagatcattcttttctggaggacactggtcaaaaagtagttgccccagtgactgttcgagcagcgcctcaagcaatcacttttagttctattcaggcaggaattcagcaagctagacaagagggtgatttaaaggcttcgcagttccctgttagaatacaccccccagatcaacagggaaatattacagctacatttgagccttttccttttaaattactcaaagaatttaaacaagctattaatcaatatggaccaggttctccttttgcaatgggactgttaaaaaatgttgctgtttccagtcggatgattcctactgactgggacgctcttacttgagcttatgtaactcctgctcagttcttacaatttaaaacttggtgggcagatgaagcttccattcaggctgctcgcaatgcccaggtccaacctcaaattaacataactgcagaccaactttcgggggttggcggctgggctggtttagatgcacaactggtcatgcaggatgatgccatagaacagcttagaggagtgtgcattagagcttgggaaaaaatcacttcaggtggggagcaatacccttcctttggtgctatagagcagggaccaagggaaccataggttgattttatagctcggttacaggagtctcttaaaaaggtgattgcaggttcggctgctcaggatacagtgttgcagttattagcttttgacaatgctagtcctgattgccaggctgctctgcgacctatcagagggaaatcacatttagtttattatatcaaggcctgtgatggtgtcagaggtaatctgcgtaaagctaccttgttggcaatggcaatggcaggactgagagtggataaaggaaatactccatttcctggagcttgttttaactgtgggaagcgtggtcatactaaaaaagaatgtagaaaaaatcagcgagtcaggccgccagataggggaaaaaagaaaactgttgagcctgaaatatgtccaaaatgtaaaaaaggaaaacgttgggctaatcagcgtcactctaagtttgataaagaagggaacctgatttcgggaaatgccatgaggggcctgtcccgggccccattctaaactggggcgtttccagctcaggccattccctcacccctgtacaatgtctgtcccccaccacagccagtagtgccacagtagatttatgctgcacaaaagctatgagccttctgcctggggaaccctcgcaaaaggtcccaacaggagtctgtggacccttgccagtggggacaataggattacttttaggaaagtctagtttaagtttaaaaggcgtacaaatacatacaggagtcattggttcagattacaatggggaaattcaaattgtcatatctacttctgttccctggaaagcagagccaggagagtgcatagcatagctcctgattgtgccgtatgtgggaatgggaaaaagtggaattaaatgaacaggaggatttggaagcac

SEQ ID NO: 1023 - DNA, 709 bp, Homo sapiens
ccaagaattaaaatggcttaattctcccagagaaataatgtctttttcattcaggaaaattcaccaatactggtataattctggggcaatgtttgtatttatgagcattgagttaagacaatttctgggtcactacattttgattgaattcagcaattgtcagccagaaattgtaccactcatttactgggcaataacactatacaactacttactagaaaaggagcttctggctaaaatctttttctgaacccaagagaattgcaaggatttatccatttcttctgggtagatagtttgattctgagagtaagctgcaatgcgatgtgctactgacatgagaccgttcccaatgggaagaacagcaatctcactccgtgatctggaagcatacagaaaagcctgtcttcttcaaaggcatttggagccatgcacagaaggaagactacatgaagataccgggagaagacagccatctatgagccgatagaggggcctcagaagaagccagctctgctacaccttgatcttgaacttccagcctccagaactgtgagaaaataaatttctgctgcttgagccatgcagtttgtggtactctggtaggcagccctaataaactaacacagcaactataaaagtaacttatttttatattagggcctatctgtctgtgagctatcaacttcattactttgaaatatctgac

SEQ ID NO: 1024 - DNA, 1752 bp, Homo sapiens
gcattagcaattttttatttttccttttttgttgcataggaaatgcagtacttgcttccagtaattgtattgtaatgtgagaaggtggtagcactaatggttgaatacaagagttaaactaatccacaccagctcaaaaaacctgtggagatttagttgaataagaatggacgcccacagtgattctcaaccaattacaaattttcacagaacacagtaaaactaaaagggtaactatgagagtcaatacaagtatactagaggcacagggggcccggctcataaaaacagatttcagaccaagttattaacacggggggtgtttcgtttcataacagatctcttaccatcactggaagtgttccatcccctccccctacaatttgaaatggaaaacagaggtattccgagtggacagatttccatgtgtggtgggaaaagtccccagtgaattttgctctgatttgttctatggaggcctgctaccagaaataaaaaagaaaagaaagaatgaagacaagaaagaaaacagaagcaaacaaaaagagagagagagagagagactccaccaccactatggacaaagatatttctagagacatgatgcaaagtacattaaatgacattcttagaatccctttcccctaaaaaacaaaaaaaattcatagaaaaaaaaggtttttccttatccaggttttgtcagtcctttatgccactgtaactacaggattcaaagcttatggggctaagggcttggaaaaaatcaaagacaaacttttggagatgggtcttgcatattcctgtgggctgactgaacaccgtggctcggggaagtctgggttccttcacactttgactgtcagaaaatgaagatcacaagctctgggaggtgtaaccttgtcggcctgcctagagcccacacctggcggcggcagggacgggcctggggagcgggctgaccacacgtaactgtcatgccagggtgtgaagacacagaacatcagttcaaacctcagaggaaagagaaggctctctagcatggagagcgtggcattactgggaggccctctgcgcacgaatgatcagaaaaggggcgttttgctggcagggacaagggccagaagaaaaagtctacagaaaaatgctaagagttagtgttcgtgcctctgacttcagttcccaaagaaaaaacaaacaaacaaacaaacaaaaaacacagaaatttgagggactcatctttgcccaatcttgttaatgccatttgatgggaaagaaaaaattcaaatgtgtctcagagtcaagggctgggccttcaaatgctgatagctctcagtctgtctgtctacacaccccaggtagcaaagtcttcctcaagcatcttcactatgcttttaagctaaaaagcaaaaacactggcaactgttggtgtttcttttttcctgcttgatcacaactgaatagtttcctgctgctttctggacaatgaaacatgaacaaaaatgtaacttcgtgtatttaatacttaacccctgttcgttatcaccctagactgcctccctaatgttttaaagcctttaaaacattttttcctgcaaatctgttcagagttccctaattttagcttcatcaaacttaatacaacaaaataccttcaaaaatacagcatacctgtaacgtccatttacaatggtttttcagtagacctatacttctcaagcataggaatatgctataccattgagagaaaaaaat

SEQ ID NO: 1025 - DNA, 939 bp, Homo sapiens
tctgtagcctagtggaaaaggtatgatattttatttgtttaaaggaataaaccagtgagatccagctgaactattcaaatgacactgaaggactgaagattctcaaggatgcagggttttgaagatgttcacaaatcaatataaagaaatagagatgagaaggcggaacaagatggctgaatagaagcctccagcgattgtccctcccacgaaacaccaaacagaacatctatccacagaaaaaaagcatgttcataagaaccaaaaatcagacgctgatgaacacccacaagcatcaaggccatccggggaaacatgatgtcaccaatgaactaaataaggcaccacggaccagtcctagagagacacagatatattaccttttagactgagagttcaaaatagctgttttgaggaagctcaacaaaatccaagataacacagagaaggaaatttaacaaagagattgaaataaaaagaatcagcagaaattctggagctgaaaaatgtgattgacatactgaagaatgtatcagagtctcttaacagcagaattgatcaagcagaagaaagaattagtgagcttgaagacaggttatttgaaaacacacagtcagaggagacaaaataaaaaagaatataaaagaatgaagcacaccaacaagatctagaaaatagcttcaaaaaggcaaatctaagagttattggccttaaagaggaggtagagagggagatgggggtagaaagtttattcaaatggataataatagagaactccccaaatctagagaaacatatcaacatagtacaagaaggttatagagcaccaatttaactcaaataagactacctcaaggcattcaataatcaactcccacaggtgaaggatatagaaatgatcctaaaagcagcaaaagaagcaaataacatacaaaggag

SEQ ID NO: 1026 - DNA, 688 bp, Homo sapiens
agcacatctttcgaagtgtcatgctctgttgcccaggctggagtacagtggcaccaaaccgctaactgcagccttgccctcccaggctcaagcaatcctcctgcctcagcaccctcaataactgggaccacaattgcatgccaccaaactcaggtaatttttctattttttgtagagatggggttttgccatgttgcctaggctgttcttgaactcccaggctcaagcaatctgcatgcttcaacctcccaaagtactgagataacaggcatgagccactgcaccggcaatactgaccatttaaaaggaaatccagtgtctgtatgtgttctggatgcaatatacttctttatcccataaatttctgctcttgaagtaaatattctgtagcactgattgcacctaaaggacaaatgttgatgataccctcccttacccaacatatattttgctttcttcccgtttgcactgtacagctctgatccatattgctctgagactgacagcaatcaggactttaaaaaaaatcatcctctcaagctgttttttgtctcctctaggatcttatttctagatagattcgaactaagtcaactgtactttactgaaagcaaaaagataaagtcattttggggcatgcaaagttaagattatgaaaaatcttcaacaaaagccctcaaaatagaac

SEQ ID NO: 1027 - DNA, 2743 bp, Homo sapiens
gagagattcttggatgacaaatgtcagtggattcactacttaaagttttctaagtaggagccaactctagcaagcttagctaagagacagactgtactagaactttcctagcatatatgagagatccatggaagagttgaattaaccaggaagatgggaagtggggcagctctaagggcccctagcaccaggaatccatgcacctttctctcagagcagtaccattcactactgagtctttatccagttcttgtttctctcacttaaaaacaggagtcttaggcaggtggctgtccctgtgccagtcacctgtgaccaggaagtcaggtcaaatggctgcttggggcctaccttatagatcggtgtccatctccaaagaatggagaatccattttgaattgggcaaacaatcagaaaagatctagcacagtgggcaagatgatgagtttgggtttgcctgggctaggttttaaaagccatctctttgaggaaatgagctaacaattagaactgaggggtccagcagattgggcagccaccaccattgagaggaagaaggacaactgggcagagcagtaaaacatcaagcagatgaccaccaagagtggtgagccagacatggccatattctataggaaaggggaagaagataaggtggataaatcagagaaatgtggggtttcaaagaaagaaccagattcataaggaaaaaagacgaaagaaacaacgttagatgtcctcagaggttcagcagcatttaaggatccaagtctcttggatttggtggtttggatgtgtgtaaccttcttaagtggcaagggcagaaggtagacagagaagtgtagcagagtcagtgggcaattgtggtgggaaggaaggaggtaaaatggttgctccgagaagagccagagtaaaatggagacttgtgttttttagtccgcagggaagtgaactaagtttgtaaacctgaagggtgagatccagccatgaaggaaagatgttgaggagctaatgtaagccacaagccaaatcagagttttgggaccaagagtacaagttgatgagttagcatcgaaggagtgaaaagacactttcatcctgagacaggagagaaataacaaatagacagtggaggagaaacttgaggtccagaggagaggggttgcagtatgtcccctggctgttctgccttctccaccgatgtgtagtgggtgttggagtttcactaaagaagtctccatttcaagaatgcaggttggatgcaacccatttcaatcagtggaaagagaagtggaaactcaagaggtaaccatggaggctaaaagaggaaatagaaggtttttggtggacaaggaataaattcacagagaaactgctgtccttggaagagataatggcctaaccctgtgcctccaaagaaaatatacacagctccctaaaaagtgcctagcatagtgtgggaattcaatcaggaagagtcggtgagagagtgaacacacttgactaatccccatctctctctgctgcgtgaccctgagttatttgggacccatcttcttgattcaagctgactcatcaggatgtcagtgcagttggtcaggctcaatttgctggtgtgtccagacattcatgagcctgtactttgtcttctgtatttcaaggtcctttttatcctgtagtgctccgggaaccatctgacttctgcaggctgtctctccatcatgttttgatacgtgattgattttgttgcatggggataacttggtttctgagatgacattagcagccccttttctgctgacatcggggggccttctaagcatgtcttgaagtgttcagagcttcctgtctcctgtgacaacacactgatctctcagggaacaatgcccttcactattgagaccagacctttcctttgtgacttttccttatttggattgatggaacccctttttgtagggcctgccccactcaagtcttccctaccccaggctcagcatctcagctcctgaacccctcctccagacatggtttctagaaagttctcccattactacttacctgttaactgcatcctagcttctcagggttccaaaatatgatgttcagatggcaggactgctccagctggcacagattagtgtgaaaatgtcccttcctgtactagggcttgatgtcctaggaaaatggtacaggatttttaaaaatactcacttcttacttttttgcttctcatgaccaagcaaccactaaatacttagttttaaaaatttgtattaccaataccttctctgtattcagcaatatttttgacttaatggtagaactttacatatatccctgttatgtatattttttcccatacaccagttaggttaagggacatctttagcttttaaaaaagtacagttcgaaatataaagtaaaagcagttaagtcttttccaagtacaaagtgaattggttccaattgctagagaatttacaaatatatattcacctgaggccagaaaaagctcctttggcctaggcctctctcctttatcaagctctctccatcacgagtgtgcacatgtgcgcgcgcgcacacacacacacacacacacacagaacttaacagcagtgatgtgtgttgtaatatgcaactttgtaagttacatatcactccccaataccaccttctcagtcacggagtagagatcttacttcacaagaagtgagactcagagaggtgaagtgacctg

SEQ ID NO: 1028 - DNA, 613 bp, Homo sapiens
tgccaccatccagataggaggtttacatcacctccaaaagtttccttgtgtacctttgcttttttgttttctgggtttttgtgtgtgtgttcatttatttttgtagtaagaacactcaacgtgagatccaccttcttaataattgttttttttgagatggagtttcactcttgttgcccaggctggagtgcaatggcgcaatcttggcttactgcaacctctgccacctgggttcaagcgattcacctgcctcagcctcccgagtagctgggattacaggcaagcaccaccacgcctggctaattttgtgtttttagtagagatgttgtattttagcagaggtgttggtcaggctggtcttgaactcccgacctcgggtgatccgcctgccttggcctcccaaagtgctgggattacaggtgtgagccaccgtgcctggacccctgctttattttcataatggcgtttgccatcacctaacacttttattttaaattgtttgttgatttacatgctccttttggagcaaggtagattttgtgagaatagaaatttgttgatcttcctcaataatatatctctggcacctagaacaatgcttgcacataattgg

SEQ ID NO: 1029 - DNA, 593 bp, Homo sapiens
ggaattgctgtctcttccagtcttcattgttaagcagatgctgaaatgcacactctacaaaccactgggagcatagaatactttctaccagattatctacacaacctaatgaggagagctgattgtcttaagtgttcaatagctcactgtgattgttgagaagtcaacacagggacaaggaaatctcagatggttgtctacagttacaagggggatttttggactgatttgtgatttttctgggaatgcaactcaagttagaagaggccattatctgaaagaagaagaagcaccagctgatgtgttggttattttagggcgacatttgcagttgcttgggcaatatcatgagcctcacctcatgcaggtctgggtcccagacccaaagactgctcctccatactcagagataccagcactaacagagcagctcctcttcttcagtacagatgcttctcaacttacaatgaggttatacccttataaacacatggtagcaagaatacagctgtgagaagatgcattgtgccaagatgaatttagtgagtttggaagaggaccctgagcctgaaatgagaattgcaaccctggct

SEQ ID NO: 1030 - DNA, 521 bp, Homo sapiens
ctcatattcttggatgaatattaatgtttttaaaatgagaggtcttcaaaagcaatcagagatatccagtgattaatggaggttgccttcttttccaaactgctttgaaaattcacctgttgaaacctgtttttctgttctgtggccataatcagaacttttagcagctctaaaatactctgttttactttatctctactttctcctaatatagctcaatcctataccatcataactgacagctccacaacagtggtagagcccattcattccaaggaggactcagatgctagtgatcttcatcctgtctgccacttgtgaggatgaaaactggagtctgctgagtctgctttctagatatgagtagaccgaatgaagacatcctggcactgggccttttcctgaacagtccaggaggtaggagccctcaaatgaatagaggagttagggaatgctgaggcagctgagaatgcagggcacagtcctagagaaaagagagccatgtataacagataaagaag

SEQ ID NO: 1031 - DNA, 875 bp, Homo sapiens
cttcgaggtggccctctggtccggctttagaactctgcggttttgtggagctcgagagtccgggacaagatatctattggatgctgatgattatgaaacaaagtagcaaagataagaagccatttgctcattctgctcctttgccagcaatatttcacaaagcccctgactcattgactgtgagcagccttgtggaagaatgccttgaagaccataagcaggatagggaataggtttgcacatctcttgcctgaatcactgaatttttacaaaagaaaaggttcaattaagtggttgaaaagcttcaggaagaaatttaagctaaattgaaatgagggagtaacatcagcaagataatgaaatggaggatcccctactatcactccctccataaaaatacaactagaaactacttaaagacaagaacacaaccctgagttcaccacaattcaagggagaattgaagaaacctccggggccctcagaattgagagaagctgtgacaggtatgaaaaatggctgtttcagacattgcagccccctccatcaagctggcataatgtcgctcatagagaattttcctagactcatggtttctaaggtaagaagagggagttggaagtggacatacgatctccccaccagtctgggaatcttctcaggaagcccacttctgccccatcccatgggaacaattgggagtgtcagaagggctgaccaaccttggatgaaatgagacaaagagtgggacactgatcatagtgactggcacgtggatcttggcagttaactcttcactccaatcagtatggacaccacattgaagagactggctggcaccatagtgctataggggacacagtctgtgagaaggc

SEQ ID NO: 1032 - DNA, 739 bp, Homo sapiens
gagatcctcctgcctttgcctcccaaagtgatggaattacaggtacagataaagatgaaacatccaattgcagatatgaatgacctaattcaatggatgagtctggaagaggaccaagttcatgggaaagatcaaaaattcagttttgaagatgttgatgagaagatgagacaaaaccatgtatagatgcggatgagctaattaaatatatgagtctggagctgaaaggaaatgccttgacaagagaagtaaatttgaggaccatcagtatacagatgtacttgaatccatctatgtaaatgcaatcaccctgggaggaaatttagagtgagaacaggactgcgtggaaagacattaaagaagttaaagaaagaagaactaacaaaggcaggagagaagaagaggacggagaggtaggagagaaaccagtaatgtgcgatggcatagaaattaaggaagtttccaagattgaagaaggagggagagagggctatggaagtcacaggttggaggtggtgcccagagcctggaataaacatttaccctagtgttcatcagagagtgaatgaggcctgggaatccaagacttgccaaagattattctgcctggaacaggtcaaaatacagcaaaggatatgaagggacactacaagatgggaaaatgggtgcctcattgttaactgatgtggacagatgatgggtaaccacataatcttctctacgtcatttttgatactac

SEQ ID NO: 1033 - DNA, 1018 bp, Homo sapiens
cggctataaaacgccatcttggaagcgagactgggctctcagcagacaccaaaccttcatctgggacttcccagcctccagaactgtacagataaagatgaaacatccaattgcagatatgaatgacctaattcaatggatgagtctggaagaggaccaagttcatgggaaagatcaaaaattcagttttgaagatgttgatgagaagatgagacaaaaccatgtatagatgcggatgagctaattaaatatatgagtctggagctgaaaggaaatgccttgacaagagaagtaaatttgaggaccatcagtatacagatgtacttgaatccatctatgtaaatgcaatcaccctgggaggaaatttagagtgagaacaggactgcgtggaaagacattaaagaagttaaagaaagaagaactaacaaaggcaggagagaagaagaggacggagaggtaggagagaaaccagtaatgtgcgatggcatagaaattaaggtatgagtatttcaagaacaagatattaatggtattgaatactactgaaaggccaatcatgatgagaatagaaaaactgctgatttcactatttggcagtgggttcactgacttcctcatctgcaatgacttctcttgatctcacctccaccgtctactccaagggccaccttagatcttaggatctaattcactcctgtgcccaaatcacttttctaaagtgatttgtattttcaggttacatgttcaactatttttagcacagccattgtaacatataattgtggttgtctgttatgtgtccatttattactatcttctgattttgtcctgttttcttctacttccttgtataacactccaccaatatcccactcacctccacttttattaagcccacatgacaaaatttaactctggatttggccaggtatgcattctttccatgctattctgactcagcttagtactattgaagacttaagtcacaaaacaggggagattatacaaaacattcttg

SEQ ID NO: 1034 - DNA, 283 bp, Homo sapiens
cgggtcaacagactgattcatatcttgacgaagacacttatttccaagatgctctcttcaagatggtttcctcaccttaaaatggggtgatgataatctacttcttaaggttgtggatatttaacagagtaagaggtggaaaactaagtacactataactaggacatagggtactggtttaataacacatgtgccaggagctattctaaatgctttacgtatgtaattaagtcaatcttcacaacaacactgttattttttcctttttacagataaggaaatt

SEQ ID NO: 1035 - DNA, 764 bp, Homo sapiens
ggctgtggaaacttaagtcatagacatgcttcagtgagaggatgaggatttgcccagatgggaagcttcaagtgcagaggcacttgtacatctacttatcttgagtctcaatgatgctgtttatgagtgagctattcaaatggaggaagaaacccacggagaaggagaaataacaggtcggagtgattatgtacagaaggataggctctagcaggagtccagtgggaaagaaggaagggaatacaattaagaattattaatggcagatctctaatgatttcactggatccaaaggaacagggcaatactgagtaagaaacacttgatatacgaaaaaagcgtgagtgcgaaggaaaatacatcattctacagatgttgacggactctgacggtgggaaagcgtccctcaagattgaattggagtagaagctgaccctcccacttgcccagagatcccctagctggtttcaacacacatgggaacaagatatattcatggaatgtgcctttgaacctgcattcaaaagaactcagacagaggttagtggtgaataaagcaattgctttcacttaatgacacaggtggggaaagagtttgcagaaaatgtttttcttgaaaataaaatatctgtggcttgcaatgtgggtgcacgtacaaatcagcttcaaaagtgctttcatagaaggagctgttggaaacgtagtataaatatctgccttgtgtatcacagcatttttttagaagggcatatctaatagttctt

SEQ ID NO: 1036 - DNA, 525 bp, Homo sapiens
gaaaaatactttgctcctgtgttactgacccccattgtctttgaaagatgagcaatactgattatggggaaatatttgtccttaggtatttcaggaggaaattggcctcagccatcagccctcactgcccaagggggaaaagcatttcaagaagttccactacaggggtagccacattcctcccactttagagtcagcagaaggataagccaagggaatctgcctttaacactcagcagaagcccaaggcattcatctttgcacttcataagaagagacagcagcaactgggaccactttctctttttgagaatgggactgatttctgaggcaaagggatgggatcattagaaaaggaatctcagagggaagatcgaagaggaggacagcagaaacctgaggagacagagagcaagaactgagctgtgggacgcttaccctcatgatattcccttactttgagataactgcgattctctcacttaatggcaaggaaaaaaatacttggaatgtggcccctgaaag

SEQ ID NO: 1037 - DNA, 1159 bp, Homo sapiens
ctctatcagaacacacacagacatattcacacatatgtttacatagatgttctgacttttgcttgaaaattttgttctacccagaataaccccattcatcctttccatctttctaaatcttatccattcttcaaaacattgtataaatcctgcctatgcttctctggccacagtagcattgaatcctctctccttcctctggatatctttggtctttaatatttgtatcattaatttattaaatatgttcattctcaatagttcttagagttatgctgcttaatatttttatttaacttttgtatgcagtgatttaactgtaaactttttgagaacagagtgctaagttcatctttatcaatttgctctctaattgccttctgtaaaaactagtaaatacaacagaaacaagcaataaaacccacactgcccacatcttacattttatatgggaaagtgataagatttaaaataaatatatttattatgataatgttgagtattgatattaattctcccatgtgacgtgtatatggatatatatgtatgcttgtatttataaagaaactattataacttaattctgattagcctcttgcagcttttcaaaattcattctcctgtgtcttctcatgactgataacttggaaagaaaatcaagatgccactcgattttgccatggatttataaaaatgacacatcagacaacaggtaagtttttttttaacttattgaccatgataacaatccattatcaactagctatttcacaggatatattctgtctttacattggaagaaaaatatacaatgaaactcattttataaaaagaaaaaccaatttaatttatacctttatattttcacagaagcatatgagaaaaatttgctgggtatctactcacttcaattcaaacatttgaagaaattatgaaaattccgatgagtttttaaagtttgtgcttgctctggtgtagtgtagccatgcattgatctgtcatcacaggtatgctttcataaatttcccctcaaccaatcagatagaaattcataccaatttgcaaaattgtttttcttattttttaaagcttaacacatgtaagataatttgggaaaaatagattttctcatttatcattctttcaatccatgataatg

SEQ ID NO: 1038 - DNA, 1596 bp, Homo sapiens
ctcaggctggtcttgaactcgtggactcaagtgatctgcccacctcagcctcccaagagtgctggaattacaggtgtaagccaccatgcctggacacttgtctttttattatcgtaaagagccaaagcattaggtactcaataaagatttaaagaatgatggtgtcaaagtacatagactttttcctctatttaaataatcaattttcttcctgtgttattcagactttaataatatgtaaccaactccaacacattaggtgagattttctatttctatgtccagcaattcttaacattgtccatgagcacaaatcttttctagatttgccttcttactgattttttttccctctttgggctttttttcccccgtccataccatcactaagatgtgtccgtgtctatgtcaggagaaggatgtcaatcagaatggtggtgaggataagtgagtcggcactatgagaaggtactggaactagggtaaaggaagaggtatttctaagtggagacttgattaaaaaggggagcatcttataccaaccagcaagtcagtgggggaggtctggagtgattaactgacacaggagtttcccctaggtcccctcatgcccttcaggctacaggttgccattttgtaatgacagattttttttttttttgagatggaatcttgctgtgttgcccaggctggagtgcagtggcttgatctcagctcactgcaacctccaccttctgggctcaagcaattctcttgcctcagcctccctagtaactgggactacaggtgtgcactaccacaccccgctaattttttgtatttttagtagagttggggtttcaccatgttggccaggctagtcttgaactcctgacctcaggtgatccacccgccttggcctcccaaagtgctgggattacaggcatgagccactgtgccagcctttttcttttcactttaagattattcttggcatttatttacttcagatatagctataaaaatatttcaagtagagaatggggaaaagtgaggagaagatgaagacaaagtaatttgtctaaacactactctctcctaatgaattaattcttttctttctccctttcatctacccctcctttctctaatcttttcccccttctttcctgcttttctttcgtactccttttacaaatatttactggtacctacttcctgtcaggcattctgccaggctctggggatacagataatgaagacagggctctgattcttgtcttttagatcctcaccttctactggggagacaaacacaaacatagttaggaaaatcataatataattagcttttgtaatgatttccccaaatacaaaaggagaaaaggaccaccctcccctgacccgatttcctgctggagtacacttcatacatgaggaacaatttgagttgaagcatgggtgggagtttgcaaggcagaataacatggagaggaggatattctcatcctgagggatagcgcgtacataatagattgcggcatgacaaaaatcatgttttgaatgttaaagcaccttactgctgtgtataaaatgcacgtagctgacagatgagca

SEQ ID NO: 1039 - DNA, 772 bp, Homo sapiens
tgttgagtgtttgactaaataaagtgtttatgtctcatacgtctttttattaccgtaagaatttgcacatatgacataataggaacttaacgcatgtttattgaataaaggaatggaaggatgagtgaacaatcaaggactctagaatgtcttagtgcttttgaaagttagtgcttgtggactaatacaaagaaggagatagaagagaacagtgaccacaaaaatgaaaatactagaacgtttcccatactaatgagaggctggaatcattgctcaggccaaagctgtttgccaaggagaagcaaatttcttctcatctatagcacggatatgagtaggatcccaggtgtttgaagtgtacttgaagagccagttttcagaacaagctgccatgctgaagaggacaatatagtaatgaactgaggtcagccaacagtcaaatgggaactgaggctctcagtccaataatcttcgaggaagtaagttttccaacacctatgtaagtgagcttgaaagtagatatttccccagttgagttttctgatgaaattggaattttgtgccaatcaagaactcttcgtactccaacgtttaagaagaaaaaggtaaactgacatacttttaacaagctgctttcttttcttgggaatttctcttgcattacaaagaacattatcccttcattaaactcagtttgaaaactacgagtggtttagcaaatattagattcactgaagttactaagtgttggtgaagatgtggagagacaggc

SEQ ID NO: 1040 - DNA, 235 bp, Homo sapiens
ggcgttttgtattttaggtgctgtcattcagagtccacaggatggatgaatggatatgaaaatgaacaaacgtgtgacacaacactgcatgatttaccggcaatgactttctgatcaagcctgaacatcccaagacaaccatgctgtgaagaagtcggtctaccccactggagaaggaaaggctgttcagggaagtgaagatgccccagctgacagtcaccacctgccagacatg

SEQ ID NO: 1041 - DNA, 6655 bp, Homo sapiens
tgattccattcgagtccattcaatgattccattcaagtccattcgatgattccatctgattccattcaatgaatccattcgattccattctatgatgatttcattcatttccatctgatgatgattccattcgattccattcaatgattccattcgattccatttgatgatgatttcaatcaatttcattcaatgattacattcgaatccattcgatgatgagtccatccatttcaatttcatgataattccattcgtttcaattcgatggtgtttccattcgattccattcgatgttgattccattagttcccattggatgatgattccattcgagtccattcgatgatgatcacattggatttcattccataattctattcgattccatttgatgatgattccatctgattccatttgatgattccattcgattccattcgatgattattccattcgtttccatccgatgatgattccattcgattccgttcaatgattattccattcgagtccattcgatgattccattcgattccattcgatgatgattgcattcgagtccatggattattccattccattccattagatgattccattcgagtccattcgatgattctcttcgattccattcgataattccgtttgattccgtttgatgttgattccattcgagtccattcgatgataattccattcgattctatgcgatgattccattccattccatttggaggtggttccattcgagaccattcgttgattgcattcaattcattcgatgtccattccattcaattccgttcaatgattccattagattccatttgatgatgattccattcgattccatttgatgatgattccatgcgattccattagatgatgactcctttcatttccattcaatgaggattccattcgattccactcgatgattccattcaatgatgattccattcgagtttattgactattccattccatttcaatcgatgattccattcaagtccgtccgatgattctatttgattgcattcaattattccattcgattgcattcgataattccattcgattccattggaggataattccatttgagtccattcgatgattgttccattcgattctattcggtgattccattcgattccatttgataatgattccattcgagtccattcaatgattccattcaagtccattcgatgattccatctgattccattcaatgaatccattcgattccattctatgatgattccattcatttccatctgatgatgattccattcgattccattcaatgactccattcgattccatttgatgatgatttcaatcaatttcattcgatgattccattcgaatccattcgatgatgagtccatccctttcaatttcatgataattccattcgtttcaattcgatggtggttccattcgattccattcgatgttgattccattagtttccattggatgatgattccattcgagtccattcaatgatgatcacattggatttcattccataattctattcgattccatttgatgatgattccatctaattccatttgatgatcccattcgattccattcgatgatgattccattcgtttccatccgatgatgattccattcgattccgttcaatgattattccattcgagtccattcgatgattccattcgattccattcgatgatgattgcattcgagtccatggattcttccattccattccattagatgattccattcgagtccgttcgatgattctcttcgattccattcgataattccgtttgattccgtttgatattgattccattcgagtccattcgatgataattccattcgattctatgcgatgattccattccattccatttggaggtggttccattcgagaccattcgttgattgcattcaattcattcgatgacgattccattcaattccgctcaatgattccattagattccatttgatgatgattccattcgattccatttgatgatgattccatgcgattccattagacgatgactcgtttcatttccattcaatgaggattccattcggttccatttgatgatgattcctttgaattccgtttgatgacaattccattcgataccaattgatgatgtttatttttgattccatttgatgatgattactttcgattccatttgatcatgattccattcgattccactcgatgattccattcgattccattcaatgatgattccattcgagttcattgactgttccattccattccattcgatgattccattcgagtccattcgatgattctattcgattgcattcgataattccattcgattgcattcgataattccattcgattccattggaggataattccatttgagtccattcgatgattgttccattcgattctattcggtgattccattcgattccatttgataatgattccaatcgagaccattcgatgattccattcaattccattcaataatgatccctttcgagtccattcaatgattccattccagtccattcgatgattccatctgattccattcaatgaatccattcgattccattctatgacgattccattcatttccatctgatgatgattccattcgattccattcaatgataccattcgattccattcgatgatgatttcaatcaattttattcgatgattccattcgaatccattcgatgatgagtccatccatttcaatttcatggtaattccattcgtttcaattcgatggtgtttccatttgattcattcgatgttgattccattagcttccgttggatgatgattccattcgggtccattcgatgatgatcattctggatttcattccataatctattcgattccattcgatgatgattccattcatttccacccgatgatgattccattcgattccgttcaatgattattccattcgagtccattcgatgattccattcgattccattcgatgatgattgcattcgagtccatggattattccattccattccattagatgattccattcgggtccattcgatgattctcttcgattccattcgataattccgtttttttccgtttgatgttgattccattcgattccattcgatgataattccattcgattctatgcgatgattccattccattccatttgaagatgattccattcgagaccattcgatgattgcattcaattcattcgatgacgattccattcaattccgttcaatgattccatttgattccatttgatgttgattccattcgattccattttatgatgattccatgaaattccattagatgatgactcctttcatttccattcgatgatgattccattcgtttccatccgatgatgattccattcgattccgttcaatgattattccattcgagtccattcgatgattccattcgattccattcgatgatgattgcattcgagtccatggattattccattccattccattagatgattccattcgggtccgttcgaagattctcttcgattccattcgataattccgtttttttccgtttggtgttgataccattcgattccattcgatgataattccattcgattctatgcgatgattccattcctttccattagaagatgattccattcgagaccattcgatgattgcattcaattcattcgatgacgattccattcaattctgttcaatgattccattagattccatttgatgatgattccattcgattccatttgatgatgattccatgcgattccattagatgatgacccctttcatttccattcaatgaggattccattcggttccatttgatgatgtttcctttgaattccatttgatgacaattccattcaataccaattgatgatggttatttttgattccatttgatgatgattacattcgattccatttgatcataattccattcgattccactcgatgattccattcgattccattcaatgatgattccattcgagttcattgactgttccattccattccattcgatgattccattcgagtccattcgatgattctattcgattgcattcgataattccattcgattgcattcgataattcaattcgattccattggaggataattccatttgagtccattcgatgattgttccattcgattctattcggtgattccattcgattccatttgataatgattccaatcgagaccattcgatgattccattcaattccattcaataatgattccattcgagtcccattcaatgattccattcaagtccattcgatgattccatctgattccattcaatgaatccattcgattccattctatgatgattccattcatttccatctgatgatgattccattcgattccattcaatgattccattcgattccgtttgatgatgatttcaatcaatttcattcgatgattccattcgaatccattcgatgatgagtccatccatttcaatttcatgaaaaatccattcgtttcaatacgatggtgtttccattcgattccattcgatgttgattccattagtttccattggatgatgattccattcgagtccattcgatgatgatcacaatggatttcattccatcattctattcgattccatttgatgatgattccgtctgattccatttgatgattccattcgtttccatccgatgatgattccattcgattcggttcaatgattattccattcgagtccattcgatgattccattcgattccattcgatgatgattgcattcgagtccatggattcttccattccattccattagatgattccattcgagtccgttcgatgattctcttcgattccattcgataattccgtttgattccgtttgatgttgattccattcgagtccattcgatgataattccattcgattctatgcgatgattccattccattccatttggagatggttccattcgagaccattcgttgattgcattcaattcattcgatgacgattccattcaattccgttcaatgattccattagattccatttgatgatgattccattcgattccatttgatgatgattccatgcgattccattagatgatgactcctttcatttccattcaatgaggattccattcggttccatttgatgatgattcctttgaattccatttgatgacaattccattcaataccaattgatgatggttatttttgattccatttgatgatgattacattcgattccatttgatcatgattccattcgattccactcgatgattccattcaatcatgattccattcgagttcattgactgttccattccattccattcgatgattccattcgattccattcgatgattctattcgattgcattcgataattccatgcgattgcattcgataattccattcgattccattggaggataattccatttgagtccattcgatgattgttccattcgattctattcggtgattccattcgattccatttgataatgattccaatcgagaccattcgatgattccattcaattccattcaataatgatccctttcgagtccattcaatgattccattccagtccattcgatgattccatctgattccattcaatgaatccattcgattccattctatgacgattccattcatttccatctgatgatgattccattcgattccattcaatgataccattcgattccattcgatgatgatttcaatcaattttattcgatgattccattcgaatccattcgatgatgagtccatccatttcaatttcatgataattccattcgtttcaattcgatggtgtttccattcgattcattcgatgttgattccattagcttccgttggatgatgattccattcgggtccattcgatgatgatcacactggatttcattccataattctattcgattccattcgatgatgattccattcatttccatccgatgatgattccattcgattccgttcaatgattattccattcgagtccattcgatgattccattcgattccattcgatgatgattgcattcgagtccatggattcttccattccattccattagatgattccattcaagtccgttcaatgattctcttcgattccattcgataattccgtttttttccgtttgatgttgattccattcgattccattcgatgataattccattcgattctatgcgatgattccattccattccatttgaaggtgattccattcgagaccattcgatgattgcattcaattcattcgatgacgattccattcaattccgttcaatgattccatttgattccatttgatgttgattccattcgattccattttatgatgattccatgcaattccattagatgatgactcctttcatttccattcgatgatgattccattcgtttccatccgatgatgattccattcgattccgttcaatgattatttcattcgagtccattcgatgattccattcgattccattcgatgatgattgcattcgagtccatggattattccattccattccattagatgattccattcgagtccat

SEQ ID NO: 1042 - DNA, 1810 bp, Homo sapiens
ttcgatgattctcttcgattccattcgataattccgtttgattccgtttgatgttgattccattcgagtccattcgatgataattccattcgattgtatgcgatgattcctttcctttccattggaagatgattccattcgagaccattcgatgattgcattcaattcattcgttgaagattccattcaattccgttcaatgattccatcagattccatttgatgatgattccattcgattccatttgatgatgattccatgcgattccattagatgatgactcctttcaatttcattcgatgatgattccattcgattcgatccgatgatgattccattcgattccgttcaatgattattccattcaagtccattcgatgattccattcgattctattcgatgattattgtattcgagtccatggattcttccattccattccattagatgattccattccagtccattcgatgattctcttcgattccattcgataattccgtttgattccgtttgatgttgattccattcgagtccattcgatgataattccattcgattctatgcgatgattccattccattccatttggaggtggttccattcgagaccattcgttgattgcattcaattcattcgatgacgattccattccattccgttcaatgattccattagattccatttgatgatgattccattcgattccatttgatgatgattccatgcgattccattagatgatgactcctttcatttccattcaatgaggattccattcggttccatttgatgatgattcctttgaattccatttgatgacaattccattcaataccaattgatgatggttatttttgattccatttgatgatgattacattcgattccatttgatcatgattccattcgattccactcgatgattccattcgattccattcaatgattattccatttgagtcgattcgatgactccattcgattgtattcgatggtgattgaattcgagtccatggattaatccattgcattccattcgatgattccattcgagtccattcgatgattctattcgattgcattcgataattccattcgattgcattcaataaatccatttgattccatttgaggataattccatttgagtccattcgatgatggttccattcgattctattcggtgattccattcgacttcatttgataattattccattcgagaccattcgatgattctattcaattccattcaataatgattccattcgagtccattcaacgattccattcaagtccattcgatgattccatctgattccattgaatgaatccatgagattacattctatgatcattccatgcatttccatctgatgatgattccattcgattccattcaatgattcctttcgattccatttgatgatgatttcaatcaatttcattcgatgattccattcgattccattcgatgttgatccattagtttccattggatgatgattccattcgagtccattcaatgatgattatattggatttcattccataattctattcgattccatttgataatgattccatctgattccatttgatgatcccattcgattccattcgatgatgattccattcgtttccatccgatgatgactccattcgattccgttcaatgattattccattcgagtccattcgatgattccattcgattccattcgatgatgattgcattcgagtccatggattcttccattccattccattagatgattccattcgagtccgttcgatgattctct

SEQ ID NO: 1043 - DNA, 6061 bp, Homo sapiens
ccattcaatttgaagatgattctattcgagaccatttgatgattgcattcaattcattcgatgacgattcctttcaattccgttcaatgattccattatattccatttgatgatgattccattcgattccatttgatgatgattccatgcgattccattagatgatgactcctttcatttctattcaatgaggatgcctttcggttccattagatgatgattcctttgaattccatttgatgacaattccattcaataccaattgatgatgactatttttgattccatttgatgatgattacattcgattccatttgatcatgattccattcgattccactcgatgattccattcaatgatgattccattcgagtttattgactattccattccatttcaatcgatgattccattcaagtccgtccgatgattctatttgattgcattcaattattccattcgattgcattcgataattccattcgattccattggaggataattccatttgagtccattcgatgattgttccattcgattctattcggtgattccattcgattccatttgataatgattccattcgagtccattcaatgattccattcaagtccattcgatgattccatctgattccattcaatgaatccattcgattccattctatgatgattccattcatttccatctgatgatgattccattcgattccattcaatgactccattcgattccatttgatgatgatttcaatcaatttcattcgatgattccattcgaatccattcgatgatgagtccatccctttcaatttcatgataattccattcgtttcaattcgatggtggttccattcgattccattcgatgttgattccattagtttccattggatgatgattccattcgagtccattcaatgatgatcacattggatttcattccataattctattcgattccatttgatgatgattccatctaattccatttgatgatcccattcgattccattcgatgatgattccattcgtttccatccgatgatgattccattcgattccgttcaatgattattccattcgagtccattcgatgattccattcgattccattcgatgatgattgcattcgagtccatggattcttccattccattccattagatgattccattcgagtccgttcgatgattctcttcgattccattcgataattccgtttgattccgtttgatattgattccattcgagtccattcgatgataattccattcgattctatgcgatgattccattccattccatttggaggtggttccattcgagaccattcgttgattgcattcaattcattcgatgacgattccattcaattccgctcaatgattccattagattccatttgatgatgattccattcgattccatttgatgatgattccatgcgattccattagacgatgactcgtttcatttccattcaatgaggattccattcggttccatttgatgatgattcctttgaattccgtttgatgacaattccattcgataccaattgatgatgtttatttttgattccatttgatgatgattactttcgattccatttgatcatgattccattcgattccactcgatgattccattcgattccattcaatgatgattccattcgagttcattgactgttccattccattccattcgatgattccattcgagtccattcgatgattctattcgattgcattcgataattccattcgattgcattcgataattccattcgattccattggaggataattccatttgagtccattcgatgattgttccattcgattctattcggtgattccattcgattccatttgataatgattccaatcgagaccattcgatgattccattcaattccattcaataatgatccctttcgagtccattcaatgattccattccagtccattcgatgattccatctgattccattcaatgaatccattcgattccattctatgacgattccattcatttccatctgatgatgattccattcgattccattcaatgataccattcgattccattcgatgatgatttcaatcaattttattcgatgattccattcgaatccattcgatgatgagtccatccatttcaatttcatggtaattccattcgtttcaattcgatggtgtttccatttgattcattcgatgttgattccattagcttccgttggatgatgattccattcgggtccattcgatgatgatcattctggatttcattccataatctattcgattccattcgatgatgattccattcatttccacccgatgatgattccattcgattccgttcaatgattattccattcgagtccattcgatgattccattcgattccattcgatgatgattgcattcgagtccatggattattccattccattccattagatgattccattcgggtccattcgatgattctcttcgattccattcgataattccgtttttttccgtttgatgttgattccattcgattccattcgatgataattccattcgattctatgcgatgattccattccattccatttgaagatgattccattcgagaccattcgatgattgcattcaattcattcgatgacgattccattcaattccgttcaatgattccatttgattccatttgatgttgattccattcgattccattttatgatgattccatgaaattccattagatgatgactcctttcatttccattcgatgatgattccattcgtttccatccgatgatgattccattcgattccgttcaatgattattccattcgagtccattcgatgattccattcgattccattcgatgatgattgcattcgagtccatggattattccattccattccattagatgattccattcgggtccgttcgaagattctcttcgattccattcgataattccgtttttttccgtttggtgttgataccattcgattccattcgatgataattccattcgattctatgcgatgattccattcctttccattagaagatgattccattcgagaccattcgatgattgcattcaattcattcgatgacgattccattcaattctgttcaatgattccattagattccatttgatgatgattccattcgattccatttgatgatgattccatgcgattccattagatgatgacccctttcatttccattcaatgaggattccattcggttccatttgatgatgtttcctttgaattccatttgatgacaattccattcaataccaattgatgatggttatttttgattccatttgatgatgattacattcgattccatttgatcataattccattcgattccactcgatgattccattcgattccattcaatgatgattccattcgagttcattgactgttccattccattccattcgatgattccattcgagtccattcgatgattctattcgattgcattcgataattccattcgattgcattcgataattcaattcgattccattggaggataattccatttgagtccattcgatgattgttccattcgattctattcggtgattccattcgattccatttgataatgattccaatcgagaccattcgatgattccattcaattccattcaataatgattccattcgagtcccattcaatgattccattcaagtccattcgatgattccatctgattccattcaatgaatccattcgattccattctatgatgattccattcatttccatctgatgatgattccattcgattccattcaatgattccattcgattccgtttgatgatgatttcaatcaatttcattcgatgattccattcgaatccattcgatgatgagtccatccatttcaatttcatgaaaaatccattcgtttcaatacgatggtgtttccattcgattccattcgatgttgattccattagtttccattggatgatgattccattcgagtccattcgatgatgatcacaatggatttcattccatcattctattcgattccatttgatgatgattccgtctgattccatttgatgattccattcgtttccatccgatgatgattccattcgattcggttcaatgattattccattcgagtccattcgatgattccattcgattccattcgatgatgattgcattcgagtccatggattcttccattccattccattagatgattccattcgagtccgttcgatgattctcttcgattccattcgataattccgtttgattccgtttgatgttgattccattcgagtccattcgatgataattccattcgattctatgcgatgattccattccattccatttggagatggttccattcgagaccattcgttgattgcattcaattcattcgatgacgattccattcaattccgttcaatgattccattagattccatttgatgatgattccattcgattccatttgatgatgattccatgcgattccattagatgatgactcctttcatttccattcaatgaggattccattcggttccatttgatgatgattcctttgaattccatttgatgacaattccattcaataccaattgatgatggttatttttgattccatttgatgatgattacattcgattccatttgatcatgattccattcgattccactcgatgattccattcaatcatgattccattcgagttcattgactgttccattccattccattcgatgattccattcgattccattcgatgattctattcgattgcattcgataattccatgcgattgcattcgataattccattcgattccattggaggataattccatttgagtccattcgatgattgttccattcgattctattcggtgattccattcgattccatttgataatgattccaatcgagaccattcgatgattccattcaattccattcaataatgatccctttcgagtccattcaatgattccattccagtccattcgatgattccatctgattccattcaatgaatccattcgattccattctatgacgattccattcatttccatctgatgatgattccattcgattccattcaatgataccattcgattccattcgatgatgatttcaatcaattttattcgatgattccattcgaatccattcgatgatgagtccatccatttcaatttcatgataattccattcgtttcaattcgatggtgtttccattcgattcattcgatgttgattccattagcttccgttggatgatgattccattcgggtccattcgatgatgatcacactggatttcattccataattctattcgattccattcgatgatgattccattcatttccatccgatgatgattccattcgattccgttcaatgattattccattcgagtccattcgatgattccattcgattccattcgatgatgattgcattcgagtccatggattcttccattccattccattagatgattccattcaagtccgttcaatgattctcttcgattccattcgataattccgtttttttccgtttgatgttgattccattcgattccattcgatgataattccattcgattctatgcgatgattccattccattccatttgaaggtgattccattcgagaccattcgatgattgcattcaattcattcgatgacgattccattcaattccgttcaatgattccatttgattccatttgatgttgattccattcgattccattttatgatgattccatgcaattccattagatgatgactcctttcatttccattcgatgatgattccattcgtttccatccgatgatgattccattcgattccgttcaatgattatttcattcgagtccattcgatgattccattcgattccattcgatgatgattgcattcgagtccatggattattccattccattccattagatgattccattcgagtccat

SEQ ID NO: 1044 - DNA, 6113 bp, Homo sapiens
cgattccattcgatgatgattccattcgtttccatccgatgatgattccattcgattccgttcaatgattattccattcgagtccattcgatgattccattcgattccatttgatgattattccatgcgattccattagatgatgactcctttcatttccattcaatgaggattccattcggttccatttgatgatgattcctttgaattccgtttgatgacaattccattcgataccaattgatgatggttattttgattccatttgatgattattactttcgattccatttgatcatgattccattcgattccactcgatgattccattcaatgatgattcaaatcgagttcatttactattccattccatttcaatcgatgattcctttcaaatccattcgatgattctgttcgattgcattcgataattccattcgattccatttgaggacaattccatttgagtccattcgatgattgttccattcgatgctattcggtgattccattcgattccatttgataatgattcctttcgagaccattcgatgattccattcaattccattcaataatgattccattcgagtccattcaatgattccattcaagtccattcaatgattccatctgattccattcaatgaatccattggattccattctatgatgattccattcatttccatctgatgatgattccatttcattccattcaatgattccattcatttccatctgatgatgatttcattcgattccattcaatgattcctttcgattccattggatgatgatttcaatcaatttcattcgatgattccattcgaatccattcgatgatgagcccatccatttcaatttcatgataaatccattcgtttcaattcgatggtgtttccattcgattccattcgatgttgattccattagtttccattggatgatgattccattcgagtccattcaatgatgatcacattggatttcattccataattctattcgattccatttgatgatgattccatctaattccatttgatgatcccattcgattccattcgatgatgattccattcgtttccatccgatgatgattccattcgattccgttcaatgattattccattcgagtccattcgatgattccattcgattccattcgatgatgattgcattcgagtccatggattcttccattccattccattagatgattccattcgagtccgttcgatgattctcttcgattccattcgataattccgtttgattccgtttgatattgattccattcgagtccattcgatgataattccattcgattctatgcgatgattccattccattccatttggaggtggttccattcgagaccattcgttgattgcattcaattcattcgatgacgattccattcaattccgctcaatgattccattagattccatttgatgatgattccattcgattccatttgatgatgattccatgcgattccattagacgatgactcgtttcatttccattcaatgaggattccattcggttccatttgatgatgattcctttgaattccgtttgatgacaattccattcgataccaattgatgatgtttatttttgattccatttgatgatgattactttcgattccatttgatcatgattccattcgattccactcgatgattccattcgattccattcaatgatgattccattcgagttcattgactgttccattccattccattcgatgattccattcgagtccattcgatgattctattcgattgcattcgataattccattcgattgcattcgataattccattcgattccattggaggataattccatttgagtccattcgatgattgttccattcgattctattcggtgattccattcgattccatttgataatgattccaatcgagaccattcgatgattccattcaattccattcaataatgatccctttcgagtccattcaatgattccattccagtccattcgatgattccatctgattccattcaatgaatccattcgattccattctatgacgattccattcatttccatctgatgatgattccattcgattccattcaatgataccattcgattccattcgatgatgatttcaatcaattttattcgatgattccattcgaatccattcgatgatgagtccatccatttcaatttcatggtaattccattcgtttcaattcgatggtgtttccatttgattcattcgatgttgattccattagcttccgttggatgatgattccattcgggtccattcgatgatgatcattctggatttcattccataatctattcgattccattcgatgatgattccattcatttccacccgatgatgattccattcgattccgttcaatgattattccattcgagtccattcgatgattccattcgattccattcgatgatgattgcattcgagtccatggattattccattccattccattagatgattccattcgggtccattcgatgattctcttcgattccattcgataattccgtttttttccgtttgatgttgattccattcgattccattcgatgataattccattcgattctatgcgatgattccattccattccatttgaagatgattccattcgagaccattcgatgattgcattcaattcattcgatgacgattccattcaattccgttcaatgattccatttgattccatttgatgttgattccattcgattccattttatgatgattccatgaaattccattagatgatgactcctttcatttccattcgatgatgattccattcgtttccatccgatgatgattccattcgattccgttcaatgattattccattcgagtccattcgatgattccattcgattccattcgatgatgattgcattcgagtccatggattattccattccattccattagatgattccattcgggtccgttcgaagattctcttcgattccattcgataattccgtttttttccgtttggtgttgataccattcgattccattcgatgataattccattcgattctatgcgatgattccattcctttccattagaagatgattccattcgagaccattcgatgattgcattcaattcattcgatgacgattccattcaattctgttcaatgattccattagattccatttgatgatgattccattcgattccatttgatgatgattccatgcgattccattagatgatgacccctttcatttccattcaatgaggattccattcggttccatttgatgatgtttcctttgaattccatttgatgacaattccattcaataccaattgatgatggttatttttgattccatttgatgatgattacattcgattccatttgatcataattccattcgattccactcgatgattccattcgattccattcaatgatgattccattcgagttcattgactgttccattccattccattcgatgattccattcgagtccattcgatgattctattcgattgcattcgataattccattcgattgcattcgataattcaattcgattccattggaggataattccatttgagtccattcgatgattgttccattcgattctattcggtgattccattcgattccatttgataatgattccaatcgagaccattcgatgattccattcaattccattcaataatgattccattcgagtcccattcaatgattccattcaagtccattcgatgattccatctgattccattcaatgaatccattcgattccattctatgatgattccattcatttccatctgatgatgattccattcgattccattcaatgattccattcgattccgtttgatgatgatttcaatcaatttcattcgatgattccattcgaatccattcgatgatgagtccatccatttcaatttcatgaaaaatccattcgtttcaatacgatggtgtttccattcgattccattcgatgttgattccattagtttccattggatgatgattccattcgagtccattcgatgatgatcacaatggatttcattccatcattctattcgattccatttgatgatgattccgtctgattccatttgatgattccattcgtttccatccgatgatgattccattcgattcggttcaatgattattccattcgagtccattcgatgattccattcgattccattcgatgatgattgcattcgagtccatggattcttccattccattccattagatgattccattcgagtccgttcgatgattctcttcgattccattcgataattccgtttgattccgtttgatgttgattccattcgagtccattcgatgataattccattcgattctatgcgatgattccattccattccatttggagatggttccattcgagaccattcgttgattgcattcaattcattcgatgacgattccattcaattccgttcaatgattccattagattccatttgatgatgattccattcgattccatttgatgatgattccatgcgattccattagatgatgactcctttcatttccattcaatgaggattccattcggttccatttgatgatgattcctttgaattccatttgatgacaattccattcaataccaattgatgatggttatttttgattccatttgatgatgattacattcgattccatttgatcatgattccattcgattccactcgatgattccattcaatcatgattccattcgagttcattgactgttccattccattccattcgatgattccattcgattccattcgatgattctattcgattgcattcgataattccatgcgattgcattcgataattccattcgattccattggaggataattccatttgagtccattcgatgattgttccattcgattctattcggtgattccattcgattccatttgataatgattccaatcgagaccattcgatgattccattcaattccattcaataatgatccctttcgagtccattcaatgattccattccagtccattcgatgattccatctgattccattcaatgaatccattcgattccattctatgacgattccattcatttccatctgatgatgattccattcgattccattcaatgataccattcgattccattcgatgatgatttcaatcaattttattcgatgattccattcgaatccattcgatgatgagtccatccatttcaatttcatgataattccattcgtttcaattcgatggtgtttccattcgattcattcgatgttgattccattagcttccgttggatgatgattccattcgggtccattcgatgatgatcacactggatttcattccataattctattcgattccattcgatgatgattccattcatttccatccgatgatgattccattcgattccgttcaatgattattccattcgagtccattcgatgattccattcgattccattcgatgatgattgcattcgagtccatggattcttccattccattccattagatgattccattcaagtccgttcaatgattctcttcgattccattcgataattccgtttttttccgtttgatgttgattccattcgattccattcgatgataattccattcgattctatgcgatgattccattccattccatttgaaggtgattccattcgagaccattcgatgattgcattcaattcattcgatgacgattccattcaattccgttcaatgattccatttgattccatttgatgttgattccattcgattccattttatgatgattccatgcaattccattagatgatgactcctttcatttccattcgatgatgattccattcgtttccatccgatgatgattccattcgattccgttcaatgattatttcattcgagtccattcgatgattccattcgattccattcgatgatgattgcattcgagtccatggattattccattccattccattagatgattccattcgagtccat

SEQ ID NO: 1045 - DNA, 535 bp, Homo sapiens
gaataatcgaatgcaatcgaatagaatcatcgaatggactcgaatggaatcatcgaatgtaaaggaatggaatagtcaatgaactcgaatggaatcatcattgaatggaatcgaatggaatcatcgagtggaatcgaatggaatcatgatcaaatggaatcgaatgtaatcatcatcaaatggaatcaaaaataaccatcatcaattggttttgaatggaattgtcatcaaatggaattcaaaggaatcatcatcaaatggaaccgaatggaatcctcattgaatggaaatgaaaggagtcatcatctaatggaatcgcatggaatcatcatcaaatggaatcgaatggaatcatcatcaaatggaatctaagggaatcattgaacggaattgaatggaatcgtcatcgaatgaattgaatgcaatcatcgaatggtctcgaattgaatcatcttcaaatggaatggaatggaatcatcgcatagaatcgaatggaattatcatcgaatggactcgaatggaatcaacatcaaac

SEQ ID NO: 1046 - DNA, 1063 bp, Homo sapiens
ggaatcatcatcagatggaaatgaatggaatcgtcatagaatggaatcgaatggattcattgaatggaatcagatggaatcttcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaaatgaaattatcctcaagtggaatcgaatggaattatcgaatgcaatcgaatggaattatcgaatgcaatcgaatagaatcatcgaatggactcgaatggaatcatcgaatggaatggaatggaacagtcaatgaactcgaatggaatcatcattgaatggaatcgaatggaatcatcgagtggaatcgaatggaattatgatcaaatggaatcgaatgtaatcatcatcaaatggaatcaaaaataaccatcatcaattggtattcaatggaattgtcatcaaatggaattcaaaggaatcatcatcaaatggaactgaatggaatcctcattgaatggaaatgaaaggggtcatcatctaatggaatcgcatggaattatcatcgaatggaatcgaatggaatcaacatccaacggaaaaaaacggaattatcgaatggaatcgaagagaatcatcgaacggacccgaatggaatcatctaatggaatggaatggaataatccatggactcgaatgcaatcatcatcgaatggaatcgaatggaatcatcgaatggactcgaaaggaatcatcattgaacggaatcgaatggaatcatcaaatggaatcagatggaatcatcatcaaatggaatcgaatagaattatggaatgaaatccaatgtggtcatcatcgaatagactcgaatggaatcatcatccaatggaaactaatggaatcaacatcgaatggaatcgaatggaaacaccatcgaattgaaacgaatggaattatcatgaaattgaaatggatgtactcatcatcgaatggattcgaatg

SEQ ID NO: 1047 - DNA, 324 bp, Homo sapiens
ctttccattagaagatgattccattcgagaacattcgatgattgcattcaattcattcgatgacgattccattcaattctgttcaatgattccattagattccatttgatgatgattccattcgattccatttgatgattccatctgattccattcaatgaatccattcgattccattctatgacgattccattcatttccatctgatgatgattcctttcgattccactcaatgcttccattcgattccatttgatgacaatttcaatcaattttattcgatgattccattcgaatccattcgatgatgagtccatccatttc

SEQ ID NO: 1048 - DNA, 239 bp, Homo sapiens
gggcaccacaaaaaacacaaaccaatgaaagaaagcagtaacaaggagcgtacggtctatttttgaaaccagaaaaaaagaaatcagggaaaagcacggacacagccccccactaccacaaattatgcagtcgatttcccacatttggggaaatcgcaggggtcagcacatccggagtgcaatggataagcctcgccctgggaaaaccacattcgtgatcatggtatctcccctgccag

SEQ ID NO: 1049 - DNA, 402 bp, Homo sapiens
cgcgaacccgctgtgcggcagaggcggccaggtacctttaaggccccgctgcgcctgcgcctgcgcctgcgccttgggctctcttgacgcgcccggcgagaccctgaggatccagctggccgcaggctatgggctgggcggcggttgagacagcggcgatattgggaggggtaggtgagggtcgcgaggctgcgtgagcttctgagtgaacgcggtgcttttgggaacgcgggacgggcgacctgtggcgccaggagcgggccgaggcgcggcggcgcggctgccgtctggatgggaagttacggtttacagcgaagtccacccagcgtttccgaggtgaaggcgccgcgccaggccgggcgggcggctggtgatgggcaagccgggtgtaccaagtccatg

SEQ ID NO: 1050 - DNA, 4067 bp, Homo sapiens
cccagttactcaggaggctgagggaggagaagcgcttgaacccagagggcagaggttgcagtaagccgagatcgagccactgcactccagcctgggcgacaaagtgagactctgtctcaaataaataaataaatcttaaatactgggatagaacattttttctaatttgtgcacgcgcgtgtgcgtgtgtaaacttttcaaagttgtaaatattagcttacatttggtcatgcaattaataaagaaactttatcaaaaagaatgaaattacaaaagttggacaaccctgaacattctgaaaggtatgattaccaacacagaaaagagagcaaccactttcacagagaatgtagcacttgaattagaataattcttttcgtaattttaaattatctcctttctgtctcctcattaaaacttgttttcttctcttctcccgttgttcgaagagaagccctatctttctttctgtggactttgcaaagtttccattctaatgataatttccattccaatactaaatttaaaaaatagcaacaaagatcatgataccaattaatatttgtaagtgcttacagtgtgccaagttctgagaatgcacttgaccttattatcttattcagttctcctaatagtcttttgaggttggtacaaccattgtctttgtttgtagagagacactgaagctaggaaaacactagtaattgatggcaagtgctggagctgggatttggacataagtgtactggttctagtgcctaaactcttagccacaattttattatgcttactgatagctgacccccttattcatttgtttgttaatccactcatccatttatgagtgcatcgtgtgtgccaggccatgttctagctgttagttgcacaatgatcaagaatgaatgtatgaaaatatgtattttcggccgggcgtggcggctcacgcctgtaattccagcactttaggaggctgaggcaggcggatcacctgaggtcaggagttcgagaccagcctggccaacatggtaaaaccctgtctctcctaaaaatacaaaaattagccaggtgtggtggtgcacacctgtaatcccagctactcaggaggctgaggcaggagaatcgcttgaacccaggaggcagaggttgcagtgagccgagattgccactgtactccagcctgggtgacagagctagactccgtctcaaaaaaaacaaaaaaaagaaaatgtatgttcaaggatgagtgtttatatttcagtattctctataccaatacaatattagtactcaaggtgaggattatttcaagtgtggaatatatatacaatagaacattatagagcaatgtactgacttgggaggatgtccattataacaaatttaagattaaacaaaacaacggcaacaacaatttgactgaatattacaaaaaataagatctcatttttgagggagaaaagatggaaatgtctggaaggatacataccaaaacattgatattgattatgtctggatgatggaattagcctattgccttctttataactgagtattatatttattttaattatctattcattgaaaaaatattctagtgcttttactatgtgcagcataccttaagcattgcagatacaatattgaataggcaaacatggttcctgccttcatagagtctacagattagcaaattccaacagaatgtaattattattgtaatagaagtaaagagtgctatggaatatataactgggcacttactcaatctgaagagattgggggattcagggaaagtttcctagaggaaactgcatctaaccagggtcctgaagaaggaataagaagtagccactaataagggggtggtagtgtgagaatgaagaatgttccatgcataggaaatagcttgaatcaagatcccgatgagagaaagaaccatagtcagtattcctagagaatgggatgtaaggaatgcagagaactgaaaccagagaaaagagagaggagtcatcatacagagtcttgcaagttatgtaaaggcttttaaattttatctgagctcaagggaactgctgaaagcttttagacagagaggtgacatgatcagattttcctcttagaaagatccttttggcttccttatggcctctgcataggaggagtagtctagaggcagagaaaacagttgcagtattccaggcaaaggttggtggagatgccagtataaaaattagagaaatggacaggtgaaagaaatttcagaggcagaattgatagagctaagccattgactggatgtagaaccagtgaggctgaagaaacccaaagacgactgatcaccaattcatctcttcactcacatcctacccactgtcaccttgtcgtaaacttccagactaccttcacctctctcttcaataacgtgagttatttgttcaaagtctgccttttctgttagaacatgagctcactatagcagggacagtggttgtcttttcacttctagatacagtgattagcataatgcctggtacatagtaggcatgcccttttcttttcttcttttttgtttgttttgaacgaataaatgatgtcaagttttcttgcttggtcaactactaggttatgccctccactgagaaagagaacaactggaacagacaggcacatgtagtacttttatgaccactgaagcaacagcaacacaaacaaaaaacagtaaagcgatttctgtttttggaagaaaagtaaagaagattcttcctgttgttaaggaactccagatctactggggagagagtcaaacagataatcccaatatactgtgaaatgggccacaataagagtaggtccgcagtgctgtggaagcattcaggagaagcccttgcccaggcattagggccagataggtttcttttagtaggtaatatctgacttagatccttatgggtgagttgggattagttaagtgagagatgggtgggaattaaagagaagtgaaattctaggctaatgctgctacccatgcaaagtcctggaggcagcatgagcctggtgaattcagaaataggaggctttctgtcatggatggagcaagggagggtcaatcggggttcatgttggctctatcttttcccttatccccctacttctggtcaaggcattattgttgcagccatgggcattcatggtatcactgtggactcttggtttttggttttgttttgtttttttttttttttagacatggtcttgctctgtcatccagacttgagtgcagtggcacaatcttggctcactgcagcctcgacctcccggattcaagtgatcccccacctcagcttcctgagtagctgggactacaagaacataccatcacgcctggataattttgactttttaaaactttattttatttatttatttgagatggagtttcactcttgttgcgcaggctggagtgcaatggcatgatctccactcactgcaacctctgcctttcgggttcaagcgattctcctgcctcagcctcctgagtagctgggataacaggcatgtgccaccacactggcaaactttgtattttttgtagagacggggtttctccatgttggtcaggctggtctcgaactcctgacctcaggtgatccacccaccttggcctccctaagtgccactgcgcctggcctgtttttttattttttgtagagatggggtctcgctgtgttgcccaggctggtttcaagctcctagcctcaagcaatcctcctgccttggcctctcaaagtgttgggattggcatctcaaagtgtttgagccacaacacctggcaactcttagctcttgtggccagagcaggtcgtagtcatgccttcaaaattgccttcactcctagaaaaaaatggagaaaggattatttaaaatctagagaaaaagtctggactagaacgttattccaggggtggaatgaagaaattaaggaaaaagaaggggagagccattaaggtttggaagaaacattctgagaccagagtaaagatgttatatgtactaggagaaaaaggaag

SEQ ID NO: 1051 - DNA, 244 bp, Homo sapiens
cctgcggcctgaagatgcctgaggcccggactctcagacccctattgccctttggtgctggaggcccagcggcagcctgaagcccaagagagtggagcctcgcgaaatgaggaacctggcacaaggctgaagcgcagtggcacgctctgggctcactgcaacctctgcctcctgagttcaagagattctcctgcctcagcctcccaagtagctgggattacaggcccatgccaccacacccggc

SEQ ID NO: 1052 - DNA, 524 bp, Homo sapiens
gcctatctgtggtaacaccatggcatgagctgtgtggattccaagtgctgaatgaagctggaagggcagaggtcacatcgggccagtatgtgcttcttggaagaggtggcatttgagtcacttgaagaatgagcaggagatgagggatgggaaggagaaggcattcctgggatgccatgagcaaagtgtcacagttttgcattgatcactgtcatccatgtaagagcaaggacagctcaggcaggtggtggccatagaatggaggtggacacataaatatgtggagaaagaaggaagtctttgggttaaaaggccaagacttgacacctgtgaggacctggaatctaaccctgtgtttgtctgtaaacccaagagataacatctccttcagctgagcccagtattaaccttcgcatgaccccattacctgccgtgtctgtgcctgatcagacccaactccttgaggccagagacttcttgctgcttcttcaacaccaagtgcaaaaggcgcccaaaaaatgaca

SEQ ID NO: 1053 - DNA, 1547 bp, Homo sapiens
gtccccttctacactgtggaagctttgttctttgcaataaatcttgctactgcttactctttgggtccacattgcttttatgagctataacactcaccgcgaaggtctgcagctacactcctgaagctagcgagaccatgagcccactgggaggaaaaaacaactccagacgcgctgccttaagagctgtaacactcaccgcgaaggtctgcagcttcactcctgagccagcgagaccacgaacccaacagaaggaaaaatctccgaacacatccaaacatcagaaggaacaaactccagtgcgccaccttaagagctgtaacactcaccacgagggtccgcggcttcattcctgaagtcagtgagaccaagaacccgccaattccagacacgttttggcaacccagatgggactttcgcctatcgccaagtggtgagacaatcgccgagcagtgagaccatcgcctattgctgagcaaattgaggccatcaagctacagatggtcttacaaatggaaccccaaatgagttcaactaacaacttctaccgaggacccctggaccgacccactggcacttcccctggcctagagagttcccctctgaaggacaccacaactacagggccccttcttcgcctctatccagcaggaagtagctagagtggtcatcggccaaattcccaacagcagttggggtgtcctgtttagaggggggattgagagatgacagcgtgctggcagtcctcacagccctcgctcgctctcggcgtctcctctgcctgggctcccactttggcggcacttgaggagcacttcagcccactgctgcactgtgggagcccctttctgggctggccgaggctggagccggctccctcagcttgcagggaggtgtggagggagaggtgcgagtgggaacccgggctgtgcgcggcgcttgtgggccagctggagttccgggtgggcgtgggcttggtgggccccgcactcggagcagccggccggccctgccagccccgggcaatgaggggcttagcacccgggccagcggctgcggagggtgtactgggtcccccagcagtgccagcccgctggcgctgcgctcgatttctcaccaggccttagctgccttcccatggggcagggctcgggaccggcagcccatcatgcctgagcctcccaccccctccgtgggctcccaagcctccccggtgtgtccggagcctccccgatgagcaccgccccctgctccatggtgcccagttccattgaccacccaagggctggggagtgtgggcgcacagcgtgggactggcaggcagctccacctgcagccctgatgtgggatccactgggtgaagccagctgggctcctgagtctggtggggacgtggagaacctttatgtctagcccagggattgtaaatacaccaatcggcactctgtatctagctcaaggtttgtaaacacaccaatcagcaccctgtgtctagctcagggtttgtgaatgcaccaatccacaatctgtatctaactactctggtg

SEQ ID NO: 1054 - DNA, 2299 bp, Homo sapiens
tggtgctttattttattttatttattttaaaaaggcgctacagtggcaggacgctgctggggatggggacacacagtgtaagtggtagattttccaagacttcccctccctattgtcctccgagttcctctcttcctggtcctatcagtagcataggattcaacaaaagccttcatgaatgcctctttatttctgaaaaggaacttctacccctccctttcccatttccagacttgaaatccttcatcagctatctcacttccatgttgaaaccaggaccactgattgtaagtctgaaaatctgggtgtcctaccccataaccaggccaagatatctgcccccaatgctaaagtctctgaatatttcctttctgtacattcaatatatttgggcatatatacatctatatacatctttctatatatatattatctctgtttctttcttcttagataaacctttcatatatgtcatatcctaatttcccaagcctccccacttcttgtttgcgagcctaagcaagactcaagagtttcattgatttcactaggtccctcagcatcatttctttctcatcttctcaccccaggtatcttcccccatcagttgtttcgcccgtcttctgaaatctcccctttttacacctgtgcctaccgaaatctcccctttttacaactgtgcctactactctgctgatattccaagtccacagttggtatgggggcccatttctcaccagacctggctgcttctaaagctcggcctattgcctaaaagaggatttcaggtcagaggagacagactatagtctaaagaaccatttagagttaaggtagggggtagttgttccctgtagggggcttgtgggagaagatgccagatcgcattaataggacagtgtgatttaaagtgcaacttaaagcaaagcctgggtaataatggaggagattccaaaagggtaagtcagaaaatgttttcttctcactgtttcatccaagagtctagaggcttgagtctgggggcttagaatagacagcaggggaatgggaagaaagcatagcatggccaaataaaccagatggaggttaacttggcaatggataggaaggtatagacacacacacacacacacacacacacacacacacacacacacacacacacagcagtacatcttgtccctacacactgaaagaaataaggtaagtctaatgttgaataaagttgagaacgcagaagctggctcttggccttctgttctctgtttcagatttttcaagtttttgtggttcttgtttttatgccaactagaaggtaatggtggggtttactgtagatggacaccgaagggtctttgttttcaagatatagttagttgagttcgaggagagatcaatataacaagaccttgtgcaattatagttggtggtgatcatgggtctagcctcaaaattttgtgtttctctgcaaggctctgtacatagatgcatgtatatattctgtagcttgtaacaattggctgagaccaccttaaactgcaacttgacttatagtgggactatgcagtaccactatgtgaggcttccttggtaccaaagtgagaccagaaagcactctagggatttggggctttggataaagctctggtgcctatatgcccttccctgacccttaccacagaccccaccagggaacaaggaataggctgagtttgatctcttaaagtctactttttaacttgtctgaaaatggcctcatggcagaggagagtagagatgacactgatttcttcattttataccaagtctcaggaatggctgagggaagccatggttatttgatcagaaggtataatttcatttccttccagcattgcctaatgaaatagctggcacttttcagaagggcactgggaggtgtaactgagaatagtggctgccagccacagagttctgctcctgcccaaaccttaacaaagcatcaccaattctcagaggctctgtacagcagtttggaaatctgagaatttacccatccctcatggtgggattgtgttaactttctggggaatctgtgccctgtgaatctagttttacttgagcatccgtgttaagagaggaaggcccttgcattttccctcccttctcccaaagagttggggttaaggaagaaggatctaggctgagcaggaaaggaagaagagaagccagatgaatgaaaaatattactgaatcagagaaactaaggttcagagacataaagtcacttgctgacgtttatttaatggcaaagccagac

SEQ ID NO: 1055 - DNA, 299 bp, Homo sapiens
aggacgagcaccctgataaacccaattgctgagtgacatccgagaagctgagttaaattcaatgttgatttgctttgcctagaagaatgggactgagatgggaatgagccatatcagatacaatggtaaggtcataagacccctgttccagagaagtctctaccgatacccagaaggaagaaatgcatgctcagagaggccaggaaggatccagatagaagctgtgtagaaatataattggaccaataaggtatgatctaaagagtggggagtgtgtcttcattctgaaggcttccaag

SEQ ID NO: 1056 - DNA, 688 bp, Homo sapiens
ggctgggcaaggtggctcacgcctgcaatcccagcactttgggaggctgtggtgggcagatgacgatgtcaggagttcgaaaccagcctggccaacatggtgaaaccccgtctctactaaagatacaaaaaatttgggcgtggtacagggtgtggtagtgcgtgcctgtaatcccagctacttgggaggctgaggcaggagaatcgcttgaacctgggagacagagattgcagtgagccgagatagtgccattgcactccagcctgggtgacagggtgagactctgtctcaaacaaacaaacaaacaaaaaaagccaagtttctcttcagaggtagaaaggtactcctctaatagatcattactaagcgttaagcgtttccgtaaattataaatgagttgcaaaacttccgatacaagctcctgtccaaacctaagagttgcaggtaaagtctggttaaaggtatccagggaagacttatagagcagagcaaacaacctacattgtaactgaaaattatgtaccgcctttttatcccccctaaagagacagggtctcactctgttgccgaggtgctaacatagctcactgcaccctcaaactcctgagctcaagggattctcccaccatagcctcccaggtagctgagactataggcgcctaccaccacacctggctatttttttttt

SEQ ID NO: 1057 - DNA, 450 bp, Homo sapiens
accaggcaaggatgcaaaaccagttctcttgaatctaggtctcaaggaaatcaagaagaagaagccaatcaaaagaaaacaacagcactatctcaccatgcaactaatatcctgctgcatttgtctttgtgccctctgcattgccgcctgttaggaaggatgaagcactcaagttcctgggtaagaacaacctctttgctcctatgattatcttctgtctctcctacatcatcactttctccctctctatggaggctttttttttttttccagacagaggcttgctctgtcaccaggctggagtgcagtggcgcaatctcagctcgctgcaacctccgtctcccgggttcaagtgattctcctgcctcagcctcccaagtagctgggactacaggggtgcaccaccttgcccagctaatttttgtatttttagtagagatggggtttcac

SEQ ID NO: 1058 - DNA, 1100 bp, Homo sapiens
aggagttcgagaccagctagggcaacgtggcgaaaccccatctctacaaaaaatacagaaaattagccaggtgtggtggtacacgcctgtagtcccagctgctcaggaggctgaggcacgagaattgcttgagcctgggaggcggaggttgtagtgagccaagatcatgccactgtactccagcctgggcaacagagtgacactctgtctcgaaaaagaaaagaaaagaaaagaaaaaaaaaggtacatttaaatcacataataatggtcattcatgggagaatttagtgttcaatacaggaattattttcccaaggagggaccctttaaacatcaacattctaaaagtttcatttatttgattaaaatgttactgaaatatgttatttttctgccttcaaaagcagaacatccggagcacagtttaacctttcatttacagctcagtaggccatcagtgctacaatgaactgtagtatcttcccctagagaaactgacataaatagaagtgcttattccaaagctaaatgatctatatacctatacacttttcttatttttatgcctggtatttcatcatcatcttcttcttacatgcatttattccacaaataatcacgtgtcttccatcggctaggtgctgttctagactttgggaatatagcagggggaaaaaaacaaccaaaacccatgtcctcatggaacttacattctaatgtacgaagcagcaatcaatcaatcaataacaatgaaacaaatgaacaaataaaaaggtatattagacagtggtgttaaggaggaagtaaagctgaaatggaggatagggagttgcagggttagggggagttgagatttgtttatttaaaaaatagagacagggccatcttggctaacatgctgaaagtccgtctctactaaaaatacaaaaacttagctgggtgtggtggtgggcgcctgtagtcccagctactcaggaggctgaggcaggagaatggcatgaaccagggaggcggagcttgcggtgagccaagatcgcaccactgcactccagcctgggcaacagagtgagactccgtctcaaaaaaaaaaagagagagac

SEQ ID NO: 1059 - DNA, 617 bp, Homo sapiens
gaagaatttatttgaatctctcttttccttggctaagaagaatgaagaggcaggagacttgggggaccccttaactggggataattactgggacaaatcagccagcacaaagaggaggcactaaacaatcagtcctggtctctgttatcagagacttttgatgctaccattggagtcagacaagcagacaaacatcaacaaaatgattataaactatgacacactatgatgggaaagaaggaggctgacagagaggacattggcaggaaggagccctactgtagatgtggtggtcagagaagggcctttgtgagaagctgacacataatctcacagttgaagttgtgagaaggagctggtcctccagagagaagtaggaagagcgctccagcagaatctctggacaagtgcagctacgactgctgctgggaccgcgatactgtgatgagactttgcatatttaaaaggatgtcgagagaggaggaggaatgataaatgaactcaggaagatgtgatgtcttctgtgatgacactaatagatggaatgcagaattcagctccaatacttagggttggaaaccaaacataaacaagcaagcaaggaaaatgaaaaggaa

SEQ ID NO: 1060 - DNA, 1162 bp, Homo sapiens
caaatcctaaagaacgcgcgcgctgcctgctcgccagcgggagggccgtgtgcccagcttgcgccctgacattttccgaggcctgggcgaggccacctgcctgacgaaggcttaccagggaaaatcaggtcctgacagcctgacagggacaaccgcccagaggattcatctgctcgcgatgcctggtcagcaaggaggagactcgacctgggacgaggaagaggccttgaagggacagaggagagcgcatcctccatcccccggccagggagaagtcacgcggacccccaggttgctgggccgcgatggggggaagaggagaccacccccagctccgcagcgagcgccctcacttcggggagacagaggcgtcgatccctcctgcggacggctgggggcgctgcgcttcaaccgaaggcagagatcctggaccggggcgaggcaagccctcccggaggagaggagctctgaagggggaaaacagctctgcagagtgtagaggagccggactttgcagccaggtacctctgtgcaagtctcagctgtgcctctgaagtagctagccgttgcccagcactgtgctaaggtcttttcatcactgtgtaattgaaggctcacagccaccctttaaggaaaacgatcttgtcgtcattattttataagaaatggaatggaagctcagtgccacccctagcccatggacacattcccagagagcggcagtgtgtctggcctggaacttaatgaattctgtcggacagaagtccatgctcttaaccattaggcctcccatacaaagatactttgtacggggacatgagacacagcctaatagcacagaaactcacagaggacgagtttcttagttttgtcatctctgaaatgggaataataatattactcccaccttgcaaggctttgggaaagattagagagaatgtaaaaaggtccatgtgagaggtcctcgtgggttaatgtgtggggggagtccccagtccctccccgggcactcagagcgatgtgggaagactgtggagcccatgcttattgatgctgtttcatttcaattaaacctccgtcagaaacatcgcatgacatcaaaatggaagagatgttgagtctgaacgggtccagagagggaaaagccaacgggacactcacc

SEQ ID NO: 1061 - DNA, 262 bp, Homo sapiens
ggcacctaattagaaaacaacgtcagagtgaatttgtcgtgcgagtctccagctctgccagaagaactaaaagaaatgtgtcaccagaggaatcacaaaaccccgcacctgatgaatcagctggcaccacccagattgaaaaactggctcatctgatcttgtggccccctacccaggaactgactcagcgcaagaggacagcttcgactgcctgtgacttcatctccaacccagccaatcagcactcccaaatcactgcccc

SEQ ID NO: 1062 - DNA, 347 bp, Homo sapiens
gatttttttcagattatagcagagacttaatattggcagctttgaatacttcacttcaaatgtataccacagaacttatgatgttgatgttgaccatgagcatatttctggatgccacttctccatgacaaagacttgctattatatcttctttccaaatgatgtaataaactgatgtgagcaaaaagaaagtgagctccaggagaaaaaggaacttgtccttcttgttcacctctatttacagcatgccaagaatattgactcagagagagtaaggtaaagactcaatacatatgttttgaatatataaataaagggaaattgctttccaatccatcctccaccca

SEQ ID NO: 1063 - DNA, 552 bp, Homo sapiens
caacacgcatatgggaaaagaacagcattgtcaggaaaaaatggacactaagagaaagaagaaagcagagtcccaagacaaagaatatctcttgatactattaaatatagatgtctggactgaattgagcttacacgacaattgcagtcaagattctgcaactcagaacgggcaaaccagcacctaagcatcaagggtggaaagggagactggaagtgcaagtctgaaaggagaaaaaagaaggtgaaaccagtctgcaggagaaatgactgggaatttagaaggagtgggcacccacaagagaagagaagacacgaagtgagaaaaggctgctgcttgccaaggcacttttaagaacgggacatcttatcacttttcagttgtttgagcttcttgctccccagactttcagctaaaattgtggctgttttgttggcggaaatcagtgaaaagaaaatgagttctgtgtctagttcagtttacagcagaggcaagacgatgcctgaagcaggtggcaaggagtgaaaggggagtgtgcatggaagcagcagg

SEQ ID NO: 1064 - DNA, 698 bp, Homo sapiens
atgtcctttatctattccagataccatcaaggatacaacatacatgaagttgtcacatctctttaagctcatcttagcagccactattcctcagaactttctttggctttgatgaccttttcagtttttgagaagtattggtcagggtaatctatgccttttgaaccactctttacaaaatcttcatcctgcctttgctactaacaacttcaccaaaccactggaagaggaactatatgagtgaaaaaatcacatcattcttcctcagcatttgtattagtttgttcttatgctgctgataaagacatacctgagactgggtagtttataaagaaaaagaggtttaatggactcaacatttccccatggctggggagacctcacaatcatgggagaaggcaaaggaggagcaaaggcatgtcttacatggcagcagaaatattgaaattgttggcaaaatctgttggaacatatttcctggcaaaagagaaagcatgaacataagatgaagtgaatgtgatcttggggacaaaaaaaaggggacatttggatacagacacaggcatgaacagaggagagaccatgtgaagagtcacagggagaatgccatgtgaagacagaggaatggaattatccatccacatgcaataaaatgccaaagattgccaggaagtcaccagaagcttggaacagtctgg

SEQ ID NO: 1065 - DNA, 1273 bp, Homo sapiens
agcaagtgatcgtggggtctggccactgcacacagccaggcacgccagctgctgcggcagggcatgcagctccaggaaccggcaccggcaccagctccttgcgaggctgcagctggaccaggtgtaccacaggcggcttccgctgcaagtaccagggtctggatgaggggaacacagtggcacccaaaaacctgagtgagacgccagcaaccacagaggccaaagagacttcttaaagctaatttccaactcttcctgcctgcaatgaagagcaagaagtgattaaactgttcaattgcacaatcaactgacaaacaacaatctacatgacaccttcaagaaagggattaatctccacatggcacaaagcttctagaggccttctgatttcttcagcttatggcttacttcctcctatacaaaacaaacacacacacaatgaaaacacccaaaaagtgtaaaccctgagaagaacaaaatgttttagttaaaaggactgtagaagactcaaataaataaaattgaaaacacaaaaggggacattacaactgataccattaaaatgaaaaaggattattagagagactattacaaacaactacatgacaacaaaatcgaaaacctagtggaaatggataaattcatagatacatacaacctacttagattgaaccaagaagattgaacctgaacaattgcaagtaacaagattgaatctgtaataaaaaagactccaatcaaagaaaagtctaaggtctgatggctcgtctgcggaattctatcaaagaagtaatatcaattttcctcaaaactctttcagaaaattgaagaaaattcttctaaattcacttcataagaccaacagtatcctgatactaaaactagaccagaacataaaaacaaaagaaaactataggccaagatacttgataaacatagaagcaaaactcctaaacaaaatactagcaaacagaatccagcagtacgttaacatgattattcaccataatcaagtgggatttatcccagggatacaaggatgattcaacatactcatatcaacagacttgatccatcacatcaacagaatgaagaaaaaacaacaatatttaaggggacatttggatacagacacaggcatgaacagaggagagaccatgtgaagagtcacagggagaatgccatgtgaagacagaggaatggaattatccatccacatgcaataaaatgccaaagattgccaggaagtcaccagaagcttggaacagtctgg

SEQ ID NO: 1066 - DNA, 922 bp, Homo sapiens
agcaagtgatcgtggggtctggccactgcacacagccaggcacgccagctgctgcggcagggcatgcagctccaggaaccggcaccggcaccagctccttgcgaggctgcagctggaccaggtgtaccacaggcggcttccgctgcaagtaccagggtctggatgaggggaacacagtggcacccaaaaacctgagtgagacgccagcaaccacagaggccaaagagacttcttaaagctaatttccaactcttcctgcctgcaatgaagagcaagaagtgattaaactgttcaattgcacaatcaactgacaaacaacaatctacatgacaccttcaagaaagggattaatctccacatggcacaaagggtaatctatgccttttgaaccactctttacaaaatcttcatcctgcctttgctactaacaacttcaccaaaccactggaagaggaactatatgagtgaaaaaatcacatcattcttcctcagcatttgtattagtttgttcttatgctgctgataaagacatacctgagactgggtagtttataaagaaaaagaggtttaatggactcaacatttccccatggctggggagacctcacaatcatgggagaaggcaaaggaggagcaaaggcatgtcttacatggcagcagaaatattgaaattgttggcaaaatctgttggaacatatttcctggcaaaagagaaagcatgaacataagatgaagtgaatgtgatcttggggacaaaaaaaaggggacatttggatacagacacaggcatgaacagaggagagaccatgtgaagagtcacagggagaatgccatgtgaagacagaggaatggaattatccatccacatgcaataaaatgccaaagattgccaggaagtcaccagaagcttggaacagtctgg

SEQ ID NO: 1067 - DNA, 406 bp, Homo sapiens
gtggcaaggggtttgtgagcaagtgatcgtggggtctggccactgcacacagccaggcacgccagctgctgcggcagggcatgcagctccaggaaccggcaccggcaccagctccttgcgaggctgcagctggaccaggtgtaccacaggcggcttccgctgcaagtaccagggtctggatgaggggaacacagtggcacccaaaaacctgagtgagacgccagcaaccacagaggccaaagagaaggggacatttggatacagacacaggcatgaacagaggagagaccatgtgaagagtcacagggagaatgccatgtgaagacagaggaatggaattatccatccacatgcaataaaatgccaaagattgccaggaagtcaccagaagcttggaacagtctgg

SEQ ID NO: 1068 - DNA, 520 bp, Homo sapiens
gcttctcaagtgtcttcttactttctttttaaagcggatgagtgttctgcagacagaaacattccagtcatggagatcaacctgtgcaaaggcagaaaagcacagatggaaataggacacatgcgggagtccaatatcgcattaatccaggaagaaggtgtatcatagaagaaggtccaggcatcaaccacttgagaagattccaatatactgtgacaagcacttgctgattaccttccttctcacattcgccagtgaattcatactgtctcagaaagaagaaaaaaatgaaatatttgatgagaagaataattgaatgaatgataattaagagccgggtttatatcatacgccagtttccatgttacagggtctcacaatgtctcctaggctggtctcgaattcctgggctcaaggaatccttcctccttggtctctcaaagtgctggaattacaggcataagccacttcacccagccaaaaatgtatttatctacagagaatttataattttatacag

SEQ ID NO: 1069 - DNA, 1036 bp, Homo sapiens
cagctcagacagcatgacagttcagtggggtggagaaagaaaggaggtgggtgcccggggtcagaagtcgggtggagaggctggcccatccatctgtccccttctcctaaagaactgcggctgaaccagcgagcggtacccggacgacatgtgggggagggaggaaacccggcctggaagtggcggtggcgggtccccgggcaaaggaaaggctcaattgtgcaaaggcttcctgccctgccagctcgcgggtccgccaccgagcagccgcctttctgcggccagcctgggaggcgggacgggaaggcgaaggcagcaaagggttacgggaatagctttccaatgacaaagtctggaagggacccatgcctccgcccctctgcgggttaaactggcacagtgcagggggaggaaagccagggcgatcggacggattctctcctcctgcccgccccccggccgccaggcactcccctcctgggcccgccgtggaggcagccggcgtgtgcctggggcagcgggtcacgaggctccgccccggccgccgttcccgaggggacggcactttgttcaggatgccgcctccctcctcattgtggggccggggccggcggctgccctagtgcggggcccgaggctggagtgcgcggcggacgccaagcctggtgcgaggggccgaggcggcctggggagccccgggaaactttgtgctcgcgagaagcggaccccgcacccgcgctgcccttggggatgcgcgactctgcgcggctgcggcgcggacccggagcccgggcgggcaggcgctccggagtggaagggatgaagagagacaggaagaaagcactctatgtagtttctggagttggctgtagaaggacgaaaggactcctcaggggctgcggaaaggaagccatctatgtgctgggcggtgactgagctgtgcatggaaccctgcgcaaggggcttggaggggcagaaaggaggaggcctggactccaaaaaacaaaaacagaaaccagggataagaataagggtg

SEQ ID NO: 1070 - DNA, 1195 bp, Homo sapiens
gaaattgggctctcccttcaggcactccttcaggaggcaggagacggaggagcagcgaaggaagctgtgggagcagggcagcggcagggggtacagaggaaagaagaggagtcacaacaaaggacagaggtatcttgggtgggacaggggagaagggctgaggaagggagagggcagcttagggtctggagaaagtggcaaaggcctgccttgaggttgctcccgaagcagaagatcaggctggggctggaacccaggggccccacacacccgcctgtccccctggcctgcctacttctcttgagagcaaccagaaaccaataccgtatttgtctccttctccaaggtaaaggaggagcaagtcagagctccaagactcaggttttgcacacccacaaattccatttccaaagacctgatggagactttgagtcccttccctggattgcagcctcccagcagagctcaaacagaacacacactcacctccatgaagggcacggcacgacaagaaacgtcacccagtagcctctgcttggtgatctcgttgaagatgacaatagggaggcagaaaaagaggaccagaaaatcccagagggccaggctggcaaggatggagttccaggcactcttcaggtagtagctgtgccacacgatgcacatgaccgacaggttgcccacaatgcccaccgcaaacaccaccagcgccagaagcatgatggcataggcactgtaggagctctcggtcaccggatacagggggttctggatctgtagcctctgccctggtgctcctgtcagattgcccctcagttcctgcccactgtctggggtgcccccatccttgccggggttagggctggtggccaccaagggcttggttggctgcaggccagcagggtgaatgggccgggggtactccgcccactcctcaggcacatactgctgcacgcccttggcctcctcatcctcggtgcccctcttggatcggctctgctgctcctgggtctcggctctgtgcctgcccaggtgcaggggggcacccccagagaccctgcttagccccacagccaaaatcacagcaagagagacagccaggggccacagccaccgcatggctggatgagcaggagacagccagcccaggaagagcaggagtggaaacggaagtccagagaagccaagtgaccaggcc

SEQ ID NO: 1071 - DNA, 1684 bp, Homo sapiens
gcctccttaaccacttgctctccacacagaacggccccaactctcctgctcctctgatggaaactaccagcacacctctcctcaaaggtgacatcagctcctagtggcaccttgtcctggatccctcctccttctcgaagaaaaccacctacaccatgtctccaagtcctccagcccgacctctctcttcccacccaccatcaaaacctcaaaatctgcgctggaaaacatccctactgcgtggacagtacacctgaacaataggagtcatctaaacaacaggaggacataagcatttctgcatggacggaagaccaggcttctgtaggcacacaggatgacagcagaagcagcacagtacagggcagagcaaagtcgctaagtgcttatggttcaagaggctggtttcaacatgcaatgcattttgttaatgacgttttagcctaataaatgcccttctaacagttcaaggaaagggtcactatccttcctgaaataactttcttggttttacattttattcagaaatacatatttaaaagatcatttcatcaatcttctaaacttttttggctgattagaataacatataccacaatcaattttttacttacccttttacttttttttatctatgtacactctgcctactcctttttaccaccatctaccacaagaaaaatgagactcatcttttaaacttatggtacaacaaaaagacctgggtcagaatcttggctctgcatttactggtgttataggtacagtcactaattccgttttctcaactataaaatgggaataatatcacctactttgcaagactgtgagaagtagagatactatgtaaagttcctagtatagtaccaagggtataaagtcatcatcaccattatcagcctcatgcaaaaaaatacctaaaatccaaaactgccaaaagaaaatgtatgcaataaatatcacaaattattttttaaaaaagatacacaagtcaatatggtaagattctgaaaaccctgtcacctgctttatttctggagaagggtaaagggagaagggaaaatattcacttgaatttgaggggcagctaaactggaagcaacaatttcaggcctctaaggttcctctgatccataagggaatgctgaaacttccttgtttggagattcaaagagtttaatttttccctacagcaagatcaacaattttcactgggataaaagaataaagaacaaactcaatagcaccaaatggggttttaacacagaaaacagggccactccttttaaatgcaaatttttacattaaaatatgtttataaatcatagtagttgttttccctcttgattcaacatttctccctcccctaacaggagccctagaacctgaagagcatgtacattactaacgagatatacaatccagccaccctgtccaaactggaatctgattactaatggactacactcgaggctgcccccaagggatgggaagcagtaactacgctctcagggagaatgggtactgaggatgccaccagtcaaagagccgaacgctgtgcactgggtccaggatgacttgcacaccctgttcactgcgcagtttccgaccaccatggacaggggaatcttggaacaccagtctcactcgatgatgccgcatgtccgtgctcacattgatagta

SEQ ID NO: 1072 - DNA, 918 bp, Homo sapiens
ggggcagaagggagtgttttggggtgacagaaacattctattgcttttttgggtggttactcagatttctacaactcgttagaaggaaacactttatcatgttaattatacctcaatattgtaaatgtgcatggaagaaatctcttgttttcaagagtttttcttttgggttcacctaactatgtacctgactgctgcataaagtaatccatggcacttaataatttgactaatcagattacttctgttcttcattgttagctccagtatttttcttacagctaccttggattttgatgcctaagaacattctctgacaggttggaaataaaattaaataaaggattgattttcaaataatgtgggcatgaagccccagccttctttagtcttctggcacagtgaaaacaagtgacaagatggcccgtccttccatgaataatgttcccgtctcgtggtcttttctcacataagctacatggcttcaagagattctggcaatcctccatgttttctgtatctgttctctgttcagaaaggttatctaactgttctcccatgcttgagatggtctcttggctttcagaactgtgagccaaatccaagaattccactgagttgcagggatcaaaaagtttggagttttctttctttatatacgcatctttaggtctaacgacaggagccgaaatggttcttcgacaatcagggacatcatttccttcattttccttttcaggtatggcagtgatatcagacgtggagagagaatgggttaactttgaacaatctgaataccaatccttcctcaaggcccaacaacgaaaacagtacctcttgcttggagagttaaatttcttgcattcagtacactgccactcatcctacaaagacaagtgaagccaattaatactcagg

SEQ ID NO: 1073 - DNA, 612 bp, Homo sapiens
ctggctttctagactttaaaatctttcttggtggctccagtttgccatatcttatggtcctgaaatgacccctgtcactgaggcagggagcagaggagactgggaatttgtgctgatggtaaatagatatggtttgaatcctggccactgcccaccagccatgtgaccaagacttaaccatattttttcggggtgttatgcagagataatgagatcaaaattgtaaggcatctagtactgacataataagctctcaacaaatggtagctatttaagtgttaataacaaatccttttcagatggtttctataacagtgaatttgcaaatagttggaacctctgaagtgcttcctctcctggactggaaaccccttgaggatgtgtacggcacccgcatcccctccatctgcacccgcagccacagccacagccacagccagcgctatgtcccgttgccattcacattcatacctgcaacgtacactcatacatgtgtcggatatttgcgaagaagctccctttcccacctaggtaaatgctagcttccagaaatttgaaaaaaaatgagtgtaattcctactgggttggttcccagcaggcctttgtctttcc

SEQ ID NO: 1074 - DNA, 624 bp, Homo sapiens
gcccagcctgtttctttctttctttattttttttattgcctattctgctcgtgtagaaatcccgaggctttggaagcaaggacatactctctttctcaggtgattattctccttttaataagtagtttaggctttttattggccctaataaactgaacccctgaccgttggacaccacatcagcatgcaacccaagctactgctcatcatgaaccatgccatgaattcaggcatgtccggccacactccataatcaagtgcaagtgatatgagtgggactgggccaagcaggtaccaatggctggtgtaaatgggatgagctactcacttaagctccagtgtgcctacttctgctgctctgctgcctctccctcaatctgcatctatggctgcatgcagagttgactgaggaggaaaacacccatgactgctttgcaaaactcttcatgatatgttcgtccccactcaaagtaaactgctctagccttctagctccattcagaagagcctccgaagtagagaccagaaatccttctagtgggctgtgctttgagcagtactgcttgttgactgctttacttggaaggagagatcgactgagaatgtataacatcaagagctgcc

SEQ ID NO: 1075 - DNA, 8122 bp, Homo sapiens
cggggcgccggggaaacgcagtaggaggagtgacgggaaccgggagccggctccatgcgcctggagcgcgcgggtcccagcgcccatcggcccggggtccgaggggcccgctgcccgggctcgctgcgtggtgctaccgcccccgggcccgctgcgccgcgtcggagccccagcagactttgagaggcgtgtgcgacagtgcgcgtcctctcctgcctctggatgtttccttggagcctctggccttcgggaagaccggtgccatccagattccaacagtgacttttagctctgagaagtccaatactacagccctggctgagttcggaaaatacattcataaagcacatggaacattctccaagatagaccatttgatcggccacaaaacaaatctcaataaatttaagaaaatcaaaattatatcaagtactctctcagactacagtggaataaaattggaaattaactctaaaaggaaccctcaagactatacaaatatgtggaaattaaataatctgctcctgaatgatctttggatcaacaatgaaataaaaatggaaattaaaaaattctttgaactgaatgataatagtgacagaacatgttaaaacctctgggatacagcaaaagtggtgctaagacgacatttcatagcattaaatgcctacatcaaaaagtctgaaagaacacaaatagagaacctaagatcacacctcaaggaactagagaaacaagaacaaaccaaacccaaaaccagcagaagaaaataaataacaaaagtcagagcagaactaaatgaaattgaaacaaacaaacaaaaaacaatacaaaagataaatgaagcaaaaagatggttctttgaaaagataaaaaaaattgatagaccattagtgagattaaccaagaacagagagaagatccaaataagctcaattagaaatgaaacagaagatattacaactgataccatagaaatacaaaagatcatttaaggctactatgaacacctttatgcacacaaactagaaaatctagaggagatggataaattcctgggaatatgcaaccctactagattaaatcaggaagaaatagaaactctgaacaaaccaataacaagtagtgagattgaaatggtaattaaaaaattgccaacaaaataaagcccaggatcagatggttacacagctgaattctatcaggcattcaaagaagaattggtaccaatcttactgaaattattccataagatagagaaagagggaatcctccctaagtcattctatgaagccagtatcaccctaatagcaaaacaagaaaaggacataataaaacaagaaaactacagaccaatatccctggtgaacatagatgtgaaaatcctcaacaaaatactagctaactgaacccaacagcatatcaaaaagataatacaccatgatcaagtggatttcatgccaggaatgcatggatggtttaacatacacaagtcaataaatgtaatacatcacataagcagaattaagaacagaaattatatgatcatctcaatggatgcagaaaaagcatttgccaaaatccagcatcactttatgatgaaagccaccagcaaagtcagcatagaagggacataactcaaagtaataaaagccatctatgacaaacacacagctgacattatagtgaatggagaaaagttgaaagcattccctctgagaactggaacaagaaaaggattcttactttcaccactgctactcaatattgtactggaagtcctagccagagaaatcggacaagagaaagaaataaaggacatccaaattgcaaaagagaaagtcaaactgtcactattcactgatataatgacatgatatgatgacataattgtatacctagaagaccctaaagacccatccagaaagctcctagatgtggtaaatgaattcagtaaagtttcaggatacaaaaacaatgtacacaaatcaggagtacggctatacaacaccaacaaccaaactaataatcaaatcaagaactcaaccccttttacaacagctgcaacaaaattaaatacttaggaatatacctaaccaaggaggtggaagatctctacaaggaaaactacaaaaaactgctgaaagaaatcatagatgatacaaacaaatggaaacatatcctatgctcacaaatgggtagaaacaatattgtgaaaatgagcatactaccaaaagcaatctacaaattcaatgcaattcccatcaaaataccatcatcattcttcacagaactaaaacaaatattaaaattcatatggaaccaaaaatgagcctgcatagccaaagcaagactaaacaaaaagaagaaatctggaggcatcacattaccagacttcaaactatacaacaatgctggtagaagagcctgatggcctggtgttgggcctgatcaccccaaaatttcaggcacccaacgtggggctatgaagaccatggtaaagaaatgctagagtatatggaaatgaaggacatatcatcaaaggacacccgaggatggctgaaagaagcttggtgggtaagctgggcactctgaagaaccaaggtaacaatgggacaaaatgaaagtaaacattctgcttgtttaaactttctaaggcatttattatggagagggggagtgaaagttagtactcagaatttattaacactctttagtacagtggagcagttttgcctgtggttcctagaacaagggacaatggagttcgatgaatgggaaagaattggcagagatctaaaaaaggtgcataaagaaggagccaaaattccagtttctttttggtcagtgtgggcattgataaaggcaggtcttgagccatttcaaacaaatgatgaggcagattcagataaggaagaggaaaacgagtgtaaaaaattaacttcagattctgaatgtggggaacagcaaccagaggaaattaaagaaaggaaaactaaaacagatatattttagtagcccgttggttccacctgctgaattaagtgaatggccacttccttcctctccccctaatggtcgagaaaatgaattagctgcaaaacttactgctctggtagctgcaacattaaaacctggaggaattggtgatgctatacaaaattctattcagaaggttagagctgaaggagacctagatgcatggcaatttcccattactataatccagcaaggaggacagaatataactaattggaccacctttccttttaagttgttaaaggaattcaagcaagccattagtcaatatgggccaaattctccttttgtacaaactttactaaaaaatgtggctcttgataatagattaataccatatgactgggatactttaacaaagtctgttctcactccatctcagtacctgcagtttaaaacctggtgggctgatgaagctcaaactcaggcaagagaaaacacacaaacacagccacctgtgcttgtttcctttgaatggttaatggagttgggccctaattggggatgattagacaattaagcagtaatggaggatgttgccatcgggatgttctgtccgacaaggacctaaagaaccatatactgactttattgctcagctccaagaggctgtgcgtaaagctgtaactgataaaacagctcaagacatggtaatacaacttcttgcatatgataatgctaatgcagagtgtcaagctgccattagacctatgcaagggaagcctcatttggctgaatatattaaggcttgtgatggcattgcgggtaatttacataaggctactcttttagctcaagctatggctggattaaaggtgggaaaaaatatgccccatttctcaggctcttgttttaattgtgggcaatttggacacacaaaaaaaggaatgtagaaaaggaaatcaaaaggcaaaaactattaccatcaatcaacagaaaagttccggtgtatgcccctggtgtaagaaaggcaatcactgggcaaatcagtgtcatcctaaatttagcaaagatgggcaacctcttttgggaaacgggaagaggggcccacctcgggcccctcaacaaactgaggcatatctggcacagccagtgcccttacaaaagtacaacaattgtatcccaccacagcaggcagtactgtgtagatctttgtagcacagttcccatttccttacttcctggggagccaccaaagaaggtcctcatgggagttaggggccctttaccctcaggaacagttggtctattgcttggaaggtctagtttaaatttaagaagtgtcactgtacatacaggaataattgattctgattatacctgagagattcagttagttattagttcctcaattccatggtctgcttccccaggggaaagaattgctcagttgttactgttaccttatacaaagctaggaagtactacagtaaaaggaacaggaggctttggtagtactaacccagcaggaaaagctatatattgggttaatcaagtgtctgacaaaagacctatttgtacagtaaccattcaaggaaaagattttgaggggctagtacatactggagctgatgtttctattattggtttaaatcaatggccccaacattgaccaaaacaaaaggcatccattggtattgttggagtaggggctgcctcagaaatttttcaaagttctttaattttgccatgccaggggccagatggccaagaagggacaattcaacctattattacacctattcctgtaaatctatggggtagaaacttattacaacaatggggtgctgaaatatctattcctatggatcagtatagtgataacagtaatcaaatgatgagaaaaatgggatatctcccagggaagggactgggaaaaaatgaaaatggccaaacagaacctttagaactaaaagggcaaacagatacaactggattagggtatcatttttaggggtggccattgctgagcctccgggtcccattcctcttgtttggttaactgccaaactggtttgggtggagcaatggccgctgaaacaggaaaaactggaggctttaaaagaattgatacaagaacaattgcaaaagggacacatagagcctgctctctccccttggaattctcctgtgtttgttattaagaaaaaatcaggggaatggagaatgttaatagatttgaggactgtcaatgctgtaattcaacccatgggtgcactgcaaccagggctgccttctccaacaatgatcccaaaatactggcctctcatagtgacagatttaaaagatcacttctttaccattcctttagttgcccaagattatgaaaaatttgcttttactgttcctgctataaataacaaagaaccagtggacagataccattggaaagtactgccacaaggcatgttaaatagcccgactatttgtcaaacttatgttggaaaagctattaagccagttagagaacaattttaaaaatgttatatcatacattacatggataatattttatgtgcagctgaaactagagaggagttaatgctatgttacaaacagttagaaaaggctgtgactgcagcagggttaatcatagcccccgataaaattcaaacttctactccctttcaatatttaggaatgaaagtagaataaagtactattaagcctcaaaaagttcaaattagaagggataatttaaaaactctaaatgattttcaaaaattattagaagacattaattggattcatcctactttaggcattcctacttatgctatgtctcacctcttttctaccttacgaggtgattctgatcttaactgcaaatggtccctgtccaaagaggcattagaagaacttcaattaattgaagaaaaaattcaataggcacaagtgactctaattaaccctatgcagccattacagtttttagtttttcctactaaacattcaccaacaggtgttattgttcaacaggatgctttggttgagtggctttttctacctcacaatacaactaaaatgctcactctgtacttaaattgctgtactagtaggacaagcaaggctgcgcacaacaaagttaatgggatataatccaaataaaattatagttccattagacaaacaacaaattcagcaggcttatattaattcccaggaatggcaaattaatatggcaggttttactggtgttcttgataatcattatcctaaatccaaaatattccaatttcttaaattgacatcatggatattgctttccattactcaaaaaacccctattgaaagggccattactgtttttactgatggatctagtaatggaaaggcctcatttgtgggacctcaacaagtttttcaaactgactttgcttctgctcaaagggctgaacttatggctgtgataacagtgttaaaaacttttaaatagccagtaaacattgtttctggttcagcctatgtagtgcaagccacacaaaatattgaacatgccttaattcaaaatgtgactaaagaccaacttaatgttttatttcattctctacagcaagcagtacaacaaaggcattcccctttctatgcactcatatgagagcacatactaacttccctggccctttaactaaatttaatcaaagggcggataattatatggggaagaggattttcttgtgtctctccaggtaacaatcaggcacctgtgtgggtgcccaccaaacatctggagatctatcatgagccacaccaggaagagagggctctgggaagagccagagctcctgatatgagtgatggtacaaatgaacatctcagagacaaaggagaagaccaatggagtctgtagatgcggaagccacctctggagagaaagccaccactgagagcaagcaatgatagctgtggcggttttgcaaaaaagaaaagggagacaagcgcccagctatagttaccaataaagcatggtactggtattaaaataggcatgtgttctgttccaatggaacagaatagagaacccagaaacaaagccaaatatttacagccaactgatctctgacaaagcaaacaaaaacataaagtggggaaaggacaccctattccacaaatagtgcagggataattggcaagccacatgtagaaaaatgaagctggatcctcgtctctcactttatacaaaaatcaactcaaaatgggtcaaagtcttaactctaagacctgaaaccataacaattctagaaaataacattggaaaaactcttctagacattggtttaggcaaaaagttcatgaccaagaacccaaaagcaaatgcaataaaaaggaagataaatagatgggacctaattaagctgaaaagcttctgcatagcaaaagaaataatcagcagagcaaacagacaacccacagggtgggagaaaatatttgcaagctatgtatctgacaatggactaatatccagaatctacaaggaattcaaacaattagcaagaaaaaacacttgtattgtgtttgttctgtaaatcagcaagaaaaaaatcacataatttcattaaaaagtgggtaaaggacatgaacagacaattcataagaagatatacaagtggccaacaaacatatgagaaaatgctcaacatcactaattattagggaaatgcaaatctaaaccacaaggagatactattttacttttgcaagaatggccataatttaaaaacacagatgttggcatggatgtggtgaaaagggatcacttttatatggctggtaggaatgtaaactagttcaaccactatggaaatcagtatggagattacttaaagaatgaaaagtagatctaccattctatccagcaatcccactcctgggtatctacccagaggaaaataagtcattatatgaaaaaggcatttgcacacgcatgtttatagtggcacaattcgcaattgcaaaaatatggaaccagtctaaatgcccatcaagcaatgagtggataaagaaaatgtaatatatatatattatacccacacacacacaccatggaatactacttaggcataaaaaggaacagaataatggc

SEQ ID NO: 1076 - DNA, 8077 bp, Homo sapiens
ggaggagtgacgggaaccgggagccggctccatgcgcctggagcgcgcgggtcccagcgcccatcggcccggggtccgaggggcccgctgcccgggctcgctgcgtggtgctaccgcccccgggcccgctgcgccgcgtcggagccccagcagactttgagaggcgtgtgcgacagtgcgcgtcctctcctgcctctggatgtttccttggagcctctggccttcgggaagaccgagatattttcctctaagtgaacggtacagctgttgaaggcaaggacaatggatacttaaaaacagcacatggaacattctccaagatagaccatttgatcggccacaaaacaaatctcaataaatttaagaaaatcaaaattatatcaagtactctctcagactacagtggaataaaattggaaattaactctaaaaggaaccctcaagactatacaaatatgtggaaattaaataatctgctcctgaatgatctttggatcaacaatgaaataaaaatggaaattaaaaaattctttgaactgaatgataatagtgacagaacatgttaaaacctctgggatacagcaaaagtggtgctaagacgacatttcatagcattaaatgcctacatcaaaaagtctgaaagaacacaaatagagaacctaagatcacacctcaaggaactagagaaacaagaacaaaccaaacccaaaaccagcagaagaaaataaataacaaaagtcagagcagaactaaatgaaattgaaacaaacaaacaaaaaacaatacaaaagataaatgaagcaaaaagatggttctttgaaaagataaaaaaaattgatagaccattagtgagattaaccaagaacagagagaagatccaaataagctcaattagaaatgaaacagaagatattacaactgataccatagaaatacaaaagatcatttaaggctactatgaacacctttatgcacacaaactagaaaatctagaggagatggataaattcctgggaatatgcaaccctactagattaaatcaggaagaaatagaaactctgaacaaaccaataacaagtagtgagattgaaatggtaattaaaaaattgccaacaaaataaagcccaggatcagatggttacacagctgaattctatcaggcattcaaagaagaattggtaccaatcttactgaaattattccataagatagagaaagagggaatcctccctaagtcattctatgaagccagtatcaccctaatagcaaaacaagaaaaggacataataaaacaagaaaactacagaccaatatccctggtgaacatagatgtgaaaatcctcaacaaaatactagctaactgaacccaacagcatatcaaaaagataatacaccatgatcaagtggatttcatgccaggaatgcatggatggtttaacatacacaagtcaataaatgtaatacatcacataagcagaattaagaacagaaattatatgatcatctcaatggatgcagaaaaagcatttgccaaaatccagcatcactttatgatgaaagccaccagcaaagtcagcatagaagggacataactcaaagtaataaaagccatctatgacaaacacacagctgacattatagtgaatggagaaaagttgaaagcattccctctgagaactggaacaagaaaaggattcttactttcaccactgctactcaatattgtactggaagtcctagccagagaaatcggacaagagaaagaaataaaggacatccaaattgcaaaagagaaagtcaaactgtcactattcactgatataatgacatgatatgatgacataattgtatacctagaagaccctaaagacccatccagaaagctcctagatgtggtaaatgaattcagtaaagtttcaggatacaaaaacaatgtacacaaatcaggagtacggctatacaacaccaacaaccaaactaataatcaaatcaagaactcaaccccttttacaacagctgcaacaaaattaaatacttaggaatatacctaaccaaggaggtggaagatctctacaaggaaaactacaaaaaactgctgaaagaaatcatagatgatacaaacaaatggaaacatatcctatgctcacaaatgggtagaaacaatattgtgaaaatgagcatactaccaaaagcaatctacaaattcaatgcaattcccatcaaaataccatcatcattcttcacagaactaaaacaaatattaaaattcatatggaaccaaaaatgagcctgcatagccaaagcaagactaaacaaaaagaagaaatctggaggcatcacattaccagacttcaaactatacaacaatgctggtagaagagcctgatggcctggtgttgggcctgatcaccccaaaatttcaggcacccaacgtggggctatgaagaccatggtaaagaaatgctagagtatatggaaatgaaggacatatcatcaaaggacacccgaggatggctgaaagaagcttggtgggtaagctgggcactctgaagaaccaaggtaacaatgggacaaaatgaaagtaaacattctgcttgtttaaactttctaaggcatttattatggagagggggagtgaaagttagtactcagaatttattaacactctttagtacagtggagcagttttgcctgtggttcctagaacaagggacaatggagttcgatgaatgggaaagaattggcagagatctaaaaaaggtgcataaagaaggagccaaaattccagtttctttttggtcagtgtgggcattgataaaggcaggtcttgagccatttcaaacaaatgatgaggcagattcagataaggaagaggaaaacgagtgtaaaaaattaacttcagattctgaatgtggggaacagcaaccagaggaaattaaagaaaggaaaactaaaacagatatattttagtagcccgttggttccacctgctgaattaagtgaatggccacttccttcctctccccctaatggtcgagaaaatgaattagctgcaaaacttactgctctggtagctgcaacattaaaacctggaggaattggtgatgctatacaaaattctattcagaaggttagagctgaaggagacctagatgcatggcaatttcccattactataatccagcaaggaggacagaatataactaattggaccacctttccttttaagttgttaaaggaattcaagcaagccattagtcaatatgggccaaattctccttttgtacaaactttactaaaaaatgtggctcttgataatagattaataccatatgactgggatactttaacaaagtctgttctcactccatctcagtacctgcagtttaaaacctggtgggctgatgaagctcaaactcaggcaagagaaaacacacaaacacagccacctgtgcttgtttcctttgaatggttaatggagttgggccctaattggggatgattagacaattaagcagtaatggaggatgttgccatcgggatgttctgtccgacaaggacctaaagaaccatatactgactttattgctcagctccaagaggctgtgcgtaaagctgtaactgataaaacagctcaagacatggtaatacaacttcttgcatatgataatgctaatgcagagtgtcaagctgccattagacctatgcaagggaagcctcatttggctgaatatattaaggcttgtgatggcattgcgggtaatttacataaggctactcttttagctcaagctatggctggattaaaggtgggaaaaaatatgccccatttctcaggctcttgttttaattgtgggcaatttggacacacaaaaaaaggaatgtagaaaaggaaatcaaaaggcaaaaactattaccatcaatcaacagaaaagttccggtgtatgcccctggtgtaagaaaggcaatcactgggcaaatcagtgtcatcctaaatttagcaaagatgggcaacctcttttgggaaacgggaagaggggcccacctcgggcccctcaacaaactgaggcatatctggcacagccagtgcccttacaaaagtacaacaattgtatcccaccacagcaggcagtactgtgtagatctttgtagcacagttcccatttccttacttcctggggagccaccaaagaaggtcctcatgggagttaggggccctttaccctcaggaacagttggtctattgcttggaaggtctagtttaaatttaagaagtgtcactgtacatacaggaataattgattctgattatacctgagagattcagttagttattagttcctcaattccatggtctgcttccccaggggaaagaattgctcagttgttactgttaccttatacaaagctaggaagtactacagtaaaaggaacaggaggctttggtagtactaacccagcaggaaaagctatatattgggttaatcaagtgtctgacaaaagacctatttgtacagtaaccattcaaggaaaagattttgaggggctagtacatactggagctgatgtttctattattggtttaaatcaatggccccaacattgaccaaaacaaaaggcatccattggtattgttggagtaggggctgcctcagaaatttttcaaagttctttaattttgccatgccaggggccagatggccaagaagggacaattcaacctattattacacctattcctgtaaatctatggggtagaaacttattacaacaatggggtgctgaaatatctattcctatggatcagtatagtgataacagtaatcaaatgatgagaaaaatgggatatctcccagggaagggactgggaaaaaatgaaaatggccaaacagaacctttagaactaaaagggcaaacagatacaactggattagggtatcatttttaggggtggccattgctgagcctccgggtcccattcctcttgtttggttaactgccaaactggtttgggtggagcaatggccgctgaaacaggaaaaactggaggctttaaaagaattgatacaagaacaattgcaaaagggacacatagagcctgctctctccccttggaattctcctgtgtttgttattaagaaaaaatcaggggaatggagaatgttaatagatttgaggactgtcaatgctgtaattcaacccatgggtgcactgcaaccagggctgccttctccaacaatgatcccaaaatactggcctctcatagtgacagatttaaaagatcacttctttaccattcctttagttgcccaagattatgaaaaatttgcttttactgttcctgctataaataacaaagaaccagtggacagataccattggaaagtactgccacaaggcatgttaaatagcccgactatttgtcaaacttatgttggaaaagctattaagccagttagagaacaattttaaaaatgttatatcatacattacatggataatattttatgtgcagctgaaactagagaggagttaatgctatgttacaaacagttagaaaaggctgtgactgcagcagggttaatcatagcccccgataaaattcaaacttctactccctttcaatatttaggaatgaaagtagaataaagtactattaagcctcaaaaagttcaaattagaagggataatttaaaaactctaaatgattttcaaaaattattagaagacattaattggattcatcctactttaggcattcctacttatgctatgtctcacctcttttctaccttacgaggtgattctgatcttaactgcaaatggtccctgtccaaagaggcattagaagaacttcaattaattgaagaaaaaattcaataggcacaagtgactctaattaaccctatgcagccattacagtttttagtttttcctactaaacattcaccaacaggtgttattgttcaacaggatgctttggttgagtggctttttctacctcacaatacaactaaaatgctcactctgtacttaaattgctgtactagtaggacaagcaaggctgcgcacaacaaagttaatgggatataatccaaataaaattatagttccattagacaaacaacaaattcagcaggcttatattaattcccaggaatggcaaattaatatggcaggttttactggtgttcttgataatcattatcctaaatccaaaatattccaatttcttaaattgacatcatggatattgctttccattactcaaaaaacccctattgaaagggccattactgtttttactgatggatctagtaatggaaaggcctcatttgtgggacctcaacaagtttttcaaactgactttgcttctgctcaaagggctgaacttatggctgtgataacagtgttaaaaacttttaaatagccagtaaacattgtttctggttcagcctatgtagtgcaagccacacaaaatattgaacatgccttaattcaaaatgtgactaaagaccaacttaatgttttatttcattctctacagcaagcagtacaacaaaggcattcccctttctatgcactcatatgagagcacatactaacttccctggccctttaactaaatttaatcaaagggcggataattatatggggaagaggattttcttgtgtctctccaggtaacaatcaggcacctgtgtgggtgcccaccaaacatctggagatctatcatgagccacaccaggaagagagggctctgggaagagccagagctcctgatatgagtgatggtacaaatgaacatctcagagacaaaggagaagaccaatggagtctgtagatgcggaagccacctctggagagaaagccaccactgagagcaagcaatgatagctgtggcggttttgcaaaaaagaaaagggagacaagcgcccagctatagttaccaataaagcatggtactggtattaaaataggcatgtgttctgttccaatggaacagaatagagaacccagaaacaaagccaaatatttacagccaactgatctctgacaaagcaaacaaaaacataaagtggggaaaggacaccctattccacaaatagtgcagggataattggcaagccacatgtagaaaaatgaagctggatcctcgtctctcactttatacaaaaatcaactcaaaatgggtcaaagtcttaactctaagacctgaaaccataacaattctagaaaataacattggaaaaactcttctagacattggtttaggcaaaaagttcatgaccaagaacccaaaagcaaatgcaataaaaaggaagataaatagatgggacctaattaagctgaaaagcttctgcatagcaaaagaaataatcagcagagcaaacagacaacccacagggtgggagaaaatatttgcaagctatgtatctgacaatggactaatatccagaatctacaaggaattcaaacaattagcaagaaaaaacacttgtattgtgtttgttctgtaaatcagcaagaaaaaaatcacataatttcattaaaaagtgggtaaaggacatgaacagacaattcataagaagatatacaagtggccaacaaacatatgagaaaatgctcaacatcactaattattagggaaatgcaaatctaaaccacaaggagatactattttacttttgcaagaatggccataatttaaaaacacagatgttggcatggatgtggtgaaaagggatcacttttatatggctggtaggaatgtaaactagttcaaccactatggaaatcagtatggagattacttaaagaatgaaaagtagatctaccattctatccagcaatcccactcctgggtatctacccagaggaaaataagtcattatatgaaaaaggcatttgcacacgcatgtttatagtggcacaattcgcaattgcaaaaatatggaaccagtctaaatgcccatcaagcaatgagtggataaagaaaatgtaatatatatatattatacccacacacacacaccatggaatactacttaggcataaaaaggaacagaataatggc

SEQ ID NO: 1077 - DNA, 1841 bp, Homo sapiens
ggaggagtgacgggaaccgggagccggctccatgcgcctggagcgcgcgggtcccagcgcccatcggcccggggtccgaggggcccgctgcccgggctcgctgcgtggtgctaccgcccccgggcccgctgcgccgcgtcggagccccagcagactttgagaggcgtgtgcgacagtgcgcgtcctctcctgcctctggatgtttccttggagcctctggccttcgggaagaccgagatattttcctctaagtgaacggtacagctgttgaaggcaaggacaatggatacttaaaaacagcctgatggcctggtgttgggcctgatcaccccaaaatttcaggcacccaacgtggggctatgaagaccatggtaaagaaatgctagagtatatggaaatgaaggacatatcatcaaaggacacccgaggatggctgaaagaagcttggtaacaatcaggcacctgtgtgggtgcccaccaaacatctggagatctatcatgagccacaccaggaagagagggctctgggaagagccagagctcctgatatgagtgatggtacaaatgaacatctcagagacaaaggagaagaccaatggagtctgtagatgcggaagccacctctggagagaaagccaccactgagagcaagcaatgatagctgtggcggttttgcaaaaaagaaaagggagacaagcgcccagctatagttaccaataaagcatggtactggtattaaaataggcatgtgttctgttccaatggaacagaatagagaacccagaaacaaagccaaatatttacagccaactgatctctgacaaagcaaacaaaaacataaagtggggaaaggacaccctattccacaaatagtgcagggataattggcaagccacatgtagaaaaatgaagctggatcctcgtctctcactttatacaaaaatcaactcaaaatgggtcaaagtcttaactctaagacctgaaaccataacaattctagaaaataacattggaaaaactcttctagacattggtttaggcaaaaagttcatgaccaagaacccaaaagcaaatgcaataaaaaggaagataaatagatgggacctaattaagctgaaaagcttctgcatagcaaaagaaataatcagcagagcaaacagacaacccacagggtgggagaaaatatttgcaagctatgtatctgacaatggactaatatccagaatctacaaggaattcaaacaattagcaagaaaaaacacttgtattgtgtttgttctgtaaatcagcaagaaaaaaatcacataatttcattaaaaagtgggtaaaggacatgaacagacaattcataagaagatatacaagtggccaacaaacatatgagaaaatgctcaacatcactaattattagggaaatgcaaatctaaaccacaaggagatactattttacttttgcaagaatggccataatttaaaaacacagatgttggcatggatgtggtgaaaagggatcacttttatatggctggtaggaatgtaaactagttcaaccactatggaaatcagtatggagattacttaaagaatgaaaagtagatctaccattctatccagcaatcccactcctgggtatctacccagaggaaaataagtcattatatgaaaaaggcatttgcacacgcatgtttatagtggcacaattcgcaattgcaaaaatatggaaccagtctaaatgcccatcaagcaatgagtggataaagaaaatgtaatatatatatattatacccacacacacacaccatggaatactacttaggcataaaaaggaacagaataatggc

SEQ ID NO: 1078 - DNA, 2146 bp, Homo sapiens
ggaggagtgacgggaaccgggagccggctccatgcgcctggagcgcgcgggtcccagcgcccatcggcccggggtccgaggggcccgctgcccgggctcgctgcgtggtgctaccgcccccgggcccgctgcgccgcgtcggagccccagcagactttgagaggcgtgtgcgacagtgcgcgtcctctcctgcctctggatgtttccttggagcctctggccttcgggaagaccgtgccactgggttagagtctccccgaccaagctggtctcagcaagtggtctccatcatgggggctcgaatccaggttgaagggtcaccagagtgatggttggagaacatggaactagctggaggacacctgagtactcttaaagcaaaccccgtgttaattgaaaatgctcagttacgatttcatacagatgaacaactgaagacaaaaacaacaaagggggagaaagagggattatgggacagcccatatacaattgaatctagcattattaactttaaattttttgagtctgcctaaaggccagatgttatcagcagctgaacagcatttacagaaaccggctgcaaagacagaagcagaacaactggtttggtggagagatccgataacaaaaagttgggaaataggtaaaataataacttggggtagaggttatgtttgtgtttctccaggccaaaatcaataaccaatttggataccatcaagacacctgaaaccttatcatgagccagatgctgaggaagagattccaggaggatcctgaggaccccctggttgcagccacgtcgaggctgacactgaggaggaccccaactgtcatgagcaacacccgtcgaacacagccatccacctggggacaaatcaagaagctgtcacagatgatggaagaaaacctgaggaaagcgggacaaccaatcacaatgagtaatttggtgatctatcacagtgatgatcaccattgccatgagtattccttcaacaagggctgacacagagaacaattatacttattgggcatatttatcaatcttgtctggcaataatgcctagatgatttcactctatggcacagttacacatgctttctgatctcagtatttaccataataaatctgctcctataattgaggcataccaccctcaaaaacctatttgtaaacaaaatagaacctggccagaaataatgaacaacttgtttagtaagattgcattgcagaacaggcagagatgctacgcaatgattcctatgggatcattgattggtcccctaaggggatgtttagcttaaattgcacctctcagtctgcatgccatggccacactagttcagatggtctgaacaaagtggtcagatggcagaaatgataagaagtatggcaaaagttcctattgtctggaaccatggcagtatagtgtcacctcaacctcaaatgatatggctcattgtaggagctaaacataaggatttgtggaaactattaatagctcttaataagatcaaaatttgggaaagaataaaaaaagcatctagaaagacactctacaaacttgtctttggatattacaaaattaaaagaacaaatatttaaagcatcccaggtacacctgaccttaatgacagaaactggagtgcttgaaggagctgcagacagattagcagctagtaacccattaaaatggataaaaacacttggaagctctgtgatttcaatgatgattgtgcttttaatcggtattgtttgtctttgtatagtgtgcagatgtggatcctgactcctgtgagaagtagctcacagtgtcaaagctgcctttgcttttatcgatttgcaaatcaaataagggggacatattgggaacagcacccccccccccaaaatctggccataaactggtcccaaaactggccataaacaaaatctctgcagcactgacatgttcatgatggtcttaatgcccacgctggaaggttgtgggtttaccagaatgagagcaaggaacacctggcccacccagggtggaaaaccacttaaaggcattcttaaaccacaaacaatagcatgagtgatctgtgccttaaggctgtgctactgctgcagataactagcccaacccatccctttatttcagcc

SEQ ID NO: 1079 - DNA, 8019 bp, Homo sapiens
gtgacgggaaccgggagccggctccatgcgcctggagcgcgcgggtcccagcgcccatcggcccggggtccgaggggcccgctgcccgggctcgctgcgtggtgctaccgcccccgggcccgctgcgccgcgtcggagccccagcagactttgagaggcgtgtgcgacagtgcgcgtcctctcctgcctctggatgtttccttggagcctctggccttcgggaagaccgcacatggaacattctccaagatagaccatttgatcggccacaaaacaaatctcaataaatttaagaaaatcaaaattatatcaagtactctctcagactacagtggaataaaattggaaattaactctaaaaggaaccctcaagactatacaaatatgtggaaattaaataatctgctcctgaatgatctttggatcaacaatgaaataaaaatggaaattaaaaaattctttgaactgaatgataatagtgacagaacatgttaaaacctctgggatacagcaaaagtggtgctaagacgacatttcatagcattaaatgcctacatcaaaaagtctgaaagaacacaaatagagaacctaagatcacacctcaaggaactagagaaacaagaacaaaccaaacccaaaaccagcagaagaaaataaataacaaaagtcagagcagaactaaatgaaattgaaacaaacaaacaaaaaacaatacaaaagataaatgaagcaaaaagatggttctttgaaaagataaaaaaaattgatagaccattagtgagattaaccaagaacagagagaagatccaaataagctcaattagaaatgaaacagaagatattacaactgataccatagaaatacaaaagatcatttaaggctactatgaacacctttatgcacacaaactagaaaatctagaggagatggataaattcctgggaatatgcaaccctactagattaaatcaggaagaaatagaaactctgaacaaaccaataacaagtagtgagattgaaatggtaattaaaaaattgccaacaaaataaagcccaggatcagatggttacacagctgaattctatcaggcattcaaagaagaattggtaccaatcttactgaaattattccataagatagagaaagagggaatcctccctaagtcattctatgaagccagtatcaccctaatagcaaaacaagaaaaggacataataaaacaagaaaactacagaccaatatccctggtgaacatagatgtgaaaatcctcaacaaaatactagctaactgaacccaacagcatatcaaaaagataatacaccatgatcaagtggatttcatgccaggaatgcatggatggtttaacatacacaagtcaataaatgtaatacatcacataagcagaattaagaacagaaattatatgatcatctcaatggatgcagaaaaagcatttgccaaaatccagcatcactttatgatgaaagccaccagcaaagtcagcatagaagggacataactcaaagtaataaaagccatctatgacaaacacacagctgacattatagtgaatggagaaaagttgaaagcattccctctgagaactggaacaagaaaaggattcttactttcaccactgctactcaatattgtactggaagtcctagccagagaaatcggacaagagaaagaaataaaggacatccaaattgcaaaagagaaagtcaaactgtcactattcactgatataatgacatgatatgatgacataattgtatacctagaagaccctaaagacccatccagaaagctcctagatgtggtaaatgaattcagtaaagtttcaggatacaaaaacaatgtacacaaatcaggagtacggctatacaacaccaacaaccaaactaataatcaaatcaagaactcaaccccttttacaacagctgcaacaaaattaaatacttaggaatatacctaaccaaggaggtggaagatctctacaaggaaaactacaaaaaactgctgaaagaaatcatagatgatacaaacaaatggaaacatatcctatgctcacaaatgggtagaaacaatattgtgaaaatgagcatactaccaaaagcaatctacaaattcaatgcaattcccatcaaaataccatcatcattcttcacagaactaaaacaaatattaaaattcatatggaaccaaaaatgagcctgcatagccaaagcaagactaaacaaaaagaagaaatctggaggcatcacattaccagacttcaaactatacaacaatgctggtagaagaggtgaggcaggactagcttgtctgtcataatgtaaaagagtcttggaagatgtctggggtccagggtctaaaacccttcgtggcctttggaacaccaagctctatgccaaagggtggaaggctgccctgacatgccaaaatctaagcccagggcataaaaccccttgtggcttgtatggaatccggggctcagggcataaacccccttgtagcctctggaatgtgcacagacttgttggttccttgcttcttacttgtaaacatgtcctccattatctcaagcagcagagcatattctatatgcatcaaagaaaatgctaaaccatcacagctacgcttaatgcaccactacctttctacccccacgtcctcatgccctcacctctttacccccacatctgcacgtcctcaccatctgcttctttgtttggtctccaataaatagtgtgggctcccagagctcagggccttcgcagcctccaatctagtgttggccccctggacccaatttatgcacttttaacttgtcttttctcatttctttcaccccaccggactttgtagcctgatggcctggtgttgggcctgatcaccccaaaatttcaggcacccaacgtggggctatgaagaccatggtaaagaaatgctagagtatatggaaatgaaggacatatcatcaaaggacacccgaggatggctgaaagaagcttggtgggtaagctgggcactctgaagaaccaaggtaacaatgggacaaaatgaaagtaaacattctgcttgtttaaactttctaaggcatttattatggagagggggagtgaaagttagtactcagaatttattaacactctttagtacagtggagcagttttgcctgtggttcctagaacaagggacaatggagttcgatgaatgggaaagaattggcagagatctaaaaaaggtgcataaagaaggagccaaaattccagtttctttttggtcagtgtgggcattgataaaggcaggtcttgagccatttcaaacaaatgatgaggcagattcagataaggaagaggaaaacgagtgtaaaaaattaacttcagattctgaatgtggggaacagcaaccagaggaaattaaagaaaggaaaactaaaacagatatattttagtagcccgttggttccacctgctgaattaagtgaatggccacttccttcctctccccctaatggtcgagaaaatgaattagctgcaaaacttactgctctggtagctgcaacattaaaacctggaggaattggtgatgctatacaaaattctattcagaaggttagagctgaaggagacctagatgcatggcaatttcccattactataatccagcaaggaggacagaatataactaattggaccacctttccttttaagttgttaaaggaattcaagcaagccattagtcaatatgggccaaattctccttttgtacaaactttactaaaaaatgtggctcttgataatagattaataccatatgactgggatactttaacaaagtctgttctcactccatctcagtacctgcagtttaaaacctggtgggctgatgaagctcaaactcaggcaagagaaaacacacaaacacagccacctgtgcttgtttcctttgaatggttaatggagttgggccctaattggggatgattagacaattaagcagtaatggaggatgttgccatcgggatgttctgtccgacaaggacctaaagaaccatatactgactttattgctcagctccaagaggctgtgcgtaaagctgtaactgataaaacagctcaagacatggtaatacaacttcttgcatatgataatgctaatgcagagtgtcaagctgccattagacctatgcaagggaagcctcatttggctgaatatattaaggcttgtgatggcattgcgggtaatttacataaggctactcttttagctcaagctatggctggattaaaggtgggaaaaaatatgccccatttctcaggctcttgttttaattgtgggcaatttggacacacaaaaaaaggaatgtagaaaaggaaatcaaaaggcaaaaactattaccatcaatcaacagaaaagttccggtgtatgcccctggtgtaagaaaggcaatcactgggcaaatcagtgtcatcctaaatttagcaaagatgggcaacctcttttgggaaacgggaagaggggcccacctcgggcccctcaacaaactgaggcatatctggcacagccagtgcccttacaaaagtacaacaattgtatcccaccacagcaggcagtactgtgtagatctttgtagcacagttcccatttccttacttcctggggagccaccaaagaaggtcctcatgggagttaggggccctttaccctcaggaacagttggtctattgcttggaaggtctagtttaaatttaagaagtgtcactgtacatacaggaataattgattctgattatacctgagagattcagttagttattagttcctcaattccatggtctgcttccccaggggaaagaattgctcagttgttactgttaccttatacaaagctaggaagtactacagtaaaaggaacaggaggctttggtagtactaacccagcaggaaaagctatatattgggttaatcaagtgtctgacaaaagacctatttgtacagtaaccattcaaggaaaagattttgaggggctagtacatactggagctgatgtttctattattggtttaaatcaatggccccaacattgaccaaaacaaaaggcatccattggtattgttggagtaggggctgcctcagaaatttttcaaagttctttaattttgccatgccaggggccagatggccaagaagggacaattcaacctattattacacctattcctgtaaatctatggggtagaaacttattacaacaatggggtgctgaaatatctattcctatggatcagtatagtgataacagtaatcaaatgatgagaaaaatgggatatctcccagggaagggactgggaaaaaatgaaaatggccaaacagaacctttagaactaaaagggcaaacagatacaactggattagggtatcatttttaggggtggccattgctgagcctccgggtcccattcctcttgtttggttaactgccaaactggtttgggtggagcaatggccgctgaaacaggaaaaactggaggctttaaaagaattgatacaagaacaattgcaaaagggacacatagagcctgctctctccccttggaattctcctgtgtttgttattaagaaaaaatcaggggaatggagaatgttaatagatttgaggactgtcaatgctgtaattcaacccatgggtgcactgcaaccagggctgccttctccaacaatgatcccaaaatactggcctctcatagtgacagatttaaaagatcacttctttaccattcctttagttgcccaagattatgaaaaatttgcttttactgttcctgctataaataacaaagaaccagtggacagataccattggaaagtactgccacaaggcatgttaaatagcccgactatttgtcaaacttatgttggaaaagctattaagccagttagagaacaattttaaaaatgttatatcatacattacatggataatattttatgtgcagctgaaactagagaggagttaatgctatgttacaaacagttagaaaaggctgtgactgcagcagggttaatcatagcccccgataaaattcaaacttctactccctttcaatatttaggaatgaaagtagaataaagtactattaagcctcaaaaagttcaaattagaagggataatttaaaaactctaaatgattttcaaaaattattagaagacattaattggattcatcctactttaggcattcctacttatgctatgtctcacctcttttctaccttacgaggtgattctgatcttaactgcaaatggtccctgtccaaagaggcattagaagaacttcaattaattgaagaaaaaattcaataggcacaagtgactctaattaaccctatgcagccattacagtttttagtttttcctactaaacattcaccaacaggtgttattgttcaacaggatgctttggttgagtggctttttctacctcacaatacaactaaaatgctcactctgtacttaaattgctgtactagtaggacaagcaaggctgcgcacaacaaagttaatgggatataatccaaataaaattatagttccattagacaaacaacaaattcagcaggcttatattaattcccaggaatggcaaattaatatggcaggttttactggtgttcttgataatcattatcctaaatccaaaatattccaatttcttaaattgacatcatggatattgctttccattactcaaaaaacccctattgaaagggccattactgtttttactgatggatctagtaatggaaaggcctcatttgtgggacctcaacaagtttttcaaactgactttgcttctgctcaaagggctgaacttatggctgtgataacagtgttaaaaacttttaaatagccagtaaacattgtttctggttcagcctatgtagtgcaagccacacaaaatattgaacatgccttaattcaaaatgtgactaaagaccaacttaatgttttatttcattctctacagcaagcagtacaacaaaggcattcccctttctatgcactcatatgagagcacatactaacttccctggccctttaactaaatttaatcaaagggcggataattatatggggaagaggattttcttgtgtctctccaggtaacaatcaggcacctgtgtgggtgcccaccaaacatctggagatctatcatgagccacaccaggaagagagggctctgggaagagccagagctcctgatatgagtgatggtacaaatgaacatctcagagacaaaggagaagaccaatggaggtatacactaatgatagtttttggatgcctggttctactgatgatagaggcccatctcacccccaagaggaaggaacaattatgaacgtctcattgggatttaagcatttacctatttggttaggaaaagctaatgggtgttcacctcccagtcatcaatcttggctggcaatagtgcctgaacgtaacatctccatagcacaattacatatgctttctggtcttagtatttatcaccatgattatgcttctgtaactgaagtttaccaccctcagaaacctatctgtaaagtggactagacatggtcagaaaaaatgaaggcatttgcttgggaagattgtgtcacatggaaagcagaggtgttgcataatgattcatatggagtcattattgattggtcccctaaaggggcatttatgaggctcacctctcaatctgtaagtaatggtcaccctgcatctaaacaaaataatcagatggtggacactataagaagtacagcaagagatcctattatttgggcatgtggtggtatagtggtacctcagccccaaacgatatggcctgctgtaggggcaaaacataaggaattatggaaaatattaacagcactaaaaaatgataaagatttggaaagggaaatatactaagccaacccaatataatcctaattacatgttaaaattggc

SEQ ID NO: 1080 - DNA, 8406 bp, Homo sapiens
gagatattttcctctaagtgaacggtacagctgttgaaggcaaggacaatggatacttaaaaacagcacatggaacattctccaagatagaccatttgatcggccacaaaacaaatctcaataaatttaagaaaatcaaaattatatcaagtactctctcagactacagtggaataaaattggaaattaactctaaaaggaaccctcaagactatacaaatatgtggaaattaaataatctgctcctgaatgatctttggatcaacaatgaaataaaaatggaaattaaaaaattctttgaactgaatgataatagtgacagaacatgttaaaacctctgggatacagcaaaagtggtgctaagacgacatttcatagcattaaatgcctacatcaaaaagtctgaaagaacacaaatagagaacctaagatcacacctcaaggaactagagaaacaagaacaaaccaaacccaaaaccagcagaagaaaataaataacaaaagtcagagcagaactaaatgaaattgaaacaaacaaacaaaaaacaatacaaaagataaatgaagcaaaaagatggttctttgaaaagataaaaaaaattgatagaccattagtgagattaaccaagaacagagagaagatccaaataagctcaattagaaatgaaacagaagatattacaactgataccatagaaatacaaaagatcatttaaggctactatgaacacctttatgcacacaaactagaaaatctagaggagatggataaattcctgggaatatgcaaccctactagattaaatcaggaagaaatagaaactctgaacaaaccaataacaagtagtgagattgaaatggtaattaaaaaattgccaacaaaataaagcccaggatcagatggttacacagctgaattctatcaggcattcaaagaagaattggtaccaatcttactgaaattattccataagatagagaaagagggaatcctccctaagtcattctatgaagccagtatcaccctaatagcaaaacaagaaaaggacataataaaacaagaaaactacagaccaatatccctggtgaacatagatgtgaaaatcctcaacaaaatactagctaactgaacccaacagcatatcaaaaagataatacaccatgatcaagtggatttcatgccaggaatgcatggatggtttaacatacacaagtcaataaatgtaatacatcacataagcagaattaagaacagaaattatatgatcatctcaatggatgcagaaaaagcatttgccaaaatccagcatcactttatgatgaaagccaccagcaaagtcagcatagaagggacataactcaaagtaataaaagccatctatgacaaacacacagctgacattatagtgaatggagaaaagttgaaagcattccctctgagaactggaacaagaaaaggattcttactttcaccactgctactcaatattgtactggaagtcctagccagagaaatcggacaagagaaagaaataaaggacatccaaattgcaaaagagaaagtcaaactgtcactattcactgatataatgacatgatatgatgacataattgtatacctagaagaccctaaagacccatccagaaagctcctagatgtggtaaatgaattcagtaaagtttcaggatacaaaaacaatgtacacaaatcaggagtacggctatacaacaccaacaaccaaactaataatcaaatcaagaactcaaccccttttacaacagctgcaacaaaattaaatacttaggaatatacctaaccaaggaggtggaagatctctacaaggaaaactacaaaaaactgctgaaagaaatcatagatgatacaaacaaatggaaacatatcctatgctcacaaatgggtagaaacaatattgtgaaaatgagcatactaccaaaagcaatctacaaattcaatgcaattcccatcaaaataccatcatcattcttcacagaactaaaacaaatattaaaattcatatggaaccaaaaatgagcctgcatagccaaagcaagactaaacaaaaagaagaaatctggaggcatcacattaccagacttcaaactatacaacaatgctggtagaagaggtgaggcaggactagcttgtctgtcataatgtaaaagagtcttggaagatgtctggggtccagggtctaaaacccttcgtggcctttggaacaccaagctctatgccaaagggtggaaggctgccctgacatgccaaaatctaagcccagggcataaaaccccttgtggcttgtatggaatccggggctcagggcataaacccccttgtagcctctggaatgtgcacagacttgttggttccttgcttcttacttgtaaacatgtcctccattatctcaagcagcagagcatattctatatgcatcaaagaaaatgctaaaccatcacagctacgcttaatgcaccactacctttctacccccacgtcctcatgccctcacctctttacccccacatctgcacgtcctcaccatctgcttctttgtttggtctccaataaatagtgtgggctcccagagctcagggccttcgcagcctccaatctagtgttggccccctggacccaatttatgcacttttaacttgtcttttctcatttctttcaccccaccggactttgtagcctgatggcctggtgttgggcctgatcaccccaaaatttcaggcacccaacgtggggctatgaagaccatggtaaagaaatgctagagtatatggaaatgaaggacatatcatcaaaggacacccgaggatggctgaaagaagcttggtgggtaagctgggcactctgaagaaccaaggtaacaatgggacaaaatgaaagtaaacattctgcttgtttaaactttctaaggcatttattatggagagggggagtgaaagttagtactcagaatttattaacactctttagtacagtggagcagttttgcctgtggttcctagaacaagggacaatggagttcgatgaatgggaaagaattggcagagatctaaaaaaggtgcataaagaaggagccaaaattccagtttctttttggtcagtgtgggcattgataaaggcaggtcttgagccatttcaaacaaatgatgaggcagattcagataaggaagaggaaaacgagtgtaaaaaattaacttcagattctgaatgtggggaacagcaaccagaggaaattaaagaaaggaaaactaaaacagatatattttagtagcccgttggttccacctgctgaattaagtgaatggccacttccttcctctccccctaatggtcgagaaaatgaattagctgcaaaacttactgctctggtagctgcaacattaaaacctggaggaattggtgatgctatacaaaattctattcagaaggttagagctgaaggagacctagatgcatggcaatttcccattactataatccagcaaggaggacagaatataactaattggaccacctttccttttaagttgttaaaggaattcaagcaagccattagtcaatatgggccaaattctccttttgtacaaactttactaaaaaatgtggctcttgataatagattaataccatatgactgggatactttaacaaagtctgttctcactccatctcagtacctgcagtttaaaacctggtgggctgatgaagctcaaactcaggcaagagaaaacacacaaacacagccacctgtgcttgtttcctttgaatggttaatggagttgggccctaattggggatgattagacaattaagcagtaatggaggatgttgccatcgggatgttctgtccgacaaggacctaaagaaccatatactgactttattgctcagctccaagaggctgtgcgtaaagctgtaactgataaaacagctcaagacatggtaatacaacttcttgcatatgataatgctaatgcagagtgtcaagctgccattagacctatgcaagggaagcctcatttggctgaatatattaaggcttgtgatggcattgcgggtaatttacataaggctactcttttagctcaagctatggctggattaaaggtgggaaaaaatatgccccatttctcaggctcttgttttaattgtgggcaatttggacacacaaaaaaaggaatgtagaaaaggaaatcaaaaggcaaaaactattaccatcaatcaacagaaaagttccggtgtatgcccctggtgtaagaaaggcaatcactgggcaaatcagtgtcatcctaaatttagcaaagatgggcaacctcttttgggaaacgggaagaggggcccacctcgggcccctcaacaaactgaggcatatctggcacagccagtgcccttacaaaagtacaacaattgtatcccaccacagcaggcagtactgtgtagatctttgtagcacagttcccatttccttacttcctggggagccaccaaagaaggtcctcatgggagttaggggccctttaccctcaggaacagttggtctattgcttggaaggtctagtttaaatttaagaagtgtcactgtacatacaggaataattgattctgattatacctgagagattcagttagttattagttcctcaattccatggtctgcttccccaggggaaagaattgctcagttgttactgttaccttatacaaagctaggaagtactacagtaaaaggaacaggaggctttggtagtactaacccagcaggaaaagctatatattgggttaatcaagtgtctgacaaaagacctatttgtacagtaaccattcaaggaaaagattttgaggggctagtacatactggagctgatgtttctattattggtttaaatcaatggccccaacattgaccaaaacaaaaggcatccattggtattgttggagtaggggctgcctcagaaatttttcaaagttctttaattttgccatgccaggggccagatggccaagaagggacaattcaacctattattacacctattcctgtaaatctatggggtagaaacttattacaacaatggggtgctgaaatatctattcctatggatcagtatagtgataacagtaatcaaatgatgagaaaaatgggatatctcccagggaagggactgggaaaaaatgaaaatggccaaacagaacctttagaactaaaagggcaaacagatacaactggattagggtatcatttttaggggtggccattgctgagcctccgggtcccattcctcttgtttggttaactgccaaactggtttgggtggagcaatggccgctgaaacaggaaaaactggaggctttaaaagaattgatacaagaacaattgcaaaagggacacatagagcctgctctctccccttggaattctcctgtgtttgttattaagaaaaaatcaggggaatggagaatgttaatagatttgaggactgtcaatgctgtaattcaacccatgggtgcactgcaaccagggctgccttctccaacaatgatcccaaaatactggcctctcatagtgacagatttaaaagatcacttctttaccattcctttagttgcccaagattatgaaaaatttgcttttactgttcctgctataaataacaaagaaccagtggacagataccattggaaagtactgccacaaggcatgttaaatagcccgactatttgtcaaacttatgttggaaaagctattaagccagttagagaacaattttaaaaatgttatatcatacattacatggataatattttatgtgcagctgaaactagagaggagttaatgctatgttacaaacagttagaaaaggctgtgactgcagcagggttaatcatagcccccgataaaattcaaacttctactccctttcaatatttaggaatgaaagtagaataaagtactattaagcctcaaaaagttcaaattagaagggataatttaaaaactctaaatgattttcaaaaattattagaagacattaattggattcatcctactttaggcattcctacttatgctatgtctcacctcttttctaccttacgaggtgattctgatcttaactgcaaatggtccctgtccaaagaggcattagaagaacttcaattaattgaagaaaaaattcaataggcacaagtgactctaattaaccctatgcagccattacagtttttagtttttcctactaaacattcaccaacaggtgttattgttcaacaggatgctttggttgagtggctttttctacctcacaatacaactaaaatgctcactctgtacttaaattgctgtactagtaggacaagcaaggctgcgcacaacaaagttaatgggatataatccaaataaaattatagttccattagacaaacaacaaattcagcaggcttatattaattcccaggaatggcaaattaatatggcaggttttactggtgttcttgataatcattatcctaaatccaaaatattccaatttcttaaattgacatcatggatattgctttccattactcaaaaaacccctattgaaagggccattactgtttttactgatggatctagtaatggaaaggcctcatttgtgggacctcaacaagtttttcaaactgactttgcttctgctcaaagggctgaacttatggctgtgataacagtgttaaaaacttttaaatagccagtaaacattgtttctggttcagcctatgtagtgcaagccacacaaaatattgaacatgccttaattcaaaatgtgactaaagaccaacttaatgttttatttcattctctacagcaagcagtacaacaaaggcattcccctttctatgcactcatatgagagcacatactaacttccctggccctttaactaaatttaatcaaagggcggataattatatggggaagaggattttcttgtgtctctccaggtaacaatcaggcacctgtgtgggtgcccaccaaacatctggagatctatcatgagccacaccaggaagagagggctctgggaagagccagagctcctgatatgagtgatggtacaaatgaacatctcagagacaaaggagaagaccaatggagtctgtagatgcggaagccacctctggagagaaagccaccactgagagcaagcaatgatagctgtggcggttttgcaaaaaagaaaagggagacaagcgcccagctatagttaccaataaagcatggtactggtattaaaataggcatgtgttctgttccaatggaacagaatagagaacccagaaacaaagccaaatatttacagccaactgatctctgacaaagcaaacaaaaacataaagtggggaaaggacaccctattccacaaatagtgcagggataattggcaagccacatgtagaaaaatgaagctggatcctcgtctctcactttatacaaaaatcaactcaaaatgggtcaaagtcttaactctaagacctgaaaccataacaattctagaaaataacattggaaaaactcttctagacattggtttaggcaaaaagttcatgaccaagaacccaaaagcaaatgcaataaaaaggaagataaatagatgggacctaattaagctgaaaagcttctgcatagcaaaagaaataatcagcagagcaaacagacaacccacagggtgggagaaaatatttgcaagctatgtatctgacaatggactaatatccagaatctacaaggaattcaaacaattagcaagaaaaaacacttgtattgtgtttgttctgtaaatcagcaagaaaaaaatcacataatttcattaaaaagtgggtaaaggacatgaacagacaattcataagaagatatacaagtggccaacaaacatatgagaaaatgctcaacatcactaattattagggaaatgcaaatctaaaccacaaggagatactattttacttttgcaagaatggccataatttaaaaacacagatgttggcatggatgtggtgaaaagggatcacttttatatggctggtaggaatgtaaactagttcaaccactatggaaatcagtatggagattacttaaagaatgaaaagtagatctaccattctatccagcaatcccactcctgggtatctacccagaggaaaataagtcattatatgaaaaaggcatttgcacacgcatgtttatagtggcacaattcgcaattgcaaaaatatggaaccagtctaaatgcccatcaagcaatgagtggataaagaaaatgtaatatatatatattatacccacacacacacaccatggaatactacttaggcataaaaaggaacagaataatggc

SEQ ID NO: 1081 - DNA, 2254 bp, Homo sapiens
ctttgttccttcctctcttactgtttacttttgtggttgggcagttttctgtagggataagatttgagtcttatctctttctccctatgtgttagctttaccagtgagtttttatagtttcacatatttttatgatgctggttatcatcttctctgtggggaacaggccccccaaaacctggccataaactggccccaaaactggccataaacaaaatctctgcagcactgtgacatgtacatgatggtcttaacgcccacgctggaaggttgtgggtttaccagaatgagggcaaggaacacctggcccacccagggtggaaaaccgcttaaaggcattcttaaaccacaaacaatagcatgagtgatctgtgccttaaggccatgctcctgctgcagatagctagtccaacccatccctttatttcagcccatctcttcatttcccataaggaataattttagttaatctaatatctatagaaagaatgctaatgactagcttgctgttaataaatacatgggtaaacctctgttggaggctctcagctctgaaggctgtgagacccttgatttcctacttcactcctctatatttctgtgtctttaattcctctagtgccactgggttagagtctccccgaccaagctggtctcagcaagtggtctccatcatgggggctcgaatccaggttgaagggtcaccagagtgatggttggagaacatggaactagctggaggacacctgagtactcttaaagcaaaccccgtgaggttatgtttgtgtttctccaggccaaaatcaataaccaatttggataccatcaagacacctgaaaccttatcatgagccagatgctgaggaagagattccaggaggatcctgaggaccccctggttgcagccacgtcgaggctgacactgaggaggaccccaactgtcatgagcaacacccgtcgaacacagccatccacctggggacaaatcaagaagctgtcacagatgatggaagaaaacctgaggaaagcgggacaaccaatcacaatgagtaatttggtgatctatcacagtgatgatcaccattgccatgagtattccttcaacaagggctgacacagagaacaattatacttattgggcatatttatcaatcttgtctggcaataatgcctagatgatttcactctatggcacagttacacatgctttctgatctcagtatttaccataataaatctgctcctataattgaggcataccaccctcaaaaacctatttgtaaacaaaatagaacctggccagaaataatgaacaacttgtttagtaagattgcattgcagaacaggcagagatgctacgcaatgattcctatgggatcattgattggtcccctaaggggatgtttagcttaaattgcacctctcagtctgcatgccatggccacactagttcagatggtctgaacaaagtggtcagatggcagaaatgataagaagtatggcaaaagttcctattgtctggaaccatggcagtatagtgtcacctcaacctcaaatgatatggctcattgtaggagctaaacataaggatttgtggaaactattaatagctcttaataagatcaaaatttgggaaagaataaaaaaagcatctagaaagacactctacaaacttgtctttggatattacaaaattaaaagaacaaatatttaaagcatcccaggtacacctgaccttaatgacagaaactggagtgcttgaaggagctgcagacagattagcagctagtaacccattaaaatggataaaaacacttggaagctctgtgatttcaatgatgattgtgcttttaatcggtattgtttgtctttgtatagtgtgcagatgtggatcctgactcctgtgagaagtagctcacagtgtcaaagctgcctttgcttttatcgatttgcaaatcaaataagggggacatattgggaacagcacccccccccccaaaatctggccataaactggtcccaaaactggccataaacaaaatctctgcagcactgacatgttcatgatggtcttaatgcccacgctggaaggttgtgggtttaccagaatgagagcaaggaacacctggcccacccagggtggaaaaccacttaaaggcattcttaaaccacaaacaatagcatgagtgatctgtgccttaaggctgtgctactgctgcagataactagcccaacccatccctttatttcagcc

SEQ ID NO: 1082 - DNA, 2209 bp, Homo sapiens
gtttacttttgtggttgggcagttttctgtagggataagatttgagtcttatctctttctccctatgtgttagctttaccagtgagtttttatagtttcacatatttttatgatgctggttatcatcttctctgtggggaacaggccccccaaaacctggccataaactggccccaaaactggccataaacaaaatctctgcagcactgtgacatgtacatgatggtcttaacgcccacgctggaaggttgtgggtttaccagaatgagggcaaggaacacctggcccacccagggtggaaaaccgcttaaaggcattcttaaaccacaaacaatagcatgagtgatctgtgccttaaggccatgctcctgctgcagatagctagtccaacccatccctttatttcagcccatctcttcatttcccataaggaataattttagttaatctaatatctatagaaagaatgctaatgactagcttgctgttaataaatacatgggtaaacctctgttggaggctctcagctctgaaggctgtgagacccttgatttcctacttcactcctctatatttctgtgtctttaattcctctagtgccactgggttagagtctccccgaccaagctggtctcagcaagtggtctccatcatgggggctcgaatccaggttgaagggtcaccagagtgatggttggagaacatggaactagctggaggacacctgagtactcttaaagcaaaccccgtggccaaaatcaataaccaatttggataccatcaagacacctgaaaccttatcatgagccagatgctgaggaagagattccaggaggatcctgaggaccccctggttgcagccacgtcgaggctgacactgaggaggaccccaactgtcatgagcaacacccgtcgaacacagccatccacctggggacaaatcaagaagctgtcacagatgatggaagaaaacctgaggaaagcgggacaaccaatcacaatgagtaatttggtgatctatcacagtgatgatcaccattgccatgagtattccttcaacaagggctgacacagagaacaattatacttattgggcatatttatcaatcttgtctggcaataatgcctagatgatttcactctatggcacagttacacatgctttctgatctcagtatttaccataataaatctgctcctataattgaggcataccaccctcaaaaacctatttgtaaacaaaatagaacctggccagaaataatgaacaacttgtttagtaagattgcattgcagaacaggcagagatgctacgcaatgattcctatgggatcattgattggtcccctaaggggatgtttagcttaaattgcacctctcagtctgcatgccatggccacactagttcagatggtctgaacaaagtggtcagatggcagaaatgataagaagtatggcaaaagttcctattgtctggaaccatggcagtatagtgtcacctcaacctcaaatgatatggctcattgtaggagctaaacataaggatttgtggaaactattaatagctcttaataagatcaaaatttgggaaagaataaaaaaagcatctagaaagacactctacaaacttgtctttggatattacaaaattaaaagaacaaatatttaaagcatcccaggtacacctgaccttaatgacagaaactggagtgcttgaaggagctgcagacagattagcagctagtaacccattaaaatggataaaaacacttggaagctctgtgatttcaatgatgattgtgcttttaatcggtattgtttgtctttgtatagtgtgcagatgtggatcctgactcctgtgagaagtagctcacagtgtcaaagctgcctttgcttttatcgatttgcaaatcaaataagggggacatattgggaacagcacccccccccccaaaatctggccataaactggtcccaaaactggccataaacaaaatctctgcagcactgacatgttcatgatggtcttaatgcccacgctggaaggttgtgggtttaccagaatgagagcaaggaacacctggcccacccagggtggaaaaccacttaaaggcattcttaaaccacaaacaatagcatgagtgatctgtgccttaaggctgtgctactgctgcagataactagcccaacccatccctttatttcagcc

SEQ ID NO: 1083 - DNA, 433 bp, Homo sapiens
ccggatgcctcactgagtataaatttcacatgcaatcttgttttgctcatgtatcagtccactaaaaaactcatctcttcctgcccctcaaaccctacagcactcaactcaggaggctaccagttaccaagctcttacaggaattataagaaggtttttgttttgagacagagtctcactctgtcacccaggctggagtgcagtggcatgatcttggctcactgcaacctctgcccactgggttcaagcgattctcctgcctcggcctcccgagcagctgggattacaagtgcctgccaccgcaccccgctaatttttgtatttttagtagagatggggtttcaccaacttagccaggctggtcttgaacttctgacctcgtgatccacccacctcggcctcccaaagttctggtattacaggcgtgagccac

SEQ ID NO: 1084 - DNA, 345 bp, Homo sapiens
gctggcgggggctctgtttctttctggggcactggctgagctggctttgcaaagtcaaaacaagattcattaccctggggccgggagcagggagatacaccgcctgaccctgcagacctgccccatatgtcatgggcctgtcagaaatctcccagaattccctttattatctaaaggtcgccacccgggttcaagcgattctcctgcctcagcctcccaagcagctgggaccacaggtgcccaccaccacgcctggctaatttttgtaattttagtagagatgggttttcaccatattggccaggctggtcttgaactcctgaccttatgatctgcccacctcag

SEQ ID NO: 1085 - DNA, 697 bp, Homo sapiens
caacagaataatctgtgattatgaaataaattctctttggaaagtaagaaagtctttcctaaattcaaatgatcattcttattttagctccttcttttaaaagtctgagacaactgaacgaaactcagctttcaaaaagccaaggacgtctttgaaatttcattctacattcctggattactgatgctgcctctctatcagagctctttatccttccttccctttttgcagacttcaaatcagcctcagttttcttcaattatccttttgcctctccttgcctagaagaaactccgaaaattttttgcatatttgatggataagatggaaaggacggtaggtgaggaaatacagcagctaagatgacaagccagctctccactgaccacacaggcacatctctagcaagggacaggaagacagaagaatgaatgcaacaggaccgctaagaagtaaagacagtcttcagctatgcaagaatagcagctagaaatagacaaactgaagaagagtttatggaaggaggagctgttttgtccagagagcagcctggtagttttccgttttcaaatgcttggctttcagggctctgatgtttccctgcacagttgtgtccaatcatgacagagacaagggaaacagccaaggctacaatatcagaccacacacacacacacacacacacacacacacacac

SEQ ID NO: 1086 - DNA, 544 bp, Homo sapiens
tgagtatattgcatgatgctgaagtttgggtttctagcccaggtagtgaacacagtacctaataggtagcttttccatcctttcccccttcctccatcccatccctttttggagtcctcagtgtctaccattcccatctttgtgtctgtgcatatccaatgtttaggtcccacttataagtgagaacatgcggtatttgattttctgtttctgtgttaatttgcttagcgtaatggcttccagctgtatccatgttgctgcagaggacatgatttcattctttttttttttattgctgtggaaggttttcttctttagacagttaatgtggtgaattatattgattgattttctttttttttttttttgagacagaccctcgccctgtttcccaggctaggttgcagtgagccaagatcgcaccactacactccagcctgggtgacagagctagactctgtctcaaatataaataaataaataaataaataaataaataaataaataaataatgataattttatattttaatgtatatttgggg

SEQ ID NO: 1087 - DNA, 489 bp, Homo sapiens
cttttgtgtttatttttagttggccaaaacactctctccatttctccccagcaacctcattctggtttcttgctttgtgaagtctatctgtgaacttctgtggtgacagagtaaatgaaggaggagtagagattctgtaaagggggtgaacgcaaccgcgacggctgatcgtctgtggctgggttggcgtttggagcaagagaaggaggagcaggagaaggagggagctggaggctggaagcgtttgcaagcggcggcggcagcaacgtggagtaaccaagcgggtcagcgcgcgcccgccagggtgtaggccacggagcgcagctcccagagcaggatccgcgccgcctcagcagcctctgcggcccctgcggcacccgaccgagtaccgagcgccctgcgaagcgcaccctcctccccgcggtgcgctgggctcgcccccagcgcgcgcacacgcacacacacacacacacacacacacgcacgcac

SEQ ID NO: 1088 - DNA, 1344 bp, Homo sapiens
gtttctcactagactaaaaactaaaggcagggtcagggatgtatcttctgtatccctcagcagagaagtggtgtgaagtcaatatcacctaaatgctggttttaaaaaagtttatatttagaatgatagaactcccagaaggtgccaagaccatagagtcccagcccctggttcttcaaaaagaccaggaacatcgagaggacaaaaaatgtcctatgtatttgggtcttcaggacccagtacattgcctggcagtagttggcattcaataaatatttagcagaagaaacaaaagaaggagaaaaggaaggaaggaggggagaagaagctgggaactgaagcttagagtcataaaatgatttccccaaaacttacatcagaacccagacctcttctttcctagtccagctctgcttctgctggattgtttgaatttttaacattactaatgtcaaaaatggcatctcttttccttctactgatggcaatttaatcatgaaagcagttgctttgcttcattgcagctgttgcctccacgtacctgaaatgccagtgctccagctgtcttgattgagaggcctagtttgcaagaaaacaagacaaaatactttgctgccttaattccagtgggaatttaatttaattagcatctgatttacacaatgcacttctgacagctgtgtttgtggagtctctgtggaagcaagaaattaccatccattgaaatcatcatcaaagcttatttatcatcctgccatgtctttccagccttcagccttgggaacttctgtgtgtttattgcacattcatgaaggttacagtaaataatactcaacaaccccgagagcacatcacagtatggagaaaacataagatcaaagaagcatgcaacactgagctatcacacggagaacacctgtctgggaagccacctaaactgacagtggacttctcaagagaaagaaataaactttcttgttttaggacactgagattttggaggtgtctgtgcagcataatctatcctatcctactatattcaactcacaactccttatgctccaggcctacttctgtctttgatttcatattaaattaattccaacttcctcttctcttagagctataatttcagttatatatggctgcataacaaaccactccaaagcttaaaacaacaataaattattatttctcataattctgtataacaataacaagcaaagtcaagtcacccatattttacaaagtagactggagctcagaaatctagacatctcaaatcacacaactagtaaatgggagaagtgaaactggaactcatgtcttactactgcaggccct

SEQ ID NO: 1089 - DNA, 3222 bp, Homo sapiens
gtggtgtttggttttctgtccttgcaatagttcgctcagaatgatggtttcgagcttcatccatgtccctacaaaggacatgaattcatccttttttatggctgcatagtattccatggtgtgtatgtgccacaatttcttaatccagtctgagatagaatactttcagtagtgctttgagtttgtttttcaagtaaacctcttcccatgccatgcgtcctattgtaatgattgctaatgattctaacattgctgtaaccatattttaccataattaacattgtagatatttgcctgcccaattagctggaggctccttgatggcagagactgcctccttggtatccccagcacacagcacagaacctggcacatactgtgtttgtggagtctctgtggaagcaagaaattaccatccattgaaatcatcatcaaagcttatttatcatcctgccatgtctttccagccttcagccttgggaacttctgtgtgtttattgcacattcatgaaggttacagtaaataatactcaagtaagtgcatcagggtttgtggagggtttggtgcaggcttgttccagagccttaataggatgaatctgaaaatgaggctttggagatttgatcaaaggacaggtgtcttttaatgttgagtttttaagaaacattaaggatctcaaatgagagaacacttaccacctggacaaaaaggacattcaacagtggcatttggggcttgtgccgttactgtttgaacagagtaactgtgaactgtgaactggctcaagaagatgtgagtgatttgggatggacctgcaatggggcctctcctgaaggagaggactaggaaccggactagggcaaccaagggattgatggtaaggtcttaaccatgtttatgttccccagtacctagcacataataaatagttgttgaatgactgaatgaatgagatcagagatgattgaactggctgcagtttttgtgcctagtccagtcattccctatacccctgtgttcaataaatttattatctgaagaatgattagcatgactttatagatcatcataataccaggagggggcacattagatgagataggtactagccaagtacagagaggggagagctcacatctaaataagggtgcaagggaaggtttcaaagaagaggtcgcattagagctgggtcttgagtgatacaaatgttttattggagacaagtgttttaataaaagataagggggaggaatctcaaggacagaaaattatgtgaaaagagatgaaaaagcatgaaataagatatctttaaggagcagggagcttggcttatagagataagaaaggaaagttaggcctggacattgactgactttgaagaatttaaaattttattctgtgacactgtaggacgtttgaaaatatttgagaagaggagtaatctgattagattcatggtttgcaagaaaaacctctggtgtgaaggtaaagaatagaccggcagagagaaggagacttttcctgtctttgctagagaaattttcagtgtttccaccagcaaaacaacaatcaaaacacaggtccatcagtaaagcccggaaacaggattagtgacatagaaatgagtttcagagacaccataaaggatgaattgtcaggatttagcaatggacagattgatggccaagagtcaaagtggcccctaaagtactgaagtttccagcttggctgacagcaagaatagtgacgccattaaaagaggagaaagtttaaaggagatgctggtaaaataaaaactattttctactctagcacgtcattcatacaactggcaaatgtccactttcttggcaccatcccagctttatagaataagaacattagaattaaaaggcactttatagattttctaggttaatgtttctcaaagtaagttcctcagactgctacttctggaaatcctccttgcacaagtgattttatgaccacatacattgggaaatattgtatactgtgtatttttgttttgttttgttttttgagacagggcttccctttgccacccaggctggagtgcagtggcaggaacatggctcacggaagcctggaactccagggctcaagtgattttcccacctcggcctcccaagtggctgcgactatctgtcttttggagcttaatgaggcacattagtttattaataccctgaaaaactctgtggcaatgatacttttttgttttgttttgtttaaccaaattcctccaaaaaattaagtttctcagatcctcctttttaatataaaacttatttggctgctgcagtggctcatgcctgtaatcccagcactttgggaggccaagtcaggtggatcacttgagcccaggagttcaagaccagcctgggcaacatggcaaaatcttgtctcaaaaaaaaaattagaggggcatggtggcatgcacctgtagtcccaactacttgggaagctgaggtgggaggatggcttaagcctaggagcttgaggctgcagtgagccatttttgtgccactgccctccagcctgggcaacaaagcgaggccctgtctcaaaaaaacaaaacaaaacaaaacaaaaaaattattaatattcagaggaacatactttaggtaaagctaatttagtccaaactgcctcatttcataaattagaaaaccagacccatggatagtaaatttttctaacgtcgtgtaactttttagtagcagagtcaggactagaatctaattttcatgacttattatccagagttcttcccacctctctaggtttctaattgctatgaagatgatgatcggtgtctctttcctaaactactatcagctgaagggtttaagactccatttgccccatcctgccctcttccctcacttccaccccagacaagaagctctctcaaaccccgaaagttggtgaagagcttattatatggtgaagagtatattattatatatgtttcccacacaatgacatgtttctccatagatagggactaaattgaaccattataactgtataaacatggggtggagggagtgaatataacatattttgttttccataaaatcacacctcctatgggaattaatgcagagaagggcatagaaatagtctttagcacatgttctcattgtccagttttctatttctggatattattgataggggttgaagagaccaaagga

SEQ ID NO: 1090 - DNA, 1246 bp, Homo sapiens
cccctgctggcacttctccttcctgccgctttgtgaagagggtatcttgcttccccttcaccttccgccatgattatatgtttcctgaggcctccccagccatactgaactatcaagatgaagggagaaggccggacgatgagaggggagtgaaccctgggcgtaatggttccacaccaagagaagttctgaaggtcaaggtccagaagccaagattcagctgggcaggctgcatctctacaaggcagcctcagatgttcattgtcaaatggatgaactgggaagagagagagagagatgaggggtcgttgtccttccatgtcccttccagcctcagcctcaggagtggccccagtttgctgatatcacaggagatctgctatttgatcattttgcctgccaacttggatgtctgtctcagcaggaaaccatttaaagaaaataaatgaattctcagcacttgacattttctggaggacctgagtcctttccaagtgagctcatatcaagcacagttggtaagacagagacgggaaaatgtgctttctccctgttaagaggacagcctcgctgaagcatcttgggcagggcagtattaagtgacttttccttgttgatgaggggtcctctcacctttgggagagaggtggccctccaccctggaggggctgcaggaagtggaagcaggttccatagctggggggtgttacaagtgagctgaaggagaagtagcatggaattcctcctcattttctctcccgagtccaccctgcctcctccttcccaacagcttgtttattacagcatggtgacttggggcaacgtgattatatgagatggtttttttctcccttctctgtcctccttcctgggcacagtgtatatagtatgagagctactgtaatgaaaggtgcacaggcctttttaggaaagtgattgcaggtgaggccaactcagccaggaaaatctcctgttgcttcctaggatgggtcaggggaaaaggagagggactttaaaacatggatacttcagacctggctgcacactggactcaccaaggggattaaagaaaaacaatgcttgggcctcacctccagagattcagatttaattgatctagggagtggctggggtatcaggatttttaaatctccccaggtgatgctaacatgcagccagatgtaaagatggtaggtttagagggagagaatgcaatggttttcactgttgtactgcagggtgatga

SEQ ID NO: 1091 - DNA, 2384 bp, Homo sapiens
gtccctgtgcccataacctagatctgtgtcagagtccctgtacctgttgcccggttcctatgggccagggcactgatactacatgccttccgtgtggagttctgagattggctgcccaggtcattaattatgggttcagggttgtaagatctaaatccagtgactcagcaactcctaatgacatctacctggttcctccaagtctggattctctacctctagtccttgagctatggctggaccctgtcttctgttttctcaaactgattaacatcttgctaatactaattctctagctccaaacctggtctgcccttttggaccttggatgtcctaccactcaaaatattagactatgtccagaacagattttctgcccctgaacttaagtggagatcagatgcctataagattcccaaaattgccccctttttctattgattcctgttactatgaccttttccccatgaatcgcgctaacctacaacagtccctccagtctcttggcaggcccaagttacagtgctccttgaacggattaactgcattaatggattagcatgcatttatcctaaacaaatagtgctttaccagggccattaaatatgtgtaacttagtatcctttgagtgctatctccttggtgaattcactagccaagagtctgggctccaggtttgcaggtttaagctcattaaagggaacagaacacacacccatttggaggtatattctatgaaggaaagccatagcagaagttaaatgataccagaatgttgcttggaatgttaactccgctctgaccagtgttaggggaatgactttaattgattaatagcatcaatctatgacaatctgatggcattgtcaagacaacactaagattcattcatgttgaggacaccttctgcactagatgggtgtctagttggccatttccctttggttgatgtattttttcttttggtgcattctcactacaatctaggtaggttataatgtcttaagttatatgatggcaggaatgtttgtctgttttgttcactgctatagtcccagctcctataacagtgaatgaatagtcaaatcctgttttttggtagatgtctgcttttttttttttttccaaagtaacttcttgtacttgcacttttatccacatattgattttacaagtttagtacttatttaagggtctctccctcttgtcttatgaatctttgacagatatccaacttttgggcaaataattcgtaatggaataaaaaaagaaatagggattttacatgagaacagtccttaaatcattcctagagactatcttaaaatagaagcactgagatgacattctttccacacaggcattgcatcctgcctctatctgccatcacctgtttgggcactgccaaatagaacactgtaataatttaaaagtagtaaaaagtgtatctttatcaggttacaatcaaattctcatgccataaaaagaaacacttaaaatagcggggaaaaacaagacagaaaagattgcagaaacatgtactttaattcacattttctagattctggtgggtacaacagtaaattatttggaattctgttcaaaatcaaagctgcacctgtagatattccttaaaatacagtacacatagatttgtgtgtgtgtttttttaccaaataatttccacgataccatgcacctaatctgtgtattttggtgagtagctatggtttctgcaggtacctcagtttgcaaactactgagaggtttactgtgaactgttcccaaattttcagctgaaggcaatgctgatgaagatcaaaatagctgtcctttcttatatacagtggcacataggcaaagttgaaaaacatggcagagtttcatatacatacagagattacaaatatcgaataattcacaatgttaaaaatgtcaaaataaaacgttttgacttatcaaatttcaaaagtgtggagtcttattctgtctgatcctcctcataatctaagaatcaaaacaggagaaacattcaaagtttaccaattttaatatatagtttgtctaacttacatagatgccacttaagtaaaaaataaacttacgccattgaaggaaggaatattttccttttcttcattttcattacttcatcagtgggtacaatcatttctgtcagttatattatcaagtgctgggtttttaaattaggtgatgagataaagacaaaatgccagagcaccagcaaagcatttttacaatgcaaacagtactctagtataatatcacttcacgacaaaagatgtgaattggaaaaacagtttagatcacaagaaccataaaatgtcaccaggctcacacaatcatttaagaaataaaaacac

SEQ ID NO: 1092 - DNA, 623 bp, Homo sapiens
ggtgaaaccccatttctactaaaaatacaaaattagctggatgtggtggtatgcacctgtaatccctgttactctggaggccgaggcaggagaatcacctgaatccaggagtaggaggttgccatgagctgagactgggccactgcactccagcctggacaacaaggtgagaccccgtctcaaggcaaacaaacaaataaataaataaataaagacaattgaacctgatttttcccttagattctccagagaaagaacttctatatggaaagaggcagattgctggaaggagtaaataattcacagacaactcataagccctgagctctggtctgtctctgccaattaaatgctgtggaacttttggtgaaaatatctttcagaaatgaagatgagataaaggcttttcataccaacaaaagtggaaagaattcatcataagaagacttgagtgagaagaaatgctaagaaagctcttcaagtagaagaaaatgataccagatggaaatctggatctccacaaaggaacaaaaagtattgagaatgggaactatcctatgtggagaaaacatgtaatgctaggatgtctacatcagacagtagaaagctgctgaaggaagact

SEQ ID NO: 1093 - DNA, 843 bp, Homo sapiens
ggccggatgtggtggctcatgcctttaatcccagcactttggtaggtcaaggcgggcagatcacctgaggtcaggagtcagagaccagccaggccaacatggcgaaaccccatctcgactaaaaatacaaaaattagccgggtgtggtggcaggcgcctggaatcccagccactcgggagactgaggcaggagaattgcttgaactgggcagctgaggttgcagtgagccgagatcgcaccactgcactccagcctgggcaacaaagcaaggctccgtctcaaaaaaacaaaacaaacaaaaacaaaaacaaaaaaataattttttagtttgagaaaatttgtgggtcagaaatgttaaaattgagaggttcttatctattactccccttttttcttcttgcaaataagagcaaactgtgttataatcagtcatctttatgcatgtctcactctaggttctatgacatgtagtgctttgagagtatctttgagaatcactggactcaactgatggaaaagagggaaaagggtatctgtacaggaatacacagacttctggcattagcttctagttcatgtgctgtcgggtcaaacacagggcattcaaaactcttaaacaagactaggcctaccaagcaataccattctacttcccttgtgacagatcacagagcaggcctgaggatccggtgacttttggaggtcagtggagtgggtgtacctaagctactctgttgccagaatttattgagtcagtagaggctaatttgctctgcctgagtagcagtcatttttggatctttggccatttggcagccaaatgttaccacatgtaatatatt

SEQ ID NO: 1094 - DNA, 973 bp, Homo sapiens
gcacttactccattaaagtctcttgattggttaaaataacacaacttccttttcagataaaacagatttttaattaagttgtatttgctaaaggttatatgctcctttagctaaatgattaacccttattgaaatatgttttcacttttaaggatttgaacaaaaattttgtacagaagcttacatcaagatacaaagatcatggatgcttatagatacgatgaactgcaaatgaaaattgagctggataatgttagaagatgtgttaaatatttaatccagccggaatgccaagttagattcagcttggatttgaaaaacaaaaccaaaccaaaaagaaaaccactggttttcaaggcctcagagcataagctttgtgtattacaggaaagcttctatgcttggctggaggtaggagaacctttctgtctttttctgaatttgctatgaccttgggtaagtcaactgacctccctgggtgatgttcagagcattattgatgttatataatttattcttatcaatgccacaaggttggctagatatgtttcctctctaatgtatgattaggaaagagtcatttagacttcagttaattttattttcttcaaggtcaaccaataattcagacatcaagttgaatggaaatgagcttctaaatataggtcaaatacttttataaaaatcacataactgcatctcccccccaccacgcctgaatttgatccatctcccaataagctctcccaagctactacttagtttctattgttagtatgttactgaccaagtgcaccagtcctgcattttgtgtcgaactgattaataattttcttctgaacccctaatgcatcccctattttgtccacactctcataaagactctagttgataaaaatgacaggctgaatattgctaatgtaatatttcaattcagatgtaacatctcttaaagattgagctaattaatacc

SEQ ID NO: 1095 - DNA, 479 bp, Homo sapiens
gctatataaatggtgttctcctgtggaattgtctttaaactcatgaatcaggcaatgtttcatagactccaggacctgactatattattttttaaatatatagcacagaatgaaaactgaggcctctgaaaacataattgctaatgcctgaacctggaaagagacacggcagatacaaagcaacataatcaacgtttaatattacatttccaggctagattgattcacacataaattgagtgtgtcttatattgttcaaaataccccccaattcaactttcattaatctcggaccaaagtccgaactcaatactcattcatctagaaatattttgagagatccatgacatttgatgttaatacttctagaatcctagagtgccctgtgcataatattcttaatagattaaaactagggcggcaaagtccctcacttagcaatgccttttattattatacttcatgtcctgggatacatg

SEQ ID NO: 1096 - DNA, 2824 bp, Homo sapiens
ggggagagtaagggagggagggtaaggaggaaggggagaaaaagaaaaagggagcaaacaaaaaaaaagagagaacgacctattgtcaacttgtgcagtagttattctaagaacgctcaactgggtaaatgtgtacacctaaactctgagctggcatgggttttgtgcaattagaagtttgttataaatgcacactgcacatgcaaatctttaagctgtttgtaaacatttatattttccttgttatgtagcgaagttatcaatttgcagcttaagtttttattcagcttaacagtttcaacttaaagacagtgggaaagtcaatttaaattatataaaataaaaataaaaacagtgcatttacgttcttcataacaccagtttttttttccaaatggtgttatttttctaaggaaattaaataattttaaactcactcgttaaagttatacaatgcaaacaaagacaaaaaatatattgaaactcatgcatttctgtagcgttaatatttacttttcaagactcaactaagagcatcaacacaacctgtcaagttctttgacacccccccagcccatgtaatcaattacagtatacaataacagtaattcacatttttaaacacacagttcaacactgctgaagctgcaatatcctttttcatcccaagcaaaccttcataagacagtgtcccagtgatcccagtgtactttcagcatttctctcactgggaactgtcagaaaaccagaagttgccacagaaagttttaagtcaactgcttgtttaaaaatagataatccagcatttcagaaattttccatttgggtctaaaagcattcaggtttccaacagccagaaaaaattcatgcaatttgagacatataaagaggctaataaaactggagggaatttctacttaaaaaaaaaaacaaaaaacaaaaaaactttgttgggggggaaaaaagagctcaaaagacaatgcagtgttgacaaaattaagccatatgaaagcattttgtgacaggacgatttgtttaaaaggttcttattggcttacttcccctatcccctcaaaggaaaaacacctctctattctgacttgctctaaagtttcttttatcagaatgctaaattagtgagattctcatgctattctaaagtgcaaaaacaagttaatatcccaactttttatttccaggaaacaagactgcttttagaccgtaccacaactatatagagatctatttatatatatgtatatatatatatattatttatatatatataaaattatttccaaagttcttgagagctatcttctaaggtccagtctctgacagtaggcaagctcagtgcttcgcttttgaccgacaaggagttcaccaactcacagtggaacttgcgaatgtgtctgtacaggtccccggactgcgtgaacctgcgctcgcaccacttgcaggcgtgcggcttctcgcgggtgtgcaccacggcatggcggctcaggttgtgcgagtactggaagctcttgccgcactgggtgcatgtgtagggcttctcccccgagtgagtcctctcgtggcgcttgagggtgtacatgcaagagaaagtcttcccacacagcgagcacgtgggcacgttgacatcggcggcgggcttgctgcggatgccgtcctgctcgcggaagtgcgtgctcaggtggatctgcaggatgtgggggctggggaagaccttgttgcacagggggcactgctctccatgcctccctccacctggacacgctcgctctctggggtcatcatctcatcatcactggctttgtcctcccggtccagctccctcaagaccgagtcctccctcaggggagccagatgggccggctcatactgtaccctgttattagtgctcacactttctttcacagtgctatgttccatgtcatagtcattagtgccaacatcactctcatcacaggaagcctctttctccaccttcacctgcaccaggttgcttctcagcacgtcctgtgaagagaaataagagctgttcagattttcaactcctgaaaggctggacttgacagacaggtccagcacacagtcaacatctgccgaatccctcacggaggtgacagacctctgggacaaagactctgttgagctgcaggggctggctactgtttttccagctgctgtggcgtgtggctctgcctctccgccagcctgggggatgcctgctgagtctgagggcaatcgcatccacatgttcccaggctcggccgccaagtcccttttgctgggcaggatgttcaatttttcatcttctccttcatcttcatcactgggcaaatcgcctgctatgtggctgctgccatcggagagactctcgactttgtccgaacaacttgaagcatcttcttcctttttggtgctgtctgcctccgtggtggctttctctttcagcttctttttgcagactttgacaatgtcatacatgtggagataactggcagctgctagcacgtcttcaatgggcaagtctttgaactggagtttcccttcatacatgaattcaagcaggagagcgaaagcgggggctgtaacaatgtcgctgttcagatgaacaatgtctcttttgtccagctggtccttgtaaaagaggtggaaatacatgctgcatgaagccagtacagctcggtgcgctcggaactgggcatctcccaccagaacagtgcagtcacaaagaaaaccctggtgtctctgctcgctcagacactgtagcaaatgtctactatggtctggaaactccatactgtcttcataacct

SEQ ID NO: 1097 - DNA, 853 bp, Homo sapiens
ccattcggacccatacctccagtatctgacatgacaccccaggaggcaacattcctctgtcttacgcatcccagagcctggtgccaggcaattagtaaccatccctgtaacccaaagcccacagaaattattcaaactaaccaatcctaaactgttcaccttgccctgctttgactctctcaaaggaaaccccaataaagacggtggcccaaaccttctccttgctcctgtcttctgcttcctgccacctggtgtctttcccatgaggccctgcctggcctgctgtgcctcctgtctctaggacctgtgagtagaataaacttcgtcttttcctgagactctcctctgtcttctcttgtggctatgcctgactgatcatcacgtaaaaaggtagaaaatagcaagtatccaacctcttcgtattttgacaaggtgtagcaagactaatataatggggcaggacagacacaaccatagtatttttttttttaaagcaggtgatggagaaagggtggttctcctgccatttggttgtgtgattagaagacagccctttgtcacacagttgtcggcctgcctgtgatattcccggctatggccaagatgtgtgaggtgctggaaacttgatcccccatgtggcagtattgaaaggtgtggcctttacgaggtgatgaataggttgtcatgggagtggaactggtggctttgtaagcagaggaagagagaccggagcaagcgcgtcaggacactcagcccctcgccatgtgacgccctgcacccacctcgggacaccacagagcccccaccagcacgaacgctctcaccagatggagcccctcaacccgaatcttct

SEQ ID NO: 1098 - DNA, 3243 bp, Homo sapiens
tgggcctggccgccgggccgggggctttgtgggtcagccacgtcgccgcgcccgggcttccccgcgggcccgccggtccggaaggtcggcccggggctcttttctccgctgttctccttctctggcgcccccaggacacgcggccagtggacgcccggaacggccgaccgggagtcgcggctggggatggaagctggaattgggggtgcgggatggagcggagagaggaggccccgcgcgccgtcggccgcctcatttcagactcccctgcgaccccccccccgccgccagccgaagcccgggccgcccagcccctcctgccgctgcgggacgccgaagacatgcctttcgccctccgccatgattctgaggcctccccaaccatgcggaactgttgggtttcagccgagcaagtctgaggcccctttcccgcgccctctggtggaaagtgttcgcttttctgtccacccatgtgaaggattcaccccgaccctcctcaggtggcctttactttgcaggagcaaagcaagttggatgaggagatacatgtatgtggcacacagctttcttcacttagcaacacgtcagatgcagcgtagatgtgcggatgaaaccaccattgcaaaattatcactgagacagtcagagaaacctgacatggctgactccatgttgcttttagcctcacaggctggctctcttagctcattcctaagcatgggcctgaaactgccattgcaaaatcgtaactgagacagcaaaagagacttgacctaaccaactccatcttgcttctaacctccaagctgtccttgttcattcctgggtgtaggctgaactaactttgggaggaacttaatttatagtttaaaacaaagacgataagacgataacagccctttctcaaaacaaacatccttcctgactggggactagactgcctttgtaggattaacaaattagccacaagatcagaaattatagtttaggagtcatgcagctggaggctctaagattgtgaccctccctaaaccgctcagtgcttgagatgttttacagaccctgcacttaatggatcagctggcaccacccagatggataaactggctcatgtgatcttgtggcccccacccaggaactgactcagtgcaagaagacaacttcaattccctatgatttaatgtcctaccgaatcaatcagcactcctgacacactggcttcccctcacccaccaaattgtccttaaaacctctgatctccaaatgcttgaggagactgatttgagtaataataaaacaaggctcctgcacagccggctctgcgcgaattactctttctctactgcagttctcctgtcatgataaatcggctccatctaggcagccagcaaggtgaacccactgggtggttacaggccacgctaagttcgggagaaatttagtttatggtttaaatgataacagcccttccccaaaactaaactgccctggtaaaactaatgaaaggccgccaagttaggaggatgacaggggcctgaattctactgagccgtaagcgtaattaccggccattattccagaggacacaagatttgcaacttgcctaattactcctgcaaagaacatcgctactgtagcacctgagaatggccttttgagatgtgttttcaggcttttgcacttctgacaactgatggctgcacttggactcgccagccggtcccgcgtccccaccagaagcagagtaagcacaagaggacagctccgactccctaggatttcagctctgaccagtcgcacgcctggctcactggcttccccacacccaccaagttgttcttaaaaactctgctgcccgaatgctcagggagagtgatttgagtaataatgaaactgttgtctcctgcacagtcggctctgcgtgaattactctttctctattgcaattccgctctcttgagaaatcggctctgtccaggcagcagcaaggtgaagccactgggcggttacactgatatgattccccctttgcagtttttactctcttggtgctgcaaacagttcctcactgaggacccttgtacacgtatcactgtgagcatgaatccgaatttctttaggagacatacatactagtgggtatgtgcatgttatgtaatttctcttagcactgtttcctcactcatcaaataaggatcaagtagttctcaccacacagggttattttagaaataatttagtatacataatatacaatgcaataacaagtactgatgtctacttcttttaggttatatgataataccttatacatagtacatgtgtgattatatatattgcaatgtagagtacgatctataatttacagaactgttgtttatatataacaaatgctgtccttgcgatagtttgctcagaatgatggtttatgtatacatatgtaacaaacctgcacgttgtgcacacgtaccctagaacttaaagtataattttaaaaaatgctataattcatgtggtgattattatctaccagttacatcatcgatagaatgaggacgttgttaacggtacacgccagacaggatggctgtgaggatctgtgataataagaattagatatttggtctttgtccctgtttcctgatggaggcttctaaaccccttggaattccctgactgataggggcaagaggaaatcttttgttattcctaacgagcccctttcatccatgcctgtgtttatgctaatgaggtgactcctggaggatgagggctggttgccaggggaatcaactttgccttgcaactttcagctccagtccgtgacttccagggaaagaacaggggctggagattgagtttaatcgccaatgaccagtgatttgatcattcatgcttaaataatggaaccataagaaacctaaagaaaaggtttggagagctgctgggttcaggagcacattcgtgtgctgggagggtgttgtgcctggtgaaggtgtggaagcgctgactctgcctcgcataccttgtcctgtctgtgtctttcatctggctgttgctgagttgtgctgtttataataataaactggtaacaggaagtaaagcactttcctgagttttgtgagcccattctcttgatttaccaaacctgagatagagggattgtgtgtgggaacccttgaatttatagctggtcagtcaaaagtgctggttaacaaacctggaacttccatgaagtggggg

SEQ ID NO: 1099 - DNA, 1381 bp, Homo sapiens
ggcctggccgccgggccgggggctttgtgggtcagccacgtcgccgcgcccgggcttccccgcgggcccgccggtccggaaggtcggcccggggctcttttctccgctgttctccttctctggcgcccccaggacacgcggccagtggacgcccggaacggccgaccgggagtcgcggctggggatggaagctggaattgggggtgcgggatggagcggagagaggaggccccgcgcgccgtcggccgcctcatttcagactcccctgcgaccccccccccgccgccagccgaagcccgggccgcccagcccctcctgccgctgcgggacgccgaaggtagcgctcacatccgcgccttccgggcctggcgcccacgtgcggagtccccgggttaggaaaggccgcgcatccggaggccacgcagagcctcggggcttgcgcagaggggctgcggtgagtcctgaccctgagtgggggtcacggggctcgttgctcgctgaagtgaacacggttgcagctgtgcacagtggcggagggagaggatgagggactctgacccaaggttatgtggcagtgaggggcaagcagaaatgggggcctccggaccccaccccgagacagggctgctggccgctgcactatgctgaatatagcccaaattcttacatgggtcgtccccggggaatgctcatttttcaggctccagagcttgagagaaagtgcgaacccggtccctgagcaggtctgattcccatggccccttcgccatctgctctgcaccgaaattggattctcctacgcagaggagaaggtggagaagattctccgtcttccggagggtagctactgccggtagctccgatttccttcggatcccctttcaagggcaagcagaaggaaatcagtttctccaaagaaagtggcccggctgagtaagtgggaacaaggtggttggactgaggcacgggatcctttagctccgttgctcttctaatcccgtggccctgggcaccgccacttcctcctctgaactgctggaataatcacttctgactagcagagttactgggagccgctgtttgtcagtgttcacattctgactttagcaggagatggagcgagcgaaggagtgaagcccttgtttgtgaacagtgattgtttcccggatgacagccagatgccgggcagggccacgcagatcttagctggagcctacaggtacaagtgagagccaccccctttgacgtaactggactggcatttacagaactcatgtacagcccactctcaggaacaccagccaggaaccgtgacatggaggagaggaattgggaggaaccgaggggtcatcaaaggctgacatgcctttcgccctccgcc

SEQ ID NO: 1100 - DNA, 1161 bp, Homo sapiens
gttttacagaccctgcacttaatggatcagctggcaccacccagatggataaactggctcatgtgatcttgtggcccccacccaggaactgactcagtgcaagaagacaacttcaattccctatgatttaatgtcctaccgaatcaatcagcactcctgacacactggcttcccctcacccaccaaattgtccttaaaacctctgatctccaaatgcttgaggagactgatttgagtaataataaaacaaggctcctgcacagccggctctgcgcgaattactctttctctactgcagttctcctgtcatgataaatcggctccatctaggcagccagcaaggtgaacccactgggtggttacaggccacgctaagttcgggagaaatttagtttatggtttaaatgataacagcccttccccaaaactaaactgccctggtaaaactaatgaaaggccgccaagttaggaggatgacaggggcctgaattctactgagccgtaagcgtaattaccggccattattccagaggacacaagatttgcaacttgcctaattactcctgcaaagaacatcgctactgtagcacctgagaatggccttttgagatgtgttttcaggcttttgcacttctgacaactgatggctgcacttggactcgccagccggtcccgcgtccccaccagaagcagagtaagcacaagaggacagctccgactccctaggatttcagctctgaccagtcgcacgcctggctcactggcttccccacacccaccaagttgttcttaaaaactctgctgcccgaatgctcagggagagtgatttgagtaataatgaaactgttgtctcctgcacagtcggctctgcgtgaattactctttctctattgcaattccgctctcttgagaaatcggctctgtccaggcagcagcaagggtctcacttcactccccagactgaagttccatggcatgatcatggctctctgcagcctcaacttcccagcctcaagcaaccctcccatctcagcctcctgagttgctggaaccacaggtgtgcatcaccacgcccaactaatttttaagtttttgtagaaacagggtctctttatgttgctgaggctggttcaaactcctgagctcaagcgatcttcccac

SEQ ID NO: 1101 - DNA, 541 bp, Homo sapiens
ccagaaatcagtgatttttttctcttaccttgattacttttagctcctgaactctaggattgaaataatattttaattactatacactgctggatggatgtgtatctgagtcctgagaccttaggtagaaaatgtttctacattttcccagagcagattctctgactcactcgtgtcagggcccccatcacctccttgttcctcaggctatagatgatggggttgagcattggagtgagggtggtgtagaagacagccagaaccttgtcctctgttggagatcgcagggatcttggacgtagataagtgtagacaaaaggtgcatagtagaaagttactacagtgaggtgggtgctgcaggtcagatttcatgtggtagacagcaaagagaacctggccataggaacatgaaataccaatgaagggaaacacgagaaagatggtggcactcaaaaacactgtgccctcatagacccaggtgtccatgcaggccagagtcaccattgctgggacatcacagaagaaatgattgatggccctg

SEQ ID NO: 1102 - DNA, 2671 bp, Homo sapiens
gtcaggtgaagcagtggcagtggagaaggaaccaagaaacctgtaactagttgtgatcaattagttgtaaacaccactacactccgaccagccaatttaatttactgatgcatgtatatgttttataattatccagtcagcatagttagtgtacagtcttggcaaggacaatttcctgaaagtcaaagtgtgcagatgtttcaatattcccgcatttgaaaagctgaagaattcctttcttaagtttacaaccgtgatttttaacgtaatagtaggtgccatgtctagtgcaaccaggtaactgttttcacatcttcaaaagacagaagacaaaacctatttgcgctgaaagaggagataagaatccttatttgatgcggtaagacagacttcaagggaatttctgtaaaaaagaaagacttttaggtttacctcaaaactacccacgagggtcaagtatgcaaatatggtggatatgagtcagcaacttactcttgaaatacgctacttctccctgagggtgttctggaagcagtaattgactatttcacatatctacagtagaaagcacaaaaccaagcatagagtaggtcaaaacttggtttattctgaaagaagagattagaatgaggaacgtaaataaaactgggctgtttattttacatttttaaatgtctgtgttcagtgcaattgaattattcattaaatcacatagttctttaatttcatagtcatatttacttattaagaaaccccattctatgtcccaaagatacaagattcagatgataaccatttatgtcaaatctgttgtaaaagagcaagagacagtggcacaggcctgtaattccacctatggggagactgaggcaggaggattgttacaggcccacagggttcaattgcccatggagtggtagcagaccaaaacaccaaaacagtgggagttgcagcagagaaagtttaataatcataggtcagctgaaggaggaagagaaagggagcttcaaatcagccttctggagacacttggggaaggcgtttttaaggagtccggatgcgtgatgagctaaagtgtgggtattgctgattggtggagagtgagtggtgacgtcatgagacagggagatgaagacgctgcatcctgcactgagtcagtttcttagacaagttaactttgagcaaccagcattctactctgtttctatgtattccatttatttttaggcccaatatataagggagatcatgtagtatttttctttttgtgtctgaaagccagtctggattgaaggacagaaaaaagagaaactgagatttgcactgggaggctacaatcttggtaacataattattgtccactcgttttgtcagaggcttttgaaccagagcgactccaccttgagtgagggctggaaaatgagccggggacttgctgggctgcattcccagaaagtttggtattcctagatagtttgatatttctagaaagtttggtattttgagcctttagatgtttacggctaaggaaacagattgacaatgtttactaaacagatccagacttgggagtgtccagatatcccgacatcctaagaacaaaggcattcttaatttttctttaaagataataatattgattcttgaaaaatatactaattaagaaaattaatcctttatcacaaaccctagtagcagagcacatctccccatgctcttttttattctatatataaacaagtattgtacctagggtggacacgtcctcctcttactttcgggaacgccctactctgtctgtggagtagctgttctttcacactttgccttcttaataaacttgtttttgctttgcactggggacctgcactgaattcttccttgtgcaggatccatgaaccctcttttggggtctggatcaggacccctttccagtaagtttcacaaactctttcatgtctagtccatctatctgcctctcttgcaactccattcaatgtctgtccaaatagggccaccgaaatttgttggcctgcttgagaaatacaaaacaaatcatgtctactcttttcttctcccatgaatatttctccaagtatcatgcatataacaaacttctcacatattccatatctccttcatatcggcccatgtaaatagataaatctgtggccgtgggactgttgcctcaacatatagtgcagaatttacttaccatcctttatgtatctgaactctcttttgacatgcctcagaaagcaaacatttcactgtctctgatagaactcaaatacttacttctctacctgactttcagctatggctattgtatataggtggagagtctatattagatttttggatcccagattttaacatgggaatgggtagctcaaagcagcagggcgggtgcaaatcctcaaaggctacctggacaccgcagaaataaattcaccaagtttctagggctgtgaatggcacccagaaggagcaagagtggtgacttcacagaactcattatcaagcacatattggaaactgctcatggtggcagattttcagaccttactagtgtccattttttggtgatttggcaagcctttgcatcttcttaaaatattatattttctgtttaattacgatgaatttatttttgttgtttttagttaag

SEQ ID NO: 1103 - DNA, 477 bp, Homo sapiens
ctgggacaagaatctgagctatttaaaaatgtgcttctgtaggaaatgatgtcagaatgcttgtttcataggtctgttctttaacagacagctattcagccccagctgtgcagatcccacttcctgggagtggagcagaggctctgcgtggagcatccatgtgcagtactcttaggttgactatctggtatagtctgcaggatttagagtgtcttcccctgaccacacggtgtttctctctgaaagcggcacttggtaccagcacaaactctgtcttcagaagtcccaccaggtgttttggggcaccaactatcaggcctcccggatggtatcaaggagctcaaactcaccaggtcaccacatctggacaatgagaggccaaacccctcacccgccatgactgcctaaccacccacctgctgcctgttgactgactcctcttccttatccctccctagttcctgttttcctgcatgt

SEQ ID NO: 1104 - DNA, 544 bp, Homo sapiens
caggtgtaatctgagtgcctttgtgttcgaatttcacttgcctcccctgaccccaaactttccttcaggacaatcccacgctgactgagaatgaggctttgggtgtgtgaaagtgaacggctggtgtgagacctgcagggctgcatcggatgaagcagaagatagcgagggagagatgcttcttcacaggctcccgcttctcagatggcagccctcaccgtgaccggtcaagtacaaaccaggttgactatctggtatagtctgcaggatttagagtgtcttcccctgaccacacggtgtttctctctgaaagcggcacttggtaccagcacaaactctgtcttcagaagtcccaccaggtgttttggggcaccaactatcaggcctcccggatggtatcaaggagctcaaactcaccaggtcaccacatctggacaatgagaggccaaacccctcacccgccatgactgcctaaccacccacctgctgcctgttgactgactcctcttccttatccctccctagttcctgttttcctgcatgt

SEQ ID NO: 1105 - DNA, 1407 bp, Homo sapiens
ctctcattagcattgtcacaatgctaatattccatgggtgaaactttcccttaattttcaaatgtaaagatacaagaataatttgccaaaacttctgcttctagccatgatgagataacagggacccaaatcacacctctgccataaacaactgtaaaactgcacaaaacgaatgagatggctgttttaagtctgtgactacagctgtgccagccagaacttgagggcaggagaatgaatgagacgcacagacagtacatttgccctctgcctggagaacacctgcagaccgtggctcagagagctcaggtgtgagtggagcatggccaccctaccacgtccaggaggcggagatcagagagagctcaggtgtgggcggagcatatcaccctaccacattcaggaggcggagctcagagctcaggtgtgggtggagcatggccaccctaccatgtccaggaggtggagctcagagctcaggtgtgggtggagcatatcaccctaccatgtccaggaggcggagctcagagagacctcaggtgtgggtggagcatatcatcctaccacatccaggaggtggagcttggagagagctcaggtgtgggtggagcatatcaccctaccatgtccaggaggcggagctcagagctcaggtgtgggcggagcatatcaccctaccatgtccaggaagcagagctcagagagatctcaggtgtgggtggagcatggccaccctaccatgtccaggaggcggagcttggagagagctcaggtgtgggcagagtatatcaccctaccacgtccaggaggtggagctgagagagagctcaggtgtgggtggagcatatcaccctaccacgtctaggaggtggagctcagagctcaggtgtgggtggagcatggccaccctactacgtccaggaggcggagctcggagagagctctggtgtgggcggagcatgccaccctgccaagtccaggaggcggagatcggagtgggtgcaggactggagctctccacccatccacaccagcagcaaatcaatccaagcctgcccatggtcacgatgacccagcagtgcctgcgctgcctgctaaaacaagagctggaaagcttccgaagaagcttatgggatcctgagcgtgctcaacacgttacccacaatgtgcaatattaagcaaacaatcactgcatacacagagaaaccggaggtagaatctgtggtcaagaaaaaggcagtaaaatgtggacacacatgcaagatgatctctgtcactcaccacacgtggtggctgagtacatgaagtgcgcccggtctgaactgaattcgctgtgtgaaagacaccagttaatataaaaaatagaaaatattttctttgtatttcttattgaaagtatagtatgag

SEQ ID NO: 1106 - DNA, 1570 bp, Homo sapiens
tcttatctcagtttcattgctcttcagagaatattcttaaagtttatcttctatgaaatgactggctgctgaccaggatcatagtttctggagaaactctcattagcattgtcacaatgctaatattccatgggtgaaactttcccttaattttcaaatgtaaagatacaagaataatttgccaaaacttctgcttctagccatgatgagataacagggacccaaatcacacctctgccataaacaactgtaaaactgcacaaaacgaatgagatggctgttttaagtctgtgactacagctgtgccagccagaacttgagggcaggagaatgaatgagacgcacagacagtacatttgccctctgcctggagaacacctgcagaccgtggctcagagagctcaggtgtgagtggagcatggccaccctaccacgtccaggaggcggagatcagagagagctcaggtgtgggcggagcatatcaccctaccacattcaggaggcggagctcagagctcaggtgtgggcggagcatatcaccctaccatgtccaggaggcggagctcggagagagctcaggtgtgggtggagcatggccaccctaccacatccaggaggcggagctcggagagagctcaggtgtgggtggagcatatcaccctaccacgtccaggaggcggagctcagagagagctcaggtgtgggcggagcatatcaccctaccatgtccaggaggtggagctcagagagagctcaggtgtgggtggagcatatcaccctaccatgtccaggaggcggagctcagagagagctcaggtgtgggcggagcatatcaccctaccatgtccaggaagcagagctcagagagatctcaggtgtgggtggagcatggccaccctaccatgtccaggaggcggagcttggagagagctcaggtgtgggcagagtatatcaccctaccacgtccaggaggtggagctgagagagagctcaggtgtgggtggagcatatcaccctaccacgtctaggaggtggagctcagagctcaggtgtgggtggagcatggccaccctactacgtccaggaggcggagctcggagagagctctggtgtgggcggagcatgccaccctgccaagtccaggaggcggagatcggagtgggtgcaggactggagctctccacccatccacaccagcagcaaatcaatccaagcctgcccatggtcacgatgacccagcagtgcctgcgctgcctgctaaaacaagagctggaaagcttccgaagaagcttatgggatcctgagcgtgctcaacacgttacccacaatgtgcaatattaagcaaacaatcactgcatacacagagaaaccggaggtagaatctgtggtcaagaaaaaggcagtaaaatgtggacacacatgcaagatgatctctgtcactcaccacacgtggtggctgagtacatgaagtgcgcccggtctgaactgaattcgctgtgtgaaagacaccagttaatataaaaaatagaaaatattttctttgtatttcttattgaaagtatagtatgag

SEQ ID NO: 1107 - DNA, 8125 bp, Homo sapiens
gcttctgtgtgctggaagctgctgtcctgtccctgcttcctgggatgcagggctgtggaatttctgctgtgttccatgaagggttaaagcattccagggaaggagattctgagatctccctttttaaagacacttttagtcagggaagtgctttccagccatgtccgtctgttctctcctgggatggacagggcagctactgtccctgttcccgagcctcaaaagccattacgaagttccagccaggcctttactttcccaatcctatttcagctgatctcagccttcccttgtagatctttctattcatttagttggcatccttgctttcttgtaccatctcccagttttccacagtttatttacactggacatagaattgcaacagaaactcacccatgctgaggtagggctgccccagggatctccccctctgcagaccaggctgcccactggagagtggtatcactgggtcacggtcaccatctgccccagcagggtccagagtgtttagagtctttcctggacatagaaacccttttgtgtgacgttcagataaaaccaatcagcatgttctgttaatcacagaggtcggagctgagaaccattagcgtacatccacctctcccgagagtgttcacgcctcttccacgtggggctaggctgctgctgagtgtggttctgctggctgtgggtgtggcctctttcctcaaccacagccatcgcaggcctgccacagttttggttcttctaaaagagaataggcaacacaagagaaataagataagttagatttgaaacctttaaaaattatttcctcaaacattgtatatattttctgcccatacctaatttgataacaattttaaaaagatgaaaaagaaaaaaaaattcccccatatcaagtctttgaaaggcatccatcttagtttttatccaatcaattactctctctttggagtcatattttattggtttaagtaatgtgtaacaagtacactggcataaacagatttaggagcaaacacagctgcttcatgattagcgttcagctcgcggggcccagctgtgggggtgcagcctgtgcctgcctgtgcgccaatagggctggtcaccttgaacatccaggagtgtctgggtgagtgaggtctgggcaaggcagcatccatacacctgcgtagttctcactttgtccgcgttatctggcaatgccacaaaattatcaagcaagtgttctccaagtgcgtattcacttagcgtttggaaagtgcataggtacctcatacagtaccttcaggaggagctaggaacccaggaatgagagcaggtgtgaggcctgtactctttgtgtatagataaaatatgcatgtgcctatctgagggcagaaagttagattggggtcagaatgtggaagtccttacctgtcagatactaggaagccactgagggcttcggagagaatcgtgcctttgatgtgcggtatgctgtggagccacgggggacaggccaggctcctgcggggcactcgccatggcgagaggaggagagaaggcagccagtgagctgagcgattcagtgcctgggtcaggaggggaagagggagtgcaggaaggcagatgaagctgtgagtctacaccctgaggtcggcgttgtgctttgctggaaatcaggaggagaagcaagtgtggacctgattcagagatacttagagacaccaccgcaagctgcgagtttggaaatatggaaggaggcttggggaaaatccggaccagggtggatttgggagcctcctacatagaagtgcaggtcaaggagccagagtgtgaggtgtgcatgtcgggagagaggaggccaaaggaaagcccacatttggaaatggaggaagggtcggaagacccagaaaaggccctgcttagagtccagagaagagctgcacggtgcagttccctaaagcccagagccgagagtttccaggacaaagtcccaagtgttgctgaaaaccagggggtgggactccagctggaggcagcgaggggagcctggtggccctgattcctgggagcagccagagcctgggggtcacggcggaagctggtgagaagcgcagggagcaggtggagatggtccttcgaggcctggagcctcacacgggtagccagccgtggaccaagacacagctgaggaggggcctcaacccagagcgtctccaggtggaggagggagccaggaagggcaaaggtacacggaagaaagggggcaggcatggagccaggtccccagggaggctgcagtcttctctctctgttcagggactggttgttggttattctgagttctcaaagtcatccactcggtgcggtccagagaaagatcccaggggcctcaagcctggagcaggccttgtgcttttcccaacactgtgcgtgttgactcagggttactgtcaatggctaattctagtgtgtcttttgttgaagtctgcagaaaagcctcaaccagcaccagcttttgaaggacttacaaaacttgtgttcttctgattctgggatttttgcctgaaatgcctcgtatatttttggctaggtgttgttagcacttgtgttacggcatttggagctctgtatttttgtgatgtgctagctgtgaggatgtttaaaattagattcctagaaatcaggttataggagctctcggccacgcttcatgggttatgttttgacacctcatagtggatcccgttgcggtggctattcttagtatttgtggaacacctgactcttgatgctaggagaatgttatttgttttctttgtaagcctaaagtctaatgaccttgtagagtctttatacccatctcttataaatcagctttaatatgcttgaaaaagtcctcattgtgcccttgaaaagcaggtgcacattttaaaagtcatccttttaaaatccttttctccagtctgtgccctttgtctgtttcgtttccttcactgcaacatcatgaaacagggacaagagctagaatctgtttcatacacagagcttgaaacagggacaagggctagaatctgtttcatacacagagcttgaaacagggacaagggctggaatctccatttcatacacagagcttgaaacagggacaagggctagaatctccgtttcatacacagaacttgaaacagggacaagggctaggatctctgtttcatacacagagcttgaaacagggacaagggctagaatctctgtttcatacacagagcttgaaacagggacaagggctagaatctccgtttcatacacagaacttgaaacagggacaagggctagaatctctgtttcatacacagagcttgaaacagggacaagggctagaatctctgtttcatacacagagcttgaaacagggacaagggctagaatctctgtttcatacacagagctgaactgggctgagcgacctgctctgctgacgtctgtttctgtcatgagagggaacctaggcctcttgacatttccttttgtacattttcaaaaagattattttttcctctctctggtccgttccactgtgagattctctcctaaggctgtttctttgccttccattttgacaactatgatttagtttccgagatgatgaaagggtagtaaaaaggcctgggaaagagaaagcaggaagggaaggaattatctcatgattttagtcagaaggaaatcactcagacagaaacgcttttacaagtggtcagatcccgggaagtgggattgaataagtggcatcgtatcacacaaccctgttttacattcttgctgttgccaggggtaacgaaaagaacgagtatattcattccgaggtcaaatatatatctttgctgactctgactataattagcagaattcgttcaattcaagtttgagaatacctttacagaagagggtcttcaggcatgtgtgcctatttctattcgtatgttcacatgtatttgagtatgaatgtgtgtatgtgtgctgtgtgtgagacctcattatttgaaatcaagaaatgtgcagtaaagtagagtttattaattacaagaagttacatttgggggataaaccattttgtatagaattgaataatggggtctttgaggggtgtatatatgtatgtgtgtttgcatttatgtgtatgaaagtgtgtattgcatgtatatgtgttgtgcatgtatgtgtcttggtactgtacagatgcatgcatgtgtatatgtgtgcatgtgtatttgtgttgtatgtatgtgtgtgcatgtgttacatgtttaggcatgacatcgcacacatgtgcaagtatgcatgcgtggatgctcctgtgtatatagttataaatgtatatgtgtgcatgttatgtgtatgcatttacatatgtttgtgtgtgccagaatgtatatgcatgaacatgtatgtatatgcatgtgtgtttgagtgttgtatgtgcatgtatgtgttacatgttggtattatgaatgtgattatgtgaatgtgtgtgcatgtgtgaatgtgtgtattgcatgtatgtgtgtgtgcgcatgtgtgtgtgtgagatatgtgtctgtgcatgcatgcatatgcacatttgatttgtgagtcctctctgggagggccatgttcctggagagagtgcatgggatcctccgctgtcctctcagggagagagatattttaaaggtttgagccattaggtaaacacgcctgatgctctataaaatatatatttacatataccattggggttaaatatatgttaaatgggtgcaaagctgttatattgcattaaaagtcatgttaatacttccttgttaaaggctttgtgaatgatttcctgcacatgaaacataatacaccacacagaattacagtgggtcagtggtgatatttgccaggaggtctggctaatgattggtatttctagttgcagacatgcagtttgagcttttctggacttaaaggagggtcactgactgcccactgaatgatgccagcagctctgcctcattctgtcggcttcatccagagctgggacagctgctctcagatggattgtacttttctctccataaaggtctgcagcatttgttagcagtccagtagcagacccagcggcaggtccagggtcaggtccagtgtcaggtccagcggcaggtccaggggcaggtccaggggcaggtccagtgtcaggtccagcatcaggtccagcggcaggtccagggacaggtccaggggcaggtccaggggcaggtccagcatcaggtccagcatcaggtccagcggcaggtccagcggcaggtccaggggcaggtccagggacaggtccagtgtgaggtccagggacaggtccagcggcaggtccagcgtcaggtccagggacaggtccagcggcaggtccaggggcaggtccagggacaggtccagcatcaggtccagtgtcaggtccagcgtcaggtccagggacaggtccagggacaggtccaagggcaggtccaggggcaggtccagggtcaggtccagtggcaggtccagcggcaggtccagcggcaggtccagggacaggtccaggggcaggtccaggggcaggtccagggacaggtccagtggcaggtccagcggcaggtccaggggcaggtccagtgtcaagtccagtggcaagtccagcagcatgtccagtgtcaggtccagtggcaggtccagccaactttccacatggcccatgtgaaaatgtacccactcccttgcattttttaaagcagtagttattagtagagcctactgccatttctccttgagttcctcacagtggatgttaagcatttgctttattaaagcaaagttccatgctctttgtgctaagtcacctctgcctttctgtgagaggctagaattgggatcgaccctcagctgtgccagagccttggtacctgtctcagttctggaatctactctgtccttgttgccttccattcaccgacagccgtctgtcttcctgtcactccttcaacacggagtccagcagtgtgcacacaggtgagcctgtgtggatgctggtttcgtaggatcttatcgggacctcactcatcttttcactaggaaatcagacactgcaaaggacttacagaaaagcccaaagaagccgtattgatagaatcatagagacagaattctataaccataggaaacggcattgattatcatgaaatgtgcacttacgtgtggcatagtaaaacatcacatttgaataccgcactgggtaagagcttggaaaagagattatgaaagtataactggctctgctcttatgtagtgggacatggtaaagcgatgcctgatactgtatagaatggaacaaacaggatagaattatacagagtagtgcagaatagaacaaatagtagagtgttcgataaggtagcatagagtagaagaaacagtgtaacatatagtatagtatacaataggagaaatggtatagcgttatatagggtagcatagaaggaacagtgtaacattatatagtatagtgtacaataggacaaatagtatagcgttatatagggtaacatagaatagaagaaacagtgtaacttatagtatagtgtacaataggacaaatagagtgttctatagggtagcatagaatagatgaaacagtgtaacattatatatatagtatacaataggacaaatagagtgttctatagggtagcatagaagaaacagtgtaacattatatagtatagtgtacaataggacaaatagtatagcgttatatagggtagcgtagaacagaagaaatagtgtaacatatagtatagtatacaataggacaaatagtagagtgttctatagggtaacatagaatagaagaaactgtaacattatatagtatagtatacaatgggacaaatagtagagtgttctatagggtagcatagaatagaagaaacagtgtaacattatatagtatagtatacaataggacaagtagtattacatagtctagaatagaacaagtgggatagtattgtagagtatacagttgaactaacaacgtagtattgcatagcataatgtagtctagattagaacacacagcatggtattaatattacatagcatggtgtgcagtagtagagtcgcaaagcacagaacagagaggacagtgactattacatagcatagtgtggaatagcagagtcgcatagcacagaacagagaggacagtgagtattacgtagcgtagtgtggaatagtagagtcacatagcacagaacagagatggcagtgactattacatagcgtagtgtggaatagtagagtcgcatagcacagaacagagaggacagtgttctgtagcactgctgcaggatttttgctctttagctcagctgggtccgggttcttgtctcacaaccaggaagaaacagacacatggacatcgaagactgagtgcagtagaatttattaagcgaaaaggaaaggtctcagcaaaaagaggggtcctgagagcaggttgctggttgcccccttcccagttgactacaagggcttttacatagaagctgatggggctgggctccctgtttgcataaggagcgaatttctggtggctccaccccattcccccatgtgtatggggaccctcagtctactgtgagcatgtttaggcaagccccctgagcaagttcccctatctgcacaaaacatgggctggaggctgtctgggacccttcgcttactgtctgcctaaagcaagctggctaactcctttcagtatagaagaaaatagtatagaatagaacagatagtacagtattatatagtgtagaatgaaacagtataatattgtatcgtagagaatggaatagtatagaatagaacaaaccgatcatagtagtgtagtatagaatagtagcctcgcgcagcatggggcagtgttgtgctccatactacagagtataaccaccaggagagcgttcttcagtggggcgttactggcccttcatatttctttagttctatgaaaatgaggacagggagataagagggggaggaggttggctttcttacttttaaggcactcattacttcctgg

SEQ ID NO: 1108 - DNA, 3743 bp, Homo sapiens
ataaagatgaacattcgatatcaggaatccctaaaaacaatggaaattgtcatattaaatgaataaattccaaaacaaagatagtgttctgtactgtgtgtttacattgaactttcttataaacattggtatgaatgtttcccacttattggaaatcacatgactagtttaagctgaaacgtggaatattctgtcttcagatcacttttgcatatttatgattgatctgttctgctgttctggaagctctgaaaaccactcggtcttaccctagctggtgccacagttgtgagaattcagggaaacaaggtgtttgccagtttaagtattttagatgtcaagctgcctcttacctgcatcataaaccagtcttaaagaaagacacagtgtgacttgtagtggattatatcagttttattttctgtggctgaatcatcactctacattgtgaattaatgttatttttcggctcatcttcataatgcagggaggttctccagtgttgagtgcaggttcagtgaaagcgctaacactgttaccacgggcttaaacggacttgttttctgaggcgataaccctggagtcaggcattcagtgtctgcccatcacttggttccgagttctcggtcccctcttgctctcctccccccgcacccccttgcttctgtcttgtcttctttttgactaacaggccctctgcagatggtgtgttgggggccggggtctgctgtgagtctttgataaccttgggaaagaactttttctttggagcaagacccctctcaataaactttcagtagcccaactattgtccgttgtgtgaactatttgtggaaaatgctcagcatttttccttggattctggctgatctttctccacctgccaatttctcctcagtttgccgtgtctgtaccgtcaccaaccccgttccagccgcggttacatgtaaagtaattgaagcagagctctgcagatgagagagtgtgtgtcgccccccgagttcccttcctggcctctgagtgtgagttgtgttttgttccgagggatgactgaggctcctggcccctgttttggagcaccccacaccaaagtgggtgtaaaatgaaaaaagggtttatgctatattattgtaattcatggagcagatgataaacatgcttgaatctgaacagcagctgaaaatgaggacatgttaccagtttggatgttggatgaccttcttgaaaaaagcttttgtcatactttagaaactgtgcatgtgctgttttctatttcatacttagaatctgtacagtatgtgttgtatgaatgtgttgtatgagcgtgttgtgttgtatgtgagtggcatgggttgtatgtgtgttgtatgtgcatgttgtgttgagttgcattcattgtatgtttgagtgttatgtgttgtatgagtgtgttgtacatgtatttgtgagttgtatgttttgtatgttgtatgagtgttgtgttgtatgaatgtgtgttgtatgagtgttgtatgtgtatgttgtatgagttgcatgtattgtatgttgtatgggttgtatgttgtatgagtgtgctgtacgtgtttgtgagttccatgtgttgtatgttgtatcagtgttgtgtgttgtgtgagtgccttgtacatgtatttgtgttgagttgcatgtgttgtatgttgtatgtgttatatgttgtatgttgtatgagtgtgttgtacgtgcatattgtgttgtgagttgcatgtgttgtatgagtgtgttgtatgtgtatgttgtgttgtgagttgcatgtattatgtgtatgcaatacacatatatgttgtatgagtgttgtgttgtatatgttgtatgttgtgttgtgcatgttgtgttgtgcgtgagttgcatgtgttgtgtgtgttgtatgagtgtgttgtatgtgtatgttgtgttgtgagttgcatgtgttgtctgtatgttgtatgagtgttgtgttgtatgagtgttgtacatgcatgttgtgttgtgagttgcgtgtgttgtgtgtggtacgtgtatgtcgtgttgaatgtgagttgcatgtgttgtacatgtgctgtatgagtgtgttgtatgtgtatgttgtgagttgcatgtatgttgtatgtgttgtgttgtatgagtgcattgtatgtgcatgttgtgagttgtgtatgttgttttgtatgagtgttgtgtgttgtatgtgcatgttatgagttgtgtgtgctgtatgagtgcattgtacatgtgtgttgtgttgtatgtgttacgtgtgctgtatgtgtgtatgtgttgtacgtacgtgttgtgttgtgagttgcatgcattgggtatgtgttgtatgagtgtgttataaatgcatattgtgttgtgagtagcatatattgggtatgtgttgtataggttgcatgtgttgtgtgtgttgtgtgttgtcagtgttgtatatgttgtatgagtacattgtacatgcatgttgtgttgtatgtgagttgcatgttgtcagtgtgtgcgttgtgagaggcgggggcatccacgtgactgctcctcagcaagtcctgccgtgcagccccttctgagcgtgcgtcctcccgagtagcctagaagcagcagcatgtttgcctctgcccctccccaggaggcctcagccaggtcctgtgctcagcctgccgtgggccatctgcctctctcgtctctctctcgtcgtcatcctgcgcctcctcccagtcctgagtagctgggattacaggtgcctgccaccacgtctggctagtttttgtattattagtagggatggggtttcaccatgctggccaggctggtcttgaactcctgacctcatgtcatccgcctgcctcggccttccaaggtgttgggattacaggcatgaaccaccgcacctggtccgtctgccttttagttacaacctgtgtgttttctgttttaaatttcatttttccaggtcagagcagtagtttctttttcgtggtgttgctgtgaatgtctgttatgattaggagactgggtgggtgccctctccctggtgcctggctctttcacatgaggtgggggtcagcttagctgcttctgattttgggaggcgcactgcttcttggggcagcttgccggccggggtctgcctgtggtatttcctggggagctacatctgtccccgtaggcctggggaagtaggcaggccctgagtacacgcctcaacacacgtgccttccaccagcccccaggcccacgtccagaccccagctgcgtcctgtggtagccagttcagctgctgccaccacgtttattgaacttttaatagctgtgcgcagacaggccacgggcagacaggccacgggccgacctcgtggctttgcttacccccagttctatgttacctgtgtgcagaaaccggctgctcccggagtcctgcaggcttggtttccccggccccgactcaggccacaggatctcagtcttgggtgattctgctgccgcgggccgggctctgggtgccagtggattccccacgcgcggtgttactcccgtgttcacatcagtgcgggagggcggtgagggagggaggcggggacgctctggattcttctccctgctcctcaccagctctgaacgcagaccagccgttcgcctcgttgcttttccagggatgttgtgagtctttcgtgggtagggagtgatgccctttgctttcttctcgctttcccggtaggtgctgaaggaataattaa

SEQ ID NO: 1109 - DNA, 324 bp, Homo sapiens
ggaggacgaggctgcagtgagccatgattgtgccactgcactccaggctggatgacagagcaagaccctatctcaaaaaacagaacaaaaaaaaagaggcgtagtggctcatgcctgtaatcccagcactttgggaggctgaggcgggcagatcataaggtcaagagatcgagaccatcctggccaacatggtgaaacctcatctcttctaaaattacaaaaattagctgggcgtggtggcgcatgcctgtagtcccagctactcaggaggctgaggcaggagaatggcttgaacccgggaggtggaggttgcagcgagccaag

SEQ ID NO: 1110 - DNA, 586 bp, Homo sapiens
agtgctcataacacacgtccacgttgggctgatggaaattctgttccacttctcttcactgtgggatgcaggctgcagtagggtgaattatgacccccagtgataaccaggtccaaatccctggaatctctaaatattaccttacgtagaaaagggtttttgcagatgtgactacatgaagcatcttgagatgaggagattatccttgggttatctaggtgggccctaaatataactaaaagtattgttataagagagagtaaagagagaatttgactacaggcagaagagaagaatgccatgcgatagaagcagagggaggcagtatctgagagagaagatattttgatggtggctttgaagatggagaaagagaccatgattgtaaggattcatcatgcaaagagcaaagagaagtatacagggcaacataaaggaagaaaacgggctttgacgttagaagacttgaagctgaatcctagatccccaaattaccaggtatgtgatgatgggaaattcacataaccactggacctctgtttctttttgctgaaataaggatgcagactaaaataattcacagggc

SEQ ID NO: 1111 - DNA, 618 bp, Homo sapiens
ggtgaattgcctgcatcaacttgactgggccacaggatgcccagacacctggttcaacacggtttctggcaatctggccacctttctggagagactgcatggaaaggccagatgacgaggaataatttgatcctacttggacagaaaagcccagcctgacaactgaccacagctttcaagatatctaccacctagaaaaaaaggatgtcaactgcttctgcatacaccacaagatcaccaagttctggaagaagcacacaactttctctgcagcaagaagagctattatagagaacaagttgaacaaatactgcaactagaaaaggctgtttaaatgagcaacctcaactgattttttgaaaatgatgctaaataacccattgtacccaaaaagggaaaagcaaacagataaaatcacaacctacaccgtgaaaaatatcccaaagtgaaaaagcagttatataaacagctagtgaaaaacctggaaacaagggatgcaacgacttttttttctcatcagggaatggaaagaaagcagatatggaatacaagagaagggtacaagaagcaggaaactgaacatacatcccttgctaaatagaaacacagaatgactcc

SEQ ID NO: 1112 - DNA, 734 bp, Homo sapiens
cacacccacacacactcacagccagttcttttgatcccaaataagccctttctctattgctactataataacctactgataataaacagttagtgagtcaatttttctttttttttttttttttggacagagttttgtgttgttgcccaagctggagtgcaatgacgcaatcttggctcactgcaacctccgcctcctgggttcaagcgattctcctacctcagcctcccgagtagctgggattacaggcatgcaccatcacgcttggctaattttttgtattattttaattttgccatataacacaggaaatgcagttcaatgggagagtgcctacacacccatggaagagaaaatccctgtgaaatataagggccccttctacgtgctcaagattaaaaaaaaaaaaaaggaaaaagtagctctcacatgcttttggcaagtttttgaaccagctgatgtatgggccaggtgatgtatggacccctgatatatggagcagctgatgtatggacccctggtatatagaccactgatgtgtgaacctcctgatgagtgacccaccaatatatggaccagttgatgtatggacccactgatgtatggaccagctgatgtatgcacccactcagatggaatctctctgtcagccagcctggagtgcaatgccatgatctcgcctcattgcaacctccgtctcccgggttcaagtgattctccagcctcagcctccc

SEQ ID NO: 1113 - DNA, 969 bp, Homo sapiens
cctcgcttaatcctcacattgatctgatcatgatccccattttacagatcaaacaggggccccaagagactgagtaacttgtcattgagccagtctcgctcaagtctgtttttaaacactatactacttgcttcttttcctttgagagagtctcactgtcgcccaggatggagtacagtgctgtgatctcagctcactgcagcctctgcctcccaggttcaagcagtccttgtgcctcggcctcccaagtacctgggactacaggcatgtgccgctatgcccaggccttacttgcttcttaaatagaaagttactccacagaagccaggtgcagtggctcacgcctgtaattccaacactttggaaggccaaggtgggcgatcacctgaggtcaggagttcgagatcagcctggccaacatggtgaaaccctgtccctactaaaactacaaaaattagctgggcttggtggtgggcgcctgtaatcccagctgaggcaggagaatcacttgaatccgggaggcggaggttgcagtgagctgagattgtgccattgcaccccagcctgggcaacaagagcaaaactccgtctcagaaacaaaacgaaacaaagcaaaaaagttgctccacagagaatgtaatggaaattaaatttcaatatacagttgcccattgaacaacatgggtttcaactgcgaagtccatttacacacagattttttccaaccaaacttggattgaaaatacagtattctcggccaggcatggtggctcacgcttgtaatcccagcactttgggaggctgaggcaggcggatcacttgaggtcaggagtttgagaccagcctggccaacatggtgaaaccccatctctactaaaaatacaaaaaaaaatcagccaggtatggtggtgcaagcctgtaatcccagctactcaggaggctgaagcaggagaatagcttgaacccagg

SEQ ID NO: 1114 - DNA, 330 bp, Homo sapiens
atggaatcaatccgagtggaatgtaatggaatggaatggaatggaatggaatcaacccgagtgcaatggaatggaatggaatggaatggaatggaatggaatagaatggaatcaattcgagtgcaatggaatggaatggaatggaatggaatgaaatcagcccgaatggaatggattggaatagagtggaatggaatggaacggcatggaatgcaatggaatcaactagaatggaatggaatgggatggaatggaatggaatggagtggaatggactagaatggaatgtaatggaatgaaatcaaccagattggaatggaatggaatgca

SEQ ID NO: 1115 - DNA, 376 bp, Homo sapiens
ttccattccattccattccattccattccattccactcaggttgattccattccgttccattccattccattccattccattccattccagttgattccattgcattccattccgttccattccattccattccattccattccattccattccactagggttgattccattccattccattccattgcattccattccattccattccactcaatcgggttgattccattccattccattccattccattccatgacgttacatttcattccactcgagttgattccattccattccgtaccattccattccattccattccattccattccattccattccattcgtgtttattccattccatcccattccatt

SEQ ID NO: 1116 - DNA, 201 bp, Homo sapiens
actcgggttgattccattgcattccattccattccattccactccattcgggttgattccattccattccattcctttccattcctttccattcatttccattccattccattccattctattcggtttgattccattccattccattccattccattccattccattccattccactccattccattccattccattcca

SEQ ID NO: 1117 - DNA, 291 bp, Homo sapiens
tggaatggaatggaatggaatggagtggaatggaatggaatggaatggaacggaatggaatggaatcaacccgaatggaatggaatggaatggaatggaacggaatggaatggaatggaatggaatggaatggaatggaatggaaaggaatggaatggaatgaaatggaatggaatagactggaatacaatcaactcgattggaaaggaatgtaatggaaaggaatggaatggaaaggaaaggaatggaatgcaatggtatggaatggagtcaacccgagtggaatggaat

SEQ ID NO: 1118 - DNA, 1294 bp, Homo sapiens
cattcgattccattccattccattccactcgggttgactccattccataccattgcattccattgcattccattcctttccattccattctatttctttccattgcattcctttccactcgggttgattccattccattctcttccattccattccattccattccattccattccattccagtccattccattccattctattccattccattccactcgtcttcatttcattccattccattcctttccattccattcctttccgttgcactcgggttcattccattacaatccattccattccattccactcgggttgattgcattccattccattccactccattccactcgggatgattccattccattcctttccattccattccattccactcggtttgtttccagtccattccattccattccatgccgttacagtccattccattccattccacttgggtttattccattccattccattccattgcattccatgccgttacattccattccattccattccattccattccatttcattccattccattcctttccattccattccattcctttccattccattccactctggttgattccattccattccattccattccattctataccactacattgcagtttaattgattccattctattccattacattgcactcgaattgattccattctattccattccattccattccattccattccatgacgttacatttcattccactcgagttgattccattccattccattccattccattccattccattccattcgtgtttattccattcgattccattccattccactcgggttgattccattccgttccattccattccattccattccattccattccagttgattccattgcattccattccgttccattccattccattccattccattccattccattccactagggttgattccattccattccattccattgcattccattccattccattccactcaagttgattccgttccattccattccattccatttcattaaattccgttcctgctgtttccactgccttccattccattccaatccattccattccattccgttccactctcgttgattccattccattccattccattccattccattccagttgattccattgcattccattccgttccattccattccattccattccattccattccattccattccattccattccactggggttgattccattccattccattccattgcattccatt

SEQ ID NO: 1119 - DNA, 289 bp, Homo sapiens
gtggaatggaatggaatggaatggaatggaatggaatcaacccgagtggaatggaatggaatggaatggaatggaagggaatggaatcaacccgagtggagtggaataaaatggaatggaatggaatggactcaacccgagtggaacggaatttaatggaatggaatggaatggaatggaatggaatcaacacgagtggagtggaatggaatggaatggaatggaatggcatgtaataaacacgattggaatggaatggaatggaatggaatggaatggaatggaaagg

SEQ ID NO: 1120 - DNA, 459 bp, Homo sapiens
ttccattccattccactcgggttgattccactccattccattgcattccatgccgttacattccattccattccattccattccatttcattcgattccattcctttccattccattccattcctttccattccattccactctggttgattccattccattccattccattccattccattctataccattacattgcagtttaattgattccattctattcaattacattgcactcgaattgattccattctattccattccattccattccattccattccatgacgttacatttcattccactcgagttgattccattccattccattccattccattccattccattccattcaattctactcgggttaattccattccattccattccattccattccattccattccattccactccattccattacattccattccacaccacttcattcc

SEQ ID NO: 1121 - DNA, 9166 bp, Homo sapiens
acaatgtgggagggcatttgacacagccccgtggaggacctaatgctcggggaggccttcacccagcacagtgagccatgccgacacttggtgcctgagtgcgctggtcacagcgccctccctgtgattttccccatagcagtgtgttttctctgccaggcagaaggcagagaaaccctggctgaaaaagcagtgagggtcatcgactgcatgaacacatcatcagctttcccagatggaggcacccaagtttaccctgcaggtccattcagcaggtagagctgggtcatcactaaacaggatctttcttctgagcatctgagattctggtccaaatcagggctgtgaggaccaggagccgggattccgagcccaggcagccccgcagataaggaggagggagtgtgtcggaaggctgtatggccagagccgctgaccgggccagggcttctttgtcccctcttctctcctgcatatcagcactcacgtcctcctggctcgggctggctggcagctcggggagctgttggatgaaacgtccatgcgtgtggctgtggctgtcacatgcaactgcgaggatggtcggctcccaaagcggaaccgcggtgctgggcgaagggtcagggctccgtggtgcggcagagcgcatgccagcgcttcaccagctccttgggcttgctgagcatctcgtcccagtgctccagctctctgccgcgggtgtacatgtaggggcccaccaccactcggcccagctgctggctctctgcaggggagggagagcaccggtgtgctcctgagcacagaagccccgtccccagtgacctcctttcctccctcctcctccccaggaggaagtagcaactcccctcctctctgagtgggagctgacaggccccaaaggggccctgcctttgctctgcagctggaagggctgcttctccccctgggagattgggaggaaggagagccctgaaagactctctccttgagggccaccagctctgccccacacccttctgtggggccgtattaagtctaccttatgccaaagagctgagggaggaaagggcccctctagaaagaaggcctcggccatccgagagtacattcagcagtaacattcactggccaccgtggagaagggtcttaagtccaggccatgtggccagccacggcctgatggctctgtttccccagagtggcagtgggtgctggggtgtggggcagtgtgggagctggctgacagaactcgcccagaaccccaaagtctcatctggagggcacgaggaaggtcagagcaccaggtccctgggctggtggcaggcctggcccctcccactctctcgggtgatttgctccaggagagggcagcagaggccattgcttaacctctttctttttcttttcttttcttttttttttttttgacagagtctcgctctgtggacaggctggagtgcagttgcaagatcttggctcactgcaacctctgcctcccgggttcaagtgattcttctgcttcagcctcccgagtagttgggcctacaggcgtgcaccaccacgcctagctaacttttgtatttttagtacagacagaattttactatgttggccaggatggtcttgatctcttgatgtcgtaatccacccctctcggtctcccaaagtgctaggattataggcgtgagccaccgcacccagccaacctctttttttttttttgagacgaagtctcgctctgttgcccaggctggaatgcagtggtgcgatctcggctcactgcaagctccgcctcccaggctcatgccattctcctgcctcagcctcccaagtagctgggactacaggcgccagccaccacacccagctaattttttgtatttttagtagagacgtggtttcactgtgttagccaggatggtctcgatctcctgacctcgtgatctgcctacctcggcctcccaaagtgctgggattacaggtgtgagccaccgtgcccggccctttttttttttttttttttttttgacagattcagcagcctcgcctcctgggttcaagagatcctcccacctcaacctcccaagtagctgggattacaggggtgtgccaccacgcccagctaattattgtatttttagtagagatgagcgtttcaccatgttggccaggctggtcttgaactcctgagctcaagtgatccacccaccttggcctcccaaggtgctgggattacagatgtgagccagcatgcccggctgcttaacctgtttctagggtgccacagacagagctcaactggactaaagctgggcctgaaacccaggccttgggcaatatttcagcctttctgagcactagtttccttaaccagggagggagctcgtacggctccttctgaggtcaggacaggaggcactcactctgcctgaacactcggcagcccctcgtggtccccatcccagcagcccagggtagggtgtggccttactgtccccttccatgttctgcaccacagtcaggctgaggctagcggtatccagctcggtggcatcggccttgaagctgaaggtctcattgtacacagggttgatggagcccagcacagctgaagtcttcttgcacttgacaaacttgttgtggttcatcagagacactttgacaaacacacctagggaacgagggattggatcaagctggggcgagatagagtggggaagtgatgagctaagaaaaattagcctgcaagcatgacgtgtcgcacgtcagcaaggctgcagccttggattctgatgtcttgagaagagcgattcacctgtgaattctcacagccctggcctcagaaagacggcccgggaccaggcccgatggcacccctcttcccagctctcagccagggcggaaggcacaagtgatggccctggcctccgcagtcacactcctcctgaaagctgactggctgaacctcacctcttggctagcttgccacccagctcttgagaacatgtttgtccaaggcctcttggcaggtctcgatgactccttcccctaagggcccccagtcacctgctaaggctcccaggcccctgtgaaactggctcggtgccccaatagactctccacctccagaccctaagccggccagcccagagtgcagcaaggcaccacacctaccctgtgagggcactcgggccccgcgctggcctctgacagcacaggaagcttctgcattcacgctgaggcctgtcttttgccttccttggataaacttgccagaaaccccatagtgcttcaggcctttgggataattcccctgagccccataggccagggcctggcattcagtagttgctctaaaattgtgttttcacccactctcttccaggtagtcaggacagggaagcccaggcttctggtcaccactcaccaaatctctcccctgcccctctatcagggatcagctcctataggccttaacctagcagactaggtaaagcagagctggtggcatcaagggtcccgggggctgcagagccctggctggtacaggaggctgggctctcctgtaggtctgcaccttcccagcaacgcggagggcaccagaccctgcctgctccagaagctgtacctgaaagatgaagtgctcgtcaaactgcgggttggaggttttgcgtttggtcttggattggaggaagcgccgctcatcgggcagcaggtagagcttcaccagggggctgcaggtctccgagggggcttgcaggtgctgtgccttgatcaagcccaccagcagccgctcagcctcctgctcatattccaccgagaaccacagccgccccaggcagccgtcggggaagtcggtctcacttttgtcctctgggaacttgtacagctctgggttgatggcccccaccatacatgcatctcctatgacagagggtgggagggctggcaggccagaggaaggcaggggcatgggagacagtggcaagctctgggcacccatccccatcctggcccatccgtctctgctgagcctcagctagcctgaccacatctgccccactctcctcaccaggctaaacacatcccctctctctggtgcagctcctccaagaagccttctcaccatgaaggcattgcatggccaggctggggatccagcagagtcctgccccctgggattggcccccatccttggaggtcaggacctgtttcaaggacacagtgcccatcacctggcctagcccccttccatggcgtctagggaatgactcagcgataaaacattgcctttcttcttcctcttcaaattagaagggccaaggtgattattgggtggttcctgtgatggtctcttggtagatcttcagggcaaagaggtggcagaaagctgtgtttgcagcccctaccattctgtcctcttggtcaaccaacccatcatcctagagtgggacccagcacaagttctgtacatggcgtgcctgggttccaattccaatctgttgcttacagcctcagttaagactatgtaaaatggggtgataattcctccccctcagagtcatggtgaggtctcactccaaatcagcacccaaggccatatctcaccctcatggggtgcagcaagcacttcataaatgaaagcacccagaaagagtggtccctgggtggtccctggcatccctggctggttcaggttgtgttccggagccaagctggtgaaagcagatggggccacccgagcagaccctgacctctgggcagccctggcaaggacactcaccaaggccgccgctggaggtgtgaggcagcagctctgatgccgggcaggggtcccatggggcatcggcccactctccactgtgcaggggcacccaatctcggccttgaagggttgggggcaccacgaatggcacagctggtggcctgtccagagtcagggagacaacatgtaggtggcaagtgaatggtgtggtctcagagcgctcagccaggacggttgagcaccaggggctggaggaagaaaagccatcgggagccaggaggaggccagggcaccattttctgggcccataccaggcaacacacacacacacacgcacacacacacacacacacacacacagcagtgggatttggagaaggaacacagcacctgacagtgtcagccagtctgggtttggattcctgttctgccacttactaattgtgttctctggacctgttgcttatgtgcactgagcctcagattcctcacctggaacatgggtttcataacacctgcctaatagctgatgtgaggtttctggggtttctttgtgatagctcccagcaccgaagcagcatagaagaggcacccccataaacagaactttccttttcgaccccaccctgagggaaattccaggggcgcacttggccccacatcctgcctcacctgctcagttgggtcctagcatgcggctggcagggcctgtcccgctgcccactggaggcagctgtggtggccatggctggtgtcccaggcagctcctcataggtgagggtggcacagaaccttctccacagacagcagcttgccccgatcaacagcagcagcagcagccccccgatggtgcccccaatcaccagggccagctgctctgggggcagagaccaccagtactatgatgcctgcctgggaaggccactctccctcacagccctggcctgctggggcagaactagggcagcaaccctgcctctgggtttgatctcaggagtgataggagcaggcctgctggggatgggttccgggagggatgctgctggctaggttccgccagctctcagaggagaagccgtttaccccagggtctgagagccctgggcagaaccttctagttttccttggaaaacagctggccctgcccttgggattctggcttaaagaagccatttccttgcgcttctgagtagaaatcaaacctgccctcaccagaacctccatatcccctgggctcctgttgaggccaggaggggagctggggtgtggacgcagtcagttaaggaaagccctgaaaggtaccttccccctggtctgcaatcaaacctctaccctctggggccctggaacctgctgcaaggctggactcttctctaacacccgctccctcccctagccctctatcaaggtgagcacgcgcttaggggagttggtgcgacgcggtggacgaggtggggaggaagagggggcaaggccccattgctgctggccctcacacgtccgcatttgcgggacctaggaggcttcgccccgggggtgctcagacgctgggttccaaccgctggccacctggggcgggccaaaaaggtgcctcccttagggtgacgtgcggccgcggggcattcaggtctcagggatctgcactgggtggggtggtgagaaggccggaccccccacacctcctaagccgcaactgaccgcgaagagcgggcctcagcgtctactccatcccagtgcccctccaagagcgcgccgaggccgggcagggcaggcgctgcaccccagcgggggcggcggggcggaggcaagtgctggaagggtcgcagaggggccggggctgggctggggaggcgaggctcgcttacccgccatggggctgctcccgcaggctggtctcgccggtctgggcggctggggctgggctgccaggccgtctcttaaagcgccgcggggcgccgtcgggcgagcacaggggcggtccgtggtgctgctggtgcccagctgcggcgcggggagccgcgcagtgcacggcaggggcagggacccagcgccccgaggccgcagtcccgccccagccagtccctggcccaggcccaggcccggcggtggaggggcgcagagccgaccgtgagctcccggaaaccgcagggctccagccagggcgggtcccgggcgccaggggcgccaggggctccctgcggcttggggcagggtgcggtgagagtaccacccccatcccggagagcagggctacagccttcaccgccgcgtctgacacagggctccgcacccgacccctcacacctggtggccaggactgagcccccgccctcccagatcctcctcaagccgaggcccctccagccgcagctccgaccccggctcgggggagccttcccggatcccggggtggagtctccgcgcgggtcccgggccccagcgctgcctgcctgatggccttgggcagggatgcggcgctcgcgcacccgttcgctctcagcggacaaaccggtcgagagcgcaattctggagcgggttccagaagctcctgggttccaattcaggctcctcactcgccagccctgcgatttgggacaacttaacgttcgtatgctgggttcagtcttctcaattgggttaatgtccgtgaggggctctcgtaagggcggctggcctgccggtaacttaagaagcatgtaaagaacacttagagcggaggagcggcgcggcccagcccctgttacggtggttatcggatggaggccagcgtcgcctgggtcccctctgtacacccagcgcctattattatggtgattattagaacgcagggcccgtgcccactagtccaggctggcgaacgcgccttgcgggaaaggcgggagtaaggtcgctgcgtgtcctctctggtcacccctcggcgcgccctggtcgcgcccctatggttcccccgccgaggcctcgaggcgtctgagtggggagcgaaaggaatgtgtgtatctgtggtgcaggggagtgtgtgtgtgggggggggagggggtggttgtgggggagtgcgtgttttggggggatggaccttctcgttttacagccttgaaggttatgtccagagtcatagcctgggtcccacacccccgcgtcacctgtgcctgtcctaggggccagtcagtgtgcgtgaggctccaccctgcctgggctttggctcacctaaggcgaggagggtggtgaactggggtgccccactgggccgggtctgggagccctcagggccagggtgcagaggccgcagccactccccttctagggtctgggcggtgggggcatgagaaggcggagacccaggccacttcacccagtaactgtcctcagctgtgcgcttaactggcgagatctccgctctacttggagacagtctggggtgtctggagaatcctcccccacttctgcttaccccaggtcgctgtgggagcaggtgtctcaggaaatggggcctgggtcccacccaaggcctcgggtctgagttagatgtctgtatgtttgttgttgcccctgcaacaaagtaccacagattgagtagtttaagccacacgcatgttatctcacagttcggggggtcgggaatctaaactgggttggcagggcctgtgccttctggaggcaagggagctgtttcccagcgtttccagctcctagaggctgctagctagtggccctttcctttgtcttcaaagccggcagcacagccttttctaacctctcccactccaggtcatttcacatcaactctttctgcctccctcttgtaagtgtgataccctaccttgttttaacctgaattgactgtcccttagctgagagagccagacacactccattttggctccttcacttgcagccccttacccaccccccttcctcaaggacttaacttgtgcaagctgactcccagcacatcaaagaatgcaattaatggataagatactgtggcaagctatatccgcagttcccaggaatttgcccagttgatagtaccctaagcccccacatttgtgtccggttgatggtacccaaagcccccgcatctatcgccttgtgatggatttaaaacccctgcacctggaactgtttgttttcctgtaaccatttgtcttttaactttttgcctgttttgcttctgtaagagtgcttcagctaggctcctcctcccctttctaaaccaaagtataaaagaaaatctagccctttcttcagggccgagagaattttgagcactagccatctctcggttgccggctaataaaggacttctgaattcatctcagagtgtggcgtttctctataagaggctcatcagataatccaggataaccaccacccccatctcaagatcattaacttaatcac

SEQ ID NO: 1122 - DNA, 917 bp, Homo sapiens
cttttttagatcatcagagcccatctgacaacctgtagaacttcagaggcagagaaaagaattatttctccctgtcctgtgctgtccttaaacctgagagggtcatgcctgacctgatgaaaacacccttaaaaaatcaaccatccagtagtccaaagccaatttcaaaactgctttatttgcataagcaatatttagaaccctggataccaaagatccacatcattgccagtggagaatggcttttttgccctctatgctggaacaataaaaaaaaaaaaaagatgaataatgtaacagtctggcttgaaacaaaaagattgctgaataagatgttggtacaggaaaatatttccaacaatgaaacagtagtagaaagaaacatgatgataaatgtcaactggcagaaccttggcctcagactcaggcatgaataggagaattggggactgtggcgaattggagagctcttgttcactgctattcagccccttattgataccctgtgaccaaatcttcccagttttcagaagaacatgtaccttgggaaaggtatgttatatcttccagttcttaaacactggcagctaacaaaatgaaacatttttaaaacttggggacccaaaagcaacatttctgtggtctggatttgtttcatgaccatgcatttgtggattctggatttgggaccaagacataattcgaaaagagaagggaaaaggtatgagaaggtaaattgtacaagaagatgaatggagtaataaatgtatggttctcacgtggctggtaagactgtgaaagagacaagaatagtagtcaagaagatgaaaaaacccctgcttcttcctataggtcaactttgtgtgttagagctcaattagtttttggtgcactgggaaaatgattcaagtatactg

SEQ ID NO: 1123 - DNA, 1443 bp, Homo sapiens
gcctttttgaattgctttctttggtgtcttggaaaactaagtgaccagagggtataggagacaagaaacctgagagtactgaattctcattcttacccctttcaattagaacaccactgattttatcagttttatttaataatgatttcataggccagaaaattagattacacagttcttttttcagagagaaggaaataagccatttttaaagagagaaacttttcttgaaaaaaaaatctgaatctggtagcttaatacaagggaaatagcaaatgaagagctgtttcttggtaaataagaatccagtgtgtcattatgaagtatcacttcatgaggatattcctgcaagagattaaaataatattgagatatgtaactgtataatgatcagtggaacctaaaggagaagaaactaataataaatatgactaaagttcatgattgtcaaccttttatttcttgtattccagtgtcccagtggatagggttaagctttaacgtgcagaattgtggaggaaacatgtttgaatggtttttttctagacctcatacccagatactgtgatcttagatatggagtataggacaaaaatctgtactaaaatttattaacttttttgactgggtaccacagaaacataaagaagtatattttgaataatctcactcccacacctgccccgatcagcctagtttaatctgcatctcttttaaataaccatttttgttaatttcttatgttttcttccagagttttttgttaaaaataaagatgtgaacggatgcacgtagtcttattcctcccaggcatatgtaatcaagctgagcataacctaaaggaaaataaccacgttataggtgttgcgatacaatacaacaggaactacacaattcaacttatgaagtatttttgccaagaagaactgaacctgaatataatgaagcttctagattctgacagcagtttacaggacatatggagagtcttgctgtatcgcccaggctggagtgcagtggcctgatctcagctcactgcagcctctgcctcctgggttcaagtgattctcctgtctcagccacccgagtagctgggtctacaggcacctgccaccacaaccggtgagttttgttgttgttgttgttgttatttttagcaaagaaagatgaagtttcaccatgttggccaggctggtcttgaattcctgacctcaagtgattcaccctcctcagcctcccaaagtgttgggattacaggcatcatctactgtgcccggagcagaataaatttttaatatatattttgataggctgattttcttgcatctcgatttttcttgtatgtcagtaactggaatcacagttaccttttgagcacggtgctcacattatgagagttgagaaaattacggggaacaaactctggccttatggtgattctgg

SEQ ID NO: 1124 - DNA, 3077 bp, Homo sapiens
taaaaggcaaaaactgtagtttgaggagaccaaaccaaacatcagaaccatagctaaatatggcaggaatgttggaaatatcagaccagaaatttttttacgtatttttactttttttttaagcttttattttagattctggggtacatgtgtgtggtctgttacctaggtatgttgcatgatgctgaggtttggggtctgaatggtcccgtcacccaggtactgaccttagtatcccacagtttttcatcccttccaccccctccctccctcctctagtagtctccagtgtctattgttgccatcattatgtcagtgagtacccagtgtttagctcccacttataagttagggcatgcagtatttggttttctgttcctaccttaatttgcttaggataatgacctccaactccatccatgttgctgcaaaaggacatgatttcattctttgttatgtctgcatagtattccatggtgtgtgtgtgtactacattttctttatccaatcctgttgatgggcacctaggttaattccatgtgtttgctattgtgaatagtgctgtgatcaatatgtgagtgcatgtgtctttttggtacaatggtttttcttttggttgtatacctggtaatgggattgctgggtcgagtggtagttcttttaaagttctttcagaaatgtccagactgctttccacagtggctgaagtaatttacattcccatcaataatgtataaaggtttccttttctctgtagccttgccaacatctgttgttttttgactttttagtaatagccactctgactgatgtgagatgataactcattgggattttgatttgcatttctctgataattagtgatgttgagcctcttttttcatgtttgttggctgcttgtatgtcttcttttgagaagtgtctgttcatgtgtttttgcccatttttaaatggggttattttattttattttattttattttatcttttgagctagagtcttgccctgccacccaggctggagtgcagtggcgcgatctcggctcactgcacgctccacctcccgggttcacgccattctcctgcctcagcctccggagaagctgggactacaggctcccgccaacacgcccggctaatttttttgtatttttagtagagacggggtttccctgtgttagccaggatggtctcgatctcctgacctcatgatccgcctgtctcggcctcccaaagtgctgggattacaggcatgagccaccgtgcccggcctaaatgggactattttttgcttcagttgtttaagttcattatcaattctggatatgaaacctttgtcagatacatggtttgtgaatactttctcccattctgtaggttgtctgttttctaacttgatagtttcttctgctatacaaaagctctttagtttaattagatctcaattgtcaatttttgtttttgttgcagttgcttttgaggacttagtcatagagtctttcccaaggtgccagtgcccagagtggtgtttcctaggttttcttctaggattcttatagtttgaggtcttacattgaagtcttaaatccatcttgagttaatttttgtatatggtaaaggtaggcatccagtttcattctcctgcaaatggcttggcagctatcccagcaccatttattgaatagggaatcctttccccattgcttatttttgttgactttgccaaagattagatggctgtaggtatgtggctttatttctaggctatgaattaaaaaaaatataggattaacatgcaaaaggctttaaaggaaaaagtagacaatatgcaagaacagatggataatgtaagcagagagatggaaattttaagaaagaataaaaaatagtaaaaaatattgtaacaaatgaagaatttcattgataggctcattagtatactggacttttaaaaatctctgagcttgaggatattacaaaaagcttccaaaactggaaagcaagaagaaaaatgacagagaaaaactccctcagaacagaatgtgcaagaactgtgagacagctgccaaaggtgcaaaatatacataaggaaataccaaagcagcagaaaaaaagaaaggaacagaagcaatattttaagtaataactgagaattcccccaaatgagtgtcagatatcaaactacagatccaggaagctcagagagcaccaaagatggtaagtgccaaaaatctacacttagccacaccatattcaaacttcagaaaatcaaaggtaaagaaaccatcttgaaagaggccagggaggaaaaataccttacctatagagaaactaagataaaaattacatccaacttctcagaaatcatgcaagcaagaagagaatagtgaaatatttagtgttgagagaaagaagcccaccacctagaattttatatcctgccatgttgtgttacccttccaaagtaaaggaagaataaagacttactcaaagtgaaaattgagggaatttgttgcaaatccgatttgtaagaaatatgtataaaagacttaaagcaaaaattgagggaatttattgcaaatctgatttgtaagaaatatgtaaaaaaaaaaagttcagagagaaggaaaataatataggtcagaagcttgaatcttaaaaacttttatattccttgttcataattgatctgacagataacagtttgttaaaataataatagtgaccatgtattcgattatgcttctgtgggtttgtatatgtgtgtgtatctatacatggtacttaggtataagtgaaatgaatgacagcaatgatgcaacagatgaaagagtgaatttaggaatatttggttattataagatcctccagttgcagcctccagagaagctgggacaacagacacatgccatcatccagcccaagctgtttttatgaataaatttttgtgaacttctaaaaagggaaaaaatcaaataatctcccagtctttggtgtagattaagatatttgatgtaggaggtttgcttgaattgatgtgtgcataggcatatttaatggacatatttacacgtggg

SEQ ID NO: 1125 - DNA, 1049 bp, Homo sapiens
caaaagagggaaagctttctcccatttggctcacagagagctgagggagcagatagagttcgtcagcaatgagagatgctaaagctgtggagaaatgggggttaaaatgcattggcagctccaaaggcctgaggagaggcatggtgccagggaccacaaattcctgaagaacctgaactccaggaaacctggacaggaatgttatagtactgacccaatttctgcaaccaaaaccaaaccaaaacaaaggctgttttagtctgttgtccaccaagttcctgctttacagctacaagtttattgcctctgacttttgagggacggaagaccgtgcaggaattttccagcacttggaccagatcaaaataaacagaaggagtgagtcgttacctgagcaccaataatgctgggtgaagcctgagccaaagatttctcaggctgcaatctgggtccttggtatgagtggtttcaccttgagcccaggtatcatcccatcataatcgttaagagagtcagaaccatttcttatctatccgttgttttttgttttgtttataagattaaaaacgtgtgttctttatttaattaaactacaagataagaagtgtcgaagttgcgcaagaaagaatatctcattccaaaagaaaattgccagccatgcatatctccaagaggagagaaagagaagaaattaaccctgggccaatttgaacattttaagatggaggaaatgtctctcttcctatggatgcccagcctctgcccttgtcttctggaccccacctcctttctaccacacaagaggaaatgaaccccggatatgttaagtaacctgcctaaggggacacaacctaaaaacagtggagccagtattcaaatcaagtccacctggctccagagctcaccttctaaccactacattttactgtttctcatgagcaaaggcatggatgaagaaatgggaatgattattcagagaggcatgaaataaatgaccattcaactattcccaaattaacctggagaagcaaagtctcagcatcacaggc

SEQ ID NO: 1126 - DNA, 556 bp, Homo sapiens
atgagattgctggattgtatgttggcatgatgacaacgtatttggccctggcaatagattatggctggtacaaaccagttctcaggatatcttacaactagaggcagccttaagaccctgttttgtcgagaatacctacttggaagtctagtcaaaagtggcagctcaccctcctgtttcaactcagaagtccttctccattaccacccctgtcaagtgaggagctgctgtttctcctactaatgagcagagcaggtcagtggtattgatagtatctacttcctcagggaatcagtgggtcatccatcaccattagtgcttccccgggggcctccaagatgttatgaggtgttgttacaggtaaaagagattcagtgctgctagacaagcagggagcctgacagagcatgtgaaggtccaatgggagcagaactgggaagtgggtttttactgctgctcataggcaggcttctgctaatggaaaaaggaccctaaacaatagtaggattagtccttcacacttgtttggttatagctgccttccttcttaaacacc

SEQ ID NO: 1127 - DNA, 448 bp, Homo sapiens
gggaggatcacttgagcctgagtgtttggggctgcagtgagccaggattgcgccaaagcactccagccttggtgacaaagaaagaacctgtctcaacaaaacaaaacaaaagaaaacacacaagcaattaaagaaaaaagagagatgaaaaatacttttaaatgatctccttgtttcttaccacccagaccacgagtaatcatctccctaactgcctaacttttatgtaaaccagattagtaaattgaacccaccagctttattagtattcattaacttatctgtaggctatatatttttcttctatttggaattataaggcgtgtgttgacttgagactctgcccttcaataactcaaccatcttgatcaaacatcaaactgccaaagacagaaaattatttactgatgtacattatttgacaaactattcaaaggaatgaccccac

SEQ ID NO: 1128 - DNA, 437 bp, Homo sapiens
gtgtttggggctgcagtgagccaggattgcgccaaagcactccagccttggtgacaaagaaagaacctgtctcaacaaaacaaaacaaaagaaaacacacaagcaattaaagaaaaaagagagatgaaaaatacttttaaatgatctccttgtttcttaccacccagaccacgagtaatcatctccctaactgcctaacttttatgtaaaccagattagtaaattgaacccaccagctttattagtattcattaacttatctgtaggctatatatttttcttctatttggaattataaggcgtgtgttgacttgagactctgcccttcaataactcaaccatcttggagtttccctgcacaagctctctctttgcctgccatccacttgatctgtgacttgctccttcttgccctttgccatgattgtgaagcctcc

SEQ ID NO: 1129 - DNA, 273 bp, Homo sapiens
atctcctattttaaatttagatcatgtttacgtgcaattcataaaacatcaaccagaagcttctatggctgcagaacaacacttccactaatgaaaactataaaagccaggtaaaataataatttaacaaaacagctagttgaaggcattagggagcaaccaaggcaggaaagacatcgggttttaacatcagagagagaagaaaaagcacgttcacacgaaggaaagccagatttttatcagcagcaaccagtatttttgttttgttgtttt

SEQ ID NO: 1130 - DNA, 549 bp, Homo sapiens
agatcatgtttacgtgcaattcataaaacatcaaccagaagcttctatggctgcagaacaacacttccactaatgaaaactataaaagccaggtaaaataataatttaacaaaacagctagttgaaggcattagggagcaaccaaggcaggaaagacatcgggttttaacatcagagagagaagaaaaagcacgttcacacgaaggaaagccaggcgaatatctctttataaaaaactatgtattggcccggtgtggtggctcatgcctgtattcccagcagtttgggaggccaagattccaagaagaaaaaatttcatttgaatttctctctgtttctgtctactttcttggatttttatggcaatcgtgctgaaggtatgaaagaatttgggaatgattggagctttttgcaatataaagactttacatccattaacatggtgatccagtagagaagaagagagatttccgtaggaaagaaactcagtatgtcaataaaagaagagtttgcagcagcaatgttgtcactacacagtaagcattaagt

SEQ ID NO: 1131 - DNA, 418 bp, Homo sapiens
atcatgtttacgtgcaattcataaaacatcaaccagaagcttctatggctgcagaacaacacttccactaatgaaaactataaaagccaggtaaaataataatttaacaaaacagctagttgaaggcattagggagcaaccaaggcaggaaagacatcgggttttaacatcagagagagaagaaaaagcacgttcacacgaaggaaagccaggcgaatatctctttataaaaaactatgtattggcccggtgtggtggctcatgcctgtattcccagcagtttgggaggccaagaacattttaaaatatatctcttatcagtgagtctggggcatagaggaaattgtttgccgttcctcagattccaagaagaaaaaatttcatttgaatttctctctgtttctgtctactttcttgg

SEQ ID NO: 1132 - DNA, 434 bp, Homo sapiens
atcatgtttacgtgcaattcataaaacatcaaccagaagcttctatggctgcagaacaacacttccactaatgaaaactataaaagccaggtaaaataataatttaacaaaacagctagttgaaggcattagggagcaaccaaggcaggaaagacatcgggttttaacatcagagagagaagaaaaagcacgttcacacgaaggaaagccaggcgaatatctctttataaaaaactatgtattggcccggtgtggtggctcatgcctgtattcccagcagtttgggaggccaaggtgggtgtttcacaagaacattttaaaatatatctcttatcagtgagtctggggcatagaggaaattgtttgccgttcctcagattccaagaagaaaaaatttcatttgaatttctctctgtttctgtctactttcttgg

SEQ ID NO: 1133 - DNA, 423 bp, Homo sapiens
ggctcttaaaaaactcttttgaaacaatctataagaaagaaaatcttgattatgtgttctagtgcaaaagcagtggtgggacttttttttttttttttccttagagagaaaaagataatacatcacagaaaatctacatcaaatagttcttatctcttttggatgtttagtctggacatccttgagacatggacttcaccatttaaatatttgtaataacattaatcattagccaggcacagggctcatgcctataaccccagcactttgggaggctggggtgaacagatcacttgagctcaggagctcgagataagcctgggcaacatagggaaaccccatctctataaaaaaagaaaaatatgggcaaaggatatgaacagacacttctcaaaagaagacatttatgcagccaaaagacac

SEQ ID NO: 1134 - DNA, 499 bp, Homo sapiens
ggcttggctatcagctcatggtctcaccttatgccaattgtttcttccttccaggattcagttgcctgtctgaacagtgactaccatgaactctacatgctgtctacttctaaccctctttggcctgactccagcttcaacacctggaaacatggcaaaaagaacagggggacattggcttggactggagccacgtgtcagagtttgactcaaggatagttgatgtagaatgaagagaatgagcagggaacaagagaaggaagtcatctctggagataaagagagtgagcccaagccacagaaagaaaaggagaatgaagactgggtgctgtggctcacccctgtaatcccagcactttgggaggcccaggcaggtggatcacaaggtcaggagatcgagaccatcctggccaacatggtgaaaccccatctctactaaaaatacaaaaattagccaggcatggtggtgcacgcctgtagtctcagctactcgtgaagc

SEQ ID NO: 1135 - DNA, 271 bp, Homo sapiens
cagtgactaccatgaactctacatgctgtctacttctaaccctctttggcctgactccagcttcaacacctggaaacatggcaaaaagaacagggggacattggcttggactggagccacgtgtcagagtttgactcaaggatagttgatgtagaatgaagagaatgagcagggaacaagaggtgatgaaacagaactgagatgatagagtgtccagcgtgggactcgccaagaacccataacggcgccacaagagaaagcccggttatcc

SEQ ID NO: 1136 - DNA, 4231 bp, Homo sapiens
ggacaacgaagcgcgtccggtgatttcaaggtggggctaggagtcttgtgagaggaaactcggtcctgaccctatgcaacgtgttggaccttccggagcttctcagaagacagagggttttcttttgaggtaaatttgatagtacattttgatagtacaggaggcgatacggcatggtgacagaaaagcgccggcttggttagcgggaccacctggcagggctgcaggctgtgccacttaccaggcaggggaccttgggccagctgcttggcctcactcaccctgtttcctcagctgcaattgggatgaacagactgcctgcttcggggttgcctaaaactcacattgcttaatgatgtgaaatgcttagcgcagtgcctggcatagagagaattctcattagatgatacctcagctgggctttaggagctacagaagaagctgcatctccatgagctcagcgtgtttctagctttcctttttgttttctattcaacctttcacccaactcagcttctcaatccctaaatgacaaaggtttgggaaggaagacttggaccgatgcttgcatttgtttctgagaattaaacgttatgttttcttcaatccaaataggtttgcttgtacagccttgttcaatggtttttttttttttttttctccatgataaatgactctcaacttcttttccctcatttaattgcttatctacatacaatgcctggaaggaaataaatgtaatggcccgtagcagttggccttcaggtatcaagtttaagtccctttaagcagaacagcaaattgagcacagaatgaactggtttcatggtagcgtactgcaattagatgcaagaatagggaaagcagggtgcttcaattggtgacacaattagtatagcactgggggacttctctttccacttcttcaactccgcctgcattccgctggctgaagagttgatgacatccctgaaaaatcttccctctcttgtttctctgatgccacctctgtgttctccgcctcactggccacacttcctttacctcccaaacttttaactctgagtgtcccaaacttgtctcatcacctacccctgctgcccagctccccagcctgttccccttctgacacgggcactctccttctgctgtcttgggagagaaacaatgaaggcctagttggcacttttatttctattcaaggaaccagactgtgaacaagtttaccatttagtcctttggactgtgtcttgaattcatccctcttctccattctcaccagcaccatcatcatgatggctaatatttcctgagcacctttcatccaggcatgatgccaggtgcaccaacttacttaatcctcatagccaccacctgagcaagctcctgttttataaatggaccagttcttgttgctattgtacaagttattttctttctataacgtcctccttgtcctccttccacattcttaaagaaacttgcccttcctttaaagtactcagggagccctgcattgcttcttgaagccttctccagcttcatcatctcacagtggtctctcttttcactaaatgtccaatatgctgcacataagtaccccaaagttagcacagaattgttccatggctgtcatatatgttaaaaatcattaaaagttcattttttctctcattatgggaaggatacatgctcctactagtaaatttagtaggtagaaaaaaattatcactatctagactgctttccatttagtctttatgcatagctttctgtctgcctatttttaccttgtgtttgtaacttactattataaaatatgcgtctctatgtgcattgtcaacattatttacaataacatggagtggattgacacgtattctctatatttggattaaaggagatagagtatgtgaaattaaatgggagaagtatctgatacataacaggcaatacaaatattatcacatagcgtcaacttatttgtgaatattgaaagctccaaaaaagaaaaaaggttttttttaattcccgtaatcacttattgcagtattgtgtacatacaaagtgctcaatcattttggaggaataacaattttttttcctcatcatgaagtaaggtatgctcactgcaaaaaatctagaaaataaagaggaacatactaaagaaaagaatactcccatataatctctgtcttcataaataatcttttgtaacacttatacactgctggtgggaatgtaaattagttcagccattgtgaaaagtagtgtagcaattccttgaaaaacttaaaatagaattaccgttcaacccagcaatcccattattgggcatatacccagtggaatgtaaatcatcctgccataaaaacacatgcacatgtatgttcattgcagcactattcacaatagcaaagacatggaatcaacctatatgcccatcagtagtagactgaataaagaaaatatggtacatattcaccacagaatactaagcagccataaaaaagaaaaagatcatgtcctttgcagcaatatggatggagctagaggccattatcctaagcaaactaatgaagaaacagaaaaccagatactgcatgctctcacttataagtgggagatacaccatgagaacacatgaacacaaaaagcggaaaaagagacaccatggcctacttgagggtggaggctgggaggagggagagaatcaaaaaacttcctatggagtactatgcttattacctgcgtgatgaaataatcactttgaacgtggtcagtacattatcttctaatctagactcttttctatgttctatatacacacagaaatacacatgcaaagctgaacacatgtgtgaaacaaaattcagacactcaaattttccgccaacacgtgataaaatcttgcacaatagcttcctccacagaggaaaatgtctttactacatcttaaaaatggggtaaatgaatagttaggctcttcagtgtaataatcatgataaatattctcaatatgcgaaaatacaaacaaaggactttctctcccagcaaatttagacccacatgaaaatttaagcacaatcattttaaacgaatttatcctggagcttagtggttcgagttcaaggttgaggagcagtctggggacatcagctcttaatatttttcaagttttggagcaagtggtttctaggttctgagtgaagtgaaacagaatctctaggggcatgtggtaaagataatcccatactatgtactgcgtagagttaaagagaagaggcgagagcatgaagataaaccagtacaatcagtcgttcacataccactaactacaatgatactcccatttgcttcctgtgaagtagttactaataatcactgatgtcgctttttaatttcatacatcctttaactgtcttcatataggtattgaaagagtcaacataaaagccacatccattttctaattttgaacaatagttagagaaacctaatatcttctcatatttttgtcttgcttctgtctcatgagttcccaaaatagatatattatctgaatgaagagttcatgggcaaatgtcacacttttcttggtttggctaattatatttctgcttttgcttagaataagattaattttcctattctgctaataaaccacgtgatggcaaaatgccttattctgagaaaagaagcctttggtattttaaagaattgggaagctatttcagataagctatcatatgcatgaagattaatttattcatatgaaatgttcaataaccagaaaagactgttttaaataaaaccatttcacaattaagtttttttttggttatggacagtgatttcttctaagaaacaaagcgcctgtctatatgaagaataactaaaataatggttagcaaatattgattggatccagccaagtgagcagcatttttgagtttacagatgtggtaactttgaactatatttacgtgcttataatgaaaccttacagttggagtaatagctttgttcctgagtctcatgaatattttccagctcctttgtcctaaatttctgcctgacaatcatccatttcaaggaataaaaggatataataagtgataaacctatgctggaaatttttaatctaaaaagttcacatactgtttctaataaactgaaaactattagagaaagatggaggtattaaaacctgttaataaggaaatcaatg

SEQ ID NO: 1137 - DNA, 680 bp, Homo sapiens
ggattcctccacccacttacacacacacacacacacacacacacacacacacacacacaaaataaaaattaaaaataaaattaaaaattaaagattaaaaataaaaaaaccaaaaaccaaccagacggtgaaatagaggtccatagtgattaaaatttgctgaagattacagaaatagtagagcttggcctactgccccttctccaacacccccagccctgcccataccatctcctgctaaacaacctggacatggacttcttaattttactaatcaattatctctttttctcttttctgatcttttgtgtataggagtaggttaatgaggaggctttttggcacaagtgacatgatcccttgactcacgtatcttcaactacaaaggaaatagattatcctacaatacaagatgcaagtgatgaacaagacaagacaaacatgatttctgctgtcatggagcatgagtgctggagacattttcacatctctaccctatcagttcatagtaacaccccagctggataattttggactatggaaatgatgttagacaaaaagcaaatttgagtgattttcttattcgagttcaaaatgggttgtaaagcagcggagacaactcgcgacttcagcaacacatttggcccaggaactgctaacaaatgtacagggtagtggtg

SEQ ID NO: 1138 - DNA, 355 bp, Homo sapiens
gctgctgactcattcgggtggtgattgctgaaggctgaggtggctatgccaatatcttaaaaaaagacaacaatgaaatttactgcatcaattgactcttcctttcacaaaaggtatctctgaagcatggatactgtttggcagcattttacccagagtagaacatctttcaaaattggagtcaatcctttcaaattctgccacttctttatcaactaagtttatgtaatattctaaattcttttttttttttttttttttgagatggagtttcactcttgttgcccaggctggagtgcaatggcacgatctcagctcaccgcaacctccgcctcccaggctcaagcaattctcc

SEQ ID NO: 1139 - DNA, 523 bp, Homo sapiens
ggcaaagtgaagtgatgtcacagaaaataaacagctttctgctttcaccgggaggccctttaattgttaccaaaaataggacggcattatgtcttattagtgagtgggtgggcgggtgggtgggagcagtcatcttgcataggatgtcggcaatctcagaaacctctgggagtctgcttttcatgtagcaaacaacctagtaagaaaaactagctttggagccagccccggctggaaaaaatgaagctaaatgaaactctctccacaatattgggctaaaaccttttgatgtttcttgctgagcctacctggctaatgccatcagtgaaagacaaatcagaacagatgaagaatgtgactttcaggggatgaatggaagcgcctcctctggctcatgctggtgggagaaaatgaaccagccctgctttctctccctggttcaattcccagcaaaggaaaaacaatgtaattcatgatgatgatgacaatgacaatgacgacaacaacaataaccaacctttaa

SEQ ID NO: 1140 - DNA, 1589 bp, Homo sapiens
ggcctctgcgtgtgtgcgcgcgggtgtgagtccgcggagtgtgtgtccgtgtgtgcgtgtgtgcgcgtgtgcgtgtgcgtgtctgtgcgctcccgccgccgtcgccgagcgcccccctctccgccctcgcgctcgcgctccctcgcgccggcgccggctccccagcccaagccgggcagggccgggctttattaatatgctaattgtcctgctagtgggaggggagagccgtgtcaaagtgacccgggagagcgcgcagcaagcgacgacgtgcgtgcgccgcgcggcgggcgggcggcgaggggctgggagcgctcggggaacggcatgcatgtgacgcagcttttaaaaaaggagacggaggcagagaccccagagagggagggcgaaggggagggcttggaggcgcagccgcgcgctcggtgtccgtcctccgggtgccgccggatggggagtctggctgagccggagcgggagccgcggctgggggaggcggagccggggtgggcagtgtggtgtatctctctccaccccgggccgcgctccgggagggaaaagggactgcagaccccctgtccgtgctccctgctgagacgccagccttcttctggaggccccttgtttcgcgtccctaccctaggctggatgggtaaagaagcattctcttaattcttgtagcaacccctcaactcaccccttccctaaattaaccactcctcctttgcctgcgaaaccagttgggactagaactaaaagggttaattaagtggggtccccgccctcctccgcctaagggcttgggatctgtgttttgctggggggagggggctgcggaatgaccaccagattggattacggaggggcgataggaggccatccttccttcttgcagactgacgcatcagtcaagacactctcttcccttcccccctttctccagccttggtgccttcacctccgtaccaaccgcccaaccccaccgcctccgacccccctgcctggaagctgctgtcctttgagggcttcggagatgagaacaggaaacaggcccctccagtgccccctaacccagagaggcagaggctgtgggccgtggggggttggatgggagatgatgtggatggtcaatgtttttgctgagggagcatgaaatgatggaacggtgcagagtccagggattgaaaagaaggcctgcctaggaatggagaccctccccaccatgtgcttaggatgggggataggggagcttgtacactgtggagtctcccacccccaggtttccccatctccacccccaccaggagcagagaggacctgactgaagccatccacactcacacaagtatttccttggcagcatcccctgcctgagtgcaccccctccctgcattctcccagacaaaggtcagcactagagggagtagagagaacataaggcaacagaacactggcccgaaattgtggatacctaggtttgaacgcaagattcgctcctcaatacctgagtgatttgagacaactgaccaccccacctgggacactagctttatcctctgtaacctatggcttggccttttacacttgccgac

SEQ ID NO: 1141 - DNA, 2003 bp, Homo sapiens
tggtgagattcgtgtgacttttaatttattatgttactaatgtcttacagtaagtgtgaggagtaaagacagggatggggtaaaggtaaggaaaagtatttttcaagttccttgaactattgaagcatgtgctaggataagaaagttcagtaaaagcatcatgtccttatcaccagagctcttaaaggagacatggaacagagacggggcaactcttcagctctggccgaagtgactgctggacagagaacaaatcctgcatcagccttggcacacatgaaagactgggcaatgcagatgctacacagttgggcagatgaagagctgactgtccagaatctacttctagcaagcgagtaggcgcatgcacaccccttctctggtctgagtgtctcttcctctccggcaggaccccaccaactgtgcagccatggggtaagtgttagggaagtcttttagaaaagagaaagatgtctttcttatatatacgctggtagtgttgattgaccagaagtggtttcttttactttggggcggtagcattgtgttctggtgacaaaatatcctacacttagcactcgtaaaaggcataggagagtgaaagcaacgcctctttatgacctaggctagtgggaaggggaatacgtggattctaagggtaaggggatgaaaaagctaattctatatcaccacaaatgaactgacacataaatgacaccttggctttttccactcatagaaacactcacttcttctagcttacactactaaatctaaggtcggcttcatcacagtttgggatatttactgtgcttctaaagtaaaggtgaaaagctacatccttaatagtttttttcctaattaaatagatttgtgtaagctgaaagcctaaagtctagggattctttgcattattttatatgttgggggaaacccttaaaattcatcactgccatttttttaacctacagaattgaaagaatatgaaatgggcagggataagtaattacacgaatcatagacatggtcaacatgcatctaattttacccactgagcagagcgcgaatgggggtaagttcttttgagaagaaccaaaatgtgtttaaaagggaagaatactacactagactatttttttcctacatagaagaaaaggatatatggaattgaaggaggtgaaaagtgtccattaaacaaacacctattatttgtgaaataattctatcagagtggaattgggtgtggaccattagtttatctctggcagtgatcttatgttttaggtatctagagtaagattatttagctgggtaatggctgggtagcatgaatagttttaatttcagttcacagcaaatgacgatgatcgcagatttagcaccttagtttgtacttcctctgcacctgaatcatcgatcactgtgaagcgtgagctgaaggtcagaaagctgtattcttagataactcatctgtgattgctccaggactgcagtttacttcaatctaaggggtggttttcttattagagaatgtaagtattcaatactaaatatgagactgaagccttgaagacattttatagtggtggcaggtgttatagttcaggaataggctgtttaacaagtcaaatgcatatcattccctcttaagcattaactttttcaaagcaatggaattatattttttggcttgaaatggtggtttcttctatatttgatttctcggttttcttagtagatattactgtctcctctaatatttcttcaaaactttcccctatctgggaggttttcttagaggctaccttagatgcctcctcctcctcctcctctttcttaagtgatagcccagtggatgagactttggaggttgtagcactgaggattctaggtgggagcagatcattctccagctgcccaatgctatcctgaaaagtaacatatccaaaatagttaggccaaaccagctgaaattcctcaagatttccagaaggcaaggattc

SEQ ID NO: 1142 - DNA, 951 bp, Homo sapiens
tgaaaccctgtacagatgcgtacatctccccattaacccttggatcatcagagccaagctttcaatatggtttgtcttctttgctggtgtgcgtgaatctctgagccataactggggcgtgtggtgaaacgatggaatcacggacttttaaatattaacaggcaacttaaaaaagcccattccaaccacctcatccaccaggtgagacaagacgaaggggccgtgggtgacacagcctgtggcaggcctatttctgcagtcccctgtcaggcacattcctgtatttcaatgggcacctaacacttcaccatatctcccacgtggggaaccaacacttaaaaggtgatttgtgtaaacagaaacctccttttcatgctcattgatagggataaacaaggaagcacctctggaagaggtaacactactcacttaagttttaaggtatcagcatgtatccaaagagaaggatttaatcaagggagggctgaaggagaggagaaaacagaagagaagcagcagaagggcagtggatgaagagggcgaggtcaaagtcagagaggcctagggacagctacttacagttcaggacctggactggcgccaggaatggactccaaggggtgagggcccagcttctccctgccttcctcccaaaatatgcagagacctaactggattccaagggatgagggcacagcttctcccccctcccacccatttcccaacatgcagagcccatggtggcaaaatcccctggctcaggctaaagtcagaactggtctggtttcctgtgtttttcaaatctctgccatttgggcagaacgcttggtcctataaaccaggagtcatcagtatccacagagaagttgcctcagcacttggacccaagtcaactgtgtttaaaatttcacaccaaatctataaattacacattcacattgtgggccagcc

SEQ ID NO: 1143 - DNA, 686 bp, Homo sapiens
ggtgagagttgggggtgagagagggatgagaagggaggacagtctagaatgattccggagagccaaactgatgctacatatcaggtttaacattttccatcctttcattttcaacagtactgtctcttcatgttttaggggtgttttagtaaaaaagaaaggaaaacttccatttattatccagtctgataatccctgtgtaacctagtgaatttgaaccatttgcatttatcatgtttactattatacttgaatttgattttcatttcttatttctttctcctttttttcatttaatttgaattaataaactcctctcctctcctttctccattactacttctgttctatttgttttctctactggtttggaagataaactttgttattttaatagttaaaatggatatttttacatctactttaaaagtttagtgtcaaaagaacttgttgggaggagaagccaagatggccgaataggaacagctctggtctacagctcccagtgagagtgaggcagaagacgggtgatttctgcatttccatctgaggtaccgggttcatctcactagggagtgccagacagtgggcgcaggacagtgggtgcagcgcaccgtgcgagagccgaagcagggcgaggcattgcctcacttgggaagcacaaggcgtcaggaaattcccttacc

SEQ ID NO: 1144 - DNA, 754 bp, Homo sapiens
aaaggagccacttctctctcccgatgtacagaccaccttagcgctggtggaggaagacggccaacatcacaaagagaacctgtggccatttcccgggctcccagtttgagaagcgcgacgccacttcggtgactaaatgcagaaagaaacccgaaccataaagtgtgtcttcagtttggcaacttgtggtacaatttcatgaaatgcaattaatttttctagtcctctgtggctacaagtttcattatctattatctaaccagtcaactttggttacctgccagtagcatccacgggaaagagacctcttgactgatttcttcagtttcatgttgaaaagcccttcccctgaaaactgtttctagttactccaactgtcaattgaattatggtgaaaaaccaagagtgtttgcaaaacggagttatgtgttaaaatggtgcaaggtgcttctcatttaatgcagattcgttttcccactggtttcttcttgctgtgtgttctgcaggtcttggaagaaaccatcacaccgaggtcatttctgagcacagcgtggaagctcctatgtttgcagattgattccttggagtggaattagtaaaaaggatatgaatatttttagtctcttgatatgttagactgatttccagaaggcttgtaccaatttactcttctaccgacaactactctcactcttggtgcccaggctggagtgcagtggcacaatctcagctcggtgcaacctccgcctcccgg

SEQ ID NO: 1145 - DNA, 358 bp, Homo sapiens
cccctgacctgcaaacttttaacaccttcttctcttcccgtttcactaggctatttgagatcctgcaagatttatcaagactgtactagccatatgaaagcatgttaacacagggagggagagaggaaaagccctccacatgttatgactggcatacatgcttccaaagcatcgttactaaccgaaggcccagttcctgaggcgatcaccccagacacactgaatgcaatttgttggtcactgagagaacagcacaagaaaaacccacccccatgacttgattacctcccacaacacgtgggaatcatgggagctacaattcaagaagagatttgggtggagacacagccaaaccacg

SEQ ID NO: 1146 - DNA, 610 bp, Homo sapiens
gttagacgtcaatacacgcttttcagaaaagagcctgctccaagctcgtaaaggtggacagggcaattccagcctctgcattatcatcatttcctcctgatcagggtggtaacacctttactctgccctcaggtgattccagctcttcatatagctgctgcctcacagaattaggatgagtagtgggaagaactgagtgtgggaatgaagcagatgggacagagtccaagaacccaaaagcaaggaggaagagacagtaccggggcatgaatagccttggagggttcctgacgccagcctgcagttcctggagctccagcacctcatccacaacatttgcgaatggacaaggcaggagtgaggaagaaaggtttcatcttcagagaagaggtatcagtagtgtaggggtgaaggtgatggaagaaacggttgtggaacaaaaggaatagaaagctcccggcaaggatggaggcagcactgtttgttggacaactgaattggcccaggtggcccctgcactctcagccccaccctctcctcctggcaagctgcacccccccggagcccatggtcagcgaagttgcggctgcaggagacccccgtcaagagc

SEQ ID NO: 1147 - DNA, 2882 bp, Homo sapiens
cttgtgttggatctgcctataggggcattgtgacatatttctgcactgatcacccaggtgatgggactcttgtctaggctctgtgtatgggggctttctgacatatctctgcactgatcacccaggtgatgtaacgcttgactaggctctgcctacggggcatagtgacatatcgctgcattgatcaccgaggtgatgtaactcttgtccaggctctgcctatagggggccttgtgacgtatctctgcactgatcatctaggtgatgtaactcttgcttacgctctgcctgcaggggcattgtgaaatatctctttactgatcaaccagatgatgtaactcttgtctaggctctgcctacagagggcattgtggcataactctgcactgatcacccaggtgatgggactcttctctaggctctgcctactggcggcattgtcacatatttctgcactgatcacccaggtgactgactcttgtcttggatttgcctatgggggcaatgtgacatatctctgcactgatcacccaggtgatgtaactctagtctaagctctgcctaaaggggcattgtgacagatctctgcactgatcactcaggtgatgtaactattgtctaggctctgcttaaaggggccttgtcacatatctctgcactgatcacccaggtgatgtaactcttgtctaggctctgcttacagggggtattgtgacatatctctgcactgatcacctaagtgatgtaatacttgtgtaggcttgcctacaggggcattttgacatatctctgcactgttaaccgaggtgatgtaactcttgtctaggctgtgcccacagggggattgagacatatctctgcactgatcccgaggtgatccaactcttgcctggtctctgtctactggggacattgtgacatatctctgcactgatctcccaggtgctgtaacttttgcctaggctctggctacacagcattgtgacatatcactgcactgatcaaccaggtgatataactcttgtctaggctctgcctacagggggcttgtgacatatctctgcactgatcacccaggtgatataactcttctctaggatctgcttacagggtgctttgtgacatatccctgcaatgatcacccaggtgatgtaccacttgtcaaggctctgcctacaggggcattgcgatgtatctctgcactgatcacctaggtcatgtaactcttgtctaggctctgcctacagtggcattgtgacatatctctgcactgatcacccaggtcatgtaactcttgtctaggatctgcctacagggtgctttgtgacatatccctgcaatgatcacccaggtgatgtaccacttgtcagggctctgcctacaggggcattgcaatgtatctctgcactgatcacctgggtcatataactcttgtctaggctctgcctacagtggcattgtgacatatctctgcactgatcacccaagtaatgggactcttttctaggatctgcctaaagggactttgtgacataactctgcactaatcatccaggtgatggggcttttgtctaggctctgcctaagggggcattgtgacgtatttctgcactgatcacccaggagacggactcttgtcttggatctgcctatgggggcattgtgacatatatctgcactgatcacccaggtgatgtaactgttgtataagctctgcctacaggggaattgtgagagatctcgccactgatcacccaagtgatgtaactattgtctaggctttggcctacagggggctttgtgacatacctttgctctgatcacccaggtgatgtaactcatctaagctctgcctacaggagctttgtgacatatctctgcactgatcacttaggtgatgtaacacttttataagcactgcctacagggaatttcgacaaatctctgcactgatcacctaggtgatgtaactcttgtctaccctctgcctacagggggcgttgtgaaatatctctgcactgatcacccaggtgatgcaactcttgtctaggatctgcctacagggggtattgtgaaatatctctgcactgatcaactaggtgatgtaactcttgtctaagctctgcctacaggggcgttttcacatatccctgaactgatgacaaaggtgatgtaactcttgcctaggctttgcctacaggggacattgtgacatatctctgcactgatcacccaggtgatgcaactcttctctatgctctgcctacagggggcattgtgacatatctctgcactgatcacccaggtaatgtaactcttttctagtctctgcctacagaggacgttgtgacatcactctgcacggatcacctgggtgatgtaacacttgtctaggctctgcctacacgggaattctcacatatctctgcactgataacctaggtgatgtaacacttgtctaggccctgcctacaagggaattctcacgtatctctgcactgatcccccaggtgatgtaactcctgtctaggttcagcctacaggagcgttttgacatatctctgcactgatcacccagatgatgtaacacttgtctcagctctgcctacaggggcattgtgacagatctctccaatgctcactcaggagatgtaaaaattgtctgggctttgtctacagggggctttgtgatatatatttccactgatcaaacaggtgatgtaacccttgtcaaggtttggcttataggggctttgtgagatatctctgcactgatcagcccaggcagggaacacttgcctacactctgcctacaggaggctttatgacttatccctgcactgatcactaggtgatgtaacaattgtctaggctctgtctac

SEQ ID NO: 1148 - DNA, 1648 bp, Homo sapiens
cacaggtgagccccccctcaccaaggccgctgtgagaggtggctcaagctgggctcctgaagtcagctgtgccccccacccccaggagcaggcggggcctgcaactcgcttccaacaggagagtggggaggcgcttctgaggccacagaaggctactcctgtcttgctggcaggctcaccccaacatgcagaggccctctgctctccagctcaagagcacccgaaccccacccaccagcgcgggggccaggaagcccagccgtgagaggaccatggccagaggcgcctctagcacagcccgagactcaggcagagcgcgcctgggtggctgttcagaggtggcacgctctgctggcgtcccctgccgttgctgcctggaggtggaaccaggtgtgctgagaggcagaggcagggaccgggaggaggggccagcagggctggggctcagtggtgccctctcccgactgattctgaggcccctcccagcggcctcacaactcccctttcccttgcccattcctggagctgcctcctcggccactgtgcggcctgggagtcctgccggacaagcacggggaccaggtccaaccctcactcagcccctcgacgcctcctcagtgtcctgccggtctcggcggctgtctgttctgggttcaaaactccgagggccaccactggccctgaccttaccccagccccatgccagggcctggagccaggaagtgcacaaagcagcctggcagttctggaagcacagtccacagctggccacatcttcatttcccggggtctcctgtgaagtgactccagcctgaccgccgctctctgccgctgcctggcctggggtcacgctgcaggctcatatgtgtacaccgccagtcgcctggtctccgagacactgcccagtgactgaggccatcgtggagaggagggagagggcctgggcgctgggaaggggtctctctggggacatctttgtccagacaccagtcacagcggcccccagggcatctcagcacctgggcgctgtagagtctctgcagtggcacctctcacggctcagaaaggcggcggggccagacctcggcttggctgctccgctccgcccctgcacacgtgttcccaccaggcctgctgcccctttgttcttaacacgggctgctttctccttgagacctgagcgacccggtctctgcccttggcgagctcaggccctggggagactctgcccagtgtaccccctgctcgcctccagccaaccctaggctctcccaaggcctgaagcttctcaacagggctgggggctcctcccctggctggccttcccctcacagccgggaattcgaacttcagagactcagtggccgagacgggcctgcctgcagtgggaggtggggccacgtggagaaggagcaccccgttggccataggggaagggttccatgcccctctcccggccagcctggtgtcaggtaccaggaggcctccagcaggggccacttactctggggacgactctggtgtcaggttggacatctcctccggcgtcggaactgtgcacacaggatgaacaggaggaaaggcgtggtgaccgctccatccttcccctgccctggccaccttgcgccgaggtcagggtcatcaggag

SEQ ID NO: 1149 - DNA, 467 bp, Homo sapiens
tatcaatacaattagtcttgaaattactgaaaaaagattaaacgtaaacatattcgtgtatacatatatgtgtatgatctattatttacagtgtcagaaaaagaatcctagcaaattgaaaattaatactaaaagtcatacccactaaaaaataagattacacctgtaccagtggacttggagaaatttcctcaaggctctggctagtgtgaaatgtagatgcagagaaatgagccctgtgctcctaccacacacacatacacacacactaacatcgtacacacatacttaccctcatacacacacatacacacacacactcaccctcatacacatacatacatacacacagtctcacacacaattaaaaacacaccttacacacactcatacacacataatcatacaaacacacacactcatacacatgcatacacactcatacacacacttatccaaacacaccc

SEQ ID NO: 1150 - DNA, 481 bp, Homo sapiens
atcccccatcacggagtgtcctggtggcggtgtacggtttcgcattatggtcttcatccctccatcaaccttaatcacatactgcatgtgaccagcaggaagaggggtcttgagaataggaggggagatcaaagaagacatcgtcgtctatttgacatcaaaactggccagtaagtgcacaagaaatgagctgggttacctggaacctaaccttgggaagatgatctgtcaatggagctgtatgtctgtgtgagactggattttcctcatatactgtgaacaaaacaacatataacagattgactgcagaaacaggtcaagcttgtctaccaataaggagaggcacaggtacgggacacttttgaagggtttgttcgccttcagacaaacagcagacacctccacgctttgttttccacggcagagatggctagactctctttttggtcccagggagtggagctggctcgctctacacgct

SEQ ID NO: 1151 - DNA, 2420 bp, Homo sapiens
tggtggataagctttttgatgtgctgctggattcggtttgccagtattttattgaggatttttgcatcaatgttcatcaaggatattggtctaaaattctcttttttggttgtgtctctgccaggctttggtatcaggatgatgctggcctcataaaatgagttggggaggaatccctctttttctattgattggaatagtttcagaaggaatggtaccagttcctccttgtacctctggtagaattcggctgtgaatccatctggtcctggactctttttggttggtaagctattgattattgccacaatttcagagcctgttattggtctgttcagagagtcaacttcttcctggtttagtcttgggagggtgtatgtgtcgaggaatgtatccatttcttctagattttctagtttatttgcttagagctgtttgtactattctctgatggcagtttgtatttctgtgggatcggtggtgatatcccctttatcattttttattgcgtctatttgattcttctctcttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattctggatctttcctgctttctcttgtgggcatttagtgctataaatttccctctacacactgctttgaatgtgtcccagagattctggtatgttgtgtctttgttctcgttggtttcaaagaacatctttatttctgccttcatttcattatgtacccagtagtcattcaggagcaggttgttcagtttccatgtagttgagcggttttgagtgagtgtcttaatcctgagttccagtttgattgcactgtggtctgagagacagtttgccataatttctgatcttttacatttgctgaggagagctttacttccaactatatggtcaattttggaataggagtggtctggtgctgaaaaaaatgtatattctgttgatttggggtggagagttctgtagatgtctattaggtccgcttggtgcagagctgagttcaattcctgggtatccttgttaactttctgtctcattgatctgtctaatgttgacagtggggtgttaaagtcccccattattattgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttcagcctatgtgtgtctctgcacatgagatgggtttcctgaatacagcacactgatgggtcttgactctttatccaacttgccagtctgtgtcttttaattggagcatttagtccatttacatttaaagttaatattgttatgtgtgaatttgatcctgtcattatgatgttagctggtgattttgctcattagttgatgcagtttcttcctagtctcgatggtctttacattttggcatgattttgcagtggctggtaccggttgttcctttccatgtttagcgcttccttcaggagctcttttagggcaggcctggtggtgacaaaatctctcagcatttgcttgtctgtaaagtattttatttctccttcacttatgaagcttactttggctggatatgaaattctgggttgaaaattcttttctttaagaatgttgaatattggcccccactctcttctggcttgtagggtttctaccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccccctcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccag

SEQ ID NO: 1152 - DNA, 699 bp, Homo sapiens
caaaaatttcgctttgatgaacaaggcattcctttactacatcatagccatttagaaccacagttgatatgcctccaagatctaaactgaagatctttgagaagagaagaaaaacaacatttaaatgacagcatgtatggagaaatataaccatggaaatctacaagtgtcctaggtacaactttccagaactttttggaagcacaggagggaacaatattcttcaacctccaaaaaaaggtatagtattttaacaatttatgccaactttgagactttgtcagaattggaaaatatctctaagataatgggagatctttagagatgtttcataccaggataaagatcaaatgccgctgtagcctagagttaatatgtttggtggttatcaactagatctaaggcatagtgaggcaaacaatgtctactctttgatgcatacattctttttcatttttgctcctttcagtttttcctctgccccattgcagctagtaacagtttggccctatttcatttgtagtcaagagctctctctgtaaagaaccatggttccctcaaacagtggtaccagcaataaaactatgataggggacttagaaaaccccctgcccaaaagaaatattcatagtaataccgagtgtctttcagttcaaatatttatataagaaaagcttaattcctttttctgtgagaaac

SEQ ID NO: 1153 - DNA, 1663 bp, Homo sapiens
ccgtccctcccctgccctccccgctagggtctatggcgcctcttgaagggggtggcagctgccagtccctgcctcccttcccaccagcatgcttgctgcctccccagcaagaaaagcccagagtttaggtcatgagggggaggctttattgacaacggagaaggcagagttctaggcaagttcacacaacactgctccaagggtccaggcacgggtcaaacccgtcaggaccaagggcctcttcacctcagggacctcagtccctcccaccatcctgaaccttcccacaccttttccagcaacccaaagatatccacccccaagccaccttctggacaaagtgagtggcagccactgttgtggagccaggaccagagttgggtctgaggcctaatcatgtgtggtgggcacagtaccccctctcctcagcctctggggacaggcaggaggtaggcaggggcagcagccccagcccacagagccctcactgcacgaggccgatgtggcaaaaggcaggagccctggcatctcctcctccctgtgcctgagcggggctctacaaagccgagcctcctcaggtcaccttcccctgcttcctccccttccagacctgaaactggccctcggaggggagccctgtcagccccaggctgtccctgccggtgtaggctccacagcaccaaccctccagcgggaacaccctctctcatcaactgccctccctgctggccaggcccagcccttagccaggtgctttttcagggaccaagtagagctggggcctgaccacaggcacttcttggagccacagacgcaaagcagcagccctcggggattgttcttccccagccaccggcccagagtgtggctggtcaatcgtggggacccaggactggctggacgcacagctctagggcccagtacctcccacagcctctgcagccttgggcgggggagaggggtgagccagtcctgaattgggttgggaggagcagggacaaaaataacccagtacaggttcctgctgaggccagaaatagcatagtgacaaatgctgaacttgggcttggccttggccatgggcacgctgcgcttgcgcaggggcccgcgggctgaggcgagggtcagagcttccagtaggctgtggtcctcatcaagctggcgggccgtgcagagtggtgtgggcactttgacggtgttgccaaacttggagtagtccacagagtaacgtccgtcctcctcagctacaatgggcacaaagcgctggccccacaggatctcatcggccaggtaggaggtgcgggcctgggtggtgatgcccgtggtttccaccacgccttccaggatgacgatgatctcgaggtcctggtggtggtgcaggtcgctgggtgccaggtcgtagagtgggctgttggcatcaatgacatggtagatgatcagcggggccaccaggaagatgctgttgccacccacgccgttctccatggggatgtccacctggtggaggggcaccacctcgccctcggggctggtggtcttgcgtaccacctgcatgtggatggtggcgctgatgatcatgctcttgcggaggtcacccacacgtagcatgaagcagaggcggccgtggcgcagggcgatcaccgcatgcttgctgaagatgagg

SEQ ID NO: 1154 - DNA, 304 bp, Homo sapiens
ggatggggaaggtgatgaagagtaggaagacgtgcggcaccacgttgagcgcgtccacaaagcagccgttgttgaggaccccctggtccacccggtgaatttccaatggtgagattccaggcactgactagctgaaggcctcagcagaagtttttgtagggcacaagaggaagtgaccactacccaacagcagaacagtcactgttcttcagtggtggggagaagtgttctgccaacggcctggaatttgagacattccgatgggagctgccttgccctctagagcatatggtggaaacgggtg

SEQ ID NO: 1155 - DNA, 669 bp, Homo sapiens
ttcggtacacccctgagtcagagcgcttggtgctattaatgaggaactgggagtggtttttgctcttggccatacagacatctagctgccctgcaaccctgtgaagcatttatttgttttctcatctgtctccttctactagtacgcaagaccctggaaggcaagtccttgtgtcttgtttctataaccctaacacctccttttgaaattgccattgcaacaattataacagcgagaaaattatgacagtgaacgagatctgatctaaccaacccccatcttgcctttaccctccaaactgcccttaatcattcctggtttcagaccaagctaatgttgggagagacatttagtttatagcttagatgataacagtcttcccccaaactaaatcacctttgcgaagctaatgaaaggccaccaggttaggaggatgtgaggagcctgaattctgctaaggtgtagacataaaagattaccagccattattccagagatcacaagatttgcaactccccagctgctcctgcaaataacatcactattgtagagcctaagattggtggttgagatgtcttttcaggtttttgcatttctgacgactgatggctccacctggacctgctctccctccaccccacaagtcctgaggccccagtcagaagcagg

SEQ ID NO: 1156 - DNA, 222 bp, Homo sapiens
gagtgcagtgcgagaccggctggaggaggcggctccgcgaagccggtgtgggcgcaggtatgggtcttacaccatgaaggaagatgacagcccaggaggggagccaccgctgtgatgaacgcttgcaggagccatgaggggcggctttccgcgcagtgtttgcagtgatttatgggagtcaggggctgccagagagggatgtggatgttagcagcttggtgg

SEQ ID NO: 1157 - DNA, 2787 bp, Homo sapiens
atttattttcgtgtgtgtgtgtgtgtgtatctgtgcatatatgcaacaagaaagcatatttaaggtgagagtaagaattagctagggaaagacattaaataaagtgcatctccaccttttgaagccattaattaaataatgtagacctggcttcaaaattaaacatcactgtagtttataacttaggatggaatgcttgctctgcataagggtacagggtatgagccttgtcagaaacttttgcaattgaatttatgagagaaactggagaaaatttgagtctttaagcagacctatagagatcaaatttaaagtttgggcaatggctagatttgttttcttgtgaggatgtcagggtgactacagagaggagaattgccaaatatgtagctattcctctgccttctttatcatatactctaagtaaactggcttaaatccagtccttctctctccttttgcattggccccttttagaaatatgaaagttacagatgtaaattacaaagtaagccagtattacatgaaaacatgtttattgcctgaataataaaacttagctaaggagttattagaattaggattccccctacttgaagtacaagtttccaataaacagacagacagaagcaaaaccccaaatgagaaagaatacattggtaacctaaatcataggcatttgtgggtatgttcatacaatctacctatttctttgtaatttactatagcactgatgacaaagcatagacatacaatgagaaagagcaaatcagcatatcagtgtgactgtgcaaccactacaaagcttggccttcttaaatgtggccactttaacttacacacacccacagaggcatcagaaatctccctgcaaacacgatttgcctatagttttgtggcaatactgttacatagaacaaaaacaactctcagaccatggttaataaataagagagaaaagaagtaagaaacaacttccatgggttggcaggcatgcaaagcagcaccttgaacctcatttgaaaaacaggcaactgggatagcttttggagcccaggagtgaaggctagaggctgaaaggagctatgcactattatctttgggtatttccacataatctgcaggatggggaagtttaattccgcaccacataaactgtgctcttttagatgtggctgaaacgggtgtctctgcagaattagaaacccatctagaaatgacattgcttaaaattgttctttccaggtgacaattccataacaatcacataaataatgtacaaaaacaaaactaaaaacaaagtcactcaagtgtccaatttttctcttttgaaagatgaccttagatgtattctcaaagtgcaaatcgggatataaaaaaatagtaggtatgggggaaatgtagccccatcttctgtcccccaccctccaaaacggggctgatttgattccctctttctagcatttgtatccttccacctatactttaagataatcatttttcagccgacctagtcgggtcccatggctcctaatggtgagggccagcagctcgtatttgtccctgagccccacagagatgtccagtgtctccttcagcagggacctggtgtggaccagcattcccagaaagtcctcgttgagcctgctctcctgccggctgtcctgttcctggccctgcttgaacttgctctccagctcagtgagggatttgtccgagttggagtaggcatccccgatctggtgggactcccgccgcaggtacttgccatagctctcttccccgtctaggtcgtaggagatgcttttgctgatgccctccagcacgcgcccagcatcctccacctggcggcccagcacggtgaactcctcccgcagggtgaggctcagcaggctgccaacctggctcccctccccctgggagcagcgcctgtggtcactcaccctgaagagcagctggcacttctcggggtcatcgttctcctcatagtccccatcgggcacgaagtagtggtgcagagtcccattggacatctctgggtagagggggccatcgaagtagccttgacacaggtggcagaagaaactcatgcagaagaacttcagaaacaccattctggatattcaggatggccagggaccccaggaggagactttttacccaggcacaaggaagggagtgtctttgcgagtcagcgtctccctgagacagcgtccgcctcagtcccagctggcttgctgctccctggcccccagtccccagcaggcttcatgtggctctgcacaccagcgtctgggtagcgcgcccgccgcagcgcaggatgcacccacccttgcgcccctcgctcggtgactggaactcctccggcacaggcgtagcggggaacccctcctccggggccctggcaagatgctggctctgttgccctcctctcggagtttccccttgctcccgggagatggagtgtgtagctggagagaaaggctcttgccccctgatagtatttcaatttctggactgggtgggaatgcggagcttttcctttggctaaagatatcctgaggatctctctgctctcaaattacagctggtttcgtcacttggaagccagggaacaagtttggaaaagaacctctcaccaggtctccactattaaagggacatggatgaagctggaaaccatcattgtcagcaaactaacacaggaacagaaaaccgagcaccgcatgttctcactcattcagtgggagctgaggaataagaacacatggacacaggaaggggaac

SEQ ID NO: 1158 - DNA, 2870 bp, Homo sapiens
cagaagaatatgaacatttatttattttcgtgtgtgtgtgtgtgtgtatctgtgcatatatgcaacaagaaagcatatttaaggtgagagtaagaattagctagggaaagacattaaataaagtgcatctccaccttttgaagccattaattaaataatgtagacctggcttcaaaattaaacatcactgtagtttataacttaggatggaatgcttgctctgcataagggtacagggtatgagccttgtcagaaacttttgcaattgaatttatgagagaaactggagaaaatttgagtctttaagcagacctatagagatcaaatttaaagtttgggcaatggctagatttgttttcttgtgaggatgtcagggtgactacagagaggagaattgccaaatatgtagctattcctctgccttctttatcatatactctaagtaaactggcttaaatccagtccttctctctccttttgcattggccccttttagaaatatgaaagttacagatgtaaattacaaagtaagccagtattacatgaaaacatgtttattgcctgaataataaaacttagctaaggagttattagaattaggattccccctacttgaagtacaagtttccaataaacagacagacagaagcaaaaccccaaatgagaaagaatacattggtaacctaaatcataggcatttgtgggtatgttcatacaatctacctatttctttgtaatttactatagcactgatgacaaagcatagacatacaatgagaaagagcaaatcagcatatcagtgtgactgtgcaaccactacaaagcttggccttcttaaatgtggccactttaacttacacacacccacagaggcatcagaaatctccctgcaaacacgatttgcctatagttttgtggcaatactgttacatagaacaaaaacaactctcagaccatggttaataaataagagagaaaagaagtaagaaacaacttccatgggttggcaggcatgcaaagcagcaccttgaacctcatttgaaaaacaggcaactgggatagcttttggagcccaggagtgaaggctagaggctgaaaggagctatgcactattatctttgggtatttccacataatctgcaggatggggaagtttaattccgcaccacataaactgtgctcttttagatgtggctgaaacgggtgtctctgcagaattagaaacccatctagaaatgacattgcttaaaattgttctttccaggtgacaattccataacaatcacataaataatgtacaaaaacaaaactaaaaacaaagtcactcaagtgtccaatttttctcttttgaaagatgaccttagatgtattctcaaagtgcaaatcgggatataaaaaaatagtaggtatgggggaaatgtagccccatcttctgtcccccaccctccaaaacggggctgatttgattccctctttctagcatttgtatccttccacctatactttaagataatcatttttcagccgacctagtcgggtcccatggctcctaatggtgagggccagcagctcgtatttgtccctgagccccacagagatgtccagtgtctccttcagcagggacctggtgtggaccagcattcccagaaagtcctcgttgagcctgctctcctgccggctgtcctgttcctggccctgcttgaacttgctctccagctcagtgagggatttgtccgagttggagtaggcatccccgatctggtgggactcccgccgcaggtacttgccatagctctcttccccgtctaggtcgtaggagatgcttttgctgatgccctccagcacgcgcccagcatcctccacctggcggcccagcacggtgaactcctcccgcagggtgaggctcagcaggctgccaacctggctcccctccccctgggagcagcgcctgtggtcactcaccctgaagagcagctggcacttctcggggtcatcgttctcctcatagtccccatcgggcacgaagtagtggtgcagagtcccattggacatctctgggtagagggggccatcgaagtagccttgacacaggtggcagaagaaactcatgcagaagaacttcagaaacaccattctggatattcaggatggccagggaccccaggaggagactttttacccaggcacaaggaagggagtgtctttgcgagtcagcgtctccctgagacagcgtccgcctcagtcccagctggcttgctgctccctggcccccagtccccagcaggcttcatgtggctctgcacaccagcgtctgggtagcgcgcccgccgcagcgcaggatgcacccacccttgcgcccctcgctcggtgactggaactcctccggcacaggcgtagcggggaacccctcctccggggccctggcaagatgctggctctgttgccctcctctcggagtttccccttgctcccgggagatggagtgtgtagctggagagaaaggctcttgccccctgatagtatttcaatttctggactgggtgggaatgcggagcttttcctttggctaaagatatcctgaggatctctctgctctcaaattacagctggtttcgtcacttggaagccagggaacaagtttggaaaagaacctctcaccaggtctccactattaaagatacttagcatcatggaaacatagaccaaaggagttttcttactgtttatgccaagtggaagaccaaggcctattttcactctatcccagaagaaaactacaacttccttcagttgaaagactggactgttggactcaagagctacattgcttcattcctttttctctgggacattcagaaatgacaacagat

SEQ ID NO: 1159 - DNA, 761 bp, Homo sapiens
gcaatggcctggtcctttctgccataccaaagaaagttgttttttgttttgagcaagagatcacttctgattttcctacctttgacatggaccagactaattgacaaattctagaaggacagacacttccaaacgtctcttgacatactggcttcacaaaggttaggaaagctgttatggggaggacggagcctttctcctcttcctgagaacgtttgaagaagaaaggggctactgagaagtctggtagattcagcagctagtaaatatcgtgtctaaatgggcatcttttattaaactctgaggcagggttggtgtgttaggccattctttcttgctataaagaaatatctgagactgggtaacttataaagaacagaggtttaattggctcatggttctgcaggctgcacagaaagcataatgacatcttcttctggctaggcctctggaagcttccaatgatggtggaaggcgaagagggaacttgcgcatcacatggcaaaagcaggagcaagagagaggcgaggaggtgccgcacacttttaaaagaccagatctcatgaaaactcactattgtgaggacagcaccaagaggatcgtgctaaattattcaagagaaatcctcccccatgatccagtcacctcccaccaggccccacctccaacattggggattacatttcaacatgagatttggatggaaacacattcaagctttatcagggatccatggagatgaccccatacaggttagcgac

SEQ ID NO: 1160 - DNA, 780 bp, Homo sapiens
ccagtaagagggtaactcccccaagcctgcctgtggctgctcatagcaggcggagcagggcaggccgtgagcagtggcccggaattaggaggtccagctgcctgggctgcccagaccacctgtccagcggttagagctcaggacccatgtgacaggctctgaagctgcagccccacaacggatggctacctctgcacagggaaagacctggatgctctattcattcaacagaatacagaaggcactgggaatagagtgaacaatgacaaccaatgcacagctgcccacaaggtgggctcctgggggagggtcatccctctgagaagagggcggcaccaagacccacacacctgaaaaatgtggtacttcatgtcgctgatctcgatggtcttgctgctgtccccatcctgttctgatttattggtcattagtgtcttgaacctggagcaaaggagacaaagcaaggtgggttttgaaccttttacttcaccactgtgtggcgatggcaccatctgtcacctgaccggctaccacaagacggaacattttaaaaattactgctgtgctcctaaaataattttcagcaagtgccattttacaccatcttaggaagacatctgagctgagcccaattctgtccccaccacccaccctacaagcgacctgacgcctgtggccagaatgctgactcttcattccaggatatttatgttttctaataataaaagcaataactaggccagaaagaacaccacctcagagcccccctttcctgctgcc

SEQ ID NO: 1161 - DNA, 2547 bp, Homo sapiens
ctctactaaaaatacaaaataaaaaaaaaaaaattagtcgggtgtggtcacgggcgcctgtagtttcagctacttgggaggctgaggcaggagagtggcgtgaacccgggaggtgaagcttgcagtgagctgagatcccgccactgcactccagcctgggtgacagagcgagattccgtctcaaacaaaaacaaaaacaaactaacaaaaaccacttggactatcatattttaatatatatatttcattttaatgaagagtgctttcttgtagacattgatgcagtacatagggctggtaaggaagtagtaacagtgcggagggggtaagtatgtcagtctggcatgttttcttctaaattaatattcaaaaaggtgccattcaaggaacacttttggtcataccttgcaaccagtactgagacatgacataaagttaaaactccaggtgcctttttgagataagtgtgaatccacattcacaacctgggttgagaaaggtcacacttctctacttactaaaatggagtccttcaatcttaagtcagcccagcaattcagttgtattgacctgatggaggccatccgaggtttcactgccattaggagcagggcttgttttatgcgctccgtgcatgctgatggtgcagggagtggtggaagatgtgccacctcaaatctggataattcctttaatcccttccttcaatacaacctgctcttaaaactgaacactgattttcattcttttcatgattagtgtttccccacccttatctttgcattcactccctctcataaaggatgcattttcagagtccagatggattaggataactgcttacaaattccatggcaatagttaagttctgaggaaaagcaggctttgtgataagaccactggatgtctttcaattttcaaaagtcagatttcattccacagcttgtcatacagtttacagaattatgagaatcctccctggattcacagtgtctttcttaatagagtcatacattaatgaatgttacccattatttaatatttaaatttcaaattctagtttctactttacaaggaaaaggacacgaagacaaaactgattgacccatggtcagtcaggagaaaatgtgtcttagctcctaatttagtgacctatatgctaaattacaccttttcatccctctgagaacataattctggaagcttgtataaacaaaataggccccaaattacattctcaccacagaaattagataatttatcaagtgcaaaaagaacacgagaatattctgcacaatttatcaaggaccttcaaataaatccattacaaaaaataccccttcaggcaaaataaataagactgaaattcagcataacaaatttgcaaagtttaaaattagcttaacgtgagggctgcaattccagttacaaagcaaatgtcccaagttcccccaaagaacttaagacaaattgattaaagttgttcagttattttagaatattttgtttagagaaaccaaacttgaagtctcattaaaagtaacatctatcaagtgataaagcaaatgtaacataatattactgcagattctaggtcgtagatgttcactatacaagtctttcaacatttctgcatgtttgggaaatttcatcaagtgctgaagaaaaaaagcaaaaaaagtaacatctgcgccttaccatctaaaatttacatgacaaggtaccagaaattggtcagcttcaactgctgctttcaataaatgttcattattacgtatttgagtgtgtgcaacgtgccaggcactgtggtaagaagaggggattcagcagcaaccagaacacatccccattccacacagtttaccttctcctggggacttgcatagaagagaactatggtcactgctgcttgggcgattgtccgagtgggacagcacctaccttcagagctgcagacagtaagagcagaggcacatgccccaacttccccatcttaaaggcagggctagtgtcctgctgagaaagcactctgagagaagaaaagcagcaccacatctctcatttcctaaaatgcttttcccacctagaattatttttcaggattttatgacccgaatttcctgtggggaaaaagctttaaaatattacacacacaagtgacatttagtgaaacaaccaggcacctccttgccaagtgtccgtttttgactgaaagtgaaggctgtatctcccagctttcactcacataaatctccctcccacctacaaaaaatgtatttacacacatccttcttttctaactgagatgcctgtcctctccaagattaacattctacctgtgctctaaatgttacctgacctgttgcgacaccccagagattttactcagtgatttttcttcatctttaaacatctcttcctctaacactttcctttagaatacaattattgaagtctttcccatcaaaaaaggacaaacctctctgaagagcttttgtctctctctagttaatattaataccattttttttaaagtcaagaatatag

SEQ ID NO: 1162 - DNA, 689 bp, Homo sapiens
attatacttgtatttggtactactgattgtgttttccttgataaaatgtagcatactccaggaaaagtaatacattttcaccccttgttagaacactcatgtaattcaagcaaataacacaaacacagtctgaatttcagtcttctagacccggttttccccaacatcagactaattagttttattccatctagccaacacctgcttgagaagaacatttagtgtcataaaacaaaccacccaccaagaaataaggaaactgagaaaagcccacacaccaacgtcatgttgccaagctcagctctaaaacaaagccttacaacacaccctggtggattctcttggaggaaactccattttctaatggatcctgaggagttctgtcttcttttttactcctactggtgatgacagtgtgcattggtgataaggactggacattgaccttgtgatgagaaaacagaatggggaatgaagcctgtccctggaaatgctggacagctgaagccacgatgacaaaggagaagattagaggcaactgagacctaaccaagtcacggacctggaagatgaaaagatggtggtgtaacatggctagtacttcgaaaactttgaagagcccttagtgatgctgtttgcagcccttcagtcctattcaacacctccaaaggaaatggtaaaccctgttt

SEQ ID NO: 1163 - DNA, 619 bp, Homo sapiens
ctccaggaaaagtaatacattttcaccccttgttagaacactcatgtaattcaagcaaataacacaaacacagtctgaatttcagtcttctagacccggttttccccaacatcagactaattagttttattccatctagccaacacctgcttgagaagaacatttagtgtcataaaacaaaccacccaccaagaaataaggaaactgagaaaagcccacacaccaacgtcatgttgccaagctcagctctaaaacaaagccttacaacacaccctggtggattctcttggaggaaactccattttctaatggatcctgaggagttctgtcttcttttttactcctactggtgatgacagtgtgcattggtgataaggactggacattgaccttgtgatgagaaaacagaatggggaatgaagcctgtccctggaaatgctggacagctgaagccacgatgacaaaggagaagattagaggcaactgagacctaaccaagtcacggacctggaagatgaaaaggattgggtcaattattaatgtgaaaaatgagccaccctcacatggggagttggacaactacatgcaagtgatgtgcaccttccaaaaaattcctgcc

SEQ ID NO: 1164 - DNA, 412 bp, Homo sapiens
atctggtctacttttttgagctgttaacatttttctgagagttaacttttcttgggaagaaatgaagtggaaatatggttgctgcctaagaagtaataataggagatacaggaagcagtttgaaatggaatagaaacaacttgtgatagaggacagaagccatatcagaagtcacggaattaattatgtgagtctgggatcagtgagagatgaaaattgagaagaaagaaaactgtaagactctgtgacttgaaaaatccaggagagacaggcaactgaattgctacattgtattttctcttaaacccaagaaaattccctgtgttagaacaacttgaatgaaaagaagaataaacaggtgtccaacaataacatttccaagataggaagaaagcgagggttcaaaacggag

SEQ ID NO: 1165 - DNA, 204 bp, Homo sapiens
caactatgtggtcagttttggaatacgtgtggtgtggtgttgaaaagaatgtatattctgttgatttggggtggagagttctgtagatgtgtattaggtccacttggtgcagagctgagttcaattcctgggtatccttgttgactttctgtctcgttgatctgtctaatgttgacagtggggtgttaaagtctcccattatta

SEQ ID NO: 1166 - DNA, 850 bp, Homo sapiens
gtggtggcaggcacctgtagtcccaactactcgggaggctgaggcaggagaattgcttgaacccgggaggcggaggttgcagtgagctgagatcacgccactacactccagcccatgcaacaaagtgagactccatctcaaaaaaaaaaaaaattttcttcaggtggaaccatttaatctggcaagaacaacttttcacatcttaccattttatgtctccacttgatcttgttctgaacttttcaacatacacactatcttaaaaaacaacagatgtaaatcaatgcttatgtaaaggaaagggtgagtcacaaaagcaggactcacatttcaggtacatttttccatgtatcaacatacctcaaattccctgaatgagccatgttgtcatcccctaccttggttcatgctggtcctactacctagaaagtgagagcttcctcactccctcctttgcccacttaattcctgcttatccttctatgaggacgagcataaactcccctcccccagcacagccagagccttcctcagtgggtccacgcagcactcacctcttaccaccaggtgctggaatgtctgtggaccggcctgagactcgataccccatgcctagcacttgaactgactggcagggggtctggctgaatggggaacaggagggtgggctgaaggatgagagcagggacaaggtctgggtgtgaaaattaaatttgatttggacagccggaaggaacccagaagagcactcaagccaagaagaaggtgagaaaaaatttcaatggcaagaaatcacaaaggagtagttctcacaggctaggaggtagcagaaccatccagggaacttggt

SEQ ID NO: 1167 - DNA, 450 bp, Homo sapiens
caaggtctttaatttgctgttactctgtccctgtgccaccattgtatattgggtgtgtgtagagtagggggtgggttggggggcagataatttttctttttagttcataggtcactggaccaccaagagacctgatggagatactggaacattggcgatcttgagctttgacctggatgtgctgacaggggatgtgaaaagtcaaggagaatgatgcaaaaatactcatgaactatccggtgctgaacaaatagagggaagataatgatgctgctgacgaaactgatgaagaagaccacgatgatgataattgtgctttgctcgtaaagttacttgatttttgactgactgattagatgcagtttccctgaatggagctgcctaccgccttccttctagggcttatccagacaaccttggcattattcataatagccaagatatgaaatc

SEQ ID NO: 1168 - DNA, 542 bp, Homo sapiens
agccaggggcctgggccagaggagagcaattgagcaccctggctgagtgaggggtgaatctcaggagttgaggacaactatttagagtaacactgcctccaacccccaagcctggttcaaggaaagactgaagtgggaggaggaggagcaaagacacataacgtttttctctatcaccaaaagaaaacctttaagggagcagagaaaatggcaagaaaggttctagccgtgtataacatgggaaggtcatggaatcaagctgagcctcagtttcctcatctgtgaactggagataatacttctcttaaagagattacatctcctgggcctccaggaacccacagatgtatagtgcttggcaccaggtaagggctttgcaacgaacgcatctcttctcatgaggcaaaacaggctcctgcccttgaggggttcatggtacccaagggaggatgaaaacactggtctctgctcactgctcagacgccacctcctccatgaagcctcccttgaatccaacagtttctccctcatttggacccccg

SEQ ID NO: 1169 - DNA, 952 bp, Homo sapiens
ggtcaggggaaggccacctctggtggtttgcttggaggggaaggagggaggagaggggagaagcccacagtgggcctggcggagggcctgacgggagctccaccactcttgcctgagagtgttccagccctgagccaccctcccgggaaaccccacagatccagtctcgactgtcccaatggggcagggaggaaaggtggccgctgggattttttttttcttttttctttttggtaataaaaaatttcttggtttaggcgaaatactctgtgcaaccgcagtaccgagggggagccctgcccccccatccaccctccccttcctttgcctccagtaggggagaggagaagggggaatctctgggcaggggtgaatgtgggagaaaactgagaagggccagggaggggagaagtgccagcaggggagacacaccaatccatcgctgcagtctcgcccaggtggggcggcgcagcggccggcagcccgtccagctggcccgcccccgccgcccccgctcctggcagcctgttaaagcttcagctcgttggctattttggaggcaatgtttttgaaggccatggaggtgcccgatatccgcttaaatcgaaccccgttgagagagagccgcggcagtttgcacacctccatctcccactgcacgaagtcctcgtggcccggcgtgccgtgcatgcacagcagcatgtacttctcatgcagctcgctctggcagctgttcgcgtccagcaccttgcggatctcccgcatcatctcgttgggctccatggagctcgtggtcttcatactccacgtgaagcggagggagcggggcttggcctcccgaaattcttccttttctttgtcgttgccgccactgcccaccacgtgaggtctgtggagagggcagaggcgggcgtcacgggggggctgaggcaccccaccccaggagagccac

SEQ ID NO: 1170 - DNA, 20455 bp, Homo sapiens
tgctcactctttcacagatgggaaggtgaaaagcaaaacctgagtgcggccatgggctgcactcagtaaaagaaacacctgcggcggctccgcgcctccctccctccctcccaggctcacctcctaccttccttacttcccttgtaaaggcatagccaggggacattgtcccccagcttcacatccacatgtctcctagcatggcacatgcatatcctgcccaaggagcatgaagtcagaccagcaaactgaacacgaggcacagtcctgcatgctctgggaccgagcactgagggggcccacaggtgagaaggtgctggcccttcagctctccctccctctgccttcacgagcagaggcacaagcttctgtgtgtatacagaaatttccagagtgagtctaggaaactcgagaggacatctctgtgtagtagggtgggataggtgagggcagggattttacttgcattttatacccatggcttgaatttttgactctatgcagatcacttttatcattaaaggcacaaatcttttcatctgaacagggaatctaagacctgtggacacttccggcaccctggcctagtggaaatggttctctgggtctgctgggccccaagcacctgaggtcacgcagacgcccgcctgcctcgccttccattctctgatctgtcagccaccgtcagctgtggattccttcctgggaactgccatcactcgaaatgaagtcggaagcacagggccccaccagcctttctcctgtcacttgactctaacctggagtccaagtcaccagggccccaggacccaaaggtacacaaagcccacctggaccctcagccggtacttgccccaggccaccctcaggatccacggtccacagcaccactgctgttggctcaggctctgcctcccctgggcccacggcgggtccgtgggagccccccacgagctctgctgtcctcatttgagagtcctgtcctggctgccatggagggagggcccctggagcccctcctgctagtgctaaggagctcagaagccctgcccagcagggtccagatgggaagcagaggctcagagaggactgtaacctgctcagggacacacatgtcaggccagggtgagagctgggtgccttctactcatcctgatgaatctgagcagaatcagccccccatttctccacaacttctctcttttacacacacacacacacacacacacacacacacacacacacacacacacacacacacacagtctgaggactaccaggtgggctccgagccaggtctgcaggcctcagacctctcaaaggggtggggaatgtgttgggccaactgcctttgccccctcccccactttgctcaagccccatcatccctcctcacacgtccatctcccctcacagcctcgcttcaacttcagcctccaaacacactatggtgcgggcacttacttactgcagcagcagagaggaaacattcacggccatctaagtcccaacctgccgatgaagcaacaaagctctggccttacaaggcctcagaaatgggggcagtcaaaacacactctgtaagatgagcaaagaattaattcagcgtgttagcaacagaacccttgggtgtgtgctgtgggataagcgagctacgcggggaaacgtgccactggcttccaggaaccactgcactcagccaatgagcagaagtaaaaacagtggtgttggcagggccaagggaaaacagcagccctagaaccatctggggcgcagggcagtgagagagccaagtgactggcccttccctctggccagtggggttgcaaaccaaaagctgccttgaggtatagaaggggatttgcccaaagatatttgtgactgtagaattcgtaaccacaaaatgctggtgccggcccacatggcccaggtggcagtgacaacctctcaccctggaatgccccagaggaccccaaccacaacaggtggattatttcagcccaagtaattgtgtccccacatagtaactaccaatcacaacagtgtaaaataaacacatgtacatgggcagaaagcagaaaagatataaaaatcattccaaattcagcagttgaaaataaccctcatagatatttaagtccagtgcaaacaagaagacagcggagtgtgtgtgcacatgtgtgcacacctttaggtctgcactgtcaacaccagacacagtgaagcccaagcagcaagcagtccacagacgggggcgttagtgtcgggaataccaatgggtcaccctgcatcaaaacacatggagcagactgctgagccagctcaggggaagcggagagaccccaggagtgacggtgagaatgcaactcacttgtcattacacaggatatggcagatcggatttgaccaacaaaatggggaggaactgatccagatgtggaatgtgacagagaatcccttcccactgccatggaacatttataaaaataatcatacgttaatcaatgaagaaagggagccacacatttaaaaaagcagaaatcgtacaggccacttcctcagataaccattctaactagggtcaaattatacatcaggactgaaaccacaaacatataggaaataagataaagtcttttggtttttttgagacggagtctcactctgtcacccaggctggagtgtagtggcgcgatcttggctcactgtaacctccacctcccgggttcaagtgattcttctgcctcagcctcccgagtagctgggactacaggcgtgcgccaccatgcctggctaatttttgtagttttagtagagatggggttttaccatattggccaggctggtattgaactcctgacctcgtgatccacctgcctcagcctcccaaagtgctaagattcaggcgtgagccaccatactcgtctgataaagtcttttcttaaatacagatggaaggccttcatgtgccctgggggtcacgtcctgaatcctcatggtggcccccaggcctggaagttggccctgtccctgccagccccagcttgcatgacttcaggctccagccatttccttcatagcctggcagctttgctcctgccttcgcagacaggaatgctgtccttccagcttctcctacccttcgggtcagagcccaaaggtccccacccctggttagggctgttttcactgggcggggggcgggggactacactccttggtaactgtcacaactgcccttaactaatgatttgtgcattgccacctgaggcctgtcccccatgagaacagcagcagcgtgaaggcgaggctgtcagctgaatgcctgtgtctctggggaccagctcaggctctggccatgggggatgttgatggagtgaccattaaaaaaaaaaaaaaaatcaaaactctgtggaatgaggcaacaactgtccactgttaccctttgctgggcaccccacatgcctgctaggctctcgctgcccacacgaaaccttacatcttcctcggatggcatcagtagcctcccttacagacactgcacgccccagcaattgaggaaccagcgtggccacagcgggctgagggcatggtggggctagagcaagactgcctcacaccctcgactgtgcagccaccctccacctcccctcttccattcttaaaagtaggcaagcgtgatcataagtgaaccagacacacaatgcgagcctctagaaaaagagtaacacaacaaaatccaaggcatgccggaggaaaagattaatgaaacaaaagtagaaataaattataaaatgaaagcagaactgcttactttatctaaagctgcttttttcaaaaggccaataaaataaatttcttgaaagtcttattaaaaacgaaaaactaggaataaaaagtgaaaaactatgcataaggaggatatcaaaatataaaatgctactctacactaatacatataaaaaaggtaattaagataatataactttgaaaaactgacttataatgaaatagaaatatttaatagcccagtaaccctggaagaacctgaaaaagttttcaaggctgggcacagtggctcacacctgtaatcccaacactttgggaggttgagcgggggaggatcacttgagtccagaagtttgagaccagtccgggcaacacagaaagaccccacatctactaaaacaaacaaacaaataaaagttttcagaaccactgaagctcctaaaagaaggccagccccagctggtgttacaagaccctccgtgccatgcagcctgcagtgcagagggttgggaacttgtctagatatttcccatcataaagggacaggaaacagcagctccccttgctcacaagtacctgcacgatactattcatttcagtttcacacaaaccaacggataggtttgaacactatttttatccccatttcattcacccggaaacttgcttcatgaatttaagaaatttggccaaagtcatgcactactgagtggcaaagtagggaacagaaaccaagtttttgggctcaaagccacactcatgaccactgaccccgactatgtctctgcctcccctgctatcctacccaaaacctgcctgatgatgcccttaagtccaagcagaagaagttctaattcattccttttcttcttggttttttttttttttttttttttgagacggaatcttgctctgtcacccaggctggagtgcaatggtgcggtctcagctgactgtaacctccgcctcctgggttcgagattctcctgcctcagcctcccaagtagctgggactacaggcacccaccaccacacctggctaatttttttgtatttttagtaaagacggggtttcactatgttggccaggctggtctcgaactcctgacctcgtgatccacccaccttggcctcccaatcttatttgctttacaagtcctgcttcagggttaccttccctgaccactgctgcctccctcccagcatttgccagggactgtcattgccttagtttattttttctgttttgttttttttttgtcgtttttgtttttttttgagacagcgtcttagtctgtcgccaaggctggagtgcagtggcgcaatcaaagcttgctgcagccttgaactcctgggctcaagcaatcctcttacctcagcaactaggactacaggcacatgccaccacgcttggccttctaatttatttctgtgtcaacaaaataaaactcaggcctaggaatagcttggttcagaaatcacagagggacttagtattccattaatacaaatggaaacattaagttcatcatcagatgataaaaggaaaaaaaaaaacctgatactcatctcaaaagacgcagaaaagacatttgcataaatccagtacctattattatttcaaatttaaaaacttcttcttttttaagagatagggtatcactatgttgcccaggctgatcttgaactcttggcctcagatgatcctcctgcctcagcctcccacagtgctgggactacaggcatgagccaccacacccatcataaattaaaacttctgaacaatctagtaacaaatggaaatgctttcccatgatccagcacatctagcagggggtgtctgctgacattctacacaaagagacacactggagttgtgcttctcatcatttcacattaagaacccaactgcacctttttctgtgcctctaaacacctgtagtctgataggggacaccccccccaagaccttaatcattcacattaacaccttgagactttttgccatatctgactgaatatagccagtcattttttcccttaaatcaagtcacttttttttttttttaaacaaagtctcattctgttgccctggcatgatctcagctcactgcaacctcctcctcctgggttcaagtgatcctcgtgcctcagcctcctgagaagctggtattacagacgtgcaccaccatgcctgactaatttttgtatttttagtagagacaagttttcgctatgctggccaggctgacctcgaactcctagcctcctcatatgatccacccacctcagtctcccaaagtgctgggattacaagcgtgagccaccttgcacagccaaatcaagtcacttttaaaatacaaatttattatatgtctaaggacattatcgataaagtgaaaacacaacccacagaatgggagaaaatatttgcaaaccatgtatctgataagggtctagaatccagaatatataaagaactcttacaactcagtaataaaaagacaaacgcctaattaaaaagtgggccaaggctcagcacagacacttctccagggaacatacacatatggccaacagcaccagcaaaggtgcttgatagcatcactcatcagagaaatgcaaatccaaatgacaccagaggctacttcacactcattagaatgattataaccagaaagtcagataataactagtgttggcaagaatgcgcagaaattggaaccctcttacttactggtgggaatgtgaaatggtgcatggacgtgggaaaatagtttggcagttcctcaaaaatatacagttaccatatgacccagtaattctactcctaggtatataatgagagaattgaaaacatatgttcacacaaaaacttgtacgcaactgttcatagcaccattgttcataatagccaaaaaccagaaataatccaaatgtccaaatgatgtgtgaataaacaaaatggggtctatccatacagtggaatattattcagccagaaaaaggaacgcagtactgttatatgctgcaacatgaatgaaccctgaaaacccgctaagtgaaatcagacagacccaaaaagacaaatactgtatgattacacttatatgaggcccctagaataggcaaattcacacagacagagagcacaacaaagtttaccagtataacaaaggttaccaaagactagggggagagacaggtaggaagttatttttttatgaatacagagcgtctgtttgggatgacgaaaaagttctagaaatggatagtgtcgatggttgcacaacatagcaaatatactaaaagccactgaatagaacatttcaaaagcatgaattttatctcaatatttagaaggaaaaataaatattcttagaagaaacaatattaccatcataaatggaaaaccggtaataataaaatacatacataaatattaagatttacaatgtctattagcaagtcaccctaactcatcttacagaccaccagtaggacaattacccctttgggtgacatgaaaaaggctgccagggggcttatgtccagtgcccagggtccagcatggcaacatattttgtaaaaagttccagcaggctgtggacagcaggaataggctgttgaggggttgggcacagggtcaggtgctggacactagaacaggactccactccgacattccgggtacacagaacttcccagtgggaagagctagccacacagtggcagaagcttggaaaacaacccatcccagccctacgctctctgaatgtgaccttgggtgcaagctgggtttgtatgaacttactggcatttttaacaagacagtgtgtacgggagcatttcaactgcaaagaccactgaactggacactgtcggcgtgacagtatcaagtaaccattaggcagagcaaaacgtaaataaaagtactctgtgatggggtagtcagtcagatggggtggggtcggctagggggcagtgaggacaactagatgccgaggtagacagaccaagaccagctttctgtgtaatgcaaagtcaaattaaatagacgtgagtggatggaaagacgtaccttattcttgcataagaagacaacggcatgaagacatcacagggaaggttaaggtaaacatgcagcctggaatagccaggagaattctggaaaagtagaataatgaggtagggcttcccttcgctattttgaagtgcagattacactatgtaaaaccattaggaactggcacgtgaatagacagatcaatagttaatagctgtattagccagaaaatggtgtaaggacaacaggctaactaaccctgtcacttgttatgctaaaattaagtctagatagagtcctccaaaataaaaataaaaagagttaggagaaaacatggggtttaacaacaacaacaaaatcttcagctggattagccttttcaaactactcacaaaatccaggaaccataaaagaaaattagtatatatatatgtatatatatatgtatatatatatatatacatatatatatatatacatatatatataaactaaagagcaaaatattacaataaaacttaaagattagtgagaaataggaatgtatttgaaaagggttaatttccttaatatgtaaagagctcttattattaatcagtaagtatacaacccaatagaaatacaaatccaaactacaattaaatactattttccacttctcacattgacaaataaccaagtttaagggcacagcctgggtgaaggtgtggggaaatgtcaatgggaccaacctccttgaggtggaagctgggggtgtccatcatatttagaaatttacacatgctgtgcccagaattcctcctgaggaaacttttctctcacagatatacttgcccatgtacataaaaacccatgtacacagatatgcggtatagccttatctacagtaaaaattgctgaaacaacttaatggttccccaaaaagggaatgggtaattcaaacacggctaccacacagatgttgaaaagaccaaggcagacatgaatacagatatgcggtgcttacctagatgtactagtaactcaacagtccacagtgcaagacaggctgtgtggtgtacccacgcctgtacagctttacacatacacaggttctctggaaagaaactgcagcaactggccatgacggtggcctctgtgggaagggaggctgggggttagagaaagatgccactgaatcacccacagggtttgaagttcaaacatgtgcaggtatggctttgaacagttttcacacatctattcataggtgaaattaactggaaggaaactagcaaagcatttgcctttggggtcagcacaggagcagaggcccaggcagggccttgctttgacacacagatgatgggtcacacagttgtcaccttgacagaagagtaacagggacagcacaccagtcactctaggagctgaggccagaggaactcaggtatttccttctagaggtagtaagtccaccgaggcagatgccaagccgggtggtgcctcgctgtgtacaatgttctgctccctgtgcccctatgagtgaccctatgaggtaagagccagagccgggctcacacctgagctcctggcatgtggcggccctttagaagacagaaagtgtgtgcttagcccctgaagcagccacgctgtgcccagcggagggcaggcgcagacagcactccttcccagaccaggatgccacttaagatttcaacaaactaaacagacaagtgaataaaagatcattaaataccactttttacaaatgtcacagacgctttcctagaatagtttgtttttggtttatttaatctgtgtaggggaaagaataccaggaattagactctggggcctgcaggacccactactgttttgtgctaagccaggcaccgtgttatactcgattccggtatggacaggcagctgcagccactacgcagttttaccccagttccacggcacatgaggagaggaccaacattattctattttggcagcacgtgctttcaacccatctcacaaaacagtgtcaccaaccagatgtgccaagagccagagcaggtgaagacacctacagatgctgcctcctctggacactgcctctgggtgcctcagctctgcacccagagggatgcaaaagagatccccgcagcacactttgagatggctaggaaactgcaaataacctcaaagccatcactagaaaaatggttaaaatgaccataccaacacgtacaatatgacatgttatagagccataaaaataacagtacaccttgtatgattccattttagggcagagaataataggatacattttagtacatccacagccagaaaatgtctgaaggaatataaatgaagttgtcattagtagttatcttaggggtccgggattatagaggaacttttatcttctacatggcctttttctatagtgtttgaattttaattacaagaccagtgatttataaattcatacactccacagccccatccattacaatagcacataatataataacattagccatggacttacctaaatctgcataattttggtctcttcaggacagttgctgcaatgcaggcataagcagaggacaaagccacagtgtgacctgggtgcagagcactgggttgggcatcaccagcagacacatgacaaaagcaatttaaaaaattataccttgacaaaattatacatgattatatgtcttggaccctgggggccttgtcagcattaagcccatgaatgctaaattcacacacagatgacaagaatctactgtaccaattacagtcttagtaggtcactgcatacatgatagatcaaagatggcaactagcagaaacttaagtttcatatatggagcgtcgtagaggatatgaacaacagatactctcatacttaggtatgcaaagctggacacccactctggagggcaacagggcagaatggagaaaaatgtcggactcacgccctatgacccaggaatttcacttcttggtacctaccctgagaaacactcatgcattgtgcacaaggggttgtgtatgacgatgatcgcacagaactgtttgtaatatcaaaagattagaatactgtaaatttccattaacagcagaatggctaaactcacagacatacagtgcagaagttgaaaacaatgagggcagttctctgtgtactcccaggcatctccctactgttaaatgaaaaaaagtaatcaataatgtacaggacacaatagcattttaccacttctatagaaaagaaaccatgcaacacgtttttcagatacaaatggaagtgaataaggcgaggtgtagcaggaaacacagcaaactggtaacactggttacccctctggagggtgggggattggtagtgccaacgttgttgtcgtcacctttcaactctgtgtaaggagaaaacacccacatatcacttctacaaggacactgagaaacagtgttgttgagaggctgagaggcaacctagtcaccatggatgggagaactgataaactaactgaggtatagtcacatgatgagctctatccagtaaacaaactaaatgaactatcccctgggcaagggctgaatcttaccatggtattaaatgagaatgttccataagattacatgcaaaataataaattttctctaagaacagctaaaatataaatatatactctgaaaaacacatttagatcagattcttttgcaaaattatatgaaaagaaagcaagtgagagataaacccaggattcaggatgattattaccttggcctagggggtggcaggaggcggcaggggaggcgggtggtgtgggaccacataagtggaaggtgtagtaaaatctcagacttcactactgtagaactcatatatatgaccaaaagccatttgtaccccaaaagccattgaaattaaatatatatatatacacacacacacacacacataaagaaaaaaaaagaaaattataagaagttaatattgacagacctggaacaaaaaatcaaagacagtatttagtcattaaaattttgctatttcaatttcatcagtgtaaataattaatttaagtggagaggagtgttcattgtaaccataggagttactgtctgtattgtcctagtttttgtattggataggagattcagaaatgcttaccacattattaaaaaacaattaaagaaagcaagtaaaagagagccatgttgtgtcctgaatcaaagattaagattgagatttacccagttctgtgtatttgagttccaacagagagaatattcttgccttacaggagtgttctagcctccatttaccagattttaaagcataatgaaaagtgatgatcattacattccattgcattttattaacaacaacaacaaaaactggagcctaaaatttccagaaatagatccagagagaaaatgttaagaaccatttgatctagcaatcccactcctgggtatctacccaaaggaaaagaagtcattataccagaaagacacttgatggcagtacaagtcacaattgcaaagatgtggaaccaacccatcaaccagtgagtggataaataaaatgtggtatctctacaccatggaatatgacttagcaataaaaaagaacaaaataatgtttgtggttttttttttttttgcagcaattttggatggagctggaggatattattctaagtgaagcaactcaggaatggaaaaccaaatactgtgtgttctcacttataagtgagagctaacttatgggtacaaaaaggtatacagagtgacataatggacactagagactcaaagtggggagggtaagaggggggcaaggtataaaaaaccacatattgggtacaatgtacactactcaggtgaccggtgcagtaaaatctcagacttcactactgtagaattcatctatatgaccaaaagccatttgtaccccaaaagccattgaaattaaaaaaaaaaaaatacacacacacacacacataaagaaaaaaaagaaaattataagaagttaatattgactgacctggaacgaaaaaaccaagacagtatttagtcattaacattttgctatttcatcaatgtaaataattaatttaaatggagaggagtgttcattgtaatcataggagtacatacatgtttagctactaaagaaaaagtaatcagaagcaaattcaatggacttatcagttattattattagacttatcaaagacttatcagactgatttttaaagtcctggtataataggtgctttttgcaccaacaataacaggaaaaatggaggataaggtttacaatcataagtggcaaatgtggccttcccaatgatactaagagttcatgatcattataaaggtcaatatgagaatttcacatggttagtggtcaaagaggaaaaatgcagagagaaactgtggtaaaatagaaaattataaaaaccattcgatccagcaatcccactactgggtatctacccaaaggagagtaaatcattatactaaaaagacacctgatcatagcacaattcagaattgcaaagatatggaaccaacctacatgcccatcaactgatgagtggataaagaaaggtgagtacagaaatatagactaagacaactaaaataccttaaaagtaccttataacgttggatttggcaaggatttcttggatatgacaccaaaagcacagaccacaaaagtaaaaacagataaattagactatttcaaaactaaaaacttctatacatcaaagaacacaatcaacaaagtgaaaaagtaaccttatggaataagagaagatatttgcaaatcatatatctgataggggattaatatccagaatatagaaagaaactcctacaagtcaacaacaacgataactctaataacccaatttttaaaatagtcaaaggacttgaatagacatttttccaaagacaacatacaaatgaccagtaagcatatgaaaagatgctcagcatcactcctcattagggaaatgcaaatcaaaaccacaatgaaatgtcacctcacacccactatgatggctgcaatctaaaaaaagcagaaaataacaagtgttggggaggatgtgggaacctcggaacccttgtgcactcttggtgagaacgtaaaatggtgcagttgctatgaaaaactacagtggttcctcaataaattaaaaatagaaatatcgtaagatttagtaataccacttctggctatatactcaaaagaactgaaggtaggatctcaaaaagatgtgtgtacattacagcattatacttgtaaatacaataatatagatatttgtacatagcaccattatttacaatagccaaaagcaacccaagtgtccactaatggatgaatggataaaaaaaagatataaaataagaatattatttggatcttttaaaaaggaaggaaattctgacatatgctacaacatagacgcatctcgaggacactgtgctcagagaaataagccagtcacagacagacaaatacttcatgatttaactgatatgaagtgcttggaatagtcaaactcacagaaacagaaagtagaatggggttgctgaggctggagggaatggaatgtttaatgttatttaatgggtacagagtttgttttgcaagatgaaaaagttctggagattggttgtacaacaatggcgacatacttaacactactgaatgtatacttaaaaatgattcagatagtcaacttctattatatgtatttcaccacaaaaatttcttaaagtagcaagaaataaataaaattgtaaaaacctgatgttagtggctatgtagggaaatggatatcatatactcacaacaggaagtgtagctttctggagtcatttgagtctgtgaagagagttataaaaccataagtgctcactgccgaggcaatgccactccaggggatacatgtgtacactaaatttacagagatgctcacagctgcacgatttaaagtagtcaaaacagtttaacagctcaagagatgggctacatatcctttagtataagcacaatggcataaaatcatgcaatcattcattcatgatcttttttgagcacgaacaagcagatgaaagttatgctttccacagaaaaatacaatttcagagcatttatagacttctagaaacccatccatgggacttcctttgggaaggttaagaatcctgagaaaaagcctcttcaaatgtgtttgtgaactctgccggtacagggaaatactactggaaacaaaattaagtgtagaaacagaccagaccagaatatacatgctgattcccgttacatgaaaggtccagcgccaggcgggcaggcagccagccacagaaaagggagaggggcccaggaggaagtggctagacctgacgctaggcaccaggggaggcggggaaggagggcagaggcaggagagttcactgtgagagctcaacaaggagtagctgctgccaaacatctacattcatttacccgcatttcacagacacaggcttggggaggttaagtaacttgctcccagacataaagttgccaagtagtccagtcaggattcgaaccagctccagtgccctattaggtccaaatccactcagatggggaaatggagagtcagggacaagcaacaaccaggggcccattcaggaaacatcagcctgccctcaaggtcttctgaattgaaccctgccactgtgacaaccaccctcacaggacagggctctctggccacaggaggtgggttctgagagcaccatgcccctcctcacacaaacacagattccacaacacacaccacggggaagaaggtttaaatgtaaaaaacgaaaccatacaagttccataagaaagtatggattaatatttatgtactcttggggtggaaaagatctacacataacaagttcagaaaccacagtgataaactaacctaagaaaatcgtttaacttttatctacctgaaacacaaaattaaaaggcaacctataaactggaaaaaaatatttgcatcaaatataacaaaagattatcaatatccttaagatgtaaatggcttttgcaaaacaatcaatagaaaaatgactaggaattagaaaatcatacacacacacacacacacacacgcacacacacacacaccacaaatggccaattgacacaaggtagagatgttcagtcaccagcagacaaagcaatgctcacatccagagggaaagcagactcgatccgtcggaggagcaaaggttttcaatgtgataaagccggttctgaggaagaggggaaggcatcaggtttgcctcaccagtgagaacactaattgaaaaaatccctccctgctgggcagtttagcaatatgaacctgaagtcttaagagtttaacagtcatttccttctcgaaatgtatgtattcagcattcccaaagagataacaacagacgtgaaaaagtctgagctacaaggaaagtcatcgcaagtattattttctaagaggaaaaaaaaactagaaaataccctgtatgcccattgaaacaagattgtttaaattgatacagccatgcaagggaacatcctgtcatcattaaaaaaggtgttcactatatattaaagtcacaaaatagaatttatggcataatcccatttttgtttaaaaatgtacttatcccatgcatacaaaagaaatcttccaaaagcaaatgtgcccataacaattgttactggtaagattactgaggacttttaaaaaaaatttccttatttgcaaactttacagtaaactttttttttttacatattagaactcaatgaagaattatttaaaagagaggaaaggcagtgcagggctggaggtcctggagggtggcggcgggtcgtcctaactagcaggctgaaaggtgctggaggggatgccttcactcagaggaagttcacagccacctgccttggaacatgtacctgttcatcttttcgtaatgttagtattcattttgctatcttcctgttgccatttccaaacagtgtcagtatgtttttgttaaatacgaacatttaaaacatatcgtatctgtaagcctatttgggtgtcttcatttcatgcccgcactgcaccataatgagtaccacacaaagccagaggatgacacttcctccagaggtctcactgcacatggagaggttagccctggcattaagggtccttggaatctctcagcagtcatagtcagtcagatgcaccaagggcagctgagtcaatctcctttttgtaacaacaggccgttcctgcggttctcagtgctgccaacctgggcatactgaagagcctcaaccaatactggctctcagggtactttcctttttaaaagaagttcaacttttgctattcttatgccccataacttttaatttgcacaagatcagccatgcccactcactgaattctattatattacccacacctctggaaattcacaaagtctgaattcagatctatgcataaggatgcaaacggattagcaataattgctggcactgccatcaacacctcctgtcgatctcacctgatctgaggataaatgaaggcaaagaatgtggccccagcccctggattggagtggaggcaaggagggtggcgagctgtcttcagcagtcggcctcacctctctgctcctgtatcaacaagtgccatttcatccccacttccaatccccaacatttataccccgtgaatcaattcttcttcagcatgccagttgctggagacagcaccatttacatacaggcatctatagcagttatcttccagggtggaagcaagagttttgtaatcataaaaaacaggacgagaaacaaggagttctgaaaagaagagaaggcggttatagaggtgctggggtaaaaagcaaagcaaaggggtaagataggaaaggaggcctggattgtttctggggcatccagggaaaggagttgcaagcagaaagaggaccctggattctgcacacagcagtgccccatcttggagatgccatgagcacagacagaaggtttactaggtgggcggcacagtgacttctccccagcactccacccgtttgtcagtagtgtacacgtggaggggtcaccaagatataacggcacaggcaaataagacacagttgcaaggacggcaaccagccctgcagctcatgggaaggaaagaatccttcaggtcatgatcccccaccatttgtgttggtccccctggctagtcccagttcagcccttatctccccttctcaggcaaacaggcccaggtgagtagaacaagcctcccttgctgctccctttgaaacaagcaccttccttctcagcacagaggctggcagtggcttccattctacgcccaaagtttaacagcagtgcaaggacagaacagtcccacccaggagacagaggcagtttgcaagccaagatgtatcctccagattccacgtgatcctgctcacacctttgcacagcctctgcttgcttactgtagcacgcacacagggaagcccagacgttttagtcactcaccaaaaggaaaaaaacaaggcaaattctttagtgaggtaagaattacgcatacacttagacccaaatcccaggcacattccagcctcccaaagactatggaatatgcatattatgtgtccatttctgtttttattcaggctttcccctaaccaaacaaaaataagtaccacttagaactctaaccaggtaatgttttaaaatattatggcaaagtactccccacctacacacccaccttcattggcttgagtggtttcatcacatttcaaaccaatgattaccaactctcaacagagagcagatcccatccccactcagcagtctgcagaccacttgggataataccagttctatctgtggttaccatgctctcctacatggccttaattacttggagctagcaaatctagacctaaatctacaatatgaagatacatccaaagtcgttatgaaggcaatgtgataggggtcgagaaatgtaacatagcaatacaacaattctaatgagtttagaactcaaactttatttgtgctgtaaaggggaagaaaagtgattagtaattatgtacatgacgtaacagaattagttcttaccatacagagcaacataccagtactttcaaccatctacttttacagtttcaatttcacaacagcatacccgagactacttccccatacatgcgtgactaatacactctaaatcccaacgacagtaattgtttgcatcatccccaagtcattggttaagaactgaactaccatgtcaacatatttttaaacatttaaaaaatggaacccagaagacagaaagatcccaacgataaaaataaccatgatttttaaaatttcaagtgaaacttaaagggaagaaggaaatgataaaaagccattggtattactttaccaattcaatagacgcagctcagaaccaagcagggttttcagatcacacatgtagtaaaggcacctcgcccactctctccccacaatccccatccccttccctttttaggtcttgttttccaaactgattttaggtgatagtttcccctctagtcttggctcatttaaaaagcacaaacattcaaattaaaaatacaataaattattcattctaaccttagcaaaggtacatggattctgtctaccaaatattaattttacagtgaccacaaaaggttatttggttgttacaaagactacaatttgaagatactagataggcaaaaattttgccattattaatatcgaccaaacacagaaaagacaacagatgtgtttctaaggcacgatttacatactaaattcccttgaaattcaatgcaatttcacttcgctcatgattttcaatcacaagacacctgtgacaaatgaggaacaaatccagaagagcccatctaatctcgtcttaagtggtcccttaaatacgttaaaagcccacaatataggcatttacaaggcttttctaagacttccagctcctgaaaaaatcacaccttcacagtttcaaatcaaccacctaagttgctaaggggcagcgaaggatgctgatctgctgcgtatgcaagtctgacgcccatctttcaagtgactaattcacttgataacacccacaccccaaacaaaacaaccctctgaaacaggctgtcttggccaccaggaggaagctggtaaagacatttcccctgcctgtgagatggcatcacacacccctccctttggttctcggaaaactggtgactctgtgtcacctgttttcagttaacacttcttcagtcttccccaccttgtagcaaagcaaaacaatttttgtttgttagtttgtctgtttgcacttaaagttctaagcactttggaaagtttctaagcaacttctcacttccaagcaacaacttaaccaacactaacaacttactattattaattagtattttcttggctcacccacgcactaaattccccaaagccccagagaattcccttcaacctgcatttcc

SEQ ID NO: 1171 - DNA, 8016 bp, Homo sapiens
gaggagaggcctggaggagggagctggaaggaagcagcaacactgcggggactcgaaccccggcccagccgtgctggacgtgccaccaccagcgccttttgctttttcctgctcactctttcacagatgggaaggtgaaaagcaaaacctgagtgcggccatgggctgcactcagtaaaagaaacacctgcggcggctccgcgcctccctccctccctcccaggctcacctcctaccttccttacttcccttgtaaaggcatagccaggggacattgtcccccagcttcacatccacatgtctcctagcatggcacatgcatatcctgcccaaggagcatgaagtcagaccagcaaactgaacacgaggcacagtcctgcatgctctgggaccgagcactgagggggcccacaggtgagaaggtgctggcccttcagctctccctccctctgccttcacgagcagaggcacaagcttctgtgtgtatacagaaatttccagagtgagtctaggaaactcgagaggacatctctgtgtagtagggtgggataggtgagggcagggattttacttgcattttatacccatggcttgaatttttgactctatgcagatcacttttatcattaaaggcacaaatcttttcatctgaacagggaatctaagacctgtggacacttccggcaccctggcctagtggaaatggttctctgggtctgctgggccccaagcacctgaggtcacgcagacgcccgcctgcctcgccttccattctctgatctgtcagccaccgtcagctgtggattccttcctgggaactgccatcactcgaaatgaagtcggaagcacagggccccaccagcctttctcctgtcacttgactctaacctggagtccaagtcaccagggccccaggacccaaaggtacacaaagcccacctggaccctcagccggtacttgccccaggccaccctcaggatccacggtccacagcaccactgctgttggctcaggctctgcctcccctgggcccacggcgggtccgtgggagccccccacgagctctgctgtcctcatttgagagtcctgtcctggctgccatggagggagggcccctggagcccctcctgctagtgctaaggagctcagaagccctgcccagcagggtccagatgggaagcagaggctcagagaggactgtaacctgctcagggacacacatgtcaggccagggtgagagctgggtgccttctactcatcctgatgaatctgagcagaatcagccccccatttctccacaacttctctcttttacacacacacacacacacacacacacacacacacacacacacacacacacacacacacagtctgaggactaccaggtgggctccgagccaggtctgcaggcctcagacctctcaaaggggtggggaatgtgttgggccaactgcctttgccccctcccccactttgctcaagccccatcatccctcctcacacgtccatctcccctcacagcctcgcttcaacttcagcctccaaacacactatggtgcgggcacttacttactgcagcagcagagaggaaacattcacggccatctaagtcccaacctgccgatgaagcaacaaagctctggccttacaaggcctcagaaatgggggcagtcaaaacacactctgtaagatgagcaaagaattaattcagcgtgttagcaacagaacccttgggtgtgtgctgtgggataagcgagctacgcggggaaacgtgccactggcttccaggaaccactgcactcagccaatgagcagaagtaaaaacagtggtgttggcagggccaagggaaaacagcagccctagaaccatctggggcgcagggcagtgagagagccaagtgactggcccttccctctggccagtggggttgcaaaccaaaagctgccttgaggtatagaaggggatttgcccaaagatatttgtgactgtagaattcgtaaccacaaaatgctggtgccggcccacatggcccaggtggcagtgacaacctctcaccctggaatgccccagaggaccccaaccacaacaggtggattatttcagcccaagtaattgtgtccccacatagtaactaccaatcacaacagtgtaaaataaacacatgtacatgggcagaaagcagaaaagatataaaaatcattccaaattcagcagttgaaaataaccctcatagatatttaagtccagtgcaaacaagaagacagcggagtgtgtgtgcacatgtgtgcacacctttaggtctgcactgtcaacaccagacacagtgaagcccaagcagcaagcagtccacagacgggggcgttagtgtcgggaataccaatgggtcaccctgcatcaaaacacatggagcagactgctgagccagctcaggggaagcggagagaccccaggagtgacggtgagaatgcaactcacttgtcattacacaggatatggcagatcggatttgaccaacaaaatggggaggaactgatccagatgtggaatgtgacagagaatcccttcccactgccatggaacatttataaaaataatcatacgttaatcaatgaagaaagggagccacacatttaaaaaagcagaaatcgtacaggccacttcctcagataaccattctaactagggtcaaattatacatcaggactgaaaccacaaacatataggaaataagataaagtcttttggtttttttgagacggagtctcactctgtcacccaggctggagtgtagtggcgcgatcttggctcactgtaacctccacctcccgggttcaagtgattcttctgcctcagcctcccgagtagctgggactacaggcgtgcgccaccatgcctggctaatttttgtagttttagtagagatggggttttaccatattggccaggctggtattgaactcctgacctcgtgatccacctgcctcagcctcccaaagtgctaagattcaggcgtgagccaccatactcgtctgataaagtcttttcttaaatacagatggaaggccttcatgtgccctgggggtcacgtcctgaatcctcatggtggcccccaggcctggaagttggccctgtccctgccagccccagcttgcatgacttcaggctccagccatttccttcatagcctggcagctttgctcctgccttcgcagacaggaatgctgtccttccagcttctcctacccttcgggtcagagcccaaaggtccccacccctggttagggctgttttcactgggcggggggcgggggactacactccttggtaactgtcacaactgcccttaactaatgatttgtgcattgccacctgaggcctgtcccccatgagaacagcagcagcgtgaaggcgaggctgtcagctgaatgcctgtgtctctggggaccagctcaggctctggccatgggggatgttgatggagtgaccattaaaaaaaaaaaaaaaatcaaaactctgtggaatgaggcaacaactgtccactgttaccctttgctgggcaccccacatgcctgctaggctctcgctgcccacacgaaaccttacatcttcctcggatggcatcagtagcctcccttacagacactgcacgccccagcaattgaggaaccagcgtggccacagcgggctgagggcatggtggggctagagcaagactgcctcacaccctcgactgtgcagccaccctccacctcccctcttccattcttaaaagtaggcaagccccagtaaccctggaagaacctgaaaaagttttcaaggctgggcacagtggctcacacctgtaatcccaacactttgggaggttgagcgggggaggatcacttgagtccagaagtttgagaccagtccgggcaacacagaaagaccccacatctactaaaacaaacaaacaaataaaagttttcagaaccactgaagctcctaaaagaaggccagccccagctggtgttacaagaccctccgtgccatgcagcctgcagtgcagagggttgggaacttgtctagatatttcccatcataaagggacaggaaacagcagctccccttgctcacaagtacctgcacgatactattcatttcagtttcacacaaaccaacggataggtttgaacactatttttatccccatttcattcacccggaaacttgcttcatgaatttaagaaatttggccaaagtcatgcactactgagtggcaaagtagggaacagaaaccaagtttttgggctcaaagccacactcatgaccactgaccccgactatgtctctgcctcccctgctatcctacccaaaacctgcctgatgatgcccttaagtccaagcagaagaagttctaattcattccttttcttcttggttttttttttttttttttttttgagacggaatcttgctctgtcacccaggctggagtgcaatggtgcggtctcagctgactgtaacctccgcctcctgggttcgagattctcctgcctcagcctcccaagtagctgggactacaggcacccaccaccacacctggctaatttttttgtatttttagtaaagacggggtttcactatgttggccaggctggtctcgaactcctgacctcgtgatccacccaccttggcctcccaatcttatttgctttacaagtcctgcttcagggttaccttccctgaccactgctgcctccctcccagcatttgccagggactgtcattgccttagtttattttttctgttttgttttttttttgtcgtttttgtttttttttgagacagcgtcttagtctgtcgccaaggctggagtgcagtggcgcaatcaaagcttgctgcagccttgaactcctgggctcaagcaatcctcttacctcagcaactaggactacaggcacatgccaccacgcttggccttctaatttatttctgtgtcaacaaaataaaactcaggcctaggaatagcttggttcagaaatcacagagggacttagtattccattaatacaaatggaaacattaagttcatcatcagatgataaaaggaaaaaaaaaaacctgatactcatctcaaaagacgcagaaaagacatttgcataaatccagtacctattattatttcaaatttaaaaacttcttcttttttaagagatagggtatcactatgttgcccaggctgatcttgaactcttggcctcagatgatcctcctgcctcagcctcccacagtgctgggactacaggcatgagccaccacacccatcataaattaaaacttctgaacaatctagtaacaaatggaaatgctttcccatgatccagcacatctagcagggggtgtctgctgacattctacacaaagagacacactggagttgtgcttctcatcatttcacattaagaacccaactgcacctttttctgtgcctctaaacacctgtagtctgataggggacaccccccccaagaccttaatcattcacattaacaccttgagactttttgccatatctgactgaatatagccagtcattttttcccttaaatcaagtcacttttttttttttttaaacaaagtctcattctgttgccctggcatgatctcagctcactgcaacctcctcctcctgggttcaagtgatcctcgtgcctcagcctcctgagaagctggtattacagacgtgcaccaccatgcctgactaatttttgtatttttagtagagacaagttttcgctatgctggccaggctgacctcgaactcctagcctcctcatatgatccacccacctcagtctcccaaagtgctgggattacaagcgtgagccaccttgcacagccaaatcaagtcacttttaaaatacaaatttattatatgtctaaggacattatcgataaagtgaaaacacaacccacagaatgggagaaaatatttgcaaaccatgtatctgataagggtctagaatccagaatatataaagaactcttacaactcagtaataaaaagacaaacgcctaattaaaaagtgggccaaggctcagcacagacacttctccagggaacatacacatatggccaacagcaccagcaaaggtgcttgatagcatcactcatcagagaaatgcaaatccaaatgacaccagaggctacttcacactcattagaatgattataaccagaaagtcagataataactagtgttggcaagaatgcgcagaaattggaaccctcttacttactggtgggaatgtgaaatggtgcatggacgtgggaaaatagtttggcagttcctcaaaaatatacagttaccatatgacccagtaattctactcctaggtatataatgagagaattgaaaacatatgttcacacaaaaacttgtacgcaactgttcatagcaccattgttcataatagccaaaaaccagaaataatccaaatgtccaaatgatgtgtgaataaacaaaatggggtctatccatacagtggaatattattcagccagaaaaaggaacgcagtactgttatatgctgcaacatgaatgaaccctgaaaacccgctaagtgaaatcagacagacccaaaaagacaaatactgtatgattacacttatatgaggcccctagaataggcaaattcacacagacagagagcacaacaaagtttaccagtataacaaaggttaccaaagactagggggagagacaggtaggaagttatttttttatgaatacagagcgtctgtttgggatgacgaaaaagttctagaaatggatagtgtcgatggttgcacaacatagcaaatatactaaaagccactgaatagaacatttcaaaagcatgaattttatctcaatatttagaaggaaaaataaatattcttagaagaaacaatattaccatcataaatggaaaaccggtaataataaaatacatacataaatattaagatttacaatgtctattagcaagtcaccctaactcatcttacagaccaccagtaggacaattacccctttgggtgacatgaaaaaggctgccagggggcttatgtccagtgcccagggtccagcatggcaacatattttgtaaaaagttccagcaggctgtggacagcaggaataggctgttgaggggttgggcacagggtcaggtgctggacactagaacaggactccactccgacattccgggtacacagaacttcccagtgggaagagctagccacacagtggcagaagcttggaaaacaacccatcccagccctacgctctctgaatgtgaccttgggtgcaagctgggtttgtatgaacttactggcatttttaacaagacagtgtgtacgggagcatttcaactgcaaagaccactgaactggacactgtcggcgtgacagtatcaagtaaccattaggcagagcaaaacgtaaataaaagtactctgtgatggggtagtcagtcagatggggtggggtcggctagggggcagtgaggacaactagatgccgaggtagacagaccaagaccagctttctgtgtaatgcaaagtcaaattaaatagacgtgagtggatggaaagacgtaccttattcttgcataagaagacaacggcatgaagacatcacagggaaggttaaggtaaacatgcagcctggaatagccaggagaattctggaaaagtagaataatgaggtagggcttcccttcgctattttgaagtgcagattacactatgtaaaaccattaggaactggcacgtgaatagacagatcaatagttaatagctgtattagccagaaaatggtgtaaggacaacaggctaactaaccctgtcacttgttatgctaaaattaagtctagatagagtcctccaaaataaaaataaaaagagttaggagaaaacatggggtttaacaacaacaacaaaatcttcagctggattagccttttcaaactactcacaaaatccagg

SEQ ID NO: 1172 - DNA, 491 bp, Homo sapiens
caccaccacacccggctaattttttgtatttttttttagtagagacggggtttcaccatgttagccagatggtcttgatctcctgacctcatgatccgccggcctccgactcccaaagtgctgggattacaggcgtgagccactgcgccaggccaacagcagactttttaaaccagcatacaaagcaagacagcaatggagcagcaggttttagacattacacctttacaagtgtgagccaggattttatattcagacaaactatccttcaagtatcatgattataggaaacaattttctgtttttcagtaagtacctatggaattctgcacccatgagccagtctgatagagatgtgtttcatccacaccaaagagaacgattataaatactatatatgggctgagcatggtggctcacacctgtaattccagcactttgggaggtcaaggtgggcagatcacctgaggtcaggagttcgagaccagccc

SEQ ID NO: 1173 - DNA, 372 bp, Homo sapiens
cgcctggcaccgcgggcgctccgcccgtccccgagaagcccccgctgggcggctggacccctgggttctcctccggccgcgctcgcgctcgcgaccttgagctggtctaaccctctggcgcctgagcttcccgggctgtaaaaccctcgaggaaggagaatctccaagctgcgtgataaagtgagaccctgcctagaaggagaagaagaatgagaaggagaaggagaagaagaagaagacagaaagaaagggagaaaaagaaataaagaaagaaagaaggaaaagaaaagacatagaaaggttttggattcagtttacaagtatccattgtgccctgcagtgacatgggaactgacttgcattagatgaccc

SEQ ID NO: 1174 - DNA, 652 bp, Homo sapiens
ggggagcattttcattattcaacggatttactgagcacctactatattccagggactgtgctaggtactaaggaatacatggcaacaggcagatggccagggtttaaaacagaaacagtaaggggatgaataaaacagagatttgggaactttcctctacctgggatatctgtgactttcacgttttagatgaacagaagagtcggtagtctaacaaggacccacaagtggccaggagatagtactgcagtacttaattttcaaagcaaaggaatggcactggagctttagtacagaggacaaaagataatagaaattctagtgctaggaagaaaatttaaaaagtccctttgttttaagtcctattggacgcatttcaaaaagactttattccagccgggtgcagtggctcacacctgtaatcccagcactttgggaggccaaggcaggcggattgcttgaggtcaggagttcaagaccagcctagccaacatggtgaaaccacaactctactaaaaatacaaaaattagccgggcctggtggcacatgcctgcaatcccagctactcgggaggctgaggcaggagaaccgcttgaacccgggaggcggaggttgcactgagccgagatcaggccattgcactccagcctg

SEQ ID NO: 1175 - DNA, 896 bp, Homo sapiens
cccagtagtgactcaacacagggaagctgacattgtgctatgatactatgaaattgtcatcatcattatcctggccagtgtcctgcccccaccccctgctcagggagagttctcccccaagtgtccctcaggtgagaaagccttgcgggtgggaggagatggtcatgttactcctgctgggacagggaaatgtttaaactgtctgtctccctacagtcttgggtagaaaacacaatttatgatgtttttcccccagattattattatcattattattattattatttggagatggagtctcgctctgtcacccaggctggagtggagtggcatgatcttggctcactgcaacctccgcctcctgggctcaagcaattctcctgcctcagcctccagagtagctgggattacaggtgtgtgccaccacacctggctaatttttgtatttttagtagagacgaggtttcaccatgttggccaggctggtttcgaactcgtgacctcaggtcatctgcccacctcagcctcccaagaggctgggattacaggcgtcagccaccatgcctggccgacaatggctttttatgaagcccttaccctctctgcccacagaaaccccattaatattattatacctatttcccaaaggagaaaactgaggccggagagtttaagacccaagctgaaggtcatggagctagcaagtgagcagtagagcagagtctgcctaactctgaattccaaactccaaacctcctgcctctagctctgggagcccctcctccacactctctgagggtgctacttgggcaattcctacacagatggaaatgacactgcccagccctggggagggagccctcggccttaaagagtccctcgctgaggactagttt

SEQ ID NO: 1176 - DNA, 510 bp, Homo sapiens
gttccatttctgggactgccaggatggagttgtgagatgtgtggaaactgctgtggatgtgcagtagtggctagttctatcaattgtgagtgtcagaaaagacttcacagttgaagtgaggtttgtcttctacatttacaaaggttttcctctttgccaagcaccttactaatctttggggttgtaaagctagaaaatccaggatccctgctgtcaaggagccttcattctggatgaagaaacaaatatgtaaatcaaggatttatagtataggctcataagcatacaaaacaaggcaagattgggttgctataaaacacaaaggagggacatctgcagtagtccattgtgaactggcttcaggacactactgacctctaaaatagacttgcagaccagaggaagcttcctgaaatactaacatttgagtgggactctgggggttgagtagaattctgctagatgaagtagagcgtggcatctcaggcagaggaaatgaacagaacgagg

SEQ ID NO: 1177 - DNA, 2171 bp, Homo sapiens
cattacttactcagttttatttaggtggacacaacagtgaagaactcaaacatggtttgacctttatctacagacacagcagcctggattttcagcctttcattccttttaaatgaaagtcagcaggctcaaaatgcagagcttggctaagtcacttctgtggaaatatgaaatatagtagtgataaccaccaagggctttcaaattcttgtgttcttctaaggatcctttcctaacaccatgatttgttctcatctttgtggaaatgaaaccaagatggtcttaatttgtaaagtcctttttcctctgttggcagtcttcttacaaaggatgcagcaaaaagaacacatttttctttcaaagttttgaagaaatatagtcattaaaaagaatttaaattatgcctaaagcaccactttacagaataccattaaattgtaattacgtgcttttaaaaagccaacttgttaaagaggagctgatggtttcagtttttgtagggaacacttgtaacactgcagaattctacaagggctttctcctctggtgggcagggaaaaaaccactcaagtcatgagaaacttttatagctttcaggaacttgaagaacaactgctgattaaatttcatgctttagtgacgaagtatttttacagctaaaaaaggaacccagaaacataatacatttcatttaaagcaggcagaaaaaccaaccacaaattaatatctattgtattccacatggcactatataatcgttgtcaatcgttttaaatgctaaaagtaaacttggaggttcctgaggattactgaacttatgcaacatgctaactttctaagactaaaactgggaagttccacagatgttaaagatttttgtgtgtgtgtgtaaaatgtgaacataggatctatttacatagttggaattgggaacagtttttaacatgttctgaatcagctttaaatgtttatgaaataagcttacatttgtcttatccaaccatttataatctttattctataattctccaccagtgctagaattttcttcccaaatggcctcaattcggacactgaataaacgataatgaattttttaaagctgtgcttaaatataaacaaaataaaccgctaagtttttctggctccaagcacgccatatgaagcatgccaatgtcacttatgtgccctgatcacattcaggcaaagtgttcttcactttaaatactcctgtgttccattattgtttaagtaaaatcctatttcaaatgcctttgataacagagaaaccgcctgtagacaaactctttgaaagtgactgaattaatgtcttctgtgatgtcagatttccccactgggctcttttggaagcattcttcctgaattgaagtcactgtgaatatcctttagatttcatcttgttaactcagttttcagtcagagcagcacttgggcctgctgcccttcaaggcacagtgcaacaaatagtggttacgggatttccatcagccaaggttgacaactaacaatgtaaagagagctcgagtgtgggccaaggcatcggaccttacacctaacttaggacataggtcgacctatggattattagccagtgaatgcttttcttgtctaacagtctttaagggcacataagaaactcacgttaaattataccctgacatattattattccatgaaaacaaaacaaatcttccaaagtgcttgttttccagtagctctgggtcttgtctcaccacgggtacagaaaggtattgctccgaggctctgacagggctactgctcttgactaattgttcttgtctttctgcttttcatttgatgaggacttacacatagttacttgctgcagtttactatctctcaggtgcttcctatgggaagttcataaaccattcttccataaccttttgttgatcaccatttccattagggactcaataagacatgctcagtatctccaccaagaaccatttattgcaaaccagctgtgaaaccaacaggggtgctttagccaaattaaatcccatgtcgcagaagtcacagatttacagctcaaggaaaaaaatcatcagcaagaagaatccagaagtctctgtcgggcattcttctctccattatttgctttagtttcactgtctatgttcatacct

SEQ ID NO: 1178 - DNA, 2132 bp, Homo sapiens
ctcctgccttggcctccaaagtgctagaattacatgcatgagccactgtgtctggccaaaaatgttagttttcacgtttatagcatgcaaagtgttattctcttccactttaattcacaaaggctctttatgtcttcccacttttatcactcttaatgaacccaccctgtatctactaaaattctggaggagtcatgggcagaattacagaagaattctggtcatatgacagtttcataaaaggacaatatcataatgtgcaagttctagtaaaatgcaaatcttatcttgtttcaccagcttactatttaggctttttttttttttttttttggcctattctgactttggatcttaactattttcaactatctttttgcttgtagaggcattctttggttcctaagaggtattaaagtgagggattactaacggtgaagctactttggcatgcaggatgctgctgtgtacatatatactagtgtatatgaatataaacccttgtcttttttttttttaataaaagtgagttttcatctgaggtgcttggaatgattcacaaacaacttggcacactcttctggcctgtttacccccattgaaatgttattttataaattactcgttttgaaaaccttctacatccacatctctgttcactgttgctggcatgctgttcaagaaagtgtttatatgtatttactcttcatctacctaacgatagtctggtcacacagctgaattaatgaagtaatatttgggggaaagcacgtggcataaagattatttttgatgagaatttcagctggaggatgaaaagaacagttgtcaaagaataacaaaatcttgcagtcatcattcaatccagcttccctgatataaagtgtttgtgaaaccaatcagaaaagatgtccctggtgatccatgtccttttgttagcacattaatggactggtaagaaattcactccttgaaatcagtgaggacacaagcttttgcctatcatagcaaatttacacttgggcgtgactgagtcattagcacatcctagcagttattctgttattcttaattcttgtaggggctgtctcatcagctatagtcaatgtttttttgagtaacaacaccaaaccagtgatgttcatcagtaacatatacttcttctggtgtcagatattcatcagcgatgaccttggcaaactcttcaatgaatttctctgctgctttgtaatcagcagacgcttgatcaccacaaatctttaaaaataatgctgtgtcttaaatttctataaccagcctgttgaatattcatggttctcttcaattttcagttcatcatgatagatctttgcttgtttcatgatcagcataccattaagtggcatgtgctcatgcgacgctgatggatccactctttgacttcatggttgaaatcctatgcagtgtttaatgttttgcattaacttctgttcatctcttccaaagcagaacttcaacagtttatccttctgtttcttcaggtcatatattgtggtcattccaacaccatccttttctataagacattttacacttaggttgctggtgtagtttctccaagtttgactttctgggctattgataaacagaaatgtttcctctttttcttatcactgctacccacaggggtatcttcaggtctttttgatattttcaacaatatctttacatcacaaagcagagaaaaagcaaaaaaatacagtgagtaatgcatgtaggtcttggccccatgtggggtctcgtggggaatctgccattggtacatgtatcattttattactccttgtgagcatgcttacatgggggaatctgggtgtgcatgggaaagatatagtgcagctgaagagggctgagaggatcttttttccccttggggatgctaaataaactgtatggtatgagcttgtgttttagctgtgacccatcatatgaagtcaggtgtaaaattttccatttgtggtatcatgtcaggggtcaaaaaattttggattttggagcatttttgattttgaaatatttggattagggatattctacatgtatatccaatacctacttgtaagcagaagattagctctcaataatcatttact

SEQ ID NO: 1179 - DNA, 648 bp, Homo sapiens
gttgctgaaaaagcgtagcaaagactgactagactggctagaatttcctcttcttccaggacagatggttctacgacattttaagccttctttgtaatggccgagtgactgggttctagctagtggaatgtgagtggaagccttttacctcagaaaagacacacaattctgcatgccctttccccttctgtggcatggtgcaaacatgcatggtgactttggaagccacattttgacgatggtggagccgcaagatgaaaagagcctaggttcctgaatcaccagttgtcgcctgaacctatatagaaattggtaccttgaaaagtggaggtttctgaacaaaaaaacctttaagttttgcagactgttcaagaagaatggtgccagcatctgcatcaggtgatggcttcaagttaaagaaagaaggttcatggaagaaggtgaaggggagccaagctggctgtgtacagatagcacataaccagaaaggaagcaagaggtgagtggggaggtgccaggttctttttaacaaccaactcgtaatagagccagatctcactcagtgcccccgtactgcaccctagggagcacattaatccattcatgagggatctgtctccatgacccagacacctcccattaggcccc

SEQ ID NO: 1180 - DNA, 364 bp, Homo sapiens
cttatatgactgattcctttgagctaaagcattttatctaagaacactaacacaatttattataattcctggtttacaaagtgacccagtcacctaacagggccctgaaggaacaaggtactgctcaagttttgtactgatgttgtaaaaagggtcagaaaaggcaagaacatggaaattaccaatgaggaccaaggtgagaagtgaggcaacaccagtgtcctgtgctgggaactgattggagagcagaaaagaagacaggcatctttatcctaaaaactaaaaacctccactggagtctccagtcagcttgcaagcttgacagaggcgccatccaaaggtgaggccgctgctagaagagggc

SEQ ID NO: 1181 - DNA, 538 bp, Homo sapiens
ctccagggtcccctgctggctactgtgggggtgctgctgggagagaggctcagcttgtcggtgagggcagtcgctctttgctgcaggctgacccagaaaacaaactggtgcttcttgcccctcccaggcctgtggtggggaggagaaagccgcagggcactgagccctatgaaccagtccagtgtccagaaaagggacgatggccaggcttcagggctgtggaactcgctgttctggaggctgaacccgggtcagctgcagaggggactccttgggctgggcagtggggaaagagagcagccagggaagtgcccagggacaggaaagaaggggccccaagctggcctcagcagctttctgtgcacgcagtttcttctctgagtctcccgtttttactaaagaaaaatcacggtaagaccaatttgctttattatattcagtctgatcatttgtataaagtgcagcaagaataattatttttcacataggatttttataattgactttgatggaactttcttccataaaaagaatctca

SEQ ID NO: 1182 - DNA, 522 bp, Homo sapiens
cctgctgaaaactcttcaatgctccacactccccttaggatgaagccccaactctgttcacgtgacatgcaagggccttcacaatccgggctttctcacctcatttccatttggttggccagaaaaacttctgctacacactgtggtatgttagaatctgtgaacttttcttcctcttccctcttcctgaattgtgtctttcacccacggctagttctgtgctaatatcctctcctgctttgcagtctcgcagtagttctagattcctgtgaggtcccctcctttgtgaaaccatccccaacttctcatgcggagctattcacaaccttctccgtgcacttttcttttctcttttttttttgagatggagctttgctcttgttgcccaggttgcagtgcagtggcatgatctcggctcactgcaatctccgcctcccaggttcaagcgattctcctgcctcagtctcccaatagctgggactacaggcacccgccactacgcccagctaattttttgtattt

SEQ ID NO: 1183 - DNA, 292 bp, Homo sapiens
agcagacacatgagcagaacccaggatggaagaatgtaatcaccagcgtgactccagtgatggagatgaactagatgtggagactggggagcagcagagtcaactcagttatcatcttggcggccgggctgccgtccagctcacagaagccacctgatccggaaaagatttccaaagcctgctggagtaagtttggcaattactatgaaaggcatcaccatttctggaggaggctcttgtgtttaatatgctttctagcacgttcttctagttcctgtaccattgagctgac

SEQ ID NO: 1184 - DNA, 2152 bp, Homo sapiens
cttgcggcttccgcccctctccgctggccccgacgccgcgctcgggccgggactcgagccccggttccgcggggcaggctcaggtctgcgcgctgcgcctgcagccgaggcagaaatccgtcccgaggcgcgggcgccgggtccgggtcccaaggatgcgcgtcgggctccctcccgcggggacagccgagctccgccggcgctccaggtgttcccgcagtgcgtccgggcgcggacgcctctctgccctcggaggggaagcgggagggcccttggggtaacgccccgacctcgggcttcctaacctgggtcgacagccggctggcacagggaggcctgcgcgggagaggggcggagagagcgcagcgcggggcacagcgggcggtctccgtgccgcgcgcgcgactggaaacggcgtgcagatcctaaaacgagggttccacagagggccacgaggggcaggagagagtccccggagaactctagctccccgacacggctacctcttggcaaacgagcgagaattggggcgcagagccttgggagggccgttccctcggcgggagcggcccgagcacagcctcacagcagatgcgagcgcggcgggcgctttggtgacgaagtagcgggacctgcaggaggcagaggcctggtggggccgtggacgccacgccgagctgcccagacccttccagaagacagtggggactattcaacggtttccagcagaaactaagccaggtgttcgttttacggagattgctcggctgcagggtggaggctggatgagaacaggcgtcctctcaggtaggcgctcgtggtggtaacgctgcccaggaggagggcacgggttccgggaagacttgcgaggttaaaccggcagctccggagaactgagcgcaagaggtcggtgacacagagaggagtccgggaggccgcatgtttcaggctgaagtcacttggcggggacgtttattgagatgcgaaacacaggaagggatagaggctgcgcagagggaaaaggcgatggactcggttttggaaacgctgatgtgaagtccctacgatgaaaaaagaaatcttccgatttctccctttgaagtctttgcttcttccgttgcaaagaacacagcctatgacatcaggttgaaaccaagaatgtagttctctgaaaatactgtgtgtgggggagggagtttatcttgtctcattccttacaaggatactttgctctccgacaccttagctccctgaaagtttcctagatcgtccatcttttcctcattttttcgactgcaagcaatgaactgttaattttttacagtttggttttacagccacacactttattcttctttgtcaagtttaaagtattctagggcttgtgccttcccacataaaatttagaataaacttgtctgtttctacaaaaagccatgttggtatttcgagaggaattgcaatcaacctatggatcaaattgagaattcaccagaaagcgggtaccattagtatccctcctttatcagtgaggaaactagagcacagaggctttcagtgacgtcacacagcaggctgttgacagctgggatctgaaggccctggaatggaaagattcagtctcatattgcccaattcggttcgctggactctgctcagcaagcagccgcgtgcgaagcactgctcttgttcaaactaagtgagatggcctaggtgaaaatgcttcaggaaaagcacacaaatgcacttaaaattaaagtataaccacgtggctagcaaagcggaaagtgaaatgcttctaaaccatcaggtctataaaataaactatgggaacatggaaaactatatccaaatattagaaggcttaaaaattcttctgttttttcggctgggcgtggtggctcacacctgtaatcccagcgctttgggagaccagaggtgcacaccatcatgccaggctaatttttgtattttttgtagagatggggtctcacagtgttgcccaggttggtctccaactcctgggctcaagtgacctgcctcctcaatctctcaaagtactgggattacaaggataagctaccacgcctggccaattttattcttttgtatgtgggtatcagttactacagaataaaatccaactccttgg

SEQ ID NO: 1185 - DNA, 459 bp, Homo sapiens
caggtagcctctggcagtcagtctgctcccggccgtgaagccagcacctccgccagcccaccaccagttccttctcctgggctccctcctggccctccaccaagcggcaacatctcccaggacaaaggacacaggtttctgagggaagagagaaagagaaaggaagaagtggaaagtgcggaaccccaatgagtagggcacagaaaggagggcgagcagagacagcaagaggtcaggtaagccaaggagcagcggagcaggtcaatcagggaagttctgggcaccctggggctcaggggatctcagggggtgaactatcacagatcaggacagcaaggttccaggaggatgagacagaggttccacgtctccaggcaagcagaggaatcacagcacactgggattacggaagttatgtccggcaaagcgagcttcatcccccagctcttcctcaattct

SEQ ID NO: 1186 - DNA, 213 bp, Homo sapiens
cccattgcttgtttttgtcaggtttgtcaaagatcagatagttgtagatatgcggtgttatttctgagggctctgttctgttccattgatctatatctctgttttggtaccagtaccatgctgttttggttactgtagccttgtagtatagtttgaagaagtcaggtagtgtgatgcctccagctttgttcttttggcttaggattgacttgg

SEQ ID NO: 1187 - DNA, 1077 bp, Homo sapiens
ctgaaatctgaactgtgttcaaagtctaaaacgtttaccttagcaaattcctcataaaactccatttggaagagtcccgagagcgaatttgttaagtacacttgcaaaaggtagatgaggagacagataaaatcttattacctctttcagatgagagccacttgagccctgctcagctatgagaataagagaggggaattaattctaattgaatacacttgttctcttatagctgttgttccacaccagaaccaaatgagcgcaagatctgacaaagaaaaaaaaaggttcatcttttattcctccaaacactttcatttaaatcaagaggatgggatgtggttattgctgtgtttttaggcagaatcaacggtttctgggtctgagatggtgcatacaccctctcagtccctgtatcctgagatggagtcacctaagaatccacagcaagtcctaaccagggatgggtctgggtgattaaggaaggttggcttcagaactgggccaggggcactgctttgcttttgctgttttgatcagctctctgcctgcaggagacaaggaaaaccaatgggaacagctggggaaactgagttacagagcttttctgcactgagtcatcaggagcaaatgctagatcagggtctctctctctgccacccaggccagagtgcagttgacgcagggcaggggagccccgaagtggagcatagcgtgtccggaactggtgggttcttggtctcactgacttcaagaatgaagccgcggaccctcgcgatttctactcattgctcatccactgaacccagaacaaaccagaagtgcttgaaatgaggacgggtagctccgtgtaccaatcggaatttaaaactctatcaattcctgctatagaaatgaggcttctccctgggaccagcattccacgaaggcagcccttttctagatggagaaaacagaacctgaagacacccgtttccctaaactgctcttgctcatgtgtaagtacaaatgaaaaatgctgaggctgcttctgttgccattgctttttaattacggccatcaataaatcatttcatc

SEQ ID NO: 1188 - DNA, 1161 bp, Homo sapiens
tgcttggtgataggtgatggtctcgccgctcagctataggtgatggtctcaccgcttggtgataggcgaaagtcccatctgggtcgccaaaatgtgtccggaattggtgggttcttggtctcactgacttcaagaatgaaactgcggacccttgcggtgagtgttacagctcttaaggtggtgcgtctggagtttgttccttctgatgttcggatgtgttcggagtttcttccttctggtgggttcgtggtctcgctggctcaggagtgaagctgcagacctttgcggtgagtgttacagctcttaaggcggcacatctggagttgttcgttcctcccggcgggctcgtggtctcgctggcttcaggagtgaagctgcaggccttcgtggtgagtgttacagctcataaaagcagcatggacccaaagagtgagcagtagcaagatttattgcaaagagcaaaagaacaaagcttccacagtgtggaaggggacccaagcgggttgccactgctggctggggcagcctggtttcattctcttatctggccccacccacgtcctgctgattggtagagcccagtggtctgttttgacagggcgctgattggtgcgtttacaatccctgagctggatacaaaggttctccacgtccccatcagattagatacagagtatccacacaaaggttctccaaggccccaccagagcagatagatacagagtgtccattggtgcactcacaaaccctgagctagacacagggtgctgattggtgtgtttacaaaccttgagctagatacagagtgccgattggtgtatttacaatccctgagctagacataaaggttcttcacggccccaccagagcagctagatacagagtgtcaattggtgcactcacaaaccctgagctagacacagggtgctgactggtgtgtttacaaaccttgagctagatacagagtgccgattggtgtatttatgtctagctcagggattgtaaaggttctccaaagccccaccagattcaggagcccagctggcttcacccggtgaatcccgcaccggggctgcaggtggagctgcctgccagtcccctgcgtgcgcccgcactcctcagcccttgggtggtcgatgggactgggtgccgtggagcagg

SEQ ID NO: 1189 - DNA, 845 bp, Homo sapiens
gtaaacataaggcccaggctaagatcaaaaaataagaataggaaataataatatttgattcttccaaagttgcaaagagaagctttctaagaatgcatacttatgtgcagttttcctcctgagttgtttctaatatgccacttgaggtatacttgacatgcaataagttgtacagatataaagtgtacaatttcatgagtgtctcaccatgtgatactcatcacatgtgaaaccatcactataatcaggtaacaaacatatatagtacccccaaaactttcctttatgttcctgtgttattcctccaacttaccactgcccattctttatcaaacccccagttaccaggcaaccatggatctgctttcagtcactatagattactttccatattctagaatggtatataaatggaatcatacatcattgtgttttctctgtgcccacagatgcctgtttcttcctctttttataaagacaccagtcctattgtactacggcctcactgtatggcctaatttaaccttaactacctacttaaaagccttatatccaaatacagtcacattgagagtgtgggcttcaacacatggattttggagacaaacaagtcagtccataacagtctttctgaagcagattggttattagcacaatttgctttggtgtggtaagaacaaaagcactgcttcactgttttatgtcatggctacgtcacttctgttttcagtttaattggcattttgcaaaacatcatgctaactcaatatattaataatattgcattaactgttacccataagcaggaagtgatgagtttctcaaatatagtaaaataccataac

SEQ ID NO: 1190 - DNA, 352 bp, Homo sapiens
gccacccatttatttgttcattaaagtatcatttttgaccatctattcttggtgctggtttcgagttcctgggagtcaacagaaagcaagacagacattatctctttttttacagtccttacattgtactgaggaagatatatgattaaaaaaatacacaaatcaggtgtggggatgatttatcttaaggtctgaacaacattgttaaaatttcataacaccaagaattaatacagtcatgtagaatttagctgtaaacaagactgtacatttccttcttataatagaacttcccattaatgaatatgtcaagacaattccatttaatcattgacaacaaaattacactagg

SEQ ID NO: 1191 - DNA, 257 bp, Homo sapiens
tgggaaatatgtacaaccttgttgtgtcaggaattcaggagccgaaagaaaaaatagatggggaatggcaaaggtttgtcctgtgaggtggataattaaggctagaagaaatcctttggagagatctgcgcttggcagataacatcatctcaaatttcctcatgatgcaactaaataagaaagttcctatttcaactatcttagagttgtataagaatgtatatacaactaattgatttttcccttcagtatataat

SEQ ID NO: 1192 - DNA, 1657 bp, Homo sapiens
gttagtcagtattaacagctgccacttatcatttcaggccttgaataagtcttgtgccatcattcagtttttggtcagggatagtgataacttcaggataccttcttagaggtattgtgtgtggggatgtgactggacatcctaaagacaggccacttgatcagttggatgagaggatcctgtgttgtacacataagaatctgttcctactcttccagaagggtctgagaatacaaggggatttcaaaaattttttggaagaacgtaatcacaatatgaaagtagacaatataaactttatttcttaacattatctccatcacattcaagaagtttggcaagtaatgatacaagaaatttagcctatctacaaagaattggggaccctgggaatttcaccatataaatgtagtcttttcacactattaactgaagaaaacagaatacacgttaaagatattttaatattagagaaaaagaaattcaaagatactgcatcagtactgtaaattggatgcctagtgattttcttttttttcttttctgttttattttcataggttggggaacaggtggtgtttggttatgtatataagttcttgagtggtgatttgtgagattttgttgcacccatcacctgggcagtactcactgcacccaatttatagtcttttatccctcacctctttctgactctttccccctgagttcccaaagtccactgtgtcattcttaagcctttgcatcctcatagtttagctcccattcatgagtgagaacatacgatatttggttttccagtcctaagttacttcacttagaatgatgatatcgacttatgaaagattggagaaagttaggcaaaactttagcagatgaatgcccagaaaggctttagcagagtccttctccatcacaacaaagctcctgctcattcccctcatgaaagaggagcaattttccagtcgatgttgtcattccttgaccctccccaaagttatcaaccaaaataccttgggcatccgaacacactgttggcataatatttgtttttgtcgcatttacttagactagaccacttccacctcttggtacccattgctttgattgtgtttttccctttgagtggcactggtaaagccacatttgatctcctgttacagctcttcaaagacatgcttaggatcttttcttttcttctccttcctacttctttaatttttcattgaatgttctgttcttgtctgtagctgacttgggtacagcagttttggccctcatcaagtggatagtttgctcaagtttaagctcttgtttctgttgttaattgtcagacctcttcaattaggccaaaagaagataaagtttttgcccataagttgatgtgtatggtctgctgctgcaatgtttactttcaccattatctcatcgattctaaaagtgagttatccattctgtgaagggctgatttacatgcgcacaaatatgtcctaatgcatcagtgatgtcaccatccctccacccaagcttcaacataaactcgaatttgtttttcctacaattttagtagaatatttgctgctctgatagaggctgttttcaaaccggtttctcaaccatgttagtgactgaacgagatcctgttcagacatgttgt

SEQ ID NO: 1193 - DNA, 6096 bp, Homo sapiens
ccaggaattaaactaagaggggaggctgggggcggtggctcacgcttgtaatcccagcactttgggaggccaaggcaggtggattacctgaggtcaggagtttgagaccaaccgggcctacctggtgaaatcccttctctactaaaaatacaaaaattagccaggtgtgggtgcctgtcatcccagctacttgggaggctgaggcacgagaattgcttgaacctaggaggtggaggttacagtgagccaagatttcgccattgcactccagcctgggcaacaagagcgaaactccattttaaacaaaaaataaactaaggggaaattagtgagaggtgacagcgcactggcagccctcacacccctcactcactctcagcacctcctctgcctgggcttccactttggcggcacttgaggagcccttcagcccgccgctgcactgtgggagcccctttctcggctggccaaggcggagccggctccctcagcttgccgggaggtgtggagggagaggtgtggagggagaggcatgggcgggaaccggggctgcgcacggtgggcgtgggctcagcggaccctgcgctcggagcagccagctggccccaccgcccgagcagtgaggggcttttagcacccgggccagcagctgctgtgctcaatttctcacagggccttagctgccttcccacagggcagggctcaggacctgcagcccgccatgcctgagcctccccgaactccgtgggctcctgtgcggcctgagcctccccgagcgccgccccctgctccacagcgcccagtcccatcaaccagccaagggctgaggagtgtgggcacagggcgtgggactggcaggtagctccacctgcagctctggtgcaggatccactgggtgaagccagctgggctcctgagtctggtggggacttggagaacctttatgtctagctcagggattgtaaatacaccaatcggcactctgtatctagctcaaggtttgtaaacacaccaatcagcaccctgtgtctagctcaaggttcgtgaatgcaccaatcaaccctctgtatctagctactctggtggggccttggagaacatttgtgtctagctcagggattgtaaacacacaaatcagtgccctgtcaaaacagaccactcggctctaccaatcagcaggatgtgggtggggccagataagagaataaaagcaggctgcccgagccagcggtggcaacccgctcgggtccccttccacactgtggaagctttgttctttcgctctttgcaataaatcttgctactgctcactctttgggtccacactgcttttatgagctgtaacactcaccgcaaaggtctgcagctttactcctgaagccagcgagaccacgagcccactgggaggaatgaacaactctggacgcgctgccttaagagctgtaacactcaccgcgaaggtctgcagcttcactcctgagccagcgacaccacgaacccaccagaaggaagaaactccaaacacatccgaacatcagaaggaacaaactccggacacgctgcctttaagaactgtaacactcactgtgagggtccgcgacttcattcttgaagtcagtgaaaccaagaatccaccaattccggacatattaggaaggtgtagattgagatgtgaagaaaaataagacaaaattggagccgagtgtccaaagagattatgtgaagggtagagggtgcatatgggactagttgatggaaactttttagtctcaacacgttcactgttactttatcttaaatactcctttggttttgtttttctgagaagcaggaatgttttagatctagtaaacaaaatttgtctacgtaatttttctgtgaatattagtcttctgcatctagaaatggaagcaggaagtaaactatttctagcttctgtgggacccattcatccttgaacggcctaattatacttggttatatctttaaagttgcagaatcaactggaaaatcacagcattgtcctggaagatatttacaagtcagtcatattgttgtactttatttgcagagacagcaatatgcacttatgtaaaaacagtttcattcttttggttccagctcaaacactagaatccgtttgaaaatgctgtcccacaggaaatgcaggatgtggccggtagaagcaatgtgacaggcaaatagggtaacctgaagagcattcagtaatggtctgtgttctctgtcagaattatgacaattccaaagaccagaatgaaagtacttggtgcagaaaagcttttcgcataactcatgcctcaaggaatgagccttgattggtgaagaaaattgagtcaacggtaaattccatcagatcttacactgacattgataaccctggaaaaatcccggaggcatggacacgcacacaccagcataacgctggtcatcctggcaggcaactagatctagttgccaacttttttatctttttggtttgaagcatgtggataattatctggctaccctttccctctgtagccatagcatttgaatggaagagacatgcctggtgtgtcaaaaaaaaaaaacccacatgaaattcaatgttatttatgacagcagtccccaacctttctggcaccagggacccatttcatagaagacaatttttctacagacagggaagcagggggatggtttctggatgaaaccgttccatctcagatcatcaggcattagattctcataaggagcgcaaaacctagatccttcacgtgcgcagttcacaatagggttcacgctcttaggggagtctaatgctgggtctgttctgacaggaggtggagctcaggcagtgatgtgagtgatggggagcagctataaatacacacgaagctggccaggtgcagtggctcacgcctgtaatcccagtactttgggaggccaagtcgggcagatcacgaggtcaggagtttgagacctgcctggccaacatggtgaaaccccatctctactaaaaataaaaaattagccgggtgtggtggcgggcacctgtagtcccagctactcgggaggctgagacagtataactgcttgaacccgggaggcggaggttgcagtgagccgagatcgtgccactgcactccagcctgggcaacagagcgagactccatctcaataaacaacaacaacaacacgtgaagcttcacctgctcatccgccgctcacctcctgctgtgcagcacacttcctcacacgccacagatgggtaccagtctgtggcctggggtttggagacccctgatttatggtaagttagtgaacaataatgccacctcctcagaggcactatatagttcttaacaaaggaatgaagcgaaaggtcagggaaagaaaagcaaaactactctcgtgattaaatttcatacctaaaaagtccacaagaagaaaagttttcatttctccctaatccatccttcaatcttgagtatcaacattttgaataatttctgctgagcactatatatctgggtttggctgaagtataaacaaatcaggaagaccaagtttcccaattgcactagaattttaatacatgtctggtcacgtctctgacaattcctggttttgccttgggaattactaggggaaatgccaaagctaagtaagttctacaaatcaacacaaaagtggcatacgtcattcgccccagggccattagtttatgtaaccttgtaaaaccgagtttgtaatacctataacgtaagggtaacagtaccaacctctttcataactgaagaagccgcaaagaaatactcaggatacagaaacatatatacagacgcacacatacataaaatcaaacttttttactcaaaaagcagattctcccagactaaactcatttctaaacggagtttcactcttgttacccaggccagagtgcaatggcacgaacttggctcactgcaacctccgcctcccaggttcaagcgattctcccaccttggcctcccaagtagcggggattacaggcaccagccaccatgcccgggtaatttctgtattttttttagtagagatggggtttcaccatgttggtcaggctggtctggaactcctgacctcaggtgatccactcgtctcggcctcccaaagtgctgggattacaggtgtgagccaccgcgcccggcctaaactcatttcttgaatgtactcctatatcagggtatggagtccttgaaactcatttaatgaaatgtttactctgtgcagagaatactgggtaggtatctaggttcaaaatatatttcatattttaaggatgttatcatctaagacacaggaaactatatatgtgtggtctataaaaccatatatagcgttactaagaataaaactttgagggaaacaaagacatgaaggccagtttctaccaaccttccactttgaccagggaaaccaggagactgcacatagaggcctatttgactgtgttcatcaacagaaatgaacagattgcaagataagcaaaacaggctctagaaagaagcagccaatgaacagctaatttataattaaaaggaagaaaagcagctgcaccttgggagctcggaatttagtcactaccaagacccagggccactgctcagagacaaaaggtaaacacgctcattgtagtcaagatgtatcggaatcacagacttggaatcttagagctgaaaggggcttgagagcccacccagacctgctcacgctgtaggaaggcggaaactgaggctcagggaaatgaaatggcttgccaaagattaaggctagaaacgtccagccaagggctctttcacaactcctatccctgaaatatcccataacggccagataggtcatggggtattaaccaacaaagagatccagcataactgcttcttgaaatacaaatcactcagactcccaggttccatcaggaaatagcaaaacatgagagggaaaggactggtaatgccatgttaccagtcagaggttccatcagaaaagaaccactaggaatgatgtagaaagagaggattgtgaaagcggtttgagcaattagaggggctggtgaaagtctcggttcggctgtttcttcttcaccagaccacaggccaggcggttggaaaggatggtgagggagagcaagtacgactgagacctgcaagccacaagctgggacctgcacctgtctctcatcagagcccgtgctggtctctcatccccaaaccttcatccttgtggctgcagaccaagaagctggttctcatacccggcccagggtctggaaaagccaaaggcagagttctgcgggagtgggaggagccgtgggcccagcggctgcccacaccacaagtgcaggagatccatggtaacgtgcacgtgatggaacagggcctgacctacatccacttccagtgaatacacatggctgttgctctacttccacttccaaacctcatgcaaatctctctcgtggccaaccctcaccagagaaacaaacaaggaagggaattctgggaacacagttcagtttagccaagttcacgacactgcagaaaccacaacatgccatcaaaatattaaactaactagaattctttccgggagtattgaatttgcctattgttcttctgccatacttctccgcttccacccagtaataagtagcctatcacctactcaggaccccagtctaagtgaaccccatgttttgtctaacttctactttagaagtagacacagttggctggagagctggctgactgcgtggtttgtttgtgctgcactaggtctgccatcctgccctgtgccagccactaacagctgcagcagtggaaaggctcggccctcgcaggcttgaactgccacccactctgtgctttcatgtgtcacctgtattaagtgcagtgaggataatggcacctaagctatttttgtagctctgtaaacagcccttcattcctcgaagctacaaacatatccctgtgttcagaaccaggttctgtatactccagaagaaagacaatgatggtgatgtcttaaatataccactttttgtcaatc

SEQ ID NO: 1194 - DNA, 450 bp, Homo sapiens
aaaaggaaaagagcatctccagaggagtgcatgacacaggcaaaagcccaaagcaaattctgtagaatctggctatggcaacccgccagaatgaaagttaatgagcaaaaagcatgaaatctgtattagttcccaatagctgcatagccgactgagggctggaatcagctgaaattcactctctcacgtctgacagcaaggctgctgtgtgctgagaccgtcgctggggctgacagccgctttatgtgttctcttcacataagccagcttgagcttcttgaaaacatgatggatagctttccaaggacattgagatatgctacaattctctatggagttctaaatcagaattttgggtgatcacaaaaaggaaaaaggaccacagttactacgttacaaagttcagaatctggaagcagcttatttttcgtctttgaaatatgagacaag

SEQ ID NO: 1195 - DNA, 2020 bp, Homo sapiens
cttggactaggcaagtagagttttccaaattgtttcaatggcttgaaatactcaagcgccaagtgtggggtttatttatctcaaatgaagaaattggctatttagcaggtaccactcttctaagcatgaatctagcctatttccttttcagataaagattttggtgcgatgagagtgctgtgaatatggattttctatcaaaaacacaggagtgccgttttcagagtaaggtgaaatttaatgccagaatttcaatattgaaatctcttagagatcagactctaatgatgaacataaaatgtaatatgcatacagtatatgtgtatctatgtgtaaagcactgtatataattatgtagagagtatttctctagcaagtgataattttaaacccctgaaatgttataataaaatgaaatagcatagctagattaatgcagtgtttctttagtcttggctatagactattcacaattccaggaagcacatatttgagatatcttttcataggaatcatggaaaggccccttgacatcagttttcaccttatttggtcctgccaccagaagcagcagctggaatggaaccttgtatgtaactacatatgtacaatgggaccttgtgcatgaactatatttatttatttatttatatacttactaacaggcttattacagcaacctgatgaaggttcaggatcatttactctttttacctagagtaaaaagactacttctaaactgtagcttttagactggtatcctaaaggctaaaaagcctgtatcttttaaccaacctgagacaataactatttcctctatacttacagaatttttttctttgcaaaagtaataacactcaataaacaagaaagtgctgctagcattttgaagttctcagctaacttaccagcaaagaaaatttactgtgtcctgttgtatttagtataaaaacaagtggggcatcctagagacagaagtgatttttctagtgggttacctacgaggggatgtattgatttctattggtagtactggtctctgcctgcagatgtacattgtgtccagggtttcagaaaacagagcttttaattcattgtaaatagtagcattgtgtgaaagagaattttttttttaaactacaactacaaaaaatattgtgcacatcggtttaaaatgaattgaccttttgtttcagtgaggacgatgtgttacttgttatggagtgactccatttgcccatgcaaataagcacaaagccaggatattatcaggcaatggcaaaattaagagggggaaaacacgatgcagaaaagagggtctataccactcagggtggcagagattgatgtttgaaacttcgttgtgacaaagagggagctgtgaactttcctttctgatttttaatttgaggtatgacattgacttcttttttgccatgtcctatagactgttgaccggtagcttattattacagacttctatcagttataaggactgtgagggacccctgccatattgtatccctctttgataatcagggcatgagtcactggcatgaatcagtaggtccctcttccttgaaggagtttttggaagtagaagcagcagcattcctgactgatgggcctgcttggcctaagtctaaatgatccttgggatgaaacgttctcctgctgatggcttttttcccaaactaaaagagtacatttttatgttaagatgtccagaaccattttattgaaaataaaagctatctttttatcctcatttttttttgaaaattttggttaagttgcttttttgaatagactcacaaggttcagaatttcaaaagtataaaaaatgtgtacaggaaaaaatctctcccccattcccattcctcatttgctcagtttccacgcgcctcactccccacaaataacagttgtaactggtgacttctgttttattctagatttacattatttgctgatacttttaaacaaggttatacctcttctcccccaatttatacatgcc

SEQ ID NO: 1196 - DNA, 1100 bp, Homo sapiens
ctaagatcatcaataaccgttatcatgctaaatccaaaaggtattttttagtcattgtcttatttcatcctcagtttcattcagctgcatgaatgactttccaaccctcaccccatttttttggttgtttttgaaggactatcttccctctgcttttcacttggaagtaaacctgtcttgttctccacttcatccctaacacactatttaaagtgctttctaatagcatgtgttgaataaatttggcgtgaagagctgtagccaaatgaatacgatgtgaaatccaatgccataaaggctgcaaaagatctacaaggtgacagtgtataaggcttcatagaaaagagaaagttccatagacaaggcagtatttgagctgggctttaaaggatgcatatgattttgcccagcagagatgttggacagtgggaagattgccaaggatatatttaaagctctggtgtcttatgttcctcttgggcttgagtttggatgcaacacaggggatacaaaaggaaaatagtgactataaagaatcattctaatggcgagatgcttatacaatgagatgcataggagatctgagacgaattcaactacaaattcacatctcctgtgtgagccatgggtgagttgagtagaatggtggtagaattatatgggttacattaactacttagactttgtcctatttttcctatatgaaaatagttgaaattctcataaaaatgcatgtatgatgtgaaactgaagtataatgtacagtcagataattttgaatatattttgtgaaatagatgtttatgatttataacagcagtattttaatttctatgcagcttaaattgatgcttggataggggaaaaggatgaagaagaaactcaatggtatgttaactgagagaatgaagtaaagtggcatagtaacgacagttataaaaggggcactgcataccccattgctgtcaagggattgtaaacttccagactgggctaaacgaatgctgggaaaggtctgtacagccacaacaagtccttagacttaggacttagaagcttatttgcagtagttattttaggagttacaggattctggggac

SEQ ID NO: 1197 - DNA, 794 bp, Homo sapiens
tgtaaagtaaactttaagctagaatatagtacttttatcactaataatttgtctttcatcatattggttttacatataatccttaattagaaattccccttcatagctttcctggaatcttggtttgagattaaacctgatctcgattctgtatgatagagctttgatcttccccagagcagtatcactgcctctgaaatgttctcttcccaatactggatagttttgcctttctctagttcataatcttaccatatctaggacacacaggctaaacaaacaaaatactttaatcctttcctgccatctctagttatctgaaaatacctgttgtacctgacagaatcagggcccagttgtcactgggacaatggaaggctggtcattgagaattggagaaaatcaccaacaaggagtaggacattggagcagattatagcaacatgtggaagcttgtgcatacaaagtagcagatgacctctgtaggaacgtatctggtcagacaggtgctgaatatctagctgttggccttagcaggtgtccggggaacaaggctggagcacagggactggaagctccgtcagctgatggtgagcagtggtcacactgctaaactggcctggagcagcaggaagccttggcacaagcagcagactctcccaacacactaaatcctcaacgcagattaaagacccgataaccaaagaattcagcattttgtgttcattggagaaatcctaggggaaaaagagcaaaaagaagaaaataatttttaaaatatgctaattctgcca

SEQ ID NO: 1198 - DNA, 1995 bp, Homo sapiens
tcaaatataaaatattttatgattaaccagtaaaattttaatgtattttaaaacttaaaataaaagaatcacaggattatgagctcccagaactgaaatgcattctcctatcttgccacttaatacttactagaccaccaatgatattcaatttttacaaaacaaatattctttatgattatcaatttccacgttaatttcccagtgttaaaaatctctttcctagagttactatacatccttcacactgaagccttttttattctagacttagtaacaatatctatagctgatatctatcatttgttaaatattcttttcttgaagactactattgtacctcctcttcgttagactaaagtataatttctaaataggtcttttcttatttaacagttttcctttttctcaaagttctccaaattattttattagaatccagagttggatatatgaatgggatctaatggattatgtgtggaccagaaagattaagccaagctcctttatttatgccactcagcactcaggccaaagacaatttattgcttcttcttattttttgattaaggaaaatcctcaggagaaaagcatttctccatactattcaatattgtaattgtgcttacttttaaaaaactacctgtttactttgctaactacttttactagttagcattaatctttgctcactctgtttgcaataattagccagtattttttagtgcatttctgctgtttatttttcctctccaagtatgtcttcaattagtcttactggagttcattctttttggttctcactagttctgccccttttcaatttccttttgaattcctgatgttatctttacagatactgatttttatcaacactacacatactgattcactttaaatgcctataaataaatatggctcagtgtaaactatactaaatgatgccacagtgtaaatacatggtattctctcttactgcttagggactatcacttaattttgtgctgaaaatgagaaatttatttccaagtttctataacttcttggcaaagattcactaaaattattattttcatagaattagtatttcagaaaaagactttcccactctatgaagataaataactgaaatgaaactagtttataatagacgtaataatacactttgtattggaagaaatgttttgtgggtgacccggcttttcatggagtcctagattcagagttagggataaagaatgcaaatacaacttagcagctatgccacttctcaggtccaaatacgtggtgcttgagaaagggggaaaaataaaaaacacaaagtgagggcaggggtaagctttctttcattgaactctgataaaatccacagtctcactaatactggtactaggcagatacaacgccagtgaaatgaagacaatgtttaggaacagcaaggccatgcaggtagaaaagagcagaaggttaggctgctatggttgggaacttcatgtcgaatcgttttgtttctgtttctgtactttaacctgaacccttattttggtgaagatttcaactctttactccacgttgcataataaatgacactgtggaaaatagcactcatataaagaacacaaaacgtcctggttgctttggtaatagcgaccactacttaataggcgtatgactaacgaaagctcctgcaatgtgctttacgacttaccatttggtctctgatggaccactccatttctgtgccacccatgtccgctcaataagctgagtggctcctggatctcctttctcagtgccctacactggtaactgtcctttgtgttaacagtgagggtcatttttgttttgaagagaagttacagatgtctttatatgaaaaggtcaaacccttatggttttaaataagttaaggctacctgacaaagacaaggaatcagggctaggagcaattgtgtgggcagcacttgatggttaaggagcccgagagtgttagac

SEQ ID NO: 1199 - DNA, 1268 bp, Homo sapiens
atgataagggagaggactttagctgaatggtgggccactggggggtctttggacccctgaacaacttggggaagaggatgacctattcccatctgtcccttagtactcaatttagaatgccaggaaggaagtagaggggagccctcttgtggcagttgctgaagccttccagttcttttgaggggataggggatgaagaggagactgaacctgggaggtagatacttagcacccagctcttaggacaaacagcaatcccatcttccagaacatgcatagcatcagtcatggactggcggaagacttggacccagggtccacttcaggataatctgggcaagggagcttcccaaatgagcctgtagaaagccagtggaagggcttaggttggctaaggtgggatggagggcaaaaccctccccttcattgcagagtataggggcagtggcagagaatgaatgtatgtgtgggtttctcagccttgaggtataaggtctaaaggctctggggattcactgcatacaccacttccagttcaagcgcctaggttggttacagcaggaagttgacaagtatgtatttagtacattcgatgtttttaggcatctgctaaaagtaggtcaaaccactgaactcagggagggggctggggatccatttctaggatgctgtggaatccttttgggacatctgtagtataccacgttgggtagtgagagttgggggacaccccttccattgctgctgcttagtgtagggagtcatgtctttgggcagcagtaatattattaagaaaagctttttttttttttgagacacagtctctgtcacccaggccggaatgcagtggcgtgatctcggctcactgtaacctctgcctcccaggttcaagcgattcttgtgcctcagccttttccgagttgctgggattatgagtgcacaccacaactccctgctaatttttttttttttttttgagacggagtctcactcttgcccaagctggagtgcaatggcgtgatctcggctcactgcaacctctgcctctcaggttcaagcaattctcctgcctcagcctccgagtagctgggactacaggttcctgaacagagcctcagacctggataagacaatagccttccaccttcaccacactgttcgagtctgctgatacatcagtgcagtatgctgtgtcatccttttgcttagaaacttgcaatgtgttcccactgccttagtctgacattcaaggttcttcacaactagcc

SEQ ID NO: 1200 - DNA, 1638 bp, Homo sapiens
taaatacacacagggggttgcgcagtttggtttgtcttccacgctggcatgcaacattttggcagatgtgagtgggcaggccaggtgccccttgcagtgaccctggctctgaaagggatgcggtgaaggtggggagcaggaggaggaggaggatgtagtgtgaagcttctggtgaagggtttgcgtgtgtgttgtttcttttttatgtaagtgaattatatttcccttacatcttgctaaagagaaggctgctccctctgtgtcatctctctcctcatctgcgctacaccctcacatttccttatgtgtttttaaaagaaccatgtggtggcaacattacataaaaccccctggattcttaagtgccctgctgacagcaaatattagcctaagtccacaggcccacaggaaccttccttccaccctagtgggtctggagacagcatggcttgtctaccccaccgttgccctcttttccatgagttgcagctttagtgcagaggagccagattggacccccttcctcagaacaatggttttcaaactactccacagaatcctcagggtctcttaggactgttcaagggctcatttgctgaggagcctttgaacagtcagtcctaagagacgctgagacttcttccaccaaaaaaaaaaaaaaaaaaaaatgcaaactgcccaggtctgcattactttattttttatattggggttctatgtaagatttgtttttgaaaaacatttaaaaatcactgctttggatttattccacactccactggtatttttccccctgcagttctccctaactgctaaaaggagctcagcaggtaaagggagcagggcctcttttccttgaaggagtcatgggccagtgcagcctgcgcttaccagctggcattcccactcagcttcctttcctgacttagaagttgggtgataggctgccctgccgctggagaatcttggtcttcctcctagaaaagactggatatcaggacaccagactttctctcctggtttggaatggctagtgacctccatccctgcagttacctagaaaaccaccttagcaccatgtggaaggaaaggaccgtctgaaactaaaacaacagtcctcttcagtatggagggtgctgcatatgggctgagaatggctgggagaagacccctcagggtcaagccttagagcttcccacctcttgaaaatccaccctgcccctttctttaaagtgcacttaataccagatggggacattagagaaggaactctttgtggagaaaaaaaaaatgtacattggggaaaagtcaggctccagcttgaaaggaaggcaactagagagattttgccaatgagctggaagcccccaaaccaaggggtggagatgggaggagcatgccgcccagtatggaacaagaaagaaatccagctcatcacttcaacttgagggcactgtgacaaaaaaaaaaggctcagaaatttcccagcctattcacccccaaacccaaggaatcaatcattttgactacacctgcctgtaaccatctccatggacagatgagcagccattgacaggctgctgggagcaggctgcctcctccccagccaggcgctctgtctcaggcacattctctcct

SEQ ID NO: 1201 - DNA, 1406 bp, Homo sapiens
acattttggcagatgtgagtgggcaggccaggtgccccttgcagtgaccctggctctgaaagggatgcggtgaaggtggggagcaggaggaggaggaggatgtagtgtgaagcttctggtgaagggtttgcgtgtgtgttgtttcttttttattcctcttcagtatggagggtgctgcatatgggctgagaatggctgggagaagacccctcagggtcaagccttagagcttcccacctcttgaaaatccaccctgcccctttctttaaagtgcacttaataccagatggggacattagagaaggaactctttgtggagaaaaaaaaaatgtacattggggaaaagtcaggctccagcttgaaaggaaggcaactagagagattttgccaatgagctggaagcccccaaaccaaggggtggagatgggaggagcatgccgcccagtatggaacaagaaagaaatccagctcatcacttcaacttgagggcactgtgacaaaaaaaaaaggctcagaaatttcccagcctattcacccccaaacccaaggaatcaatcattttgactacacctgcctgtaaccatctccatggacagatgagcagccattgacaggctgctgggagcagtctgcctcctccatttttcaaaatattttaaatcagctctgggttctggtcatgagctctggggcagggaatatcaaaaggagcttgaagaaaaagggaaatggtcccttgagcaacccatttctcagtccaggggaaaacaggaagagggaggcaaaaggcagactttgtagggcagaagtaacacctgaatcctttgattaaggtgaggggtgtatgaagaaaattatatgtctcaattagcagcccttccattttaccttcccctgtgctatatgtgaaagaggagggaggaagagtctatttctctgtctcatgatgctaagacattcttctgcttaaggctttgtgtgtgtgcatgcgtgtgtgcatgtttgtgtgcgtgcgtgcgtgtgtgtatgaagggtcacaaccctctagctcccatttttccttttgtcatctctgtgacctctactcagtgactaacaccactcagtgtgagacgagtagatgagaaagaagaaacattcaccctcctccctattgccccaaataaggaaggtagactatgctttgaaattgctaaatacatcagtagatacttgagaataagacagaagagagacatagcagcagcttttgatatatagatacagagtacaaagagatacagagtaagtaagagaagacatcaaacatagtacagtccaacaacaggggttggggagggagttagtatcagagaccacaggtttgcagcatgctgagaagaggcctcagtccctcttagaaactg

SEQ ID NO: 1202 - DNA, 1956 bp, Homo sapiens
gtgcacattcaaacatagaaaatctaattattttacttgtttcttagtattaggctgaggccaatgagtccatgagctaaagggttgaaacttggcaccaaaaaagtgattgtttatgagtcctgtagatttatactgagaaaacatcatgtcttccaatgtgaaatacactaaaacctgattttttgtctcttaaggtgtgctaggtgaatgcaaaaaggatcaggaaagggggtgaggataggtcaggaaaagtgcaaacacaatgttctattcataaattagtgatggcatatttaaggttaagtagtaaaaaatatggggggctcagttaacacgaatgaaaaaatagttaaagtagccatgaattatctggataccttgatttaatgacaccctttcttctgtacaatttcataatgtgggaatagagattagtggggattgtagtggtataccctgactttgcttcatgatatctcaaatgtttaaaacctattattccctagagaaagaaatatgttcatactaattgttgcagaggcagaagccaaatatatctcctcctccatttatgtgactatatagtaatgaaaatcctaggttgatacacttttctcaatcttggaaagattctgctaaagcagcaaatcttctaacaagttcaagagggtggggagagtgaacaagtagaataatttatattaccctggaacaattctgaatcctgtaggtatttatgtcactgtttcaattgtgttctggtttaactgtcaatatttatgcatagcagttaacgtgtgtgcatatttgtaactgtgcagtgctactgccaggtgtgactgtacaaatcatgtgctttgaatgtgcaagttttactttcttttctaacaatttaatacagtgttagaaataaataacgaatgaagacaaccaaagagcagccagacaaatgtgaactggttttgacgtgacgagaaactcatcagtaagtaaataaacctcctccctggagaaggccactgaaatgcacccaggaggatgtctctactagaagaggagggccaagaagaactgggccacactccacaattgtgacaagtccgacggcactggaaaatcttggtgcacccacgaggtccatgagagtttcaaagagaacactgctaacactcccaaatccaaggccaaaaaatacagcatataataccaggcttgtgtagtcctgtgccagtgggcacaagaggtgacacactccattgaacatgattgcaaaactgaagaagtactgaattcgaggtcgaatatatttggagtttgcaattaatcctacagaaggcctagcaaacatatcaacgaaagccataacagatagcagaaaagctgccgagtactcatcaattccttggtctttagcatatggagccaagaatataatgggggcaaaaaaacctaggaacataatgacatttccagacagatatatcagaaatcctctatgcttaaaaagggagaaatctaaatacttattaactttttcccaagttgatttcttcgttttgattttctttgggcttgaatcatcttctgttttgccagtcttatttttagacttagaagtggtttgattgggtccaaggggtctcatgagggaaccagccacacaggcattcaaaagtagacttcccaaaatcaggaagcttcctttccagccaaaagtattaaaaaggtactgattgaaaggagccaatgaacttaagaaaacaggacttcctgccatggccaatccatttgccatgggtcgcttcctatagaagtatttgccaattatggttaaggcgggttgcaggttgaaggctaaacctaaacctaaaaagaacaaaacaaaagtgggggaaaacacaaacacattatggcactcacaaaagaaattactcctcaaaatgtacattcaag

SEQ ID NO: 1203 - DNA, 1596 bp, Homo sapiens
cactaactcgtcacctagcattaggtatatctcccaatgctatccctcccccctcccccgaccccaccacagtccccagagtgtgatgttccccttcctgtgtccatgtgttctcattgttcagttcccacctatgagtgagaatatgcggtgtttggttttttgttcttgcgatagtttactgagaatgatgatttctaatttcatccatgtccctacacgaacttattctattttaatagaatgttcagtatcagtgttttcacactgagattctctagcttattttgccatatttaaattaaaaagaaacaaaaaatcctgtttgatcatgtgaaaaatatttactgaaatgtgaataaatttatgatcattaattgcctactgaaatattcctgaatattgctcaccttattaacaagtatatatggagactgaaaaacatgtagatcatgcaaacaagtgtaactaactataccaaagaaacaaaagtccatactaaatatgtccataattaaataaaaaatgctaaacaagttttacctagatattataaaaacatagaaaggaaaacatttaggagatgatgaagaagcaggagattgggatgggagatgtaatttgatctaaattcccatatgcttctgtaaaatcaaaaattcattttgcaatattaattttgctcttaaggtagagacttttaaaatgaccattctcaatactacagcaattcttccctgatttgcacataaatgaattaaagtgaagaaaaagcagtagaggagagaagactaaaataaaccagattgtagcaccctgtaaagagctaaaatctccagtgtacaaacaactgataggaaagaagagaaaatcagaactataaaaaagtgacataagctcagaaaattactcatttttaattgtatcaacaaagataatttgtaattttgatcatgcaagcattataattactgataattgggcctttcagcttttaagtgccttctcaaacatgagttctgcatatggttgtgcagaaatcaaaatcttaaagagagatgagtaaagtcaagtttgtaatattaatcttatattctcaatatagatgctaattagtgctctgaatggttgtggttagaaatcttgttggtatgatgtatcagtgatgtcactgcattgatggagacagaataatacataatggtgcaatgtggtgatggtaagctttgttactcaatattgtcaggcactttaagaaaatcagaaacattcaggatagtgccaaagaagatcagtttttcaagactctaaaatcatattcaattatatgtgtatgtaattataaatatgtgcatcatggctgactttgagaagaatgcagcgccttgcaagtgcactatttgaatagagctaaggagaactatagtctaaggactgcaaaagtctagatggagaagacaaaagcaatgacacttgttttctctacagaacaaatagacaaagaggtgaatgacaacaaagatgttcagagaaacttgaaaaataagctacggtgtaggtgttagaaataaataacgaatgaagacaaccaaagag

SEQ ID NO: 1204 - DNA, 1208 bp, Homo sapiens
acagaagaccgctgagcttcctcaatttgaaagaggtattttcttcctgctttctttcaaaggaatgcaaagaatgagaatgacagaagttttgatttgtgatttaggcactatctgaaggcactttagggaatgtgagccctgaactgatacattgtgaccctaggtacagaaattacttaaattctctgggccttagttttctgatctgtgaaatataaataataatatctgttctattgatgcaggattttttgctcctcagctcagctaaatctgggttcttgtctcacaacgaggaaaaattacgcacatggacacactaaaaggagatgtttcttttgtgtatcttgctgttttggtagtcacctgtttgcagtggcaccattgaatctatcttcaagaagctgagaaagcagaaacctgggaattaatggattcagtattataaatcaacttggatggagctggagaccattattctaagtgaagtaactcagaaatagaaaaccaaacaccatatgttctcacttttaagtgggagctaagctatgggtatgcgaaggcatacagaacggtataatggacactggagagtcaaaagcagccgacttggaggggatgaggaataatattgggtatgatgcacactgttcagatcaggaaatcctgagagttgtcatgaaaccctctgccacatttccaatattttattagtagggaaatagtgaaaatgaatggatctgacagacacaagcaattgagagtatggcctaaagaaaaaaaatccactgaacatcatgcaattagaagtgccattaggaaaggggtcaatggattggctggagaaagctggaagcttgaaatgactgtctacaaggtgatcaagaacacagcacctggatgaagggaggagcaagaggaaaggtggtgacagtaagcaaggagagcaaaccttcagagggctaaggggaagcccttcacccctacagttttggcactgtgaacaggatctcatcaaagctgctctgcttttcagggagccacagtgaaagaaacccaggacctgacaagccaacagaaagaaatctagaagagacttctaacaaccctgaaatacctagaagaaaatagaaaaagacaccacacacactgattctggggtcttctctcttcttcctagtggatcctgaaaatctactttgccc

SEQ ID NO: 1205 - DNA, 1485 bp, Homo sapiens
acagaagaccgctgagcttcctcaatttgaaagaggtattttcttcctgctttctttcaaaggaatgcaaagaatgagaatgacagaagttttgatttgtgatttaggcactatctgaaggcactttagggaatgtgagccctgaactgatacattgtgaccctaggtacagaaattacttaaattctctgggccttagttttctgatctgtgaaatataaataataatatctgttctattgatgcaggattttttgctcctcagctcagctaaatctgggttcttgtctcacaacgaggaaaaattacgcacatggacacactaaaaggagatgtttcttttgtgtatcttgctgttttggtagtcacctgtttgcagtggcaccattgaatctatcttcaagaagctgagaaagcagaaacctgggaattaatggattcagtattataaatcaacttggatggagctggagaccattattctaagtgaagtaactcagaaatagaaaaccaaacaccatatgttctcacttttaagtgggagctaagctatgggtatgcgaaggcatacagaacggtataatggacactggagagtcaaaagcagccgacttggaggggatgaggaataatattgggtatgatgcacactgttcaggaaatcctgagagttgtcatgaaaccctctgccacatttccaatattttattagtagggaaatagtgaaaatgaatggatctgacagacacaagcaattgagagtatggcctaaagaaaaaaaatccactgaacatcatgcaattagaagtgccattaggaaaggggtcaatggattggctggagaaagctggaagcttgaaatgactgtctacaaggtgatcaagaacacagcacctggatgaagggaggagcaagaggaaaggtggtgacagtaagcaaggagagcaaaccttcagagggctaaggggaagcccttcacccctacagttttggcactgtgaacaggatctcatcaaagctgctctgcttttcagggagccacagtgaaagaaacccaggacctgacaagccaacagaaaggtaagaatttttaccagccaggctcctggtctctcttcctgtggaatttgactgagctgacgctaaaaacccactatttgtctctctttttctctgcaaagttctgattaataggagaaaaaaatttgtgtgagtagtcttgggtatagcaatgctggtatattttatggtataaatattcatattgtttgattcctatcatacccaaaacagactatgttggttaatactgagtgtcaacttaattggattgaaggatgaaaagggttgttcctgggtgtatctgtgagggtattgccaaaagagattaacatttgagtcactgaattgggaaatgcagaaccaccctcaatctggataggcacaatctaatcagttgccagtgcagctagaataaaagcaggc

SEQ ID NO: 1206 - DNA, 1663 bp, Homo sapiens
ctttctgcttctgacttaggcttttgcatgagtaaaagtagttgcttcatatattcctcatgtggatgtgcaggatgtgccctgtacaaaaatccaggaagcactgtttacagagaccattatgtgcatgactacaactagagttttatgttgcccatcttggatgactgtaaacagaagaccgctgagcttcctcaatttgaaagaggtattttcttcctgctttctttcaaaggaatgcaaagaatgagaatgacagaagttttgatttgtgatttaggcactatctgaaggcactttagggaatgtgagccctgaactgatacattgtgaccctaggtacagaaattacttaaattctctgggccttagttttctgatctgtgaaatataaataataatatctgttctattgatgcaggattttttgctcctcagctcagctaaatctgggttcttgtctcacaacgaggaaaaattacgcacatggacacactaaaaggagatgtttcttttgtgtatcttgctgttttggtagtcacctgtttgcagtggcaccattgaatctatcttcaagaagctgagaaagcagaaacctgggaattaatggattcagtattataaatcaacttggatggagctggagaccattattctaagtgaagtaactcagaaatagaaaaccaaacaccatatgttctcacttttaagtgggagctaagctatgggtatgcgaaggcatacagaacggtataatggacactggagagtcaaaagcagccgacttggaggggatgaggaataatattgggtatgatgcacactgttcagatcaggaaatcctgagagttgtcatgaaaccctctgccacatttccaatattttattagtagggaaatagtgaaaatgaatggatctgacagacacaagcaattgagagtatggcctaaagaaaaaaaatccactgaacatcatgcaattagaagtgccattaggaaaggggtcaatggattggctggagaaagctggaagcttgaaatgactgtctacaaggtgatcaagaacacagcacctggatgaagggaggagcaagaggaaaggtggtgacagtaagcaaggagagcaaaccttcagagggctaaggggaagcccttcacccctacagttttggcactgtgaacaggatctcatcaaagctgctctgcttttcagggagccacagtgaaagaaacccaggacctgacaagccaacagaaaggtaagaatttttaccagccaggctcctggtctctcttcctgtggaatttgactgagctgacgctaaaaacccactatttgtctctctttttctctgcaaagttctgattaataggagaaaaaaatttgtgtgagtagtcttgggtatagcaatgctggtatattttatggtataaatattcatattgtttgattcctatcatacccaaaacagactatgttggttaatactgagtgtcaacttaattggattgaaggatgaaaagggttgttcctgggtgtatctgtgagggtattgccaaaagagattaacatttgagtcactgaattgggaaatgcagaaccaccctcaatctggataggcacaatctaatcagttgccagtgcagctagaataaaagcaggc

SEQ ID NO: 1207 - DNA, 331 bp, Homo sapiens
gtttgttccagagactcaaattaccaaaacttcagaaagtggaagaaaagtttccctcccctctgcagtttcagtgagaagccaggagaacaaatctctctgctcactctgaaggctgtgagaccctgagacctggggaagctggcaaaagatacagaagacatctgtgcagcaagctgagccagaaaggaagagactagtaattgttgcagaaaaatcaagaagactaatcttgcatctcccttgaaatatccaagaggtatttctggaaatgcctggagggaatttgtgtatgaggatcaagaagatgaaaagcaggtagaaggagagg

SEQ ID NO: 1208 - DNA, 2149 bp, Homo sapiens
cccctttacttgcaacactgttactgagttaccataccttactacatttcccatacttcttcactatttttgttccacccagcctgttcttcttttgcagcctccctagaatgtgacagtccacagaaatatctgatttcaaagagatgcttgcattctgtactgatgccatctagaattgtaaatgaccagtgtcacactgctaagtggagaaagcgtgaaagaagaatcccatcagtacattcacgatagaggaaataagaaacaatgaaagccacaagtaagtcctgagttgatcaacagtattgcacttctccaggtttactcgaaggcagcaaaattggccctactcccaaccctgcaacatgcaccatttccataaacaatctacagagatggctgagaaaaagaaaaaggggtactctcctttaccccttctccaaagcccgatgaagtaaagagtagaaatcaagagtgtctacaagaattggggattggcattgattctccactgtgtgattactcatgctttatggcaatgtgcctatttaaagggcaggtaatgacttagcaagaaggaaggagagagaatgtcaaactcacctgaagtcttaccaattggtgtggcaggtatgtggctgtttcccatgagtgaatacactataagattattaggctctagctgttttgcttgtatctaatccaggtgacaccagcatttagagactatgaggtgtactgggagctgagataatgaaagaggtagcattaaagtaatatcccccaaattatggcagatctatggttagaagcctaagaataacatgtgaaaacctcatgtcagagcctgacaatataccagaatttggatacctgccatacagaaggtaccagccgccaaggggtaactgtcagaaaagtgacaacaatcacaagttgggaaaaggacttgtctctttgcccctcactcctctctgtgcccaataatttggatgagctattgcctacagaatgaaaggagagttgtagggctatgaatcaaatatgagacaagttttaaatgagaagaaagtaacatttaataagcaaaaatgcccagagaactatggaatcatcccaagaaaggattaataaacaaaaattggattcaatagaaaacacatcagagaaaaaagttaatatttttataccatagatgtgagagtccttaatgcactagttacagcatattagtgcattatgtacattccatgtgactctcttattaccactatacccacaatgcttagaactgggtcctcaataatcgagtatgggtggctaaaggacttttcattttatgtggcagaggataataataaaaaaagaaataatagaggaagaaactggctttggtgttctagacatattagggctgaaacccaaatattcagttacctgttttgcttggcctacatccattttcagcagtgcactcaaagtctccaaagaaatttgcagagaatttcttccagtagccccaagagttctcagcataagtactggaaaaactcactagcatggaggatgcttctctccagtggaatcaacagtggcctctgctgattcagagacttcagtgttccacagtgaaactagattgtgatgagagcaaatatggctggaaggcaacactgctcaggtggttagagcgtgagttctgtagtatcaaggagcttttttctcagtgtgtctgtcagtggagaatttgggggaaagatcaaatcaaattgctaaataaaacataaagccccacagagatggaagccagcaatatgtgtatgctgtggtttgggtgccccctttaccttccagaatgtctttgaactgcatgttgagctggtttcacctgggtgaaaacatgagggaaaaggaagtaagggaaggatggacagatagtggtagagactgatgaccacttcaagtaagtgtgctatcaggagaataactctcccatgtcttcataggagtcagtgaacagtcacctgttgtatagaatcacccatgggcagtcactggttaccagcagcagcaccaaccaaccacctgagaattacaccaatggtcagttaggcaaagagacatctgcctccctctcctcttccccaac

SEQ ID NO: 1209 - DNA, 1197 bp, Homo sapiens
gtaaaaataaattacaattcatttatacattctactcttgatggacatttgggctacttccaatctgaggctattgtctgtaacgctgatatacacatttgggcatgagttttttaggcttttgtgcatattcctaatgtagactttcaaaatctcattttattttttaaattcaatttaaataaattaaatcctttattaaagtaacctctctttttttttttttttttcagtgtataccaggacagtctaatgccttgagtaggtgaccgggtgtgcactacccctcaatgagctgtgaacaggcctactgctgtttcataatgtgcatttggctttcctggacctaccgtgaagatcttttaaatctcagttttcttccagctcctggtaatagacttacaccgaaacagtcctcccacgccacaagatcaatggaaccctggaagctacaagagaaagaaattagaatgtgcatcaaatttgtgaagctcataaggaaaacacatttgtccttcatgtatttttaaagagattcttgtttcgttatatcttataaatggtttctctgtttagtatagcagatagaattgaattttggtagtatcccatttttcagaataacagaatgccattcagttttaataaagatgttagtggtgatactattatgtttaggtgtccagttattctgtagggactttgcagttctgagaaaaaatcttgacatataacctcatttatttgcctcattttcttctttcctaagtctttaagattcaagaataaagtctgttgccaaaaaaaagaaagatgattttttttcaatcagctatatctcatgttttgttttcagtagcatattggattgtataacagaaaaaaaaactgataatttagaatagcactttggaatatgcattcatgtaaatctgtttgcttctagactttgtaatttttagatgaaaatactggtttattaattataactttgggatcaaactatcaggactgagagaactgaggttttttttgccaaatactgcttatgcaaataaaaaaattgcatctcccttatttcataagtattgatttattgcatcacatattcatgctgattttcaactttaggtatttgctatttgctttttcaatatggagtcattccagagcagaattagtcaaaacatgaataat

SEQ ID NO: 1210 - DNA, 305 bp, Homo sapiens
ctgagccagaaggcctaacaatagggagtaccagtgtctgaggacaggaggagatggatgtcctggctccagcggagagcttgtgactgtagtcttagccacttgggagccgaaggcaggaggatggcttaagcccaggagatcaaggctgcagtgagctatgattgcaccactgcactccagcctggttgacagaaggaccactctggctgatgtgtggagaatagaccgaagggaggtatagatgcggggtgtccagtgaggactgaacagagttaggctgcaactgtgttctacttcacagg

SEQ ID NO: 1211 - DNA, 413 bp, Homo sapiens
gctcattatctgtctccccccagaatagggacttgggactatttgttccctactgtatcgtcagtgttcagcccagagcctggcactcaatcattgttttgttttgtggatgctagaacagcacttttccatctgcaattattgtgttcctttctttctttacagattgagggtctgtcttgcccacacctagagtgacagctgggggttctcagccccactgtgtcctggacccaacgtgctgagccctggacttgtctctggcatggtctcttttaatcctaacagcaacttgatggggggctggctttttccacttagtgtaatggttcatccacgtgccagtacggtaagtcctgactcataacgtataaggaaatcaaatgtaccatgagctaattactataaacaag

SEQ ID NO: 1212 - DNA, 848 bp, Homo sapiens
gcctggccatgtttggattttcttgcagagctgcacagaaatagtagagggtaaagaagctgggaataccatcgagacaaaaatcccctttgctctaagggaaccactgttacctgtcattggtaaacaggacataggtatctgaagtacacagaattcaagcaggtagtttagaataactgctttgttgccagttcgtctggagcagttctcatctgggggctcttttgctactaaagggacatctggtaaggcctgcagacatgtttggttgtaactgagagctgctgccagcttgcagtgggtggaggccaggggtgctgctaagtaccctacaacgcacaggacggccccccacaaacggttatcttgaccaacatgtgactagtgctgggctgacaagccctgctccagagacccagccctgtgtttcagcattgttcccttctcctccactttttcctttctatgtattatcgagggacagcctgagagtatgaatgggttataaaggaagactagttagtgtttctctctccttgttgcttcctggcagtctcagactacattcctgatacagacagaaggctttgaggacatggtggccacagcggcatgctgggtatgtggggcagcgggtagggaaatatacaaggaaacatggctggtttaaaacacaggctagaagtccacagatttcctaatggcaagaatgaaaaggctgcattaggcgctggtgctgtcggagtgaaggggctcaggcatctggattgcccatcctattaggaccatttgccctatgagctaggtcaggacacctctcacttgttttgagcttagggcaagac

SEQ ID NO: 1213 - DNA, 2141 bp, Homo sapiens
gtggtcttgaaaaaaataatttgagctggtagttagttcccactgtcagttgaatgaaataaataaatctcactttaccataaatgtggggaaatggtgaagaaaggcacaaattagatgctgcataaatgttggttagatgcaaaggtggatggatgggtagatggacaggtagatcaatgggaaaagaaaaaagaaaatagttgtagaatggatgaatagagaaactgctggaaaatagatggatgggtgaatgaaataataaatgcatcaattgttgcttgactgacaggtggataaagggtggatggatggatgaataggtggtggtggataaataaatggatgcaggaatagatgatgagtaaatgcatgataaacggatgggtggatgggtagatgcatgaatcaagttctcagcaagcataaagtattgtgcatctgaagaataaccatgattgcataatggctgcacctaactgggtcagcttggggtaagcgttgcagttagaagtcccaaatttctcactcaagaaagacttattctccttgtctgtttctcattcctagggaaacttgtttccggaaagcattctacattaatgtagcatcaaattggcaagtcccaaaatagaactatggggcagtgcaggtggacagatatcctgagccacattctctctgatgcaccactgtggcactgggatggagcagaatggagccacatattggaagattttccatatggtgctcctaagttttctcatctttccttatctcaggagattggcagaacaggtgttcccaataagagttagtgagagttagcagcacaggattcaaattctggctctgacattacctagctgtgtaagttagacaaatcacttacctctctgatccttaattttctcatctacagaatggaaattgtcacagtatctacctcaaaaagcagttgagcagattaagtgacatattgcagataaagcacttttctcagtgctgggtgtatagtaagtagtcaaaaactattattagtaactattattaaaccttttgacagatgaagaagttttaaaattgacatttatgaggtcactgaggcagagaagtgaactctaggggtaaggagacctggattcccattcactgtatgactttgggtaaatgcctttccctctctgaggcttactttctccatctgcataatagagaatggaacccatgaactgtgaggtttagcattcttgatcaggggtataatcccagtgtcttttctcactccaccaccaccatcaaactgactcgcttttgaacataagccggaatggccaaaggcaaccattgcaaatactcagtcataccaggaatcagcaaccactcgagttaaggatttttggccccatattacagatgagggcactgaggctcagggtagtgaagggatttgctgaaggtcgcacagctactaggtggtggagtagaattcaagcccaagcacattaactgcaaagccagaagtcttctaactatacaacaccccttccttggcatgcgtcagaactgacatttgcttggtgactgggagttgatgctttccttaggttggaggattggaggggtgggaatgcagagcacgctattttccagtgagaggaaaggcaaaaggcttttaagaactagagtaggggtagtaaacatcagggtggctgaaatggcatcttgcccaagttgcaagccgggagtctctgtggtggaagcctcagcctgagctttcctggaaaacattaaaagcatctaggagcacttagaccatagcctctagctcctgaattcacaccactacgtggggacagtttgagagttggcttgttaataggacataaatgctatagagccaaggtggaacagccagtgttctggggtgtggataggagtggtgagtggaaagcaatcatttttattttttatttatttttactaatttttttagagttggggtctttctatgttgcccaggctggaatgcagtaggtattcacaggcgcgatcccactactgatcagcatgggagtttagatctgttctgcttctgacctaggccggtttaccatcccttaggcaacctggtggttccc

SEQ ID NO: 1214 - DNA, 1352 bp, Homo sapiens
ccatcctttatcatccccacattacacaggaagaaactgagcttcagaaaggggacgcgactggccctaaggtatgcagtgttttcagattggcttttcacttagtaatatgcatgtgtgtcccctcttcaccatgtcttttcatgactagatagctcatctctctctctctcttttttttttttctttttgagacagagtcttgctctgttgcccaggctggagtgcagcagtaccatctcagctcactacaacctccgcctcccgggttcaagcgattctgtgtctcagcctcccaagtgctgggattacaggtgtgcgccaccacacccagctaattttttttgtatttttaatagagacagggtttcaccatgttgatcaggctggtctcaaactcctgacatcaagtgatctgcccacctcggcctaccatagtgctgggattacaggcatgagccacagcgcctggcctagctcatctctttttagcactgagcaatatcccattgtctggatgtgcccccgtttatttatccatcacttactgaaaggacaccttggttgtttccaagtttggacaattatgaataaagctgctataagcatctatgtacagatttgtgtggacataggttttcaactcatttgggtaaatacctgcccttccctctcacctggtggctcttcccattttggggggctctaattatttataacctcctccaggaagtcttccctaatccctccctgcaacttggcacaggcgccccctctatagcagccccctgtgcttcccccagcacacatggattatgctattgttttctctggttttcttgctggttttgagctcttcgaggcagagaccagatcttagcacacagcagatgtacaatgcatcctcgtaggatgaatgggggatgccaggctttcaagagcaaggctgtcatctgtggtgggcgctacctggatacagggagacctgagatttccagatctggtgataacaaagccttctctccaactatccacgctccctggccttgaaggccaactgctcctgagagaaaacctcccagcctttgtgttctggacactcacggtctctggcacatgcttatcttgtctttctgctcagaatgcaagttcctggtgtgcagagtcaacattttaccctttccctgtatcccgtagtgcctcacatggcgtcatgcacaagactgcattctgctgtgatttcaggcctggggctgtgccccagctctgcctcttagtaggcaggcaatcttgagctagttatattacttctctgagcctcagtttcctcatctgtaacatgaggttataat

SEQ ID NO: 1215 - DNA, 754 bp, Homo sapiens
ggctggttttgaactcctgacctcaagtgatacacatgctttggcctcccaaagtgctgggattacaggtgtgagccaccatgcccaccctgacctcagctattttaaaaaaggaaagactaatataattaccttaagagttaagggactgtggccacctggactaaatactggcaactgtaatgacacatcctccctgactctctgcctttttcctcctcagcaaagcactcttacacctgtaatcccagcactttgggaggctgaggcgggcagatcacctgagatcaggagtttgagacaagcctggccaacatggtgaaaccccgtctctactaaaaagacacaaattagctgggcgtggtggcgggtacctgtaatcccagctactcgggaggctgaggcaggagaattgcctgaacccaggaggtggaggttgcagtgagccgagatcgcaccactgcactccagcctgggcgacagagcgagagtctgcctcaaaaaacaaacaaacaaacaaaaaattagccaggtgtgatcacgcatgcctgtagtcccagccacttgggaggctgagaggtcggaagatcaattgagcccaggagattgaggctgccgtaagccatgattgagccattgcactccaactggggagacacagcaagatcatgtctgaaaaaaataaattaaaaaaagaaaaaagaaaatgcatccctggaccaaggcctaacgtcctttagaatgtggcttacgg

SEQ ID NO: 1216 - DNA, 2267 bp, Homo sapiens
ctctgcctcccaggttcacgccattctcctgcctcagcctcctgagtagctgggactacaggcacccgccaccacgcctggctaagttttttttttttttgtatttttagtagagacggggtttcaccgtgttagccaggagatggtctcaatctcctgacctcatgatccgcccgcctcggcctcccaaagtgctgggattacaggcgtgagccaccgcacccggccaatgtacattctctaaagtcacctgtcaataacacactaggcctgcctcctgcctgctataaatatcctcaacaggttataaacagcagcaggctacctgtgttcattgcaagtaaattactcatcatttgtaggttaaaagcataggcccgacttcttaaataaacatagggaatttgctgcagcagcaggccagaaaccactgtttcaaatctgcaagattttcctatcaggtgggaagacagagataagaaatatggtaaggcctgaaaaattgcaaaagtagaagcaagtcaggtttgctgatctaagagctaagtttgatcccaaatgcactgaagaagttagaggagcttaaagaagtctcaggaagcattttttaaaatgtgaaaacatcaggctcactatagcttccaaagaacaacataaacgagcatcagcagtcatacaatgacagtatcagaaatggcactcaagtgcatccccccagtacaatgcattgcacacaacacaataagacatagtaaaaaacattaacacaaaacaggaattctacagcaaagatgcaaaactgaattctaaaatacaggaacaaatacttttctaaatgaaaagttttccatacttttcttaaaaaaaaaaaaaaaaaaaagtcataagatgccccatatgggaaagtcaagaaaagaataaatagagctgaagggaagagggaaaagggagaaacaggtgggcagagtcccaatttacaagaattatttacattcagaatccagaagaactcaacatttctctatatatacatttatgtacatatatataaatacagcacaaaattagagggtgggttttggattttatctcaagtactcaaaaaaaaaatgctagcgagcttgagttgcaggtatttaggtgtgtttctgtcacttaaaagacactgcatttgtatcagacaactggcattcaatgagacatttttttttttttttgcagtttttgctctcagctgtagccctgacatgaaacgcttgctacgtttctgcagcaaagtgggccgagcgcagtacgcacaggtgtggtgttagccagggagaccgaagccacacagaaggggagtcagtaaatgtccatctccacggtgtctgcctttgccattgggaggcctgaactaatcaaacgttcattaataggatcccagcctaacagcaacgcttatgtagcaccattcttagaaactaccaagtatcacacaggtacatgtgtatggggaccttcctcttgactgcttgtcaagaaaaggatccagagggaacttctgcccctacttccatgaagtgagatgcaacaatcatttccaatctatttttttatctcatgctaaaatgaaagtggaggggagagggaagaaggctcccattctacaattataaatgctgtcctggtagcctttcttctcttgccggctaacaattgttctaacagcatcccatggaggccagcaaatgaatgccccagggactacagccagaaaattgtgcctgtaaaatatcatattcctctggagcttggtaatatagaaattttacctctacagatgaggcaaactaaaatattgttgtaactcaaaaaggcttctgaagtgctgagttagaataaatatatatagatacatacacacactacattgctttggatgcaggttcttactaatttatatacacatgtaaagagaagatactgaagtgtctaactgtaatttagcagcagaaaaagaaaactgcttaacatatttgcttcttaatcaagttgtgtttaaagaaatgcattaatactcctatgaatttgtatcattgatagtgtatctggataatcccagtaactacagacagagaccttgtggtatggaggttgctaaatgaggggaacactaattcccccagagataacatctgagctgctttagactctggaagtggttttcagtacaattgacgctgtaaactctgaaaacacgaacatgatttccaaccaaatctttg

SEQ ID NO: 1217 - DNA, 1965 bp, Homo sapiens
actttattgaaaggaaagtgcaatgaaatttgttgaaaccttaaaaggggaaacttagacaccccccctcaagcgcaggaccaagtgcagagtggactctttctggatgttgtagtcagacagggtgcgtccatcttccagctgtttcccagcaaagatcaacctctgctgatcaggagggatgccttccttatcttggatctttgccttgacattctcgatggtgtcactgggctccacctcgagggtgatggtcttaccagtcagggtcttcacgaagatttgcatcccacctctgagacggagcaccaggtgcagggtggactctttctggatgttgtagtcagacagggtgcgtccatcttccagctgtttcccagcaaagatcaacctctgctggtcaggagggatgccttccttgtcttggatctttgccttgacattctcaatggtgtcactcggctccacttcgagagtgatggtcttaccagtcagggtcttcacgaagatctgcatcccacctctaagacggagcaccaggtgcagggtggactctttctggatgttgtagtcagacagggtgcgtccatcttccagctgtttcccagcaaagatcaacctctgctggtcaggagggatgccttccttgtcttggatctttgccttgacattctcaatggtgtcactcggctccacttcgagagtgatggtcttaccagtcagggtcttcacgaagatctgcatcccacctctaagacggagcaccaggtgcagggtggactctttctggatgttgtagtcagacagggtgcgtccatcttccagctgtttcccagcaaagatcaacctctgctggtcaggagggatgccttccttgtcttggatctttgccttgacattctcaatggtgtcactcggctccacctcgagagtgatggtcttaccagtcagggtcttcacgaagatctgcatcccacctctgagacggagcaccaggtgcaaggtggactctttctggatgttgtagtcagacagggtacgaccatcttccagctgttttccggcaaagatcaacctctgctggtcaggagggatgccttccttgtcttggatctttgccttgacattctcaatggtgtcactcggctccacttcgagagtgatggtcttaccagtcagggtcttcacgaagatctgcatcccacctctgagacggagcaccaggtgcagggtggactctttctggatgttgtagtcagacagggtacgaccatcttccagctgttttccggcaaagatcaacctctgctgatcaggaggaatgccttccttatcttggatctttgccttgacattctcgatggtgtcactgggctccacctcgagggtgatggtcttaccagtcagggtcttcacgaagatctgcatcccacctctgagacggagcaccaggtgcagggtagactctttctggatgttgtagtcagacagggtgcgcccatcttccagctgctttccggcaaagatcaacctctgctggtcaggaggaatgccttccttgtcctggatctttgctttgacgttctcgatggtgtcactgggctcgacctcaagggtgatggtcttgccagtgagtgtcttcacgaagatttgcatcccacctctgagacggagcaccaggtgcagggtggactctttctggatgttgtagtcagacagggtgcgcccatcttccagctgttttccagcaaagatcagcctctgctggtcaggagggatgccttccttatcttggatctttgccttgacattctcgatggtgtcactgggctcaacctcgagggtgatggtcttaccagtcagagtcttcacgaagatctgcattgtctaacaaaaaagccaaaaacggccagaatttagcggacaatttactagtctaacactgaaaattacatattgacccaa

SEQ ID NO: 1218 - DNA, 1948 bp, Homo sapiens
gtgcaatgaaatttgttgaaaccttaaaaggggaaacttagacaccccccctcaagcgcaggaccaagtgcagagtggactctttctggatgttgtagtcagacagggtgcgtccatcttccagctgtttcccagcaaagatcaacctctgctgatcaggagggatgccttccttatcttggatctttgccttgacattctcgatggtgtcactgggctccacctcgagggtgatggtcttaccagtcagggtcttcacgaagatttgcatcccacctctgagacggagcaccaggtgcagggtggactctttctggatgttgtagtcagacagggtgcgtccatcttccagctgtttcccagcaaagatcaacctctgctggtcaggagggatgccttccttgtcttggatctttgccttgacattctcaatggtgtcactcggctccacttcgagagtgatggtcttaccagtcagggtcttcacgaagatctgcatcccacctctaagacggagcaccaggtgcagggtggactctttctggatgttgtagtcagacagggtgcgtccatcttccagctgtttcccagcaaagatcaacctctgctggtcaggagggatgccttccttgtcttggatctttgccttgacattctcaatggtgtcactcggctccacttcgagagtgatggtcttaccagtcagggtcttcacgaagatctgcatcccacctctaagacggagcaccaggtgcagggtggactctttctggatgttgtagtcagacagggtgcgtccatcttccagctgtttcccagcaaagatcaacctctgctggtcaggagggatgccttccttgtcttggatctttgccttgacattctcaatggtgtcactcggctccacctcgagagtgatggtcttaccagtcagggtcttcacgaagatctgcatcccacctctgagacggagcaccaggtgcaaggtggactctttctggatgttgtagtcagacagggtacgaccatcttccagctgttttccggcaaagatcaacctctgctggtcaggagggatgccttccttgtcttggatctttgccttgacattctcaatggtgtcactcggctccacttcgagagtgatggtcttaccagtcagggtcttcacgaagatctgcatcccacctctgagacggagcaccaggtgcaaggtggactctttctggatgttgtagtcagacagggtacgaccatcttccagctgttttccggcaaagatcaacctctgctgatcaggaggaatgccttccttatcttggatctttgccttgacattctcgatggtgtcactgggctccacctcgagggtgatggtcttaccagtcagggtcttcacgaagatctgcatcccacctctgagacggagcaccaggtgcagggtagactctttctggatgttgtagtcagacagggtgcgcccatcttccagctgctttccggcaaagatcaacctctgctggtcaggaggaatgccttccttgtcctggatctttgctttgacgttctcgatggtgtcactgggctcgacctcaagggtgatggtcttgccagtgagtgtcttcacgaagatttgcatcccacctctgagacggagcaccaggtgcagggtggactctttctggatgttgtagtcagacagggtgcgcccatcttccagctgttttccagcaaagatcagcctctgctggtcaggagggatgccttccttatcttggatctttgccttgacattctcgatggtgtcactgggctcaacctcgagggtgatggtcttaccagtcagagtcttcacgaagatctgcattgtctaacaaaaaagccaaaaacggccagaatttagcggacaatttactagtctaacactgaaaattacatattgacccaa

SEQ ID NO: 1219 - DNA, 300 bp, Homo sapiens
tgtgtctctcgtttgttccacagtcgtgtgactcttaccagcatgatttgtagcaacgtcttgtctcctgtctttgtgaagacagaatgagaagccacagaacactattacagttaaaaaatcacaagaattctagaggagtcactgaggatgagcatgggtgtgctggagagagagatgcagggtgtcatgagatccagagatgctcgatgtctgggaaacaccaccgaggcataggtgtgcctgaaaaaaggagattcatgcatacagtgtgaggagctggggagcaagaaggtgagg

SEQ ID NO: 1220 - DNA, 1141 bp, Homo sapiens
ctacagaagatcaagggagctgccactgtgccgtgggcgcggtgatgacagccacaggctgtgctgccgagaggagaaatggagcagaaactttagagcagcttgtcaaaatctgccaccacacaactgccacccaggacccagatcccgagacactctcgccgcgagtccgggaagttctggccagaagcaggctgcaggccgagcctggcttaaccaggtgaatagacgggcggctccggcacagacactccagatagcgtgcgaagctgcaatcgcacggcccacggtgccaccgtgcaaaaataaggcacggagagccgcgtcccatccgtgcccaggaaccaggggcgggagggaggcggacgcctgtggagaccctgggctgctcgctgtatgtcgtactcaaaacacagaaagacaaaaaactcaggcccacaaggacaagcagccccgccaaggacccccggggggacagtgcgctcttttgtccccgccgggggctcctgaaagcccggctccgcagcccagcagcctgaatcccggccttgttcacgtgcatacggggggcgctccggggcgggccctcccctccagccccggctccagccctgctgggtgcagctctgtctgcagctctgagacaaaggagcacttctcgtccctggcgcccagacctgaatatcagtccactccgggagcgcctccggcgagcgggcggaggaggagtccccgctcccgcccagatcccggcctcctcgtccctccccgcggggaagccgcccgcccctgggcctgagctcggcccgcggttccccgagggccagcagaggacgccccgcaccgccagtgtgagcaggaagccgcggcaggacggaggctccacgccaggccgggcccgacacggagcggggctccaggcagggggctgcccgcagcgtcctccctctccggctggacaccggggccccactcactgcccccggccaggctggggagccacatcctccgctcggtgctgtcgcagggcgcggggcgggtgacccccggggtgccaggagagaccgaggcgcaggtaccagccgagaggagggcgcctgacccactctctccgggcaggggggcagacaaagaaactgag

SEQ ID NO: 1221 - DNA, 636 bp, Homo sapiens
gtcctcctcctgtgtcctccctcatcctcctcctgtgtcctccctcatcctcctctgtcctccctcctcctcctcctctaaggagaagagaatggttggcagcagttttcccgagtacctgggacaggagctggcgtttctgtagacctttgctctgaaaggaatctcttgtgcgtcctgtcttagtcacatctgttggactgggggcgtgctctgcgtctcggtcgcgtccgtcggactggggaggtgctctgcgtgtctcggtcgcgtccgtcggactggggaggtgctctgcgtgtctcggtcgcgtccgtcggactggggaggtgctctgcgtgtctcggtcgcgtccgtcggactggggaggtgctctgcgtctgggggttttgggagagcaagttgggggtgtgctggccagtgtctgacaataggctgttggaagcgcagccgtggcgtgtagcattgccaatcatagtgtctgtatctctgtctgtctctccaccacggaccgttccaggcgaccaacacgcagtctccaagcttggagttgcctgctgtaggccccccaccgactgccggaaccccagctcccagcccttccagcctgtgggtgttggtaggcggtttcggcagttg

SEQ ID NO: 1222 - DNA, 1867 bp, Homo sapiens
cccaggctgaagtgcagtggcgcgatctcggctcactgcagcctccgcctcctgggctcaagcgattctcctgcctcagcctcccaagtagctgggattacaggtgcgcactacgacacccggctaatttttgtatgtttagtaaagacggggttttgccatgttggccaggatggtctggacctcttgacctcaggtgatccacccgcctcggcctcccaaagtgctgggattacaggcatgagccaccgcgcccggcccgatttcttgattttaaaattaaaacaaaggggtagtacagccaaaataaataagaacgtaaattgccgtatttttttttctaatggtacaagaacaatttagtaaataacatcttcaacttaagataaaaagtaggatatatttataatgaaattttcaagtattatttcaaaattaaccctgtacaaatgatatattttggaaattccaatatttgctagagaatattttttaaataccaaacatctttgtggttaatgctaccttaaccttaccaattaaccttctaaaagtatattacaacagaacacaaatagcttaaaacacaccatactgttttctccacaaaacagacaccagacaccgacatgagcacatctggcctggccagtgactcagaacctcatttcagaccagtacatctgcagaggaggccacgcggacccattctctctctcctaactcatataataaatattattttagattttcttagcaaactaggggacaacttacagaccccacctctcccagtcagccagtgtctgcagggtttcaggatttggggtaggaaacagaagatctcacacatgtcgtgctgattttaaataaggcatctgtctctgagacacctgggagagcacagccaccttcctcacggtgcctgcctgtctcttccggaagtcgcctctgcttgccacatgatgctggtgtaaccacaaaagatccaggacttctcgatgactgcagaagtacaggtgctcctacacacgagtacaggcgctcccacagacaatggtaaagattttcacttggggaacaggagtgtgaggtttgttaccgcctgcgacctacacctggctgactccaggggaaaccgcgggagtcgctgcagggagcccctggtctgctctcctcctcctcctccaccggcctctccctgtgcccccccaaaggtcagatcagatatggggcctcagtgtccttgtgcctcctgatggccgtcaggcctgaccaagggtccaagctgccccttcccagtggccagccacggtggaatcacacagggccagtggcctgagaggaagagaccagcaggaaggaaagatcctcagcaacaaagtaaaaccagaacaacagaggacctttctgtgtaagaatatttggctttagaaggtaaataaaataattatatttcttagaattttctgactatccctaaatcctgcaggtaaattattcccaacaaattttcaaaaggcaatcaataataagtaggttcttcttcaataacatgagcatatgcttcttaaagactgggtgacaggccgggcgcaggggctcacgcctgtaatcccagcactttgggaggctgagatgggcagatcacttgaggtcaggagatcgagaccatcctggccaacatggtgaaaccccattgctactaaaaatacaaacattagcctggcatagtggcgcacgcctgtaatcccagctactcgagaggctgaggcaggagaatcgcatgaacctgggaggcggagcttgcagtgagcggagagtgtgccactgcactccagcctgggcaacaaagcgagactctgtc

SEQ ID NO: 1223 - DNA, 736 bp, Homo sapiens
gtcctgggccgcatgcaacccccaagggctgcaggttggacaagcttgatctaagacaaaagcatgttcacggattgatgagagttctgtgtaagcctttgcatattgcatagtgctgtatgtcatggatatgcctaatatcacctacattttttaggtcctcagttactctttggaaataagtgaattacatgtaatgtcatcattttaatgactgctgtaaattacaagcactgactaccctgagttcgtggagaagggctccatagagaaaatttgaaggtctgacagaaactttaaatgtgagtacctctaaagcaagcttgtccaaccagtggccaggaggtggcatgtagcccagaatggctttgaatgcatgtggtccaacacaaattttgtaaactttcttaaaaccctttcagacatgtgatgctttccttgatgttatgacatagcaagaaggcccatgacagatgccagcaccttgatattggacttccctgcctccagaatgttctaaattctcaacgaaaaattctccctgatatcagaccagcaaaccaatgaacagttgcatggacagatgtacctgaatgaatttaaaaagtaaataataaatactataattagcacagttgctcattagttatataaaacagcaataacactagggaattagtagcagtatagagctccaactgaacagtacgtggcaacccaatctatcatttatcac

SEQ ID NO: 1224 - DNA, 852 bp, Homo sapiens
cctcccaaagtgctgggattacaggtgtaagccaccgcgcccggcctaaattcttcctatgttattaagtatgtgaccttcggtagttgcataatttctccaatttgtttccaactctgaaaactgaaataataatggcccccttctatataaaccatattttcttcttttcttttctttttttttttttttttgagacagagtcttgctctgtcgccaggctggagtgcagtggcgtgatccgtgatcttggctcactggaacctccgcctcccgggttcaagcgattctcctgcctcagcctcccaagtagctgggactacaggtgggtaccaccatgcctggctaattttttattttatttttgtaaagggtattgctatgttgcccaaactgcccttgaattcctggcttcaagcaatcctcccacttgggcttcccaaagtactgaaattataggcatgaatcaccatgcctggccaaaagttttttgtttttaattctaattcacatttaacttttcctataagtatgccaaccactgaggataagatttagggaaataggttttttaaaccatgtcggcataatttcaaagaatcactgtttcataacccaaaacaaagactgtatgtaggaccaataagccatttcacgtagcctttaccactaaagattgtgaaatacatgttttgtaactataattagtattattattctagatgtttgtgtgtcctaacattcaaacacgattcaagtgagtttacaagagtatgattcaattcaattcaagttatattaatttaaagtctactagcactaggctctaatggatacaagaacaaacaggac

SEQ ID NO: 1225 - DNA, 2336 bp, Homo sapiens
tgttgattcagctacaggaagacaactaacaattaacaggctcatgaatatttatgaataaagtgccactaattttattgtaataagatataaatagaataaatcctgacatggatagtagcttctgtgttctctccatcctgagaacagaagggccataaaaaaacaaagaagcattaccaaaggggagttctagacccacacggggaactcctaatacaaaagcaacaagaaagacaagtaagactttaaaagttgcagaagtcctaagaatagcgccaatgtagtaggccctttttaacaacaacaaaaaaaaaaaaaagagagagagagagaaattagaaatttagaagttcattaataactgttacttatattcaaggaatttatagtgacagcctagtggtgaccagctctaggaaaagacgctgaagaggacgctcccagcacctgggacagaggagagaacagacacaccagggaagcagccttggaaaggggatgcagacatgaggcttttcagggcttcagatctacatgactgcacccaatggacaggctctgtacaatcactgcccacaagcccaacaggtagccactcgagacacacacactgaggggacttcggggctggctgacttgctcagatgcattttaacaaaaacccccatcaccatcctgctcacattcctaccgtcacctcaaacatctctgcttttagctccagattcttctcaacataactgagtaactaaccacaatggatatgaaatactgttgagtaggttaaagtccttaataagtcaagcgtcttagcatatttttgaagtcgtatctataatcaaagcctggagcacctgtttgttcaacacagttatctttcatccagaattacaaaatatagaagctgtcattcttgagtttccccatgggtccctggtattgcccacgtgggaacaacaggaagggtggaggtgagggcacagcactgtactacagctgcagggctgatcaagggaatctcatgaggtgctttttatcatttaatgtgccaacaacaggaggacaaccatgtgcttctagaacagggtgaaggccctcctcacgggagtgatccctaatctggccccagcaccgtgaaaggtgaatagctgtcaatatctactttcacctaaacctaagcttttaaaattctgaccaagtggtgaaaggtgccatctaaagtgctctctgttgctcgctgaggagctaagaactcctgcggctcactcaggacacagggctcctttgcagcccaggccctgtgccgcagctctgcccagctcagcggtgtagctcccagagtcatggactgctcgcatctgttctggccggctggtgcccacactggagagactggcaagtatcttgagtgtcatccccaatggccccaggaaggaaaatggactctgttcttcactttcattactgttgagctgctgaattctcttgcaaaaaccatcaacaggcatttactaagcaaatgcccacagggaacccagcctgaaaagggcccttccaatttcatatttgacaggcatgtgcagaggtaatgaaattattcagcagagcatcagattcactcagaggctaccaagccaagaaactgaaagcagaaacactggattctccctgtttgttgaacctttccctctaaaaccaacttattcagaaacacatcctttaaaaaaacaaaaggaaaaaccaaagcggtgaaacaatatcacttactggttggaagacatcactctgacatagtcattagtcttgcagagacctaacaccaggcagcttcacaaacacacagcaagtctgcagagttatattgatcagtaagagtaaacccaaactgcactaaatactctcatggccaagaggaaagcagatgctgttttcaggacaatgtgatagtgacagcctatttcctcatgtgcagcacaatttgctatgtttagtggcacttaagtattacacagtaaatactgaaaagacccagaatttttggatgtgcagaagcaatatcacattgtttatacaaaaggtgctatgctacgggattagaataccactatttgggtgtagagaccacttaaaatcttcaacacgctcccacacgcggcctctccgccggcctttgctcagtcggaccagtcgttctcgtcgaactctgagtcgtcgtcagagtcgctgtactccacggcaatgcgccgggacaggatcgtggccacgtcattccccactggctcccgcttggcctcctgctcccgctgctcctgcacctttttcagttgaattcc

SEQ ID NO: 1226 - DNA, 355 bp, Homo sapiens
cagccatacaaaaggatgagttcatgtccttcgtagggacatggatgaagctggaaaccatcattctcagcaaaccatcgcaagagcaaaaaaccaaacaccacatgttctcactcacaggacaaagcaaggagacagccacagaagagatgacactgtggtgaaattttccgagagaaaggagaagagctagtgtcacagagcaggagggtgttttaagaagaagaggcagatttgaaaggtgtcaggaaacttcaaatgaggtgagttcccagtaaaggccattaggtttgggatttaggactttgatggccgccctagagagaccaatggatgatgagttcacggtcctctt

SEQ ID NO: 1227 - DNA, 5944 bp, Homo sapiens
ccaagaaattcaaaagtgtagcccaggttaagaacccctattaatgataaacagaaattgacccatgtccgctaaaaaatgtattaagtaggtttcttgtagagcaatatcaatgagaaaaacttttaatattcacaaccagtatattaagccttggaaaacattagcattattctcggggaaataactttgggactacataacaatggtacagattcaaagttctctgaatttactcatcaagtataaaataaagcctcttaaaatatcccatgctgctattattttaccagcttatactgataaactatttacagtttacaaagcgttttatctaaattctctgcttttcacaaaaaccctgatcaggtagggcaagtataattatcaccacctctaacagatggagaaattaggtctcaaagctatttaaacggcttgcctacagtcattcagctggtaaaaacctaagctgaaaataaaatctaggtcttttgactcctagccaaatattctatcctgggacacttagcccaaaacaaacctctgttctggttccagtcatgggcatcaccaagttgattaacattatacctgtacccatcttgatggtgaaaatagtcatcagtgctgaacacaatgccatcacgattctgaccaagcagaattctgttaataaaagaaatcataaaggtgccatttacaaaatctataaccatcagaaataaactatcagaaataaatataaccaagtgaaataaatcacacaggaaaggttattaaatggatttctgatacttacctgaaagtatatcacgaacagaccagcacaagagctgaataatcttacaaagatttcagatttcaaatcactttacacttaaatctacacaattacagatgctaacagaaactctttttttttttttttttagatggtctctgtcgcccaggctggagtgcagtggcacgatcttggctcactgcaacctccgcctcccgggttcaagtgattctcctgcctcagcctcctgagtagctgggattacaagcatgtgccaccatgcctggctaatttttgcatttttagtacagacagggtttcaccatgttggtcaggctggtgttgaactcctgacctcttgatccacctgcctcggcctcccaaagtgctgggattacaggcatgagccaccgtgcctggccataacaaaaactttttgaagcagcatttgtattgcaactttttaaaacattatttacccaatctcaaaattatatcaactattatccatgttttcactttagtatatttttatttgcctcaatctagtgcaacaggtaacctaaaaagcaagtaagcctaagcaagcaattcatttagaaaaaaccatatgtgactctagacagctttaataaactcatttccatgaagcatatatgatcctctagtgaaagtcggaaatagttggaggcttaaggttatggaacaatctgtgatcctccaaagtataatcaaactttaaatttttaagaacttaagtcgttaaatgaaattattaaacactaaataaaaaactctcagttcaggtcaatgataatcaagctttgttttgaaaacgatactgccttaaattgacaagtacagcaagattaacaagtactcagaactctcattaccaatgactcatgaaagaaattgggagtgtgctatgatagggaaaatgcagcaagataatgatttggatccaagaacaacaacgagagtattttgttgtttctctcctctccttgaaccattaggcatttggatatcactgtataattttgaggggattggtgggatggaaggtggtatattaatagaaggaattgagagtaaaagaatattggcctggaatgattcaagcttacttacctctcactaaaaaaatagtaggaagggtttaaactattaagatgacaagtgtcatctctccatccctcagcttataatggtatcatatacagttctctccctcaatatccatgggagattggttccaggaccacacttgctgctcaagcccttgatataaaaatggctgtttgcatataaactatgcacatcctcccatacactttaactcatctctggattatttataatacctaatactctacaatgtgaataccttgtctagatactttatgcttccttttttgtttttttttttgtttcgttttgttttgttttttccattctattactttattagcaggtcatttcttttcttttcttttttttttttagacaagagtccgactctattgcccaggctggagtgcagtggtgtgatctcggctcactgcaacctccacctcccaagttcaagtggttctcctgcctcagcctcctgagtagctgtgactacaggcacgtgccatcacgcccggctaatttttgtatttttattagagatggggtttcaccatgttggccaggctagtcttgaactcctgacctcaggtgatcctcccacctcagcctcctaaagtgctgggattacaggcgtgagccaccgtgcccggcacaggtgatttttaagatgttaataatatcattctacatgacaatcatattttttgtatctaaaaaacggtttaaattttctcaaaataaaaggtgggggagcaatacaccaatttatatcattaaaacaagtcaacaatacatatgaacaaatctctataaagaacattttcttaaatatataaatcataactatagtaaataagtttaacttgaaaagacttttcctcccaggcagcatagactgtttatgcatatttttcaaattccgtgaattacttcaaaccatgaagctttattttatggacttaaaaaaacacctatatgaatctaggaatatctgaatgtcttatcaagcctctaaagcaaaaataaattatttaagaacatcagtattttcaaaattcttagactgtcagaactctcaagtcaggtactaaaatggattctcagaatgtcaaaatttagaaatgtgagtaagtcaaatatctaatttaaaaaaatcaaatctgggctcattggccacttgatttctattttttcaaaacaatagctatctttttgagagcctattttatgtcaaacattttacataaatctatgacctcatttaatcctcataaaagcctgccaatttgataataaactaatccaggagaagaaataattttggcaagttagatggtagtgggagaactaagataaagcacctccttgaccccaaaaccaaaggcctccaatgatccctgcctcctggtactcacaaccttgcatcctcttatcctgcagtatgcttggatttagtccctagcttctaaggaacagaatatgatacaggtgatgggatgtcacttcggagattactaaaaaaaaaaaaaaaaaagtagcttctgtcttagacttgagcttgcatgctttctctttcactttgaaagaaatcagctgtcttgtgaatggacagaggccaagtagcaaagaaatgagagaagcctccagtctctagccagcaaggaactgaagtcttcaatccaacatagctcacaaggaactcagtcctgtcaacaatcttgagagagctcttagaaccagatccttcccaaatcaagccttcagaccagaaacagtcctagccaacatcttgatcacagcattcttagagacactgaaccaaaggcacccaggtaactataaccagagtccagacctacagaaactacgaggcaatatatgtttgttgctttaaacaactaagttttagggtaacctgttatacagccttgagtaatcaatgtactctatacttataatttctcacgtaagaaacaagtaaaccaagagaatctgttcccaaaacaaggcctacaagagagtccattttcatggtttggtttttaaatttctaagaactgagcattactttaatactttcatgtgcatttacaagtgattttcaagaaaaatacaaaatctaagtaaaactgacacatcatgaacacttttcctccttatctactgagtgcctttatatacttcctatcctgagactactttactggggtaattcaatctctaaacactccctgaattaagaatcaagggacctatatgaagaaagacaagtctttcctctggagttaaggagacctacctccttcaaaagaagggagaaaaaaaagtctcctcccatctctctctaaactacggtaagtatattcatttctgtaacttctataacaccacaaacgtaaaacaacaggaatttatcttacagttctgaaggtcagtagtccaaaatcagtttcactgagctaaaaacaaagtgtgtgcagacgtgtgttccttctggaggctctacagaatatgtttccttgccttttccagcttctaaaggttagctgcacacctgggcttatgggatgttccatcatcttcaaaaccagcagtgcagcatcttctctcttgacctttgcttttggtcttaacccttctctgactaattcctcctgcctccctcttattaagaacctttgtgatcacactgggccaatccagttatccaggacagcctccccattgcaagatccttaatcaaatttgcaaaatccaatttaccatctaacgcaacatatgcacaggttttagggattaaaacatgagtatctttggaggggtacattattcagcctaccattgcaaatatccacaataatctgtaaaacagatgataacaacaaaaaactaatttcttaaattccctcacttttcatttattagggggtaagaaagatcccactgttttactcattctctcaaattacttttaaaaacctctattttcttccagtttccttgctggttttgtttttactcttagtcctttatccatctagaagttatttttgtgaatgatttaagataggggctttaaatatttttccagactgacaatcaaatatcctattaccatgtattgaatattttgccctactaatataaaatgtcatttcatcaaatattaaattcttttatatgtaggttatgtttctggattctcttttcttttttcttttttttttttttttttaagacagagtcttgcactgttgcccaggctggagtgcagtggtgtgatctcggctcactgcaacctctgcctcccgggttcaagcgattctcctgcctcagcctcccaagtagctgggactacaggcacatgccaccacgcccagctcatttttgtatttttagtagagatggggtttcacaatgttggccaggatggtctcgatctcttgacctcatgatccacctgcctcagcctcccaaagtgctgggatcacaggggtgagccaccggcacccggcctttttttaaaaaaaaaaaaatagagacagggtctatgttgcccaaactgatctcacacttctggcctcaagtgatgctccccacctcagcctcccaaagtgctgggattacaggtgtaagccaccacacctagcctgtttctgggttctctaattttatctatttgttcttttgctaataattgcaaaattttaactatagtagtttctaaattttaatagctggtgggataagtctcgtttttttaaactgtccttgttatagttacataccaaacaaactttataggcttctcaaattcatacaaaaattcctttgggattttggttaaagtttcactgaatttataaatcaattagggggaaaagtgacatctttatcgggctatcctacccataaacaccctatgggccaaaactatggccaaggctattatggcctactgtctctctctctcagaatatcatccgacatcttgaatacttacaatgttagagacatgctgat

SEQ ID NO: 1228 - DNA, 2798 bp, Homo sapiens
gctcttgtcgcccaggctggagtacaatggtgcgatcttggctcactgcaaactctgcctcttggattcaagaaattctcctacctcagcctcctgagtagctaggattagaggcatgtgccaccacacctggctaattttttttttttttttttttttttgtatttttaagagactgggtttcaccatgttggccagactggtctcaaactcctgacctcaggtgatccacctgccttggcctcccaaagtgctaggattacaggcatgagccactgcacctgacccacagacatctcttcattcagtagtctagcatgggggcttgctcccaagagtactgttccaggaagacatgccccattgtgcaagtactcattcaaacctctgctcgcataatgcttgctaacatgcctttggccaaattaggtcacatagctaacccaaagtcatgtgggtggccatcaacactgggatgtgtgtggctcgttggaggtcactgaagtgaaacctaccgtagttacacagtaagtcagtcaaattcttggtttattggacagctgacagctgttaagaaggaccctatgttaaaggaaatggatacaatctaataacattaacaatagataatggtttttaaccattaacttccattgataatggttctgattagagcgcaagataactagtgaaacgagaattcccttatcccccttgcggggcatgcgacatgggtatggctcactcttttggtttccctgttgctcaaacccctaggaggagcatgcagacgggcaggtgcagaggccgtggggagcgcttctgggctctgacctcacggcagcgtctagggatggctgtctgtgactcccgaatccctagtgggcgtctcttacagtgtgctctttcagctttgccgtctgcagaaggattatgttaatcagctcgatagaccctctgccttattgcaagggcagtggccagtttaacagctttctgtatcccaagttcttgcccagtgtacaagaagaatcggatgacacgtgggcttgaaggatgagtgcaaggttttattgagtggtggaggctctcagcgagatggatgcggaaccggaagtgggggatggagtgggaacgtgatcttcccctggagtcctgctgttctcggtagacggacgcctccttccttctctgccatgccgccctgccactcccgctctttgtcactctctgccactctctttctctgctcctctcaatgtccagccacttgtgtctgtgcctgctaagatggagagatcaacctgaattatctggatgggctctaaatgtaatcacacgtgtccttataagaggaacccttgcttacagaagaacaagagatgtgatgatggaagcaacaggttagagagattcaagaaaagcatagccagccaagggaatgcaggcagcctccagaagctaaaaaaaaaaaaaaaaaaaaaaaaagaaaagaaaaaagaaaagcaagagaacgattccccctagagcttcctgaaagaactagccatgccaccacattgtcgttatcccagtgagacagatttcaaacttgtggcctcaagaactgtaagggtaagaactgtaaaataaatttatgctgttctaagccacaaaatttgtggcacttttttacagcagcaacaggaaattaataaaagtcttccagtggtagggggtgaatctcattacgtttctaaggcaagcattgcttagtatcttgcttatttaaaagataaatttagctagtatacacaatagtggccaattagattgtatgctataatacttgtaagaaaaatgattgcatactctttgttttcttgtttgagacagagcctcactctgttgcccaggctagagtgcagtggcacaatcttggctcactgcaacctccacctcccggtttcaagctcttctcgtgcctcagtctcccaagtagctgggactacaggcacacaccaccacacccagctaacttttgtatttttagtagagacagggttttgccattttggccagactagtctcgaactcccgacctcaggtgatccacccgcctcagcctcgcaaagtgctgggattacaggcatgagccaccacacccagccaattgcatactctgaatcaaaaaaccatttccctcaagttagaatatgcaatatttattgtacattgagtgccctctggtgcttacccaaagctttctaaacctcaaccaaactcgtagagataaagcttataagcagtgggacaatttggagccttaaactcccaaattctcagatgtcttccaacatgattttccaaagcaatctgtagcatgtctggagcaaggatggggggatcatgattcagggggccccaaggagggtctatcatagactgttgctttttaaagtaactagtagcaatgctttaaattgtcattgtagatttaagaacctgtagttcaaatgtctcagtttagtatgcaaaaccctttacctccaagctcctgcctatttctgcctctctcctttatgtcaagccatcatgatttatatggtataatgccaatggatcattgtttcacaaaagttctttccattccttttagttcttttccactccttcagcaagttgaagagccctctcttgtccttcagcactgagctttgtatttcctttttatgccaaaccaggagaaacaaataggaactctgccaacttttgtttgcaaacccctttcacggtaatctataatctcacaaactccc

SEQ ID NO: 1229 - DNA, 947 bp, Homo sapiens
attatgttggagaactatctggaccctatcctgatggccagggcagatggtagatatcatgtgctaagaacaggcactttgcaattcccagcatttggaaatctgccatataaatttgaaatgggtcaaagtgaaatgctgagattcttttatacttatgagaaggtgcaaaatttcaaaacttgggaaaataggaagttatttcctgataaaacaactctaaaaatgtttggaaccaaagattaatttatcttgctcttctccagatggacagaagatggaaaaatttcttacatgaatgaagtgttttttggctgcataagaagaacaaagctggaggcatcatgctacctgacttcaaactatactacaagactacagtaaccaaaacagcatggtactggtaccaaaacagagatatagaccaatggaagagaacagagccgtcagaaataatgccgcatatctacaactatctgatctttgacaaacctcacaaaaacaaaaaatggggaaaagattccctgtttaataaatggtgctgggaaaactggctagccatatgtagaaagctgaaactggatcccttccttacaccttatacaaaaattaatccaagatggattaaagacttacatgttagacctaaaaccataaaaaccctagaagaaaacctaggcaataccattcaggacataggcatgggcaaggacttcatgtctaaaacaccaaaagcaacggcaacaaaagccacaattgacaaatgggatctaattaaactaaagagcttctgcacagcaaaataaaccaccatcagagtgaacaggcaacctacagaatgggagaaaatttttgcaacatactcatctgacaaagggctaatatccagaatctacaacgaactcaaacaaatttacaagaaaaaaacaaccccatcaaaaagtggg

SEQ ID NO: 1230 - DNA, 1599 bp, Homo sapiens
tgtggtccttggtaatttttaagagtacaaagggatccaaatttttgccagattaggccaaaagctcacatttttaattttgagcgcacttctgtgaaatcctgtgcttctcttagagttgattacctttgaattttgctctttcaaaagaccccagtactatcataatacttgctaaggaatctttttccagtgagtatcattttttaagttctttcttgtttgctttttcaaaattatatatgtacattgtataatttgtcatgtagaaatctcattttctttttttttctgagacagggtctcactctgtcaaccaggctggagtgcagtggtgcaatctcggctcactgcaacctccagctcccaggctcaagggatcctcttgcctcggcctcctgagtacctgggattacagattcactttctacctattcttggatgactccccaaacaatattatctacagcccagatgtttctaagctccaggccccaccgcacaccaggcatctctacttgattgtccacatccttctggcttgctgtgtttcagactgaacttcctcctattcttctcagagaagggctctaccatctgctgaattgctcaaatttgattcccttccccgcatccagcagttgctctttcttgtccattctgtttcttgtctcttgaatccacccccatcacatggtcccacctgcctctcccctaggccaggcccgtgccaccttttccccagactcttcctgcagctttactccgccaatcaactgaatggcttatttttattcttgtggtaaaatacacgtaacataaaacttaccatcttaaccctccaattcatttttgacattactcctggagtgacttttcaaagcataaatttagttatgtctcatcttcccaaacgtctttggaagttcccatcacctgtagaataaaatccctaacctgacgtatgagctttcctaatttccctggactaattttctcattatatcacaccctgctgttgcaccctgcactctcagcatctttgtgcttcatccagtgcaacaggctggttcctacctccttgccagtgcgcctgcagctccttctgaactgaatgcgacacccaccttcaatgtgccttaacagatccttactagtttttcgtaccttagttcaaggttccttcctctgtgaaacctggactcacccaattggaccttgacatatctcaccttacaccatttctactgtatgttgacttcagaggtagcgcttgatttcataaggccctaggcttaaatgagacatgtcacaagttgtgttcttccaaagccgcccatttttgtctttttgaatagcatggtttaaatttctaatgggttgaattcacctctgatgcatttgtgaagcaataagttaaattctgcagataaaatgcccgcaagtcagcctcctccttcaaaatggctgaagacaagtatacatcaatattgtagttttcataagtgctattcatgtgaatgaaaaggaaatatgttcacctttcagggatcacatgtgactctggaagggtattttctgtggctgagcacagctttg

SEQ ID NO: 1231 - DNA, 4094 bp, Homo sapiens
cacctcctggcaggaatcaacagacacctcatacaggagagttccagctgccatctggtgggtacccctctgggacgaagcttccagaggaaggaacaggcagcaatctttgctcttctgcaacctccactggtgataccaggcaaacagggtctggagtggacctccagcaaactccagcacacctgcagcagaggggcctgactgttagaaggagaactaacaaacagaaatgaatagcatcaacatcaacaaaaaggacgtccacacagaaaccccatttgaaggtcaccaacatcgaagaccaaaggtagataaatccatgaagatgaggaaaaaccagcgcaaaaaggctgacaattccaaaaaccagaatgccttttctcttccaaagaatcacaactcctcgccagcaagggaacaaaactggacagagaataataaactcctccaagccaaaggaccatgttctaacccaatgcaaggaagctaaaaaccttgaaaaaaggttagaggaattgctacctaaaataagcagtttagagaagaacataaatgacctgatggagctgaaaaacacagcacaagaacttcgtgaagcatacacaagtatcaacagccaaagcagaagaaaggatatcagagattgaagatcacctttatgaaataaagtgtgaagacaagattagaggaaaaagaatgaaaagaaacgaacaaagcctccaagaaataggggactatgtgaaaagaccaaacctatgtttgattgtccctgtacctgaaagtgacagggagaattgaaccaagttggaaaacactcttcaggatattatccaggagaatttccccaacctagcacgacaggccaacattccaattcaggaaatacagagaacaccacaaagatactcctcaagaagagcaaccccaagacacataatcgtcagattcaccaaggttgaaatgaaggaaaaaatgttaaaagcagccagagagaaaggtcgggttacctacaaagggaagcccatcagactaatagtggatctctctgcagaaaccctacaggccagaaaagagtgggggccaatattcaacattcttaaagaaaggaattttcaacccagaattttgtatccagccaaactaagcttcataagtgaatgagaaataaaatccttcacagataagcaaatgttgagagattttgtcaccaccaggcctgcattacaagagctcctgaaggaagcactaaatatggaaaggaaaaattggtcccagccactgcaaaaacataccaaattgtaaagaccattgacactatgaagaaactaatgggcatcaactaatgggcaaactaactggctagcatcataatgacaggatcagattcacatataacaatattaaccttaaaagtaaacgggctaagtgccacaattaaaagacacagactggcaagttggataaagagtcaagacccatcagtgtgctgtattcaggagactcatctcacatgcaaagacacgtgctctaaataagggaatggaggaagatttaccaagcaaatggaaagcaaaaaaaaaaaaaagcaggggttgcaatcctagtctctgataaaacagactttaaaccaacgaagatcaaaaaagacaagaagggcattacataatggtaaagggatcaatgcaacaagaagagctaactatcctaagtatgtatgcacccaatacaggagcacccagattcataaagcaagtccttggagacctacaaagagacttagactcccacacaataatagtgggagactttaacaccccactgtcaatatttgacagatcaatgagacagaaaattaacaaggatattcaggacttgaactcagctctgcaccaagcagacctaatagacatctacagaactctccaccccaaatcaacagaatagacattcttcttagcaccacatcacacttattctaaaactaaccacatgattgggagtaaaacactcctcaacaaatgcaaaacaatggaaatcataacacagtctctgagacctcagtgcaatcaaattagaactcaggattaagaaactcactcaaacctgcacaactgcatggaaactgaacaacctgttcctgaatgaatactgggaaaataatgaaattaaggcagaaacaaagaagttctttgaaaccaatgagaaccaagacacaacatacccaaatctctgggacacagctaaagcaatgtttagagggaagtttatagcactaaatgcccacaggagaaagcagaaaagatgtaaaattgacaccctaacatcacaattaaaagaactagagaagcaagagcaaactaattcaaaagctagcagaagataagaaataaccaaggtcagagaagaactgaaggagagagaaacacgaaaaacccttcaaaaaatcaatgaatccaggagctggttttttgaaaagattaacaaaatagatagaccactagccaggctaataaagaagaaaagagagaagaatcaaatagacacaataaaaaaatgctaaaggggatatcaccactgatcccacagaaatacaaactaccatcagagaatactgtaaacatctctatgcaaataatctagaaaatctagaagaaatggataaattcctggacacatacaccctcccaagagtaaaccaggaagaagtcgaatccctgaatagaccaataacaagttctgaaattgaggcagtaattaatagcgtaccaaccaaaaaaatcccaggagcagatggattcacagctgaattctgccagaggtacaaggaggagctggtactattccttctgaaactattccaagcaatagaagaaaagagagtcctccttaactcattttataagccaagaatcatcctgataccataacctgccagagacacaacaaaaaaagaaaatttcggccaatatccttgatgaatatcgacgtgaaaaccctcaataaaatactggcaaactgaatccatagcacatcaaaaagcttatccaccacaaacaagtcggcttcatccctgggatgcaaggctggttcaacatatgcaaatcaataaacgtaatccatcacataaacagaaccaaagataaaaaccacatgattatgtcaatagatgcagaaaaggccattgatgaaattcaacactgcttcatgctaaaaactctcaataaacttcatattgatggaatgtatctcaaaataataagagctatttatggcagacccacagccaatatcatactgaatcagcaaaagctggaagcattccctttgaaaactggcacaagacaaggatgccctctctcaccactcctattcaacatagtattggaagttctgttcagggcagttagaaaagaggaagaaataaagcgtattcaagtaggaagagaggaaattaaattgtctctgtttgcagagacaatgattgtctatttagaaaaccccattatctcagcccaaaatctccttaagctgataagcaacttcagcaaagtctcaggatacaaaattaatgtgcagaaatcacaagtattcctatacaacaataatagacaaacagagagccaaatcatgagtgaactcccattcacaaatgctacaaagagaataaaatacctaggcatacaacacacaagggatgtgaaggacatcttcaagaactacaaacttcactgctcaaggaaataaagaggacacaaacaaatggaagaacattccatgttcatggataggaagaatcaatcttgtgaaaatggccataccactcaaagtaatttatagattcaatgctatccctatcgagctaccattgacttcctttataaaattagaaaaaactactttaaatttcatatggaaccaaaaaagcccatatagccaagacaatcctaagcaaaaagaagaaagctggaggcatcatgctacctgacttcaaactatactacaaggctacaataaccaaaacagcatggtattggtaccaaaacagatatattgaccaatggaacagaagagaggcctcagaaataatgcca

SEQ ID NO: 1232 - DNA, 468 bp, Homo sapiens
gttttttaaacggtagacataggaaactaatacagtttgactctcttctagaaattgtgaaaataataatatatgaaaatctgaatttttgccgtatttgtttgatatcgaaaatgagaaaaaaggcaagatgaccagaagctactgacagaaaaaaaattaagaagcagcaccattagtggaagccaacaagcctttccattgctcctggggagctggtcccagagaagcctactaactagatgggaggcaagcagctgtgagctgtctcttttagcacctgactttcctggcttggctaaggggcagttgttttccagaattacctcaaaggaaagcacaacagtcagacgtgaaatggaaacagaaaaatcttctgaagcagaatagtaacgctgtgaatttaaaagtaatgggtaagcatggctaaagattaaatagatgactttttaaaggatcaattcgagg

SEQ ID NO: 1233 - DNA, 624 bp, Homo sapiens
gagacgctggggagagagcagggatcgcgagcccggcggatgcggcagcggcggaaggcggctggggagacgctactccaactgttgaattgaattttcacctttcctttcatccgctgctttgcttgcggagatggatttatttgctttgaaatccgcatatctttctcagactgtggggtgatcccggcagacaccagactgaaagagaccacccgtgacagaaaaggaggaattaaaaaaaaaaaaaacctccacaacagactgcacaattaactgtacacatcgatgttggactttgtgaatagaaaaaattgagaggaaaatcttgaactatgatgcgaggctaagctgggaacaattactggaaacctgattttgtttttccttttccaagactctgaaaaatttcggggtacctctcgcctaaccaagaggaaaggtttaaaaaaaataaacaaaataaataaaccaatacacctagcaaagcagacgccttgttttccagaacctcggactccggcagaaagagactgagtcagagaaagcgttaggaagaagccgcaactaatgtctgtgaagggaggaccatgaggcgagagtgaatacgattcgttccgctgc

SEQ ID NO: 1234 - DNA, 278 bp, Homo sapiens
cttagttctaaacagagaaatacttccaccaggagacacaacaatgattccactgaactgaagactgccacctggccactttgggctcctcatgcctctgagtcaacagacaaagaaaggagttattgcgcaaagaaaggagttacagtgcaaagaaaggagttgcggtgttagcttgagtgattcatctggggtactaaagggaaattggactactactggaaattggactactaattggaaattggaccacaaaagagagtggtcctgggagcggc

SEQ ID NO: 1235 - DNA, 4175 bp, Homo sapiens
ttttaattggtattttgagtttctggagctgtaagaaacagagttccagagagttgagtgactccctgatttttagactttagctgtttggggttgcaaagttatgttttctgcattattttagttagtcctgcaatatttaagactttaaaaaatgttaacttctcttgaatgtttggataaactgccaataccatcctttttttttttttttttttgagatggagtctcgctctgtctcccaggctggactgcagtggcgtgatctcgcctcaccgcaccctacacctcccgggctcaagcaattctcctgcctcagcccctcgagtagctgggattacaggcttgtgccaccacacccagctaatttttgtatttttagtagagatggggtttcccctttttggtcaggctggtgtcgaactccggacctcaggtgatcctcccacctcggtctcccatagtgctaggattacaggcatgagccaccttgcccggccaaaaccatccattcttgaatggccacaaaagccctttgaagttgagcccctgttatcacttcaattctcaggttccctcaaatttgaatagtcccaacagcagctgtcatctcattatttgaagccaactctctgttaccattcttcatcttactccccatttagttataattatatactttaactgcctgtacactgaagtcatttaagtttgcttatctttctatagaaagggcatagacattacaagttttctgaaactcttactagtatgtgctacctggagaggtatgtttagaatgatgccagggctctgccttggctaagcagaaaagtgtgccttccaacgttctactttctcccaggggatgccgtgagaacaatcatgctagatatagttaacatttacttgagatttgaaggacagtaagggtgcctgaaatagtaccatgaccacaattggaagagaagctgatgtttactgagcatatctcttttggtcagagattaacatacattcatggatttaggctgcataagtttcaaaagtttcatccgatgtgataaaactagtaagtggtggtcttaaattgtgactgtacagctctattatattgtgctctcttagtgttttgaatactttcacatctttgagagcaggcgatgtaaggcagatacctctagcagtaaggccctttagggaaataaatgacaccgctctcattttgagggcttacagtgtgctctgctgttaggaactttgcataggtcatttcatttactgctacattttcccactttgtaggaaagtattataatcactactttataggagaggaaactcaggttcaatcgcctcaaacaggtctccaaggtcacagaaccaataagtcactgaggcagaattcaaatcctgggggataatttcttaaatttgtagtttatacgcactgcaccattaaaggtgttgatagaaatgcataataaagataaaggtataacataaccagagataaatgactacagtcacaattttgcctgagtctagttctcaagagttttaatgaaatcatagatagctcaatggtttgtttcaaggcttccaactttaattctgacacatatggaagaagtataccaactagcagcaatattgacagaatgtgatcttcccagagagtgagggttaatgattggtgacagtctagtcctccaaaagcatctgctgttaatgaggttagacctccaatgccaccctgaactggaaaagtcaactgttaccctgaaattctaccccgactcatatatatttatgattgcttttacttactgtagataccctattttcaactttttcttttaaatagtttgggttaccgtacatataattaataagaaaaattattccctgtgggaaaatttacttggaaaaataaaattaaaatgacagaaatctcttaatgagaatatggcaccagttcatggtaaatggatttcggtatgctatgtttcatctaggagatagaagtcatttcggccaggagttgccaaactttatgacatcaccctttgacagctccagggataggatgaccatatttttctctgagttatgatttcatgcaactttttaattctctccatggttctcacttttttgtttttgtttttgagacagagtctttctctgtcactgaggctggagtgcagtggcgcaatcttggctcacggcaacctccacctcctgggttcaagtgattcttgtgcctcagcctcccgagtagatgggattacaggagtgcaccaccaggcccagctaatttttgtatttttagtagcggcagggtttcaccatgttgcctaggctggtcttgaagtcttggcttcaagcattccgccggcctcgacctcccaaagtgctgggattacaggcctgagccatagtgcctggccagttctcacttcttacttttgataaatatagtaaaatatgcaattcccattgttattatattatagcattctaatgatatatggcaaaagtttaattcttataggatggtctttcatagaatctcctttgctattgcaaatcgaatggtattactttatacttctggtcatgtttttgaggcagccattctccttatctgatatagaaataatccttttaccatagagtttactcaatttttaagtaacttgtaacaaacacattttgaaactttatgcgaaatgtatttctcagtgttagaaaaataattattatctccattcacaagcaaacaggtgttatctacagctatgttatatgagctgccatttctttaagtttggacattggcatacatgaccatataagttttaaattttcttaatgaagcattacattcaaatacaaataccaaatagagctttgctaaagaccataaataaaagtaatctgatggtttcataatgctatagcactgatacctgtgaataatataaagctgtttttcttctcaaagaatggatcacttagaatgagacagaaccacctgcaaataagcaggtatctgtgatttaagaaataatataaaaaaaggaggaggagaagcaggattataatcggatgctctacaaccatatagagacgtacctaactggttccagagatttgaggagctggatgtattgccagaattataatttgaaatagtcagtgagatactgcagaaaaataaatagagactcatgtgagtcttttagcaattaactatttagacaaaaaatacagaagagtaaaatcagggctaaaagattaatttactttcttaagatcttggttagtagaagctttattaattaaataataaaaatgttgctcttaattatttttcaggaaaatacagatacactttgttgaattttttaatagcctagggttgttcagattctatatgagttgacattgactcagcagtttcgatagctacagaataagttaaaacattgtttagcttacaaaaaaatccctttagtttattgtggaacatttcaataacaataattaaacaatgagcacttcagaatctgctgtaagattctagctaacagaggccaaaagacatgtaatcagaaatgattttatgggttaaatctatgccagagctttcttttacaataaaattggaacgaattttgtatggcagaagatggcaacagagcagtgtttaaattcttaatttttaaatgaaacattaaaaataaatatgaacaccataatgagcattgtacaatatataaaaataaatttgaacagatgattttaggatgttataacttggatttacctaaaaggtggattttcaacaattatatagttctggcttcatatttgcactcttggttttcatatcaagtgccatcagtcatttgtgttacaaatataactgtggtttccattcacagggaaaacaaacactgattttccccagtggtgctgaggacttccagtgtcacaatgtgaggataatatttccaaactttccaattttatttgtgatgtcccatgaatattgttccagtttgccctgtggaatattgccttctactaatccaaatccctacagatggaaatagcaatatagctgcaccagccaactcaaaattctaaacattctaactctgagc

SEQ ID NO: 1236 - DNA, 3285 bp, Homo sapiens
ctacaaaggacatgaactcatcatttttatggctgcatagtattccatggtgtatatgtgccacattttcttaatccagtctatcactgttggacatttgggttgtttccaagtctttgctattgtgaatagtgccgcaagaaacatatgtgtgcatgtgtctttatagcagcatgatttatagtcatttgggtatatactcagtaatgggatggctgggtcaaatggtatttctagttctagatccctgaggaatcgccacactgacttccacaatggttgaactagtttacagtcccaccaacagtgtaaaagtgttcctatttctccacatcctctccagcaactgttgtttcctgactttttaatgattgccattctaactggtatgagatggtatctcattgtggttttgatttgcatttctctgatggccatgatggtgagcattttttcatgtgtcttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattaaactaaaaacttttttcttaaacagttaaatatatttagtttaatggtataaaaactaattatatttagtttaaaaattcaaagaacatagaaccttgaagtatagtccttagaactataattgggtttgctcctcttccttcacttctttttttaagggatcttccttttctactgtcatctattatcaatatttctactatttgctgctgactgaaacctgtatctcaactttgcctgacatttcaggctgtattaattgaatttagatattaaatgacattttaactgggccttgaagtgtaagtgtgtgtttgtgagactgaggacaaatgaataacatgcacaatctgagcaaaggcagagagataggcaagaacccaatttgcttgggaagcaagacgttctaaaggatgattggctagggaaatggctgttattacaggatggacagaaggttgattttgatggcaaaggactctgagcatttcaaaggaatttatggtttatcttgggttatatttgcagttgataacaattgactgaagtattttgttgctctttatttaatttttttaattgagccttaataatatgacattttgtggcgctttcattgtgtagagacttcatgggcagcattagaaagaatgaattgaagaacaacaaggaataaaggaaagaagaacaattagaatttaattacaacagtctgagtggaagattgatgagaaactgaactgataattgagtgtaagggctggttataggagacattgcagagacaactggcaggaatgtgtgagtagaagtggacctggctaactatgaggaagagggagaagtcaacgatgcctgaattatgttttccttaattttggcaactgctgagatgaaaactttgtttctttcaccaactaagtaaaaaggggaagaggaagtttgaagaagtaagggagatgtataggtttaatttgggaatatattgatctgagtgacacagacacacacacactcaggttggaatcacaataggaagtaggattgtgagagtacagaactcagaagagtgagcagagctatagacagatattttaaaactactagctaattggcatgtgtggtagttgaagacccatttatggagtttcccaaggaacaactctattggttgacacattgctattaattttcttcaattccaagaactccttaaaccaacaatctccagattatcatctccttgctattcctgccctcttctaatctccttgatttgttcctcgggccctggcacattctcttctcacttgtggacactgttgccactctctaaactggattaatcattatttaccctgaaggccccagtgggtgtccaatttagataattcttcatataaaattttctcatatcactttgcactctcattgtataatatcaaaaatcacaatctgcatctacatatctttatgattgcattgtgagtgctaagagaattaaacaaacaaacaaacacaaactgacaggtttcatcctctattctagtgtttcatgtaacctggcccagaatttttattttttctttcttttcatcctgatatggtttggttgttttgttccctctaaatctcatgttgaaatatgacctccagtccaggcgcggtggctcatgcctgtaatcccagctctttgggaggccaaggcaggcggatcacgaggtcaggggatcgagaccagcctggccaacatggtgaaaccccgtctctactaaaaatacaaaaattagctaggcatggtgatgtgcgcccgtagtcccagctactcgggaggctgaggcaggagaatggcttgaagccgggaggcggagtttgcagtgagccaagattgtgccacttcactccagcctgggcaacagagtgagactccgtctcagaaacaaaacaaaacaaaacaaaacaaaacaaaacaaaacaaaacagacctccagtgttggtgacgagcctaatgggtggtgtctgggtcatgggagtgcatctctcatgaatggcttggtgctgtcctcctggtaatgagttctccctctatgagttcacataggatttggttgcttaaaagagcctggcaccttctccctccctttcttgctcctgcccttgccatgtgatatgctggcttcccttcaccttctgttataattgtaaatttcctgaggccctcaccagaagtagatgccagaccatgcttcctgtccagcctgtagaaccatgagccagataagcctcttttctttatgaattacccagcctcaggtattcgtttatagcaatgcaaatgaacgaacacacttcctaaataaaagattccatgaatgaatggataagtttcttttggatatagcccagttttcaagttccaatatgataatattaccttaagtctgtgttatctcttgaaaggggtatttaggagtctaataatcacctcccacatttccagtgtctttcatatctaatcaaacttaaccaccacttcaaagcacaatgctattcctgtcaacaactctttttctctgttcttttcttccttg

SEQ ID NO: 1237 - DNA, 1331 bp, Homo sapiens
gcagagagccgctgagaggctctgcgtgtgcgtgtgcgcgggtgacgccgtgtgtgtgcgagtgtgtgtgtgtgtgtgcgcgcgcgcgtgtgagagagagaaagggagagagagagggggactctgtgtgagggaaagaaaacaatttctcctgctctgcagcttctgttcagataattccactggctaatggaattctcggcgagcactctgatattttattttacaccagcgttaagattctctgtttccctgtaacatcggagagacgagcaactctatttacatttagtgcgtgtgcatctagtgacttcggtagacatctgccaatcaaatacacgtcattctgcaaaaccacctagacgcctccatgcccttttcttactggacgatagagttgtttagataagtaaatgctttgaaataaatttggtggcttttagcaagaagcagcttgtgatgggaataggagtggtcactttgaggagtgggtgtataccgtcttctaagaaacgcttttagaactgacatttatttaaaacagtggaccccccctccctcaaggaaaaaagcttgcttgtgctattctcagacctcattcacatgttgtgtgcattttttaagaccacatagaaattggttccgataaaggagtatacttttaggttagaaaatttcaaactgtagaagcatagtggaaataggatgttgaaggacagacgtttcagttgggtaagttatatctttattgttgcagacgggtcttgatactagattgaatatattaagctcctttgagttggggaaagagcaatttgagcatataaaaattaggaaagcagtttattattctgccaatttaataactattatgaaatgtactgggaaaatttgaaatttgaaatgttttcacataaaattttcataattttgaactaagaccatgtaaccaacatggctatgtcaggttaaacaaaacattcttgagggtttctgtttatttttgaaaaccttcagttatttatctactacttagcaatgcagtcagctgaactttattgtggaatgctttttattactgtttattgaaaaaaattgttgtgctaatgagtccttaatattctccacctcccactccccagaagttctttttacagcaatgactatcatttgggagtaaatggtcctggtatagcatttgagaccttgaccttagcaactcttggctggtggttgtttactacagctgcagcctatgtgtgtgctgaaagggaaggtctgcaaacactagtgtactcactctccccaggccaaagggagaacaaatcggg

SEQ ID NO: 1238 - DNA, 287 bp, Homo sapiens
cccggcccagggaaatcaacactgttactcgctgaggaagctgccaaggggttgccatggcaactgttctgctttcagcagctacttttctggtttgaaggggggaaggaaaaaaaaactggggagaactaggcggctttctgatcagagttcagataaaaagggtcacagtaatttgtgggcactgactaaaataacccaatggatttgagagttaccgcaaaagaagcaaacagacaaactaaagagaacttgaacttgggtactgacaaatgaagatgatgaac

SEQ ID NO: 1239 - DNA, 688 bp, Homo sapiens
cagccatgaacttggtgatgagccagagaaggtaacttttcatcccctacaagaccttaaagaagaaagccttaaaaacccttgagtgaatggttggtatttacagacaagcaaatgtatggaagagaaacgagagacccagcctgaatctgttgaatgaacgaaaggggaaatgccctaaggagtcagatggaagaagtttttctgggaagagcagaacacaggagttggggtgcagacctcctggatcaccagcagaaggaaaagagcagtgagacgttaaagtgattgagacaaaaatggaagtaaaacagcttaaggctttctgagatcgagttcctggcagtgtcatcagcagatggtttcttctgaagttcaggggaagagaagatgctcgaagaactctccagggactgagtgggtggtacagagctagtgctgtagatgccatgtatacaggcaaattccccaatgagtgttttccaatatcaagtttaactggcatttaagatatatgccaaaggtaggtaaattattttggcctgtgcttataggtttatttccctggatgaagctttctgtctctgtcctagtgcactgtagcagatgcagggtctttccatacaatacattaaaagctgcatctcattttaaatatattatagaaaccctgatcatacaatacata

SEQ ID NO: 1240 - DNA, 801 bp, Homo sapiens
ctgtggaaaacacgcttctgtgctgtaccttccattgaggatacagatatactccttttggcaaagagatagcatgatgagctagacagaattctgcaacaatttgaaagatgataaatattcacagaaagaaagaaaagcaatccaggaacagaggaaagtgtgctgtgcttaaagtcaaagccaaaggtggtttaaggtgacctccaggaaaacatgagcactcaaagagaggaaattgatcttttctgtactgaagctaaaaaatcaaagggaactacaaaaagttagatgatttgaggccatggcaatcctgaaataatcatcaagatacaattctgcaacagaagaaagaagtgtagcattgattctcttgcaccttaattagcgtcagtgggactgattcagctatgcaaacccacataggtcaacaggaccacaaaccagaaatagatgagccctaatgaaatcaaagtagaaaatcactgtatgtttcaaatagcacccacaccaccgggaatgtactttttcaaaattctctgcttctgccaagaaatgcaccatggtgtgaataatgaaaatgaataatgcaaagcataatggagtacacaatttgcacatcagtcacagttttcctcctcagactgatagacttcagaaattacaaacaagactgtttaaaatccagaccaacaggagcattaaatcggaacagaggccagctggatgtgagagcccataagtaatggtgctgtatttagtcatctgaagagaaattataatggagatccataataaatg

SEQ ID NO: 1241 - DNA, 256 bp, Homo sapiens
gaattacgaaacttgggacagactctgatgttacgtttcttccctaaaagggcagtttgaaagcctctaagagaagattatgaagtttggaaccagatgccaggagacacgaggaaggctgtagatgctttgaacttgtctactggaggaatatgctatgttgtgtacttcatctctatgaatatttagcaaggatttctactgaacgtttgcagtaataaaaagtatgccatcagttttaataaagagacaccca

SEQ ID NO: 1242 - DNA, 880 bp, Homo sapiens
gggcaaacggacacagaaactgctttgtaaaaaacacacaagaatccaaattaaaacacagcaacaacaacaacaaaaggaaataaaaaattgcctattttgccacctactttcaggtaatggaaaatgatcgcgaccgcttgatgactttcttcctgcgctgggtcagcccgagcttccaaaaataaaataagtgtgacccaggctgaccacgaagaacggaagagagagagctgcacttccgaaccgcagagacccggcgccaggcagggcgacgctcccacccgctccgggctagactgtccacacggagcagaggcgggcactccctccacccggcaccctgcctttttctcaccctggaagtctcctgcccccgaggcgggcaacctgtgtcccccagccccaccagcgccccgcctagggacagcctctccctggactttgccttccaccaagaggaagaacagaccaacttccgagcaatcggcgggagaaaaaaagagaattcggagccagattccccgctgatgaacactccggggttcggagctggagacgactccccttctacaagcgcacgcggagtatttcctcttttttctcaatgaacaagaggccgaagcgccaacgcattttcagcttcaaacatgtgctacctgactagatggaattccttgagaactgtattaacatgtttcaaagagttgaattaacagatggagtttcgctcttgttgcccaggctggagtgcaatgctgcgatctcgactcaccgtaacctccgcttctggggttcaagtgattctcctgcctcagcctcccaagtagctagaattacaggcacaaaacagcaacaccacctacccctcccattgcct

SEQ ID NO: 1243 - DNA, 1475 bp, Homo sapiens
ggcaatttttgataacactaatatacaatcagagaaaaaaatatgtgtgcattttctgtagagaaaaacagtatacctaagatatgacctaaaaatgggcttcctcctttttgttcattttattttactcttgcagaaaagttttgctctaggaatttttgatttgtggcagcacatactgaagcacatagaggtcaagagaaataagaaagagaatcaatgagatgtggcagtcttctgcagtccatgactcaaacttgaaggtggaaagatcaaattaccttgctggtttttgtcttcctgaagtcttaatcttctggcataacatttcaaattcagaagctactttattactgggaaaggtgagaataaagatcccgaataaagtcaaaagaactcaccataaggagggagttcagcctgagagaagactactcaccagaagagcttgattaacaattttacggcattttaccccttaaaaaactcttccatatacgcaatcacctttgaactccacaacacatgagacttgctatgatgtccaggttggcctcaaactcctggctacaagtgaccctcccacctctgcctcccaaaacactgggattatggatgatatccagctattttgcccccttccaccagcaccaatatcttttgcttactaaaggaggtactcacaacgaagatcacacatgactctttattttctattatgaagcaacagcctgaaaaaacagccacttattaaatactgagcgagagtccagaggcctacatcatttcagctttaatcttaagaaaaaacaagaaagcaaatttctagcttcagttctctaattgcacaccagttatcagttttagagtaattgaattttactcatcatgtaaataactgacattatagagacacagtcttactgtttgttggaccaaaactagtctgctgcatatacactggagaggaaaaaaggtaatcaacatgaaataatgaagatgcactccaatagaataattaaggattatttcactattcaacagttgacagtcttgatgataaatatgatatttgtattaccatcaagcttaatcttcaaaagaggaatggcaaaatgagccatcctttcataaagatctaatcttatatcagtaataaatattgccaaggttaattaatatatgttattatctagccttcatataccaaaattacaatgtaattataaaatatttttatgaggatgtctaaggacattttaaattgggaggaaaaaacacacataattgtgttcattcatgcacagagcgactggagcagattgatttgaacatgaaggaaaattacagaaaaagtaacagaaagcaaacaatgctcctcatctaacagaaaaaaaacctttatttaaaattaattaaagtataaaaataacttacttccaaagaataaatcacatattaaacttagatctaaa

SEQ ID NO: 1244 - DNA, 1289 bp, Homo sapiens
tttctgtagagaaaaacagtatacctaagatatgacctaaaaatgggcttcctcctttttgttcattttattttactcttgcagaaaagttttgctctaggaatttttgatttgtggcagcacatactgaagcacatagaggtcaagagaaataagaaagagaatcaatgagatgtggcagtcttctgcagtccatgactcaaacttgaaggtggaaagatcaaattaccttgctggtttttgtcttcctgaagtcttaatcttctggcataacatttcaaattcagaagctactttattactgggaaagatcccgaataaagtcaaaagaactcaccataaggagggagttcagcctgagagaagactactcaccagaagagcttgattaacaattttacggcattttaccccttaaaaaactcttccatatacgcaatcacctttgaactccacaacacatgaaacaggatcttgctctgtctaccaggctggagtgcagtggcacaatcgtaactcactggagcctctgaccccagggctcaagccattctcctgcgttagacttccaaagacttgctatgatgtccaggttggcctcaaactcctggctacaagtgaccctcccacctctgcctcccaaaacactgggattatggatgatatccagctattttgcccccttccaccagcaccaatatcttttgcttactaaaggaggtactcacaacgaagatcacacatgactctttattttctattatgaagcaacagcctgaaaaaacagccacttattaaatactgaggtgagaaagttttttttttttttcttttaatatgagatggggtcttgctcttttgcccagggtagagtgcagcggtgccatctcggctcactgtacctctatcccttgagttcaagtgattcttctgcctcagactcccaagtagctgggaccacatgcatgccctgccatgcccagctaatttttgtgtttttagtagagacagggtttcaccatgttggcaaggctggtctcgaactcctgacctcaggtgatccacctgccttggcctcccaacgtgctgggattacgcggttctgggattactcagcttgagccactgcacccagctgagaaaggttttaaacatagtaaactatgtttaactacgtttagtaaactaaatcatgtcatctaatatgacctctgagaattaactatttttatcgtgggggaatgtcccaatcatattcaagagacttaatagtgagggtggtatttaat

SEQ ID NO: 1245 - DNA, 1245 bp, Homo sapiens
ggcaatttttgataacactaatatacaatcagagaaaaaaatatgtgtgcattttctgtagagaaaaacagtatacctaagatatgacctaaaaatgggcttcctcctttttgttcattttattttactcttgcagaaaagttttgctctaggaatttttgatttgtggcagcacatactgaagcacatagaggtcaagagaaataagaaagagaatcaatgagatgtggcagtcttctgcagtccatgactcaaacttgaaggtggaaagatcaaattaccttgctggtttttgtcttcctgaagtcttaatcttctggcataacatttcaaattcagaagctactttattactgggaaaggtgagaataaagatcccgaataaagtcaaaagaactcaccataaggagggagttcagcctgagagaagactactcaccagaagagcttgattaacaattttacggcattttaccccttaaaaaactcttccatatacgcaatcacctttgaactccacaacacatgagacttgctatgatgtccaggttggcctcaaactcctggctacaagtgaccctcccacctctgcctcccaaaacactgggattatggatgatatccagctattttgcccccttccaccagcaccaatatcttttgcttactaaaggaggtactcacaacgaagatcacacatgactctttattttctattatgaagcaacagcctgaaaaaacagccacttattaaatactgaggtgagaaagttttttttttttttcttttaatatgagatggggtcttgctcttttgcccagggtagagtgcagcggtgccatctcggctcactgtacctctatcccttgagttcaagtgattcttctgcctcagactcccaagtagctgggaccacatgcatgccctgccatgcccagctaatttttgtgtttttagtagagacagggtttcaccatgttggcaaggctggtctcgaactcctgacctcaggtgatccacctgccttggcctcccaacgtgctgggattacgcggttctgggattactcagcttgagccactgcacccagctgagaaaggttttaaacatagtaaactatgtttaactacgtttagtaaactaaatcatgtcatctaatatgacctctgagaattaactatttttatcgtgggggaatgtcccaatcatattcaagagacttaatagtgagggtggtatttaat

SEQ ID NO: 1246 - DNA, 3329 bp, Homo sapiens
caggctggagtgcagtggcgcgatctctgctcactacaagctcctcctcccgggttcacgccattctcccgcctcagcctctccgagtagctgggactacaggcgcccgccaccaagcccggctaattttttgtatttttagtagagacggggtttcactgtggtctcgatcccctgacctcgtgatccgcccgcctcggcctcccaaagtgctgggattacaagcgtgagccacagcgcccggccgtcatgttactattttaactcaaaatttataacatcaaattaagaagaaagtaagatgagagcacatttgagcattatttgcatgagtatgacattactaatagccagttgaaagatttttatgctacaattttttacaaaatagagccttttttttcagtattcttttcatggatagctaatattttgcctattaaatttccatccctacaagcccaatttacgtatttgatgagcaattaaatccttatgtcggcgaaaagagtcaaacactgtaaaatattttaagagatttattccgagccaaatatgagtgaccatggcccatcacacagccctcagggggtcctgagaacatgtgcccaaggtggtcggggtacagtttggttttatatattttagggaggcatgagacatcaatcagatacatttaagaagtacattggtttggttcagaaaggcgggacaattcaaagcgggggcttccaggttaccggtaaatttaaacattttctggttgacggttgagtttatctgaagacctgggatcaatggaaaggaatgttcaggttaagataaaagattatggagactgaattttattgtgcagatgattctctcagatagcagacttcagagagagagcaggtttgtaaaatgtttctcatcagacctaaaagggtgcctggctgttagctgattatcccttggatctggaaagaaaggaaggaaaacgaagcggaaaagggattctccataggatgtggatttttcccacaagagatttttacagggcaatttcaaggtatggcaaggaaatatattttggggttaaatatttttttcccttgtcttgtagtgttatgccagagtcagactgaaaagtaagtcatgatatatagggtcaaataaaacccatctgatgagaatttatgatttgtagggcatgactccgtagaccccttaggtaggaatttgggcaagataaaaaattcagagcttagtcctcacatagactggaaacagggttattctgttttataaattcaggatttttagttcataatatatgaaactggtacaacatactaccagaagataaatttcaacctatatttatgttgtcttttaaacgatgaatgagaaatattttcactacagcctttaaaataaagtgagttcttcagaatacaagtgtcagtagtaaatgtatcatatagcccaaaatgtttcgaggagccaacatagcattatgttagggagctacatcttaattataccaaattcaaaatacgaaaaggaacaggaaaacaagtgggatgatagcaattttaccttgattgatagaacaaccatatatgatgcaaaaatcccactactaggtatatacccagaaaaaaaaaatcagtttattgaagagatatctgctgtcccatctgcagtatttataatacatatatttattgatcatttactatataccggacacttatgcggagattttaaagctatacagaacagactatgcttctgtttacctgaatttacattctatagaggattacagaagaacataaaacaataagtaacagataacataaacttgaatactgaagagctatgaatgaaaaaaatgatctcctcctttcttttagggtcatcagagaatttctctctgagcagataagactcgaattatgtgaaaaatgataagaaaggaacacgcattttaatatttggagcaacagagattttggaaaataaatcaccaagtacaatatattgtaatttaaaaatgtttgaaaactaaaaaggaaaagtggctgaagtctggcccccatagcagacaaacatagagaggcaaagaaaagttttgctctaggaatttttgatttgtggcagcacatactgaagcacatagaggtcaagagaaataagaaagagaatcaatgagatgtggcagtcttctgcagtccatgactcaaacttgaaggtggaaagatcaaattaccttgctggtttttgtcttcctgaagtcttaatcttctggcataacatttcaaattcagaagctactttattactgggaaaggtgagaataaagatcccgaataaagtcaaaagaactcaccataaggagggagttcagcctgagagaagactactcaccagaagagcttgattaacaattttacggcattttaccccttaaaaaactcttccatatacgcaatcacctttgaactccacaacacatgaaacaggatcttgctctgtctaccaggctggagtgcagtggcacaatcgtaactcactggagcctctgaccccagggctcaagccattctcctgcgttagacttccaaagacttgctatgatgtccaggttggcctcaaactcctggctacaagtgaccctcccacctctgcctcccaaaacactgggattatggatgatatccagctattttgcccccttccaccagcaccaatatcttttgcttactaaaggaggtactcacaacgaagatcacacatgactctttattttctattatgaagcaacagcctgaaaaaacagccacttattaaatactgaggtgagaaagttttttttttttttcttttaatatgagatggggtcttgctcttttgcccagggtagagtgcagcggtgccatctcggctcactgtacctctatcccttgagttcaagtgattcttctgcctcagactcccaagtagctgggaccacatgcatgccctgccatgcccagctaatttttgtgtttttagtagagacagggtttcaccatgttggcaaggctggtctcgaactcctgacctcaggtgatccacctgccttggcctcccaacgtgctgggattacgcggttctgggattactcagcttgagccactgcacccagctgagaaaggttttaaacatagtaaactatgtttaactacgtttagtaaactaaatcatgtcatctaatatgacctctgagaattaactatttttatcgtgggggaatgtcccaatcatattcaagagacttaatagtgagggtggtatttaat

SEQ ID NO: 1247 - DNA, 2490 bp, Homo sapiens
ccaggctggagtgcagtggcgcgatctctgctcactacaagctcctcctcccgggttcacgccattctcccgcctcagcctctccgagtagctgggactacaggcgcccgccaccaagcccggctaattttttgtatttttagtagagacggggtttcactgtggtctcgatcccctgacctcgtgatccgcccgcctcggcctcccaaagtgctgggattacaagcgtgagccacagcgcccggccgtcatgttactattttaactcaaaatttataacatcaaattaagaagaaagtaagatgagagcacatttgagcattatttgcatgagtatgacattactaatagccagttgaaagatttttatgctacaattttttacaaaatagagccttttttttcagtattcttttcatggatagctaatattttgcctattaaatttccatccctacaagcccaatttacgtatttgatgagcaattaaatccttatgtcggcgaaaagagtcaaacactgtaaaatattttaagagatttattccgagccaaatatgagtgaccatggcccatcacacagccctcagggggtcctgagaacatgtgcccaaggtggtcggggtacagtttggttttatatattttagggaggcatgagacatcaatcagatacatttaagaagtacattggtttggttcagaaaggcgggacaattcaaagcgggggcttccaggttaccggtaaatttaaacattttctggttgacggttgagtttatctgaagacctgggatcaatggaaaggaatgttcaggttaagataaaagattatggagactgaattttattgtgcagatgattctctcagatagcagacttcagagagagagcaggtttgtaaaatgtttctcatcagacctaaaagggtgcctggctgttagctgattatcccttggatctggaaagaaaggaaggaaaacgaagcggaaaagggattctccataggatgtggatttttcccacaagagatttttacagggcaatttcaaggtatggcaaggaaatatattttggggttaaatatttttttcccttgtcttgtagtgttatgccagagtcagactgaaaagtaagtcatgatatatagggtcaaataaaacccatctgatgagaatttatgatttgtagggcatgactccgtagaccccttaggtaggaatttgggcaagataaaaaattcagagcttagtcctcacatagactggaaacagggttattctgttttataaattcaggatttttagttcataatatatgaaactggtacaacatactaccagaagataaatttcaacctatatttatgttgtcttttaaacgatgaatgagaaatattttcactacagcctttaaaataaagtgagttcttcagaatacaagtgtcagtagtaaatgtatcatatagcccaaaatgtttcgaggagccaacatagcattatgttagggagctacatcttaattataccaaattcaaaatacgaaaaggaacaggaaaacaagtgggatgatagcaattttaccttgattgatagaacaaccatatatgatgcaaaaatcccactactaggtatatacccagaaaaaaaaaatcagtttattgaagagatatctgctgtcccatctgcagtatttataatacatatatttattgatcatttactatataccggacacttatgcggagattttaaagctatacagaacagactatgcttctgtttacctgaatttacattctatagaggattacagaagaacataaaacaataagtaacagataacataaacttgaatactgaagagctatgaatgaaaaaaatgatctcctcctttcttttaggcacatacaagcagctgtcagccaccgctttcttctaggattagtctagtccaacatgttatgtttttcgctacttgatgggagtaactctttccaaactccctttgtgttttctagtaaacataaattgataaataataaaaatatttatattttagtggtaattatatgcaagaaataatggtaaatttgtaaatatctcaaggtaatgcttgagtcacaaatttttacttcaaagatagccaggtattgttctctatattctttctttagaataccaaacttcaatatttgttctaaaatgatgatctgtgtcatggttgggaaggtttagctctccttttttgagggcttttttcctaataaagtatgttagcaaggtgtgcccttctttaaaaccaatatctgcctcttatatttctctttcatagagcaattgaattactttcaaacagtcaatggtgattgactttcttcttggtggtgcccttttttaaaaaaaatagtatttcatgttaatttctgatgttctaaggttaatttgcatttgcccttctcaaattattttatcaaattaattattgcccc

SEQ ID NO: 1248 - DNA, 4356 bp, Homo sapiens
tgatagtcctacaattttagagtcaatatatagatgatttagtttcaatcatttgaatatctgtaatttatgaactcatttagcacactcatcttttcttttatgtgctgtgtcttcttatatactactcttggagaacacactgaagttatctccactgaatgaagggcaaatttctgttgctgcaagaaatatcggaaatataaagggccaccaatacatatttggctgtgaatatacaaactgagtgcctaatttgttacatagtattttcataaatgctttttttttttaagattgccttaagaacttgatcaggtaaatgtacgtgattacttactcaaaatataaggtctttgagtacaaggaaaattgaatttaaattccactccactatttaccatgtatgaccagagttactgctgacttttcttaagcctcaattttctcatctgtataatggaaatagtatcttactaactgccctgtggttgtggagattaaattaaataattacgtaaatcacttagcacatgcgtggcacacaatgaatactccaaaaccattgaaactactatttaaaaataattttacccctttaaccttggtttctatactgtaatttcttttcaattaaaatgaagaaaagttctcgcctctgtgcacatcttctatgagaagttctagtttcctgacctagattagtcatgtatcagtttcaaaattactaacatacctcactagatatctgccattaaatgtcaccttccaccagagatgttgtttctacatctgtcattttttcttttctttctaaaggtcataacattgtcgaatgtatgcctcttcttccctaatttttccatcacaagtaaatctgttgattgcttaccgagaacccagttgtactttctgtaaaaagaataaagccatcctgtaagaaattaataaatagaaaacaacccataatatctgtcagaggagagtaggttgcaggtttactgtcatgaaatgcagtccacaaacaaaagaatcaagagagaaaatgatgaatggccttaggaatagtcatggtttataataaagattttattaaaaaagtgttaaaataaataatacatattccagaacatcactgttctgagaaatcacttccctttagaatatgagttctagatggcagatctacttacaactgctctgaggtctttcactagctgatttataatcctatattaaaaaaaaatctatagtctgcagtcttttgacatacttctcaagggtggatatgtggtggaatgcagactccatcaatatgtgtggttttgtttgctttttgtagcttaactgctgtttagaaatcccagaggaatatgattgaggccagagttacattggttcataaaattcgaacagttgaagctgtttttgttaattgctgggccacaaccagaaatccggatgatgggagagaaacacttctttaggataatgattaatttccataaagatgagtgctttaacaaatttcaatatgcagttgctggggcggggagggtgggtgggcactaattagttttaccgttttcagcagatgttgaattcaaaatgccagcagcatctcaaatgccagtcattaggtctgtctttcattgaggagtgctgaccaatgaaatctccactctgtttaatgagacctatctaggcagagtcaattaaatcaaatctctcctaacatccttaatatatctgcagtgtgggcagcaccaacaaaagcagcagagagggatttccagtattaataaagggattcactgctgcatttggagaggggaaaaaaagaaggggtgagtgttggggcaagacctttatggactggggaaagccggtaaagtctgagcgaaggtgggggtggggtagagggtgggggcgagggaagaggagctacttaaagggtaaaaagctaagtaaggcgattagagaaagagccttaatgtagctcaggaagggatctaaccccaaccgtttccctcccctgtctcttccaccgcaaatccaatttaccacttgcaaatatgaagctggaaaaaggtaaggacccagagttgaaaacattttcgctttaatactgaaaaaatatgccattataaaatcctcgaatagaattagtaagtttcacgtgcttcctcggttctcttttcctactttataagtaagatttataccagcacagaattgctaccataggatcgcagcctaagcactagagtgacattaattggtcatgcttaactgcctcaaaatcattttttaaataattacactgatactataatagaaatcatgggtacttattttacattcagatggaaggcattattggatatgtattaaaaaaaagaccccctgaaaaaaataaaataaaataaaacatcaccatcaaaataaaagaacccaaaacaacccctaaaaacttccctcaacaaaatacattgttaactcataaaatggactgatgactagccatgcaaatgtcctaaataaaacctttacatttttttcacagttaacttatgctctgaactgcctaccgatcacaaataatggcgaaatggcactttctgattatactgtattttgtttatagaaagtttgatacgatggaacttatcaggtaagagggtgggtgctgtgaacgagatgccgtctccagtcgcgggggcgggcagagtccctggagcgcgtggattccatgcgagccatgcagcactttttgttttttgtcagaagtcaaagttacttatttacaatacattcatgccttcgtgcaactgcccatccctgcgtagccaacagggagccatcacggggctaatccacaggggaaaaatagatatctatctctctatatagatgtggatatatgtatatatgtatagaaccgcggcatccaaccccacaggccccggggccgagggcgagggcactgtcagttcttccagcagggtcgtgctgggctttctgtcaaaaggggctctcagcaaagagcgagctggctgcgctctcccagctctccacagtctgctctttgtttcaaggagggagctaagtaaggggtcaggccctttcggttgtgcgagctcacagttatttatctacttatgcccatccaggctgatggcgcggggatttgggtacacgcccctccagcccccggggtgcctgcggtggggaaggatgtatcgccttccctctgccctcccctattggggttggggtcttagtctgagagcgagtgagagccacagtcatacactctgtgggccccatctgcgttgtaaggcccattgtgccagtaggaagagtcacagactgtctgtagggaattaatctcggacgcggaggagttggcatctcgtctcttggaccgctttcggttcctcaggataaacacgagcatgcccaccacggtgaaggcggaggtgacaaacaccagcagcagtcccgggaccaacaccgagatggacaccctgctggtgtctaggtaggagttggagtgcgtcccggtctccgccaacccagtgctgtttttactgtgcgaagttaacgtgggcgagatcctagcgtacagctgagggcagatctcgtcattggagaggagcatgaaatcctttctaaagaagttcaccggcgtctcacacttgaggtcgctcatcagcacttcggaacccaagcgttctgcccactgcttgaaaggcacaattgtgcaggagcactcccaggggtttccgtggaggtctatctggatgatggaggttaactggtccagcacccctgccaccgggaggagagctgctggaagccaagaaatgaaaagagaatggggaaatccagacagatttatgtatatattaagggtttatcttggaggttgaaatcacaattcaagaggaaattcttcatgggacattctaaaggaaagtaatgataactaatgtacccaccagaacctcttctcacgtaaaaattgccgctgtccccagcaaattccgtcaatcattttacaaatgctagcttattaaagatataccaaaaagtaggtaactagggctaaatctgagaccatgatgtttcagagttttagaatattattgtgaatacacaggagaaaacaaatttaaattttgtaatcacatttgaaaagtcagagcatcactttgagggtggcattgagatttatggccagaagtcaagttcagctttaagtttaatgccattcagcctgtatctgtgtccctgcagctagggtagctagctaggttcctgtttcttcttggacaaccatctctatcatag

SEQ ID NO: 1249 - DNA, 781 bp, Homo sapiens
ccccctgaaaaaaataaaataaaataaaacatcaccatcaaaataaaagaacccaaaacaacccctaaaaacttccctcaacaaaatacattgttaactcataaaatggactgatgactagccatgcaaatgtcctaaataaaacctttacatttttttcacagttaacttatgctctgaactgcctaccgatcacaaataatggcgaaatggcactttctgattatactgtattttgtttatagaaagtttgatacgatggaacttatcaggagagctgctggaagccaagaaatgaaaagagaatggggaaatccagacagatttatgtatatattaagggtttatcttggaggttgaaatcacaattcaagaggaaattcttcatgggacattctaaaggaaagtaatgataactaatgtacccaccagaacctcttctcacgtaaaaattgccgctgtccccagcaaattccgtcaatcattttacaaatgctagcttattaaagatataccaaaaagtaggtaactagggctaaatctgagaccatgatgtttcagagttttagaatattattgtgaatacacaggagaaaacaaatttaaattttgtaatcacatttgaaaagtcagagcatcactttgagggtggcattgagatttatggccagaagtcaagttcagctttaagtttaatgccattcagcctgtatctgtgtccctgcagctagggtagctagctaggttcctgtttcttcttggacaaccatctctatcatag

SEQ ID NO: 1250 - DNA, 576 bp, Homo sapiens
gcggagtacatctagaaactacttttattggaaaagatggacttatcaaggaagatatgagtagagcaaaagtgaattaatattctggagaatcagggtatcagacctgcaaacaacatggattcacacagaaaagaggtcatgtgatgatgtaccttcttcctcttcaactttgaccatgattgtaagtttcctgaggccaccccaaaagcagaagtctgaacagcccacagaacaggagctgattcaacctcttatctttataaattacccagtcacaggtatgtctttacagcagtataagaacagaccaatacagaagattggtaccagagcagaagggtattgctgtaaagatacctgaaaatgtggaagcagctttggaactgaataatggccagaggtgaaatagttttgagggctcagaagaagacaggaagatgagggaaagtctggaacttcctagagactggttgaatgattgtgaccaaaatgttgatagctatatggacagtgaagtggaggccaaggatgtcttaaatggaaatgaggaacttactggggaatggagaaggg

SEQ ID NO: 1251 - DNA, 859 bp, Homo sapiens
catcatgtttgccattttctcttctccccacttttgtgccatactcactctctttcaactctgattatgtagaatggctgttggtatcctcccggtcttcctccatggccgaaaaggaaaatatgctcccatggaaaccaggataacagatgaccagatggcttacattctcaagctaggcttttgttcgtttttcagtcatcaagcctaactgagcatccactctgttgctgaaatgctgctggggatacaaagacaaatgaagtgccgtctccgttctgatgtgacaaagagactagaggaagatgaacatgtgaacacacacagtccaatgagaagaggggaaattcaggcccagagccttgaacacaagaagaacatcatattaagattggagttctatattacaagccaagaaactaccagaagctgaaagacaggcctggaaaagatccgcccctatcacttcaaagggagcatggctctgctgacaccttgatcttagacttttagccccaggaccgtgagatgataaatttttattgtttgaggcactcagtttgtggaagctttactctgaactctttactctctatggttcccagtccctaaaagcgccctgacttttcttgttcactgacatctttgtattctttccggtcttcggtgaggactaaatgtttccacaagaaggttgctcacccctccattattacatactcttctgctgagctccaacctggcctttgaatcattggtgctcaaggtgaaatccatttcatggcataaataaatagatgaggaatctgaggctgagagagaataaccacttgtccagggtcatagaactggtaagttt

SEQ ID NO: 1252 - DNA, 541 bp, Homo sapiens
tgaagactgctctcaatttcttgccacgtgggtctcttcaacaaggcagcttgctttatcaaattgttcaagctgagaagacaatagtgttggctagcaagatggaaaccaaagttttttatacaaactcacaaagtgatgtcccatcatgtttgccattttctcttctccccacttttgtgccatactcactctctttcaactctgattatgtagaatggctgttggtatcctcccggtcttcctccatggccgaaaaggaaaatatgctcccatggaaaccaggataacagatgaccagatggcttacattctcaagctagtcatcaagcctaactgagcatccactctgttgctgaaatgctgctggggatacaaagacaaatgaagtgccgtctccgttctgatgtgacaaagagactagaggaagatgaacatgtgaacacacacagtccaatgagaagaggtaggagggagttatgcagaaggtgccttggatacaaagaaaataagccaatacaagtcatttcttatttttcac

SEQ ID NO: 1253 - DNA, 4040 bp, Homo sapiens
gtggtgtaagcgtctgaaagtggcccacaaatgcagcgctgtgattgggcagagagctgctgctggctcgcgatctctatctccatctctttatctatctccgtctctctccctgtttctccatttttctttctttccttctctctccttccttccttccatctttcttctttcccttccttttattcttctattttcgtttcttttcaaggttttttttaaagccatgatgcaatttctttggtattcaccgttgtcccaaaacttgaagcaagcctcgtatccaaggggccaggcatgttgcttcgggctttgtgcaaacaggtggaattgcgctgtgtaagcagtaagaactggtgctggggacgctgtcgcgcgagggggtggctttgggagagcagggttgctggccgcgattgttacttcccttgacaatttcctcctccccctcccccaagaagataggagaaagcaccgcggatctccctctcaccccaggctcggggcgcagaagatggagagaagattccactctccccggagcagatagggacggtcgcgccagccaatcagagcgcggctcggcgccggcgctcccggccgcctgggccgccgtgtcctccaggcaagcgaagttcccgcaactcgtccgcctcgagggtccgcgtctttcttgcgcccgcggcccagcggaggccgagggagccgtccaaactttattaatctctcctcctttctttctccctcagcccagtgcatctcaaagcgctggaatctgtggagcaggaagcctggcaattccaagatacgcgatgatcttcaaacattcccgggagccagtcctgaggctctggcttcagggcctagtttccatttatgccgcgtttttgagagtctaatactgtgtctggcacatggtaggtgctcactgaatagtcgtggtatgaatgaatgaacgaatgaatgaatgaatgaatgaatgaatataagtttaatgggggaaacccgggcctcctaataaaggtaggggctgggggatacctaggggcttccccaggaggatttcttttttcatcatcccacccctgggagaaaggtccacgcaggatggtcgcttcccccttgctgagagttttgccttcagcctatctgggccgctggaaaagaggagaagaataaacaagagacaagcaactactcccctaccggcgttccgtccttgtcctcactgccaaatccactccaaagccgaggatggtgagactgtgaagttgcaaagaaacacagagcccacccccttaaagaattacgatatatttaaagtttgcctctttcaggtttctctccttggctcctgcccctttcccctcccggctccttgtccttgactgaacctcatgggacagagaacctcctgtcccccacgaggcaaggcgcgaacccgcagagatctggggtgccctttggttccctgcgctgccctggaggcgtccatagaggcctttgccgccaaggacagcaattgttttattttcgatggttgctcgccaggcctgcgggtcgcgggcccacccagccgtcgaactttccagtcgttatcagcgctgctcctaacttaatggaataatgcaaattatagcctgcccagctgacacgtccctgcgaatgcgccggggctgagctctggccagccgctctctcgacgtcctggacggccggagggaatgaagctctgaattgtgacaaaagtggggggggggcaccccaaattctcaaagcaatgttcttttttttttcttttttcttaagcaattgagccttaccaaatgtcggggccgcacggaagccttgcatattttaaagtgtaacctgagccttcgcggtttcagcttcacttaaaacatgcaaattcttgaaattgaaaaatctgaaaaacttccgaagagttctatctgaataaatccaaatccattgggagtcgctttgaggagacaaaacgcacagcgatttggggtgagggatatttgtggggaggcaggacgtgctggattgggtttccagggtcaaggtgtctctgggccttcgacgatagccttagcgcagagcagggaagtggcaccgctaggcagcaagctcagttgctctacttttgtgacccatccccccaccccccccaccgccacccttgcctccgggccactgcccctctctgcaagctttgtccgctggactccgttgcccttgcgcggccgccccatcactcacgcttgactggaggaaataaaattggcgttggctttttaattccaagcttcgtgcttgattgggggaggggttatttaggtattttttttttcaaacagaagaaatttaggtactaattgtaaacaccccgttgctcttcttgaaagtatgtatcatattagccgaggccttggagacacacggcctattactcatttccagcctctaggcaaagaattctatggagatccaccagtaaaaccagatttcttaagggaaattaccaggacgtcttcagactctcttcaagggatattactggttgtcgattacacttgagcacactcttctctagcccacccctaccattttattttgggatcaccctaaggaaattagccatttgcagaaagcttgaaatcccgaaaggagaggcacaacctagggtaaaagagaccgagtgaagcttttcagattgattgtctccactggggccacttttcataaggtcgggagtggagaggagtgtctgcagaagagagactacctttaaaggggctctcccgaactcaggaggtgagggggacttcctagagttgtcaccacctgtaggtggatttgtcatcactatgtagtgtctcctggggagccagcctgttctccccagagtccccctcaggtactgtcccagagttcaggggagcctttagcgctttctccgtttgccctgagggtattgcatgtacaaaagctccttcacgcgcgcgcgcacacatagacatccagcgggtttggagtgtacccctgtttatttgtcaccacgtggtaaaccccagatttggaagtcatcactatgcgggcgcgcatcaggatccaggggagactgtgtggggttgggactgcgcacaaacacaggggaattctgcacaacaaacatttgcgcgagcgctctccctcgccccctctcgcttagctggatttttgtaagggggtttcttttaaattggattatccgaatggtcgcccatatggccttactctgcctgcatagactggccgggtgaagacgagtgaaaggacgcacggagagcctgagacagaagatagagaacttcttcagagcagcgtaggaaaagtgggtgctgggtgaaacggaaggcaaagagagagaatagaagaagaatctacaagaacgagaatgcaacagcagcattgcagacgcaccttcaggttcacctgcggaaggcacgcccagggcggaggagtggcgggactggcggaagatcaggaggcggcggaggaccccagggttcccaacactgacccctccgcaaagttcctccctgggagaagagactggccaggtcagggagggaggggtgtgggaggcgatgatcacgcgggctctggcaggatccgcacggaacagagagatctggaagggagagagggtcttagaggacaccccagcctccagtcccggtgacccctccctctggggctggagccacattagaaagaaaagtgtctgaaattaggtgcggcctctccccccgctaatttaacccctgcagacccacagtggaaagcagattttgtgcagcctgaaatttatctaagtcttgggggcttatttagtaaaaaataaatcataatcctgataggactttagaaggggggtcggcacaagtgtgggactctttcttgccgggaaacggaatctgcccctggtagacccattggactaccttgggatcttgttcccagctccagtggtgaggcgagcgcctgggggc

SEQ ID NO: 1254 - DNA, 390 bp, Homo sapiens
ttttaaaaaattgtgtcataatatacatttttaaaattaattatccattagcagcaagataaatgtctcttcttttgctaaggaaatagtggcctcagtggtgaaagattatttcacatgagtagcactcataaagagagctgttcccagataaggtggcaactgttctttgaagaagcacaatgaaggtgacaggcaagcccatgttgatgaaatggaatagaagaacctgcagatttcagtccactgatcagttacataagcggagagattcatatcaggaatgacatttcaccgaaccacatagacagcaaagtaggggaaatcagtggaggataagaacaaatctttggcaatttatacaaattatggtcacacaagttataaggt

SEQ ID NO: 1255 - DNA, 1305 bp, Homo sapiens
ggaagaggtggcattagagggaaagtaggaagggcggtgagcgtggtgaaagaactaggaaaacaacacaggcaaaaagtagcaggagagaatcctcctcgaatgaccaaatctgcaaaatgaaacggagatgttaaaggaaatggtgaacgacataaaaggaaggttttggtctggagatcactgatggagcagcactaggttcaactggaaaagttgtaagggtttctttgttcatgtctgcattctctggggatgactgcacttctgctctgtgccagatgccacgctaggtgctggggcacaataagtaagacacaatcccatctttcagatgggatttctgggctctcactgggcatggatttccaggagtaaactatgacatgaagtctgaatagtgtccagagagggtgcacaggggaagtggttgatatacccagaacagctgaagccaaatgaaagagagatgggcttgctttcaggaagtacaactggtgggtccaagaatctttaagcatgaacctgcctgtactccgttgcattataaaactgacttaagcatttcaaaatcacatgggcacacacacacaccaacaatgccttggacaaaaaccatttttgttacagagatttagtaggtgatggtataatatttatatacagacaaaaacagaaacaaatacaacatatgccttactttctcttgtagtgtctctgtcttttaaagattgaaatttctgctatctaaacaggtttactcctgggagcttctattttacaatggttttttatttatttatttttttcttgagatgaagtcttgctgtgtcccccaggctggagtacagtggtgcaatcatggctcactacaacctcaacctcctgggccaaatcaatcctcctgcctcagcctcccaagtagctggaatcaaaagtgcatgccaccagaactggctaatttttaaaatttatctgtagagatggggtctcactatgttgcccaggctggtcttgatctcccaaggctggaggaatcctcttgcctttgcctcccaaagtgctgggactacaggcgtgagccactgtgcccagccggcccaattcttcacctaaatgtaccagagatgactcatttttaccttgtcccaaactaaaatcattttttatttgatcatttcccatttcaataagtgaaagcatcatttctcttacgtttcccactttggtaaatggagccaccatctttgatgcctaactctttatcatcaccaacaaccaaatggtcccacaccctgtgaattc

SEQ ID NO: 1256 - DNA, 2159 bp, Homo sapiens
gtttgtgtctgtcgtgtggaagctttgttcattcgtcttttgcaataaatcttgctactgctcagtctttgggtccacactgcttttatgagctgtagcagtcaccacgaaggtctgcagctgcactcctgaggctagcgagaccacgaacccaccgggaggagcgaacgactccagacgcgctgacttaagagctgtaacagcttaccgctaaggtctgcagcttcactcctgagccagagagaccaggaacccacctagaaggaacaaactccggacatgccgcctttaagagctgtaacactcaccgccagggtccgcagctgcattcttgaagtcagtgagaccaagaacccaccaattccagacacactgtcatcaaaaagtgggatatctttttaaacagagataacattgcagaatcttggagttggaaatagacctcagctggggtttagtcctgttttctcctcagagcagaagtcctgggatgccgttctggactgattgtcagttttttctcctgtccttgagctattctaatgccagacatctgtggctttacacagccaggctttcagttagagaacttggttagctcaggtcaacaaatgctgctctgagaacactgactcccatgtggggagactctgcacctggagctccgggagagccggctcaggcctcttcctgctatccagggaactgcagtggcgttggagggccttgctggggctggggctggggagaagggattccaaccctactgataattcgtttggaaacaccgggctgtggatttcagaagttcttgggcagcctgattaccactggcagtgagccggggacgaagccgaagctatgagtgacagacggaaagaactgggggctttggtgaaccagagaacacttagctcctccagccctgaagcaggcgtcaccgcagggcttatggtcctaagagccacttagtttccttattcattaaactagtttaatttgggttttctgcatcctggaggacaccaagtcggtgtgcggagggaccctgtagacacgtgtgcaaagaataagccgacgatcatggaatttctgatgacgccactgacacgtgggatggaggcctccttcccagggcacccctacactcatgacaatgaatcctggctcttattcacccctttggatttcacaagcaagtaaccaaatgacagaaggtgagagaaccagatgcattaccacagacacctgttgggagaggacgcttgagactgttttgacaagaagcaaaaactcagagaactctgtgaagtctctaagaaaaggccaggagagcaccagcaaggggttggtggcagctttaaagatgcccctatgtgactgccaggaccctctttccgggatgccacacgaggctttgaagacaggtctaattctatcctgacagtatcaccctagtcattccaacatcccttttagttctaacgccttaagaaatccagcaaccccctttgcagtccccaagctgaggccttctaaaatgcccctgaggctggtggctgaggactcagggctcagcggaggatggggtctgggtgtccccctggacaagtttcccactagctgagatgcaggctgaagcacaagaaaaggggaagaacagaggagttctgagctggcctggggcataaagcacttggaggtataaaacaatgacttcttcttggtgctgcttgctgcgtccttcttgagtgtaatgagccctgagtattcctggtcacctttcctggtgctgtggtgagtgctcattcctccggcatggagggtgccagggacttgggctgcctgtgccatgctatcgattttcttccctaacccccacacttatgctgatcattctgttagtactccacacaaggctgtgaggtgttggttgttgctgttgtgttatttctttagaactctgaaaggacatgctcactccaatgtccccacgggtctgagctgaaggaccctgcagtgtcctgctccatcaaacatcactgagttcatctccttggaagaggaagctgccacttccaagtcagacctgaccgtcacagcctctgtaatcacctgtggtaggcagaaatctgacccccgccccccgcaaccccccg

SEQ ID NO: 1257 - DNA, 744 bp, Homo sapiens
ggcatccatgatcaatacagactaaatacaatgcactattctagtccagtttattctcgtctccagcagcatcacattgacccctatatacagcgtgtacagtggaagacagagcaagatctgagcttgtaaatagaataaaaggcgtttgcaatgtgaagtacctacataaacatctacatcgagaagattaaacaagtctgttaaaggtaaaaagagatattcatccccttcccaaagcccttccctcccacctcccactacccaatacagttgattttcaaaagtaggttgcttcagttacatataataattattatttagtaatccgtcttcaaagtccaatcccaaatttcacttccattgagaaatgtcagtcccacactgggctcggtgtggacgtaaacatcgcaggtacctgcactggaatccaacaagcagctgtctacttggaccatttcaataaggccgaggaccgcgctccagacacacagcgcaggggctactacaggaggtcctgtgggacccccgccacggaaatccggctttaccttgaactgaggtaggactgtggtcgttttgagtgtaagccagtaaataccagattttaccacttccataggtacgggtgcactctcctagcatgctgagggttatatctgctttgccaaaaggaaaagaagaagaaattaaaagacactggccacaatttaagaaggccaatgaaaacatccaattttcttg

SEQ ID NO: 1258 - DNA, 1067 bp, Homo sapiens
ggcggagggtggcgtgacgtcagcgtgttgctgagaagagcatcggttctgcgttcgggatgcgtgcaggcagccagtggctgcagacggacagacagctccaccatagagcaatgtcctgcacgctgctatggggctgaggtccgggagaggcttcctgagccgtccgtggaaaggacagatgggtgaaaggcccttcctatgggaaagcccacggcaggaagcggggaacaaggccactgtgggggctgtgggcagtgccctctggggacacttgaggacaacctggtgatgaagtggaagagtattggacaaataaaacacaggagtcagaacaaatgggagaaacaatcactgcatcatcaccaagtgcacaaatcagggggacacggtcactgctccgtcaccaagcacacaaatgatcaccgttccgtcaccaagcgcaccaacggtcaccgccccgtcaccaagcgcaccaacggtcatcgcctgtcaccaagcgcaccaacggtcatcgccccgtcaccaagcgcaccaacggtcaccgccccgtcaccaagcgcaccaacagtcactgcccgtcaccaagcgcaccgacggtcaccgccctgtcaccaagcgcacacacggtcaccgccgtgtcaccaagcgcacaaacggtcactgttccgtcaccaagcacaccaacagtcactgccccgtcaccaagcacacaaatcagggggcgcttattttctaaattcagtaggaattttctaatcttatcctcacaagagcccctgagagatagggttgtccccatttcacaaatgtgaagagtccagagaagtgaacaggcctgtgcagtcacgtgagccccacgggatccaaacagaggtcgggtggacccttcccacgcccctactctgcttttaaggaaagggctcaaataattccagtccctcaagctaaacaaaatgcacaaaaaggacattagagaacacaaaactataatgcaaactgcaaagccacaaaaggtcaaagtgcaatagctgttttaacatcttccacaactgctacaacatttc

SEQ ID NO: 1259 - DNA, 437 bp, Homo sapiens
agttctgcaggtcaaaggtccaaccaagatcgtctcactggactcaagtcaaggtgtgggaagggccaatctcttctgcagcatcttaggggagaatctattgtattgttcaacatctgcttgccacctcttttccttctctgtggcctcttcctcatcttcaaactgagttacttcaatctctgcatcacatcaccttctttcctctgtgggagatgctgggaaaatcctcaccacctgattgctgaaagcaaacatcagggcctatgtgtggagctacttctacggaagccgctgagatgccttgagcctcttatgggatcatgaggattgtgtgctgggatcccggcagacaaagctgagattcagctggataaagcaggctgtagcacagctgatgtttgttctctgtggaaatcaggctcttttctcctaag

SEQ ID NO: 1260 - DNA, 354 bp, Homo sapiens
cttctgttactggctggagtttagaagatcgttctgagtcaggagagtgcagaggctcaggctctttcagactttccaaatgcataaaaggatcataatctacagatgccaaatcagagaggctcatgggaaaataccttggattactccttttagaagaaaaaactctgcgaactatttcaatgtctgtgagatgttcttcatcaatactacagagactagatgagctaggttctcgctccgtgagagtgcttgtattggaatgagactgttcgggttctgtagttctgtctgttttatcagcattatcatttttgctttcttctctggatactaaactagcagctgctctct

SEQ ID NO: 1261 - DNA, 2554 bp, Homo sapiens
ggcgggcgggcggcgagagggggacaggggagggcagggaaagatgcaccttcacccaagagtaggagaaaagaccagctgcttagatctttctcaagtccaactttccttaaggtagggctgcgcaaagggagagcggtcattcccgggactccagtaggggcaccagacagaacctggacagcggccccgcgcggctagggactaacgccgagggaaacccgtggcggtatccgtggctcagcttaaacaaacagaaataacgactggaggggctgaggatcagaatgagttgttaatgagttcgtgatctgcactggcgggacggtgcggaagaaaggatagaagttgcagggtagggaaaatagaaggagggtcagaggagtaagcgcagtggaggaaggaacagaaagtgggagacccagaaaaaggtagcctgaaagccttcccagtttataagcaaagctctcacttctaccattgtcgcgcgcctttcttgggttcctccatcaaaggctgtcagtgtcctagccccacgttatcccgacagcaccctggcgccctggataccgtccctttcgcacccggccttcccttctcattctccccctcttttggctcagggcccctgcgtggcccgggctcagagcccctgcgtggcccgggctcagagcgtcgtgatccgggacgtgcaggtgccattacggaagacgccgccggactccaggttctcaggttggaagtcttccacactgtaggcacggctcttgagcgcggtggcgtaatagtcaaccggctcctccgcggcgttgtccatccagctgaggcataggatgcgttggaaagagcgcttgaagttgtctgagagaaagccatagaggatggggttggcgcagctgttggcatagccgaggatgaccgacagctgactcaccgtggcgtcgtcctgctcagcaaacacgttgaccagctgcaccacgtagaaaggcatccagcagatgacaaacaccatcaccaccatcatcaccattaaggtgatcttgcgctccgagcgcttgcgctgctgccagccggccttgagggccaccatgcgcatcttagcaatgatgagcacgtagcacaggcagatagcccccacgggcagcaggaagcccatgagaaatgtgtacaacacgaagcccaccagccagcgttgagcgggctctggcatgagcatgttgcaagccaccgtgccgtcgctgttggccgcggtgcgagagaagaccacgatgggcaggatgacgagcagcgatagcacccacacgcccaggtttactaccttggccacggtgggccggcggtagcgggccgccttgatgggatgcaccacggccacgtagcggtccacgctgagcacagtcagacagtagatgctggtgaacatgttgaccgcgtccacgctgagcacgaggcggcagagcagcgcaccgaagggccagtggcgcaacaacgtggaggtgactaggaagggcacgctgagcatgagcagctcatcagcaatggccagatttaggatgtagatgttggtggccgtcttcatcttggcatagcgcaggatcacgtagatgaccatagagttcccacacagccccaccaggcacaccacggagtagatgaaagagatcaggatggcgctgccctggccctcgctcaaggtcccgttctgggacgcatttcgccctggctcctccatgccgtccgcagcgccggccccggggcccctgctgccgccgccttcgccgcagctgcccgggctggggctaggagaggaggaaggagaggaggcggtgccattggggaacatcccagctgaggggggccagtggggctgccagggctggggctttctcctcgcgcacccgccgcctgcgccctccctccccacccgaccgcttgcctgcagcccacagccgcccagcgcctccgggtagagcgcaaccgctgcggggagcgcggctcctaccggcgccggcggggcgcacagcccagcggttgcctgggctctgcagtttgcagctccggggtgcccgggcacaggcgaccgtggagaggagaggccaggatgtgggagcaccgcacggcacagccattaactggcgcggctctggactggaatatcgactgcagaaacgaggacgcgcagctgggagctctggaggagcttgagactccctccagaaacgtgccaggcgcggtgttgggaatccacctaggtgttcactcgggaaagataaggctgcgccgcttggaagggctccacccgcgtccctgctgtactttgtaccctggagagttggcgggttctggcagacgagagtttaaaggcttgggcgggcggggacgccagctcttctaaatccaggtgaggagctgccgccgtgcgatgaccagacctgtcaccaaccccaggaacggcagggcgacattcgagtttttccgggaagagctaggatgtcagctctttctgaggcttgatttgtgagctggctctgggtcacgtgcccaaaccattagg

SEQ ID NO: 1262 - DNA, 1115 bp, Homo sapiens
aggaggcttctgagtggttcttctgctgcatgttgtgttggctggggttccttagattcaggggtacatgtgcaggtttgttacaagagtataatgtgtgatgctgaagtttggagtacagttgaacccatcacccagctagtgagcatgatactgaaaaatcttggaagaagaacacttctttgatgacgttgtcagagagaaatggatgttctcctaaatgggaagccttaattctgtgtgtaatttataaagccatggagaagaggagacagagtgtgcaagggaatgaagaaaaggaacaagactattttcaaatcacccatggcactactagaaatgtatttcagcaaaaggactggctgattttatgattcctgtgtccaccacagccctctaatttttacataggtaccccacatctctctagatttcaggaagactattatccttcgactttagctttctgatgggttcacaaaaagccattagtgtgctgttggtccagcttttttctgttgcaaatatgagagctacagttctgagatgaaaccacaggatgttctttctctatgtaaggagaacagtaccttttctgactactctgaaatgaatcaagaacaaatctgtgtggaattttggaccataatcaggaacaagaatctcgggaatccttggaaataaagtaattttcttacaatttaaacttactttctgtcagaggacagctattcatgtatttctggactatttcaattcattgagctttacctgctcaggataaagaggtcctttgataaaatcaatgaagccaagcagaacactgcagtttctgagttcagtaccagttaagtatttccctattataagggatccctattgttggaaaatagcttttctattcacagaaatgatgagaaaatgacatcttgctttttgcagtaatatgaatacttacttttgagatctagtaaattaacattgctgactcttcagactggccccttgaattagggtcaaatcaaggaaatgaaatgcatatatgcacattctgagagtaaacagacaagtagtcatgccattgctctcttctctgtgcacagcacaggcttagg

SEQ ID NO: 1263 - DNA, 1320 bp, Homo sapiens
aggaggcttctgagtggttcttctgctgcatgttgtgttggctggggttccttagattcaggggtacatgtgcaggtttgttacaagagtataatgtgtgatgctgaagtttggagtacagttgaacccatcacccagctagtgagcatgatactgaaaaatcttggaagaagaacacttctttgatgacgttgtcagagagaaatggatgttctcctaaatgggaagccttaattctgtgtgtaatttataaagccatggagaagaggagacagagtgtgcaagggaatgaagaaaaggaacaagactattttcaaatcacccatggcactactagaaatgtatttcagcaaaaggactggctgattttatgattcctgtgtccaccacagccctctaatttttacataggtaccccacatctctctagatttcaggaagactattatccttcgactttagctttctgatgggttcacaaaaagccattagtgtgctgttggtccagcttttttctgttgcaaatatgagagctacagttctgagatgaaaccacaggatgttctttctctatgtaaggagaacagtaccttttctgactactctgaaatgaatcaagaacaaatctgtgtggaattttggaccataatcaggaacaagaatctcgggaatccttggaaataaattttttctttaggctgattttcctcctggttgcaagacaggtatcagcagcaatggtgaatccattcttcctagtttgcctctcgtggaagaaaaagtgtccatttcctgcaaccactgaacaaaagttttgagcttcactctgataagattatgcctaaggccatcaatgtggccaggtaaatgcatacactaattctagaggtagaactaaagtcagtttatcaaaaagttgactttagggcataagtagggggatgggtcactgttgaaaaaaattgaagtatagttaacaagggcacatgatagaatgaatgctgtgttggtaactcacagatgtccacaataagttgtacagaaaaatgggaccagattcagagaggtatagatttttacaaacacattggggtgggaatgattgagaaggtactatggggaatgaagaagacactgatatgaactccttacccttaaatatatgaggatgaaaagaatgagcaaccttgatacaaggggcacagggaaagcagttcaggggagaacacatttttagctaagggaaaataagtggagatacagtcatggacagtgggttttgagaggccctgggcaagccttgtggtttagaaatggcag

SEQ ID NO: 1264 - DNA, 607 bp, Homo sapiens
aggaggcttctgagtggttcttctgctgcatgttgtgttggctggggttccttagattcaggggtacatgtgcaggtttgttacaagagtataatgtgtgatgctgaagtttggagtacagttgaacccatcacccagctagtgagcatgatactgaaaaatcttggaagaagaacacttctttgatgacgttgtcagagagaaatggatgttctcctaaatgggaagccttaattctgtgtgtaatttataaagccatggagaagaggagacagagtgtgcaagggaatgaagaaaaggaacaagactattttcaaatcacccatggcactactagaaatgtatttcagcaaaaggactggctgattttatgattcctgtgtccaccacagccctctaatttttacataggtaccccacatctctctagatttcaggaagactattatccttcgactttagctttctgatgggttcacaaaaagccattagtgtgctgttggtccagcttttttctgttgcaaatatgagagctacagttctgagatgaaaccacagaaacccatatattttccagcactccatcctcactgtcaaaactgtcaag

SEQ ID NO: 1265 - DNA, 1053 bp, Homo sapiens
ggaaagtagaaagctaaatcttagttatatatatggtgttctacagaacaatatgttccaagtgtgtagctttctgatgaagtggcttaatacagggtaacaccaactaaggtaaccacagcgaggaagttatgatatcttttagatcagcgtttcaaactgggttctgtagatggcaggacaaaagagggtctctacaaatgtttaattttaatttgctttaaatttgttttaattcatttattcattctttttttcaacttttagattcaggggtacatgtgcaggtttgttacaagagtataatgtgtgatgctgaagtttggagtacagttgaacccatcacccagctagtgagcatgatactgaaaaatcttggaagaagaacacttctttgatgacgttgtcagagagaaatggatgttctcctaaatgggaagccttaattctgtgtgtaatttataaagccatggagaagaggagacagagtgtgcaagggaatgaagaaaaggaacaagactattttcaaatcacccatggcactactagaaatgtatttcagcaaaaggactggctgattttatgattcctgtgtccaccacagccctctaatttttacataggtaccccacatctctctagatttcaggaagactattatccttcgactttagctttctgatgggttcacaaaaagccattagtgtgctgttggtccagcttttttctgttgcaaatatgagagctacagttctgagatgaaaccacaggtaagtgttatgattttaagtaactgaatactaaagtgatgtaggcgaactaaattaagtactaaagaaaactagacagaagtctaaaagatatacgattagaaatgatacagctcccagtatgagcaacgcagaagacgggtgatttctgcatttccatctgaggtaccaggttcatctcagtaggcagtgccagacagtgggcacaggacagtgggtgcagggcaccgtgtgcgagccaaagcagggcgaggcatagcctccctctggaagcgcaaggggt

SEQ ID NO: 1266 - DNA, 1274 bp, Homo sapiens
ggaaagtagaaagctaaatcttagttatatatatggtgttctacagaacaatatgttccaagtgtgtagctttctgatgaagtggcttaatacagggtaacaccaactaaggtaaccacagcgaggaagttatgatatcttttagatcagcgtttcaaactgggttctgtagatggcaggacaaaagagggtctctacaaatgtttaattttaatttgctttaaatttgttttaattcatttattcattctttttttcaacttttagattcaggggtacatgtgcaggtttgttacaagagtataatgtgtgatgctgaagtttggagtacagttgaacccatcacccagctagtgagcatgatactgaaaaatcttggaagaagaacacttctttgatgacgttgtcagagagaaatggatgttctcctaaatgggaagccttaattctgtgtgtaatttataaagccatggagaagaggagacagagtgtgcaagggaatgaagaaaaggaacaagactattttcaaatcacccatggcactactagaaatgtatttcagcaaaaggactggctgattttatgattcctgtgtccaccacagccctctaatttttacataggtaccccacatctctctagatttcaggaagactattatccttcgactttagctttctgatgggttcacaaaaagccattagtgtgctgttggtccagcttttttctgttgcaaatatgagagctacagttctgagatgaaaccacagatgaggaaattaaggagtcaaaggggttcagcatttttttccatagtctcattactgggaagtggcagatctaaccagaatgtcaaaatatttacactgcaccctgcttggctagggtaagtatggaacaatggtaagactcctgcctgaaagtcaggaaacccatgttctagtcttaaagaaatcatcgagtctcttcctctaggaaaggcatatagattgaagtctttgttggggtcataattccctctcaagcctcctgttgtctctgattagtagactgtgcatataattgacatttactgaggattactttgagtaagattgtccatagtaaatattagctgttggactctaatttctttcagaggtggtgctattatttttcaatataatgggaatgaaaagaaagcattaatgctcaattctcaaaagatttatataatttgtgagtcacagactataagtaatcagatgttcagaaacacttaaagaagctccagg

SEQ ID NO: 1267 - DNA, 819 bp, Homo sapiens
ggaaagtagaaagctaaatcttagttatatatatggtgttctacagaacaatatgttccaagtgtgtagctttctgatgaagtggcttaatacagggtaacaccaactaaggtaaccacagcgaggaagttatgatatcttttagatcagcgtttcaaactgggttctgtagatggcaggacaaaagagggtctctacaaatgtttaattttaatttgctttaaatttgttttaattcatttattcattctttttttcaacttttagattcaggggtacatgtgcaggtttgttacaagagtataatgtgtgatgctgaagtttggagtacagttgaacccatcacccagctagtgagcatgatactgaaaaatcttggaagaagaacacttctttgatgacgttgtcagagagaaatggatgttctcctaaatgggaagccttaattctgtgtgtaatttataaagccatggagaagaggagacagagtgtgcaagggaatgaagaaaaggaacaagactattttcaaatcacccatggcactactagaaatgtatttcagcaaaaggactggctgattttatgattcctgtgtccaccacagccctctaatttttacataggtaccccacatctctctagatttcaggaagactattatccttcgactttagctttctgatgggttcacaaaaagccattagtgtgctgttggtccagcttttttctgttgcaaatatgagagctacagttctgagatgaaaccacagaaacccatatattttccagcactccatcctcactgtcaaaactgtcaag

SEQ ID NO: 1268 - DNA, 1463 bp, Homo sapiens
ggaaagtagaaagctaaatcttagttatatatatggtgttctacagaacaatatgttccaagtgtgtagctttctgatgaagtggcttaatacagggtaacaccaactaaggtaaccacagcgaggaagttatgatatcttttagatcagcgtttcaaactgggttctgtagatggcaggacaaaagagggtctctacaaatgtttaattttaatttgctttaaatttgttttaattcatttattcattctttttttcaacttttagattcaggggtacatgtgcaggtttgttacaagagtataatgtgtgatgctgaagtttggagtacagttgaacccatcacccagctagtgagcatgatactgaaaaatcttggaagaagaacacttctttgatgacgttgtcagagagaaatggatgttctcctaaatgggaagccttaattctgtgtgtaatttataaagccatggagaagaggagacagagtgtgcaagggaatgaagaaaaggaacaagactattttcaaatcacccatggcactactagaaatgtatttcagcaaaaggactggctgattttatgattcctgtgtccaccacagccctctaatttttacataggtaccccacatctctctagatttcaggaagactattatccttcgactttagctttctgatgggttcacaaaaagccattagtgtgctgttggtccagcttttttctgttgcaaatatgagagctacagttctgagatgaaaccacagaaattgttgcaatgtgtttaaaaatgagatagacgccggacacggttgctcgggcagatcacgacgtcaagagatcaagaccatcctggccaacatggtgaaaccccgtctctactaaaaacacaaaaattagctgggagtggtggcgcacgcctgtagtcccagctactcagaaggctgaggcaggagaatcacttgaacctgggaggcggaggttgcagtgagccgagattgcgccactgcactccaacctggcaacagggatcctgctaccaaatgttgctttaggagtggcctctcttcctctccctgcctctgcttctgagctgagtacctcaagtattgtactgggtaacctacctactctactcttctgggatgactggaaggaaggaagcactgcattagcgagtcctgaagatcctttccagctctttgattatatgacattctgactagcacaaagaggcacacctgcaatcctactgagagttccatggatcattaatgattattcatggtgaaggaagcagaggtaatgtagactctgaaagctgatacttctcattgtagaagtacactcttgtgttacagtgtttttgtacatgagaaattccacctgccagcccttgaaggtctctgagcacaagggattaactcagtgccctttaagttaaaatacgtcctgcaaac

SEQ ID NO: 1269 - DNA, 344 bp, Homo sapiens
cctcagaaaataatcttctccaacttgcagtaaagaacacagatcattagttaggcacacaagagagaaggagaaggcaatggaaagatggatgcagacatgacagtgatatagccacaagacaaggaagccaaggattgcagaaagccaccagaagttggaaagaggcaaagagggattctcccttagagcttccagaaggagtctacttttacctatatcttgattttggacttttggctgacagaattgtaagagaataaaattctgttgttttaagacatctaatctgtgataatttgttgtggcagctgtaggaaactagtatagattttggtaggggg

SEQ ID NO: 1270 - DNA, 370 bp, Homo sapiens
gaggcagggtctcactatgttgcccaggctggagtgcagtggctattcacaggcgcaatcccactactgatcagcacgggagttttgacctgctccgtttccgacctgggccggttcacccctccttaggcaacctggtggtcccccgctcccgggaggtcaccatattgatgccgaactcatgcggacacccgatcggcatagcgcactacagcccagaactcctgggctcaagcgatcctcccacctcagcctcccgagtagctgggactacaggcacgcgccaccgcgcccggcggtcggagacgctgcgaaaagctactagaagctgcagggcagttacgtcattggggagcgggggggccacgcc

SEQ ID NO: 1271 - DNA, 523 bp, Homo sapiens
gaggcagggtctcactatgttgcccaggctggagtgcagtggctattcacaggcgcaatcccactactgatcagcacgggagttttgacctgctccgtttccgacctgggccggttcacccctccttaggcaacctggtggtcccccgctcccgggaggtcaccatattgatgccgaactcagtgcggacacccgatcggcatagcgcgatcccactactgatcagcacgggagttttgacctgctccgtttccgacctgggccggttcacccctccttaggcaacctggtggtcccccgctcccgggaggtcaccatattgatgccgaacttagtgcggacacccgatcggcatagcgcactacagcccagaactcctgggctcaagcgatcctcccacctcagcctcccgagtagctgggactacaggcacgcgccaccgcgcccggcggtcggagacgctgcgaaaagctactagaagctgcagggcagttacgtcattggggagcgggggggccacgcc

SEQ ID NO: 1272 - DNA, 501 bp, Homo sapiens
gaggcagggtctcactatgttgcccaggctggagtgcagtggctattcacaggcgcaatcccactactgatcagcacgggagttttgacctgctccgtttccgacctgggccggttcacccctccttaggcaacctggtggtcccccgctcccgggaggtcaccatattgatgccgaactcagcgcgatcccactactgatcagcacgggagttttgacctgctccgtttccgacctgggccggttcacccctccttaggcaacctggtggtcccccgctcccgggaggtcaccatattgatgccgaacttagtgcggacacccgatcggcatagcgcactacagcccagaactcctgggctcaagcgatcctcccacctcagcctcccgagtagctgggactacaggcacgcgccaccgcgcccggcggtcggagacgctgcgaaaagctactagaagctgcagggcagttacgtcattggggagcgggggggccacgcc

SEQ ID NO: 1273 - DNA, 551 bp, Homo sapiens
aggcagggtctcactatgttgcccaggctggagtgcagtggctattcacaggcgcaatcccactactgatcagcacgggagttttgacctgctccgtttccgacctgggccggttcacccctccttaggcaacctggtggtcccccgctcccgggaggtcaccatattgatgccgaactcaagacggggtctcgctatgttgctcaggctggagtgcagtggctattcacaggcgcgatcccactactgatcagcacgggagttttgacctgctccgtttccgacctgggccggttcacccctccttaggcaacctggtggtcccccgctcccgggaggtcaccatattgatgccgaacttagtgcggacacccgatcggcatagcgcactacagcccagaactcctgggctcaagcgatcctcccacctcagcctcccgagtagctgggactacaggcacgcgccaccgcgcccggcggtcggagacgctgcgaaaagctactagaagctgcagggcagttacgtcattggggagcgggggggccacgcc

SEQ ID NO: 1274 - DNA, 667 bp, Homo sapiens
aggcagggtctcactatgttgcccaggctggagtgcagtggctattcacaggcgcaatcccactactgatcagcacgggagttttgacctgctccgtttccgacctgggccggttcacccctccttaggcaacctggtggtcccccgctcccgggaggtcaccatattgatgccgaactcagtgcggacacccgatcggcatagcgcactacagcccagaactcctgaactcaagggatcctccagcctcagcctcccgagtagctgggactacaggcacgcgccaccgcgcccggcagacggggtctcgctatgttgctcaggctggagtgcagtggctattcacaggcgcgatcccactactgatcagcacgggagttttgacctgctccgtttccgacctgggccggttcacccctccttaggcaacctggtggtcccccgctcccgggaggtcaccatattgatgccgaacttagtgcggacacccgatcggcatagcgcactacagcccagaactcctgggctcaagcgatcctcccacctcagcctcccgagtagctgggactacaggcacgcgccaccgcgcccggcggtcggagacgctgcgaaaagctactagaagctgcagggcagttacgtcattggggagcgggggggccacgcc

SEQ ID NO: 1275 - DNA, 614 bp, Homo sapiens
aggcagggtctcactatgttgcccaggctggagtgcagtggctattcacaggcgcaatcccactactgatcagcacgggagttttgacctgctccgtttccgacctgggccggttcacccctccttaggcaacctggtggtcccccgctcccgggaggtcaccatattgatgccgaactcagtgcggacacccgatcggcatagcgcactacagcccagaactcctgaactcaagggatcctccagcctcagcctcccgagtagctgggactacaggcacgcgccaccgcgcccggcgcgatcccactactgatcagcacgggagttttgacctgctccgtttccgacctgggccggttcacccctccttaggcaacctggtggtcccccgctcccgggaggtcaccatattgatgccgaacttagtgcggacacccgatcggcatagcgcactacagcccagaactcctgggctcaagcgatcctcccacctcagcctcccgagtagctgggactacaggcacgcgccaccgcgcccggcggtcggagacgctgcgaaaagctactagaagctgcagggcagttacgtcattggggagcgggggggccacgcc

SEQ ID NO: 1276 - DNA, 512 bp, Homo sapiens
ggcagggtctcactatgttgcccaggctggagtgcagtggctattcacaggcgcaatcccactactgatcagcacgggagttttgacctgctccgtttccgacctgggccggttcacccctccttaggcaacctggtggtcccccgctcccgggaggtcaccatattgatgccgaactcatggctattcacaggcgcgatcccactactgatcagcacgggagttttgacctgctccgtttccgacctgggccggttcacccctccttaggcaacctggtggtcccccgctcccgggaggtcaccatattgatgccgaacttagtgcggacacccgatcggcatagcgcactacagcccagaactcctgggctcaagcgatcctcccacctcagcctcccgagtagctgggactacaggcacgcgccaccgcgcccggcggtcggagacgctgcgaaaagctactagaagctgcagggcagttacgtcattggggagcgggggggccacgcc

SEQ ID NO: 1277 - DNA, 485 bp, Homo sapiens
actgatcagcacgggagttttgacctgctccgtttccgacctgggccggttcacccctccttaggcaacctggtggtcccccgctcccgggaggtcaccatattgatgccgaactcaacggggtctcgctatgttgctcaggctggagtgcagtggctattcacaggcgcgatcccactactgatcagcacgggagttttgacctgctccgtttccgacctgggccggttcacccctccttaggcaacctggtggtcccccgctcccgggaggtcaccatattgatgccgaacttagtgcggacacccgatcggcatagcgcactacagcccagaactcctgggctcaagcgatcctcccacctcagcctcccgagtagctgggactacaggcacgcgccaccgcgcccggcggtcggagacgctgcgaaaagctactagaagctgcagggcagttacgtcattggggagcgggggggccacgcc

SEQ ID NO: 1278 - DNA, 973 bp, Homo sapiens
ctgagtaacgtgtttgtttacaacttgcttacagtgccaacagcatgttgggtaacactgcagactcttccagttttgccatgataacactcgcggagcattcctttttgaatagtacccattcccttgatgtctacaatatcacctttcttatagattcgcatacatgtggccaaaggaacaactccatgtttactaaaaggcctagagaacatatatcgggtgcctctcttctttccctttgtgttcgtccttttggcgaattactggaagatggtggttccggccgaaaggatctcactctgtcaccctggctggagtgcagtagtggcgtgatcataactcgctgcagtcttgaactcctaggctcaagtgattctccctcctcagcttctcaagtagccaggactacaggtgtgtgccaccatgcctggcgattaaaaaaaaaatcgtagaaacagggtctccaatgttgcccaggccggtcttagaaaaaaggacttagctgggcatggtggtggcatgcacctgtagtcctacctgcttgggaagctgtggcaggaagattgtttgtgcctaggagttcaaggctacagtgcgctgtgaatcaccactgtactccagactgggtaacagtgagaccctgtctcaaaacatatatataaaaaaaaattcctggtgataatttgataattcctggtaaaaatttctgccacatccgagtctgtttccgaggcttgctttgtttcttcagattgtattttttgcctttatagtgcctcataattttttttcatagccagacagaatgtatcaggtaaaaggaactgaggtaaataggcctttagtgtgaggttttatgtttatctgtttagaagtcaggctgtgtttagtgtttgttctggctgtggtatcggaggcaaatgttacgggatctttaaggtgttgcttttctgtctagaaacctctgtgg

SEQ ID NO: 1279 - DNA, 3198 bp, Homo sapiens
ccgggcttgtctcaaccccacccagtggctgctgctgtctgcgcccgaggacctcatctcctcgcagaggctggctccccgcgccccgcatcccacgctgggacacgcgtgtggccttgccagggtgggcgagacacggccgccttccttcacatccaacgccggtgaggctcagcactcattgtctcactggcagcacagacaaagccttgcgggctccacgggataatcaacagcgagaacgcccccagggacctccggaaagagacaccattggttgcaggcctccaggttctcgtctgcctggtcaagaaaggcacaaaaaggaccaacaaataatactgacatggtgctttggatccaggaggccttgcggtaccaggagaggaatactgatggttccatctggcgaatgggaaaggtgaggcattgagagggtgaaatgctttcaggcataggtgagggggtaccaggaaatttaagggggagactctttttcctgggggcaggtggagaaggtacacgaccactgatagtgaacacaactctcaacaaaggcaattccagctcttcggccaccacagtaaagcagccaaggataccctaattgtcctcagagaagtagagatgattccttcacagagggaatcctacactccaaactctctggggcccacccttgagacggcatgcagggctggagatttaggcaggaacagcctgggcaggcacgtaaggtagctctgcttcttaaggcatgactgctgtcttcatggagtgggccccaccctgcaaggaagcttaatggaatggaacactgctcccaaaggaatccagcccctccaggggctgggggtttctattaaagctaaacagcatcaccaaaccaaccaatttcctgtgccacttggtagaatgagggagggggcaaaggacaaaaattgaacattatctgcagatgactgtctaactagaaaacccaagggactaaactggaaaactatcaaaactggtgagaatttgctcaggtggccgattaaaaggtctaaaaaatcaactgctttttggatcatttgggcgtggcttgacaccttggaggagctgtgtttctctgggaggcctccgcgatttgtgcagcttgccatattttgaaagatggaggtgagccagggtgatgttccctcagcagtagcaacactgtctcagacaccaatgtcgaacaggtgcctggggcaactgctgcagaaggggtggggacaaccacctctgccctctcctggggggccctctcaccagtcctgatcagcccctttcccccaagcttctctattccagcccaagagacacatagggaagtttggcaagggtcggtgcgggagccatcaagggtggatgtgggcagattgtgctgtcatctccaaatgaagtaagttttaaaaacaaagggggccagctgacaggtcccaaacgtctgtactgttgttgcctcattggtcagaagcctcgagaggccaccgcgctgcgcaccgagcggggactcccacgatggtcagtggttgagggaggccccagggggctgtgcgtgccaatctggctggcaaagagccgcagttatttgcggtccaggctggcgtgtagctgggcctcccgcaccatgcggtcgaaggatcgcgtgttggtctcctcgcgcaccttctcacgcacgtggaaggaagcccgggctgtggagcgggcgctctccagcgcactgcgccgttcccgcgtcagctgctcgctgcgctccagcttgcgcccgatggcctggagtagctctcgccggcggcagtcttcgtccctctccaccttctccttgttggcgcgctgggctcgttccttctccagccggctctggcccacgcgccgcgccttctgctgcactgcttcctcggccacctgcgtcgcgtgctgcagccgtcgctcccccgcccgggccagcgcctccaggtgcgcctgatgttcccgctctttgcgctctgccgcctccttggcccgccgaccctgcagctcctctcgccgggcccgctcccgcagctcccgggtgcgctgctccaccaaatgctcgtagttctcctgcgcacggcccaaactggcttccagcgagctccgcaggccctctcgctcctggcgctgctgccgggtccgaccctgtagcagcgcctcgtggcgcgcccgctcggcccggctcagctcccgcttctcccgctgcagctggccctcctgccgctgcttggcgcgggccgcgcgctgggcgcgctccctgcggatctgctcagcccgctcccgcccttcctgtagaccttcctcacgttgcttcaggttctgctcctgctgaagcttgcgcagccgatcctcccgggccgcgcgctccgcccgctcccgccgcaggaggccctggcgttcggccagctcccgccgccgctcctcgctgcgctcgtactgccgctgccgccgccgcgccgcctcgcgctcttcgcggccacggcggcctcgccgctcctccacctgcgcggcccaggctcggcggccctgctctagggcgcgctgcttctcccgctcctcgcgctcccgccgctgcttggcgtgcacgcgctgcagctcccactggccgtgggcagccgcgcgttgctccagcagcaggagctcctcctggtgccgcgccagcatgagcgccgcgatcttccggtcacgctccggcaccccgcgcaggccgcgctctgcacgcacttgacgcacgatgcgctccacgtgctgagcggtctgcggcgaatggctcaggtcgccgaggctgaagctgcggccggtgatcggaaccagggtcagggcagacgggcggcccggagcgttggtggtggaggacgccgaccccgctgggcagctgttcctggccgaggcccgaggcggccagcgcagctccctcaagctttccccactgtaggatgacgacgatgcgcccgactcggagctgagggcgccctcacgccggcgggacagtgagtccagcgaatggctcttcctgcctgttcgagaacccgctggcggaggttgggtccgggcggaggagggactaggggaagccttgcgggccgcacgcggcgcgggcgaggccgggaggctggcgctgctgcagctgctgctgctgcccgcgctcggggccgaggc

SEQ ID NO: 1280 - DNA, 3163 bp, Homo sapiens
gggccacagagcgagacccgcctctaaaacaataataatagtgaaaatttaaaaaataaataacaaagaaaaatcctcactctttagctattgaattttgtggcggtgatttctttggaaactgcctcttcccacccccactccacccacaaacaggctgagctacatcagtacagagcctggcactccggatgctggcggaattgattcactagcatgagcaggaaggtccatttgaagggatcactccaaaacagcggctcacgacaaggtcaagaaaggcacaaaaaggaccaacaaataatactgacatggtgctttggatccaggaggccttgcggtaccaggagaggaatactgatggttccatctggcgaatgggaaaggtgaggcattgagagggtgaaatgctttcaggcataggtgagggggtaccaggaaatttaagggggagactctttttcctgggggcaggtggagaaggtacacgaccactgatagtgaacacaactctcaacaaaggcaattccagctcttcggccaccacagtaaagcagccaaggataccctaattgtcctcagagaagtagagatgattccttcacagagggaatcctacactccaaactctctggggcccacccttgagacggcatgcagggctggagatttaggcaggaacagcctgggcaggcacgtaaggtagctctgcttcttaaggcatgactgctgtcttcatggagtgggccccaccctgcaaggaagcttaatggaatggaacactgctcccaaaggaatccagcccctccaggggctgggggtttctattaaagctaaacagcatcaccaaaccaaccaatttcctgtgccacttggtagaatgagggagggggcaaaggacaaaaattgaacattatctgcagatgactgtctaactagaaaacccaagggactaaactggaaaactatcaaaactggtgagaatttgctcaggtggccgattaaaaggtctaaaaaatcaactgctttttggatcatttgggcgtggcttgacaccttggaggagctgtgtttctctgggaggcctccgcgatttgtgcagcttgccatattttgaaagatggaggtgagccagggtgatgttccctcagcagtagcaacactgtctcagacaccaatgtcgaacaggtgcctggggcaactgctgcagaaggggtggggacaaccacctctgccctctcctggggggccctctcaccagtcctgatcagcccctttcccccaagcttctctattccagcccaagagacacatagggaagtttggcaagggtcggtgcgggagccatcaagggtggatgtgggcagattgtgctgtcatctccaaatgaagtaagttttaaaaacaaagggggccagctgacaggtcccaaacgtctgtactgttgttgcctcattggtcagaagcctcgagaggccaccgcgctgcgcaccgagcggggactcccacgatggtcagtggttgagggaggccccagggggctgtgcgtgccaatctggctggcaaagagccgcagttatttgcggtccaggctggcgtgtagctgggcctcccgcaccatgcggtcgaaggatcgcgtgttggtctcctcgcgcaccttctcacgcacgtggaaggaagcccgggctgtggagcgggcgctctccagcgcactgcgccgttcccgcgtcagctgctcgctgcgctccagcttgcgcccgatggcctggagtagctctcgccggcggcagtcttcgtccctctccaccttctccttgttggcgcgctgggctcgttccttctccagccggctctggcccacgcgccgcgccttctgctgcactgcttcctcggccacctgcgtcgcgtgctgcagccgtcgctcccccgcccgggccagcgcctccaggtgcgcctgatgttcccgctctttgcgctctgccgcctccttggcccgccgaccctgcagctcctctcgccgggcccgctcccgcagctcccgggtgcgctgctccaccaaatgctcgtagttctcctgcgcacggcccaaactggcttccagcgagctccgcaggccctctcgctcctggcgctgctgccgggtccgaccctgtagcagcgcctcgtggcgcgcccgctcggcccggctcagctcccgcttctcccgctgcagctggccctcctgccgctgcttggcgcgggccgcgcgctgggcgcgctccctgcggatctgctcagcccgctcccgcccttcctgtagaccttcctcacgttgcttcaggttctgctcctgctgaagcttgcgcagccgatcctcccgggccgcgcgctccgcccgctcccgccgcaggaggccctggcgttcggccagctcccgccgccgctcctcgctgcgctcgtactgccgctgccgccgccgcgccgcctcgcgctcttcgcggccacggcggcctcgccgctcctccacctgcgcggcccaggctcggcggccctgctctagggcgcgctgcttctcccgctcctcgcgctcccgccgctgcttggcgtgcacgcgctgcagctcccactggccgtgggcagccgcgcgttgctccagcagcaggagctcctcctggtgccgcgccagcatgagcgccgcgatcttccggtcacgctccggcaccccgcgcaggccgcgctctgcacgcacttgacgcacgatgcgctccacgtgctgagcggtctgcggcgaatggctcaggtcgccgaggctgaagctgcggccggtgatcggaaccagggtcagggcagacgggcggcccggagcgttggtggtggaggacgccgaccccgctgggcagctgttcctggccgaggcccgaggcggccagcgcagctccctcaagctttccccactgtaggatgacgacgatgcgcccgactcggagctgagggcgccctcacgccggcgggacagtgagtccagcgaatggctcttcctgcctgttcgagaacccgctggcggaggttgggtccgggcggaggagggactaggggaagccttgcgggccgcacgcggcgcgggcgaggccgggaggctggcgctgctgcagctgctgctgctgcccgcgctcggggccgaggc

SEQ ID NO: 1281 - DNA, 3126 bp, Homo sapiens
cacgcttacaaactgccttagttcttgcctaaagggatcgtaagcacgtccacctgcttaatctccagcaaaaacaaaagaacaattcccattttttttttctcccttcctccaaacacgcccagggctttcttccatgaccagttggccagagcagaccctggaaagaagccttccccaaggggccttgttgactatggccaaggcctggcccagtgctggacaccagtctatgtcaagaaaggcacaaaaaggaccaacaaataatactgacatggtgctttggatccaggaggccttgcggtaccaggagaggaatactgatggttccatctggcgaatgggaaaggtgaggcattgagagggtgaaatgctttcaggcataggtgagggggtaccaggaaatttaagggggagactctttttcctgggggcaggtggagaaggtacacgaccactgatagtgaacacaactctcaacaaaggcaattccagctcttcggccaccacagtaaagcagccaaggataccctaattgtcctcagagaagtagagatgattccttcacagagggaatcctacactccaaactctctggggcccacccttgagacggcatgcagggctggagatttaggcaggaacagcctgggcaggcacgtaaggtagctctgcttcttaaggcatgactgctgtcttcatggagtgggccccaccctgcaaggaagcttaatggaatggaacactgctcccaaaggaatccagcccctccaggggctgggggtttctattaaagctaaacagcatcaccaaaccaaccaatttcctgtgccacttggtagaatgagggagggggcaaaggacaaaaattgaacattatctgcagatgactgtctaactagaaaacccaagggactaaactggaaaactatcaaaactggtgagaatttgctcaggtggccgattaaaaggtctaaaaaatcaactgctttttggatcatttgggcgtggcttgacaccttggaggagctgtgtttctctgggaggcctccgcgatttgtgcagcttgccatattttgaaagatggaggtgagccagggtgatgttccctcagcagtagcaacactgtctcagacaccaatgtcgaacaggtgcctggggcaactgctgcagaaggggtggggacaaccacctctgccctctcctggggggccctctcaccagtcctgatcagcccctttcccccaagcttctctattccagcccaagagacacatagggaagtttggcaagggtcggtgcgggagccatcaagggtggatgtgggcagattgtgctgtcatctccaaatgaagtaagttttaaaaacaaagggggccagctgacaggtcccaaacgtctgtactgttgttgcctcattggtcagaagcctcgagaggccaccgcgctgcgcaccgagcggggactcccacgatggtcagtggttgagggaggccccagggggctgtgcgtgccaatctggctggcaaagagccgcagttatttgcggtccaggctggcgtgtagctgggcctcccgcaccatgcggtcgaaggatcgcgtgttggtctcctcgcgcaccttctcacgcacgtggaaggaagcccgggctgtggagcgggcgctctccagcgcactgcgccgttcccgcgtcagctgctcgctgcgctccagcttgcgcccgatggcctggagtagctctcgccggcggcagtcttcgtccctctccaccttctccttgttggcgcgctgggctcgttccttctccagccggctctggcccacgcgccgcgccttctgctgcactgcttcctcggccacctgcgtcgcgtgctgcagccgtcgctcccccgcccgggccagcgcctccaggtgcgcctgatgttcccgctctttgcgctctgccgcctccttggcccgccgaccctgcagctcctctcgccgggcccgctcccgcagctcccgggtgcgctgctccaccaaatgctcgtagttctcctgcgcacggcccaaactggcttccagcgagctccgcaggccctctcgctcctggcgctgctgccgggtccgaccctgtagcagcgcctcgtggcgcgcccgctcggcccggctcagctcccgcttctcccgctgcagctggccctcctgccgctgcttggcgcgggccgcgcgctgggcgcgctccctgcggatctgctcagcccgctcccgcccttcctgtagaccttcctcacgttgcttcaggttctgctcctgctgaagcttgcgcagccgatcctcccgggccgcgcgctccgcccgctcccgccgcaggaggccctggcgttcggccagctcccgccgccgctcctcgctgcgctcgtactgccgctgccgccgccgcgccgcctcgcgctcttcgcggccacggcggcctcgccgctcctccacctgcgcggcccaggctcggcggccctgctctagggcgcgctgcttctcccgctcctcgcgctcccgccgctgcttggcgtgcacgcgctgcagctcccactggccgtgggcagccgcgcgttgctccagcagcaggagctcctcctggtgccgcgccagcatgagcgccgcgatcttccggtcacgctccggcaccccgcgcaggccgcgctctgcacgcacttgacgcacgatgcgctccacgtgctgagcggtctgcggcgaatggctcaggtcgccgaggctgaagctgcggccggtgatcggaaccagggtcagggcagacgggcggcccggagcgttggtggtggaggacgccgaccccgctgggcagctgttcctggccgaggcccgaggcggccagcgcagctccctcaagctttccccactgtaggatgacgacgatgcgcccgactcggagctgagggcgccctcacgccggcgggacagtgagtccagcgaatggctcttcctgcctgttcgagaacccgctggcggaggttgggtccgggcggaggagggactaggggaagccttgcgggccgcacgcggcgcgggcgaggccgggaggctggcgctgctgcagctgctgctgctgcccgcgctcggggccgaggc

SEQ ID NO: 1282 - DNA, 303 bp, Homo sapiens
gccagactcatgagtacatacagtattatttcactcacatgaagttcaaaaataggcaaaactaatctatggctcagtatagcagttatctttggggtattagaaaataactgagggggatgagggagatttcttgggcaccagtaattcctatttcttgatctagtagtgataccatgtgtgcctttttttttttttttttttttgagacggagtctcactctgtcacccaggatggagtagagtggcacgatcttggctcactgcaacctccgcctcccggcctcaagcaattctcctgcc

SEQ ID NO: 1283 - DNA, 386 bp, Homo sapiens
ctgtatccatttttataatataatggctgattctttcatatcatacagcatattccaagcaaccttaatgaagactagctgatgtgtggtcaggaaatgaaactgaattttaatatgggccaaataaaaatataattaagaagattaatctgtcaaagttaaagaaaaattgcctggtattttctttttttttttctcttactcctcagggatccttgttctgatgcctggtattttctgaggctaaatgtaaagaagggttaattatcacctgctgtgctggcctggggactaactgggtcatgctgagatcctacggaagcagcagaactatagttaccaaacagcctgaaatgagcctgagaacgcatagcaagagacaggag

SEQ ID NO: 1284 - DNA, 249 bp, Homo sapiens
agcttgccgatacagatcttgggacttctcagccttcgtaaccaaggatttggagagagatgagacaaagttacgttaaatgaggaccgtgattgaggaacctgggagcctgaggaagagggaggagcagccccttaccaaaaatggggtgggggctgatgaagaactgaagtggccagaaaggaagtgatgccggatacaagtcaggaacagccaaatggaagagatgcagaggacaaagcatgaggg

SEQ ID NO: 1285 - DNA, 683 bp, Homo sapiens
agcactctgtgtctagctaaaggtttgtaaacgcaccaatcagcactctgtgtctagctaaaggtttgtaaatgcaccaatcagctctctgtcaaaacggaccaatcagctctctgtaaaatggaccaatcagcaggaggtcggtagggccagataaggaaataaaagcaggccacctgagccagcagcggcatcctggtgggtctccttccacactgtggaagctttgttctttcactctttacaataaatcttgctgctactcactcttagggtctgtgccgcctttatgagctgtaacactcaccgcgaaggtctgcagcttcactcctgaagccagccagaccacgaatccaccagaaggaagaaactctgaacatgtccgaacatcggaaggaacaaactccagatacaccatctttaagaactgtaacactcaccgcgagggtccacggcttcattcttgaagtcagcgagaccaagagcccaccaattctggacacacttcgagtagtgtggttggagaaggtccttgggagaagacaacatcacacctgaaataagagagattagaaggagccagtgataacagacctggaagaagggaattcaggacagagggagcagaaggctctaacgtggaaacaagaaggccagagtacccagagcagaatgagaagggg

SEQ ID NO: 1286 - DNA, 658 bp, Homo sapiens
agcagaagtaatgtgtatgaaggcttggggccacgtggaccttcgcaggggtcccagcattttgtgattaccagcatattttttctcccaaggcaataaagagagaagatggccctcatggtgacccaagaaggaagggaatccagagcagctgcagcttaaccctgggagttgtggcacagccctatggagaaacaccaggtcttgacagttctgggttggttctctgtgaaggaagttgtcacactgattggtgtgctattctgggttctgggtttgttgttggtcagagtatgaaagtctggaggccggacacagtggctcacacctgtgaacccagcacttttgggaggctgaggctggaggaacattgagtctggtagttcaggaccagcttggacaacatggtaagaccccatgtcttcaaaaaataaaaacatgggccaggggcggtggctcacgcctgtaatcccagcaatttgggaggctgaggcaggcggatcacaaggtaaggagatcaagaccaacttggctaacacggtgaaaccccgtctctactaaaaatacaaaaaaattagccgggcatggtggcgggcacctgtagttccagctacttgggaggctgaggcaggagaatggcgtgaacccgggaggggag

SEQ ID NO: 1287 - DNA, 1790 bp, Homo sapiens
gccaccgcgcccagctccccacctcttaatattgccatagtggcaattacatttccatatgaattttggaggggacactcaagccatagcccaggctcggatgatggtggtgtttgtcaacgtacacattcatttccctcctgggtgagtctgggcagtggtccaggctgccaggacacagatccctcctactcgtggcccctgggtcctgggtgtggatcttgctctcacaggtcaggctgcaccatcagggctcggcggcagcacagccagggtggaggaggttgacgaggcatgcttttggggtctctttgggatggggctcaggagctggcatgaggcacctgcccacactctgctgcccagaacttagacatgccagtgccctgagctgccagggagccaggaatagggacctgcctttgggtgccgcatgcccaggtgaggaagaaggggagccctcctgtgttgctgcaccttggtaactttactggacttttcagtgttttcctcccaagcgttgcccaaacctgcatcctgcccagcagtgagagagcccagggaccacctcctcactcacacctgctgctggcaaatcctctggacaaagtgcaatgctgcaacattttacaaaacagagtcgcccttgatggtcataatggccgagaaggaaaactcacgacgacggaagccatcgactggcgaaatttgatatggatgagcaccggcccgtggttcaggttttcgtagtaaaatttatgtgggggagaatttttttttgagagaaacgtgtgtttaatggtaaaaattagcataccccatcaccaggaatggcgtggagtagggacgggcagcagggacaggcaggtgacccctgtggagcctcacgtggcgaggatgaggaagacgaccaccaaacagaacagccccatggcctcagacacagcaaagcccagaatggcatcggagatgagctgctgcttgagaaacagattcccggcatagccaacaagctgccagacaccgttccaatgccaggcccgaagccagccacaccgacaggggctgccccaacaccaatcaacgtggctgctgtgtcaacatcccgggagacagctctggtctggaactcccacctggccacctggtgtggggagcggctgtaggaaggctgttcagatgaattttctgggctgttcaagaaggagacagacacagcctgattagacccgtggtacaacagcggaccagagctggagagtgcctttgtgagctgtgacactcatggtaaaggtctgtagcttcatttctgaaaccagcgagacccccaacccaccaggaagaacaaacaactctagacgcggtgccttaaaagctctaacactcaccacgaaggtctgcagcttcagtcttgaaccaccgagaccacaaacccaccagaagaaaaaaaaaaacaaaaactcggaacatgagggaacaaacggcgggacatgccgcctattaagaactgtagcactcactgcgagggtccgcggcttcgttgttgaagtcagtgagatcaagaaccgaccaattccagacacagtagtacggcaaggcccgcctgagcttgtcgtaattcacgttggtcttgttcttgcgtcgcccccacggctaggccaccttcctctgcaaccaccaccatcccatgaagtccaggagctgtggccgttgccttgctctcagctgcagcagaaagtgccagagcgtcacaggtgggtccatcgccgggggagtgctcacgccatcct

SEQ ID NO: 1288 - DNA, 1046 bp, Homo sapiens
aaaaaaaaagtttattacttatgtctttagatgaatgcacacttacatacttacacatagacatatagcttagaaggtgtataagctctggaaaactttataattttgagttggtctggcaatatttcccagccttctctctgtacctagttatataaataaactcccttctatccagttcatctgcatctcattattgggccatgagaataagcataaaacaaaccttcctttgatgctggtatctaagcaccaaaaaatagataccagcatcaaaagaaggtttggatacaaccttctttcattttgtttggatacaaggagctagtttgggtctgctcctttaatgtatctatgctcatattttccttcctcaattataaaataaagtagaggtgaacactgtggttagccatagattaaccaagaaagcagaaatcatctcaaatgttcacagcagaaggaatggaaagcagtggtgggtccatgaagagtggagaggctgagaattaaacagagggctctaaaataatcctgggagattgacgatagcaggaagtctttatcattcttgggctggagagacaaaaggaaaacatggaattactggcaccaagaggaccactctgggagactggatctctggtggcctcgatacaatgggggctggagtcacagagaagataaagccactggagaggccaccttaggctgaaaacaggagggagtgtcttgatagctccctcccccaaaaaccgctcctcaccctgctctctaattttccatggttgatatattcctgctgcccgttgactcagtcctttcagaaattctctagagcctgaaaaagtcaccctgccgaggatcaacttcttcaccccagaacaaggcagagcagaaggatggatctgagtgcaaacaggtccaggaccagcacaccatatgccgaccttgagaaggaaattcactgagccattccttacgagtgttcccaggagaaacaggaaagtgagaagtcaagtcggtccaagaagaataaagaggcc

SEQ ID NO: 1289 - DNA, 626 bp, Homo sapiens
cagatttcttgaaccatagtttataaaacaattacagcactttactaataagtctaatatttctaataactaagtagaatgtaaatagaattgttaaattaatgtgaaaatatatacaacaatgtttacttaataacagactaaaatatagcagattagccaccatgattttttctttttctttttgagttggagtttgctgtttcgcccaggctggagtgaagtggcgagatctcccctcactgcaacctccgcccccggggttcaagtgattctcctgcctcagccaccaccatttaacactgagaagtgggcagtcacagagaaaaagtttagaatagttcaccagtgaagtcatctcaaccagcacagggccttgactcctaacaacaatcacacgaacttggaagaggagccttccccaactgaaccttcgcttgagacctcgtccttggccatcctctacatctggattcatgatacagagaaactgtgagtaagagccactcagtgtgtgagaatttattattcagcagtaaataatacacctgacagtcaatgcaatgtggtatcctggacagaaaaatgacattacttaaaagcctagtaaaatatggaaaaagcct

SEQ ID NO: 1290 - DNA, 8906 bp, Homo sapiens
cttttagtaattccagtagagcaggcctagtagtgacaaactcccttaggcattgtttatctggaaaagtgtttatttctccctttgccaagtaaagtattcttaattaacagctttgtttccttcagcactttgaatataccatcccactctctactggcctgtaaggcttttgctgataaagccactgaatctgtattggggctaccttgaatgtgatgtttcttatctttgctgctttcagtattctttgtctttgatttttgataacttggttgtgatgtgtcttggtgaactctttaggttgaatctgatcggtgacctcagcttcctgttcctgaattttgtcatcttttctcagatttgggaatttttcagctattacttccttaaatatgctttctaggcctttttctttcttttctccttaaggacctcctattatgcaaaagttagctagcttgatgtgtcctgtaattcttataggcattcttttttgtttttgtttctcattggataatttcaaatgtcttacctttgagctcattgattcttctgcttgatcaagtctgctgttgaagcgttctacttagattttcagttcagttactgtattctttatctttagaatttctattgtttttgtttatatttgttaaacttctcattctgttcagatgttgttttccaaatttcatttttctatccatattttcttgtactttgttgaacttaagaggattagtctaaattatttgtcatttcacaggtctccatttcttctgagtctgttactggagctttcatatccaatgtacaccagaaactttgctaattccacagtaaatgttagaaatgggtttttattgataaaatcagtggcttgctaattagtatgttagaagctggcttgcattggtgaagttgagggtattcgatatacgtatcccggctaaaatacttctaaagaacctctccagctttgcaagaatagagtataggaatctgaggaggcctttaacatggccctcagaaaggacacacagggcttgacctctaaacatataaacatatacagaaacgaggtcagaacatgttttgactgatgccagtagtaacacagcagagcctattgctggtcactgttaccaataccttgtgtaataaacctttcatttaaattgagaggttgtaagccccgaaaaagcaaagggcttacagtacctcttgcctgaacactcctgtgtgtgctttctaagaaatgcttttaaaataatgcctgtggcacaaattgatttgacactggctctctttataagctgctatcaaggttgtggggaatagctaactcttacccactttccctgacaaataggaacccgtagttacctaccaaaagtatgtaaaagctatatccgacccaaaggccagttaggtcaaaacaccttgaaaggagctcagtttaaggaaatcagtggtgtcacagtgccccactagcgtgtaaaagttttcatagtttgactatcggatgtgcttagtttcacagctgagtcttaccttgtgatacttttagagcaaaagtcaaatcaaagatgatttaaaaaaacatttcaaagattcataaagaataaatgcctcctcaggaagtcttctggagttctgcccacttcccttaggtggctctttactgtgcccatctcatagcctgtctccttccacttggtgtattgcagagtaaagctcactgtttacaggggtggtagaaagtgtggtcctttcccagactcctttttcccttcctcttctcatttttcagaagatgtgtttgataataaacgaaacaaaatgactaacacattgagctgagctacataagcagatgtcagtttgacgtgaagagtttaaaagatctatgcattatctggggactcctcccccagacctgaaggatcaggtgctgccttctatgccacctgtgcagacagcaaaagaggaaaaccatacccacgttcagtatgaacaaaggggacatttgaactctgtgtggacccctcattggaagggtgtttcttctcctgctgcatccacaaagagcactccttagccttgccttttgtcagttctctctccaataaggcttgagcagagacaacccagtgcagttcagagagactgaagtctggtgttccaggtctgagtcctagctctagctctctgtgtaactttgggatgtcccaaagtaacttttcacaacttgataggtgttaacttgaattttggatacaggtgactcttagcccatcccctctctgtgcttcagatatgtcatcacttgggccatatgacctctggacacctttcctactttccacaatttcagagcagcagagcagactggagctcctgctgcctctgagcttcagtgaattatcactcgttggagggaagcttcaagcattttgttatctttcaagagcaaacacagtgtctgtcagcaagaatatgtagcagatgctagtgaacagcagtgattagggttgaatgctggatttaaatatggagcttaggctgtgaaggaagcctgaagaacctagagccccatgaagctgccctctgtgagatctgacaccatttcccactgatgagccatgggtctaatgggtagcactgattccacatacagtatgtgagtgcaatacagtgaaagcaaagagaataaaatgatggctaacatgatgttccaaactttaaacaggagaaaaacacacaattccattatgtataagaacccacacagagatcaggagaataacctcattggagaatgaatgacctgtgtggggaatttagggtagagttgagattgaaaaaatgggccgaagtcaggtggccaagggccttaataccttgtatacaagatgtgtagtcaaggaagaccatgccttacttatgcatcaattcccttgggcctacaaagagctgcctagcctgggactgttgtagagaaaagctacagtgttccaatgacacagggactcctccatgtatgtatgagtgcccagctggctctgtaataaatcttatttttatttattaacttttcttgcgcattggcttgatgcatcagttggaagtcagaggccaaacgaagtgaacactgagccaaaggaagttctcagcctttagggaggcagaattcactttaaacacaataaacaaatgaactcacattatacaggagagagtcagaagatcccagtggctggtgtcatcgggccatatttgcccgaagtgcctattccttataggaacccactcccagggttgatgggctacatccttaggaggctttatgcctatgttctcctgaccactggctcctccagggctggccttttttagtctctctgtagaggttcctgtagctggttggatataggctttcacagaagggtcagtgccttgggtctggttacaggactgttaatcttgctttgttaagagtaatgttatttccccatttccaaattctccagggagatggaatgtcaaagatagtatgactgtagcacctaaatcctgggttccagaagcagagaagagaatacactgaagctgtagaaaggcctattagtccatgtcagagattaactggatgcgaggaccatttctgggatggtgtatacagaactggagaactggatagggagtcagaaacaaagagctgaagatgatgcctttgaagtttccaacgtggataactaggtcaacagaatattactcaagaaagtattaacataggattgagatgcagtcagtagtaatggaattgaaatttcaaagtatatacctcatggatctcagggggtgttgagctgatcacctgggctaacactcctatgaccctggggaaaatcaaatgacctggtactgtagccatggtaggggtgtcatcaccttaatccaactgggacagtgctgtttgatattcatctggaacttggtgcagacccacattttgctgggtttcaccacaaccaaggcttttttgattcttttctcttttaacatcagtacatcactgcaaagttaatcctcatataataggagatgaaactaattgcttataaaaacaagatttttacaacactaaaattgttcaagcatatgggcatatttatagttgcaggcagtgtttcagatgcagactgttcttggctgcagtggttgtttacaggcagcatctgttctgattaaatatttgatgattatccccgaatgttttaaagcatagtactgggctctgctgactgtacaacaaactggcatttttgacctatagggcactgggctaggagatacagttctgagggaagtgaaagatagttaacaactgcacaactgaccctttattagttgcaataaagcaatccaaccacccaacccactgtgatggctttcctactatttaaggttggtggtgtcaaagagacaccctcctgtacagtgtgcagtgaatcaacatcatttccacaaaacctccttcctgcacaaaggaattatcatactttgttacgaagtaaaattttcctgtatcagtcacaggagttcaccagttaagatactgttagttgaagacttctggggtgacttaatgaaatagctcagccatctggtttaaaaactggattcttctatccctccacacagctgtccatgcacctgcatcatctcaaggctggtctccctggtggtagaaaggctgacagtaaaaactggagccacatgattccttgcttaggcagtgtttcttcatactctcacatgagagcaggcatgttctttccctaggctcacagtaaacactctgtcaaatctcacaggcccaaagtgcttttggttatccccattccaagccaatctgtggcatggaagatagcattaccctgactgccttagactaatatacctactccacttctggggctgggaataattttgaggtcaaccatccaaactgcatgacagccattccatggaagaggtatggcctaaatctttggggcaacctgaattcatgaaaactctcttagatttatgtaactatttttagaattcacttctgtatcatttaattttactaataaaaataccacctttaccctaaatgtcagccaagcgtaaggctccgttgggacagaaggaactatcaaagctttgtgtttttatacattagcagcatttgacaaagaaataactctgaaggaaggagaataaccaggcagagtctagatgcatggaaaagaagtctttgagaaggcttcgcaggctgaaggaaagggcaggactacttcaggaatacaacgtttaagtaaaagaggttggggtctgttgatcttgaggagagatgaggatggactggaaaataggagtgagatatagtaggagaggaaaggatatggatgatgtatatactgtatgggtaaccatcagtcgaccctaagaagataatagttgttaaatggttagctatttaatgaaagaaacctgaacaagtaataatcttgagttgcaaagtggctggagtcacacaacagactaaatttctggtagaacaaatccagcagcttatgtgaaggttaccatgtctgaagctggatagaaaaggtctaacttccaaccaaagtcacagttcttgagctcggtacacagagacagactgctaacagctgatgtgtcctcagcgagagtgtcctcatttatatcctcgttctcttctgcctcctttttttgttttaaacttttgggaagtctcatcattcaatacagttctaatatatcacaataacagaggcggcccaatttctacaaattgactaattctatccctgaaaagttcatacaataaaactatacaaagcatcattttcaaccatcctatagaaaaatttccctattaaattttaactctaaatcctctatctctgttaataaccttactaaaaacttccccatcactgcctgccagggagatcaaaagaaaccaaatttaagaaacctccaacacctgtacctgactgaaaagcaaacatacagacctttcagtcctgcccctactattcagctcctatcacagagacatggtggatgtccccttgggaagcggatagctcttaggtggaagctaggcctgcaataagcaggccaggaaacatgtctcccaggccccatactcttggcagaagcacttggccaccagacagcatgtcctgtcaacctacagagttcttaaaaacaaacactgggacccagaatagtaccctgtggtcatagtgcccacagttcactaagcaccctcacaggtctttgacagaacactgactgccaggtcacctggtgggcagagaaatggaagattcccaggcccaactagcatctcagggaagaaccacaagcagagcaactttcagagctggtcggccagcgttggcacccagggaagcaagtgctattccatatttggagagaacataaaactcaaggaaacagagaagtcctactcaataccgttctcaactgaaaacaagagaacttgcaaaaaagaaacccagttttctggagtccatggagaaatatgaagccaatgctcggctaacagagcagaaagccttttataaataatgccagtcaaagctccaaaggtcagagctgatgcatgccggattgttctgacaatttcttaggtttctaggcaacaaggagctggtcaaacagctcacctccaaggacatactttataataccaccctggtagacgagagcgaggcagcagtgaaggcaatagtcaagaacaggagagggaggtaaagaacaagatgctcttcagacagtctggacaaagacagtccctacccagctctcaggagttgcctccttaagaaggtggaggcccaggcagctcccagggtgaccctaaagacagactccaaggaaaagggtgtgagggcaatggtgaatataaggaggtcccctttcagtaggcagagcaagtcagttcaggtcttatttttagagtctctgaacagtgaagagaagctttctgtggacagcattccaccaccatgggaggggaaaggtgccatgagagacttctccagtggggcatacaagcattgtgcagtgatccccaagatccagccactggcaggaaatcgaaaggcaagcttcttaaatacatagtatatggagacagaagtgtggagcactcccaaaatgaaaggccaagacccaggaacaacctccacaacctggagtatatacaaatgaacccagccctgctgactcagatccacaccatcctaaagcaggggtttctcatgaatgaaagggctaagtatttggtggagagaatgagaagtctcccactgcccacacattttttcttcagagatttcttttccaagagccccttgaataaaggaagggagggagcactgaatgccccagaaatcagaatgcatggtgcgggaagacgacaggaaatagttctcaaagagatcagaaaataaattggaagcaatttcattaccacaaagaacagacattttttctaaggcacccctcccctttccacccaattgtcattcagcaactactgaatacttaccaatgaaaaacgttacccctgacctcaaggctgctcctgagctctggtagaaaatgctttccttgtctataaaacatggcaagcaaggcaggatttaacagtaagggcacagtagcactgcaagccttcaaatggaaacctggagacaagcagtgagaacaggaagcaaaagcagggcaggtgaagctaggaccagggcatctggaactttccacacaggttggatctccatgccagacaacagttttcaaggaaaaatatctaagaggaacatgactttgggaaactttttggcagtactgcttactgtatactagagagtaaaagaatttggggaacattcaccaatttgcttcttcaggggcttgggtagggaacgtgaacaggaacctggctctaatttctgaacttttttatcagtaaaaacaatccaacaaacgaaagctagtcagtgagagaactgggagggtctgccctccttccctgagtcaagccttctggggggacctcctgacatttaattaagcaaagacaacgcccactgaaggaagctgacctgaaagtgacacgctactgtgaaatgagcatgaagtgggagcttgttacatatatgaaatggccagcgatcctgagcaaagcgcttcagagcttgagacctaagtcttctcatctatatactgagggctggacaagatgatctgtcaagccatttttatccctaatccaccaaaatccaatgctttagtttattgtcacaaaagcaggtatcgaatggctatcctgcagtgcctccaatcaacattcagactttttccctgaggcaatataagataacagttaacatgtttttatcaattaggtggtcatgagataaatatatatgggaagtggtagtttttcacttaaatgcatataataatggtacagctctctttgaatagtatttgtttatttcttaaatatttaagttcctaaagacggtaagaataacccaaggaagtgaaatcaatgtcacaaagcacatggctaaataactgcaggtttatgtagcatggacaactgagattatcccaggaatgcaaagttaattcaatatacaaaagtccattaatacaacatattaataaaggacaaaacaacatgaaaatcttgatacagaagaagcatttaacaaaacccacagcccctcctttttttttttttgattaaaaaacactcagtaaactaggtttaataaaag

SEQ ID NO: 1291 - DNA, 405 bp, Homo sapiens
gtcaacatctgttcgtggctctcagttttgaaggctgtcagccccctgattcccactctgcactctatttctgtgtctttgtcttaattcctctagcgctgctgggttagggtctccacgactgagctggtctcagcaagcggtgctcaacatgggggcttgaacccaggatgaagagtcgctggagcggtggttggagaacctggaagtaagctggagaacacccgagtactcttaagcaatccccgtggccaaaaccagcagctgatttggataccatgaagacacctgaaaccttatcatgagccagatgccgaggaagagattttgcgagggacccaaggaccaccctgttgcagccaagtccagactgacaataaggcctcctttcctgtttgtagtggg

SEQ ID NO: 1292 - DNA, 2009 bp, Homo sapiens
tgaaggtgaaaggacagaatcaccatgtgttactggcacagatgcatcggctagtgaagaaagaagacattcaaactagtcccgctctgtcgcccagtctggagtgcagcagcgccatcatagctcactgccacctagaagccggggtgaagcaatcctcctccatcagccttcagagtagctgggactacctgcgcggcccaccacacccggctaatctttgtggtttttgttttgttttccgttctgggtttccgtcgggcgcagtggctcaggcctgcaatcccagcactttggaaggcagaggtgggcggatcacccgaggtcggagaccagcctgaccaacatgaagaaatcccgtctctactaaaaaaaagaaaaaaactacaaaattagccggatatggtggctcatgcctgtaatcccagctactagggaggcccaggcaggagaatcacctaaatccgggaggccgaggttgcggtgggcaaagatcacaccattgcactccagcctggacaacaagggtgaaactccgtctcaaaacagagaccgggtttcaccatgttgcccaggcggtctggaactcctaggctcaagcgatctgccacactcggccttccaaagtcctgggatcacaagggggaggcaccacgccaggcagatctattcctttctggttactaaattggaccgggggcgcggtggctcacgcctgcaatcccagcacccagggaggcggaggcgggcgtatcactcgaggtcaggagctcgagatcagcctgaccaacacggagaaaccccgtctgtaccaaaaaaataaaaccaaaattagctggcatggtggctcatgcctgcaatcccagacactcaggaggctgaggcaggagaaccacctaaacccgggaggtggaggccgcggtgagtcgagaccacgccactgcactccagcctgcaaaacgagcgaaactccactcaaaaaaaaaaaaaaaaaaaagacagtgtttcaccacgttgcccaggccggtctggaagtcctaggctcaatcgatcgccgcgctcggccgtccacagtactgggatcacaagcatgagctaccacgccaggccgatctattcctttttggttactaaattggaccggaggcgcggtggctcacgcctgcaatcccagcacccagggaggcggaggcgggtggatcacccgaggtcaggagcttgagatcagcccgaccaacacggagaaaccccgtctgtacaaaaaaaaaaacaccaaaattagctggcatggtggctcatgcctgcaatcccagccactcaggaggcttaggcaggagaaccacctaaccgggaggtggaggccgcggtgagtcgagaccggaaaacactctagcctggaaaacaagagcgaaactccgctcaaaaaaaaaaaaaaaaaaaaaaaaaaagaccgtgtttcaccatgtcgtccaggctggtctggaactcctagaacctgtagatgttacctcatttggaaaaagcatattttcaggtatgattaagttaaggatcttgaggagagattatcctggattgtctccgtgggcattaaatcctggcacatatatccttataagagggagataaaggagatttaacttcagacagaagagaaggaggccctgtgaccaagaaggcagagcctggagtggtggagctgcaagccaatgaatgccagcagccatcagaagctgcgcaagtcaaaggatggattttcccctcagcctctgagagcactggctctgctgagacctagatttcagcccagtgatactgattttggacttctgatatccaaaactgtgagaaaataaatttctgttgttttaagtcaccacatttttggtaatttgctctaacagccacaggaaagtaacatacatgcctacctgggtccagttgtgtcctgtgactcctgctttcctgggacaggcaggctgctccgtgcctcctggccatcctactgg

SEQ ID NO: 1293 - DNA, 241 bp, Homo sapiens
atttgaatgaagataagagaagaggacagtgagagatgttccaatgatggcaacacgatgttccacgataaaactgacacaaaaaacaatgcaaaatttgtctgagagaggtttagcaagcatgagaaaaacatctgatatctctcagagcccgccaagttcgcagcttacagtgccagagtaattatgggatgatttgaagagaggcaatgcatgaggaagccacttccaaatgtatcag

SEQ ID NO: 1294 - DNA, 505 bp, Homo sapiens
ctaagccaatccagcctcgctctccaaatgccactccgaccccagaagccactcctttaccgaaacatccccgtgggagatgagttcagagccagcccgggaggactccagtcagctcggacaagactgcccttctgtcccaacacctccagaggacacacacaggcagcctgaccaccatatctgctattgcactctgcctgctgccacagccccccgggcacttctggcccccacagcgtcttccatatctttagggggtggcagcagactcacagcaagtcccatcttcctggagcccaaggaaagaagatgaaatgaagacattctcagatgaagaaaaactaggagaattaattgacaacggacctgctctaaaagaaagtggctaaaagaagttcttcagactgaagggaaatgatactagaagggaacttggagcttcaggaatgaagaaaaaacaacaacaaaaaaaaggataaactaagctctacaaactcagaag

SEQ ID NO: 1295 - DNA, 690 bp, Homo sapiens
ctggcaactaactgtctgtcttgctctttgagctctcattgggtttagcttgtggttgcatcatcagaagatccaatgaaggaagaaaagaagatgagtgcccaaccctttgcggagatggatatgccaagaagagaaatttatagcaggctgcctgctttgctccattccagatcaatttacacagaacacccagagggcaggtttacgccttctctccatttctctcaaacagtgatggcaatgagtggagtactagagacaacatagatatgcaaccacgggataaatgaccaaaggacagagagacgagcgacctcagttgtatgatggaaccaagagaagtcgctgatttttagttgttttgatctggttgtaaggatggggtgacaacttccaagcttttacacgtcagcactgaaactgcaagtcccatttgttattaatctttaagcagacatattgctacagaagacggactccaaattagaataacacaaagttataccactaatcaccttatacaaatattttagtgttgacaagatttctctgaatgtatcatttctaaaatcagtatatctaatttctctgatccattatcattcttaaacttcccatttaaaatggactttagtgtctaacctgcctatggaatgaaccagatcaacatcctgccatcatgtaacg

SEQ ID NO: 1296 - DNA, 659 bp, Homo sapiens
acactgagcctccagagggcttactgaaagaacactttgatctgcctgaattggagctcttcttgatgtggccaaccccagctcccccatagaaagaaagctgcctctcttcttgtttctaaatttcactagtcccctattatccacaccccacaagtgcagggaagcttccagtcccactctcctttggcagagtcaggcagagacagggcactgaccccacctggtctcgccccagcacggttcaaactgtgctcctggagtctgggcatgagtgctggccacttctctctcaattcagcccatactctgcctctagagtttgcacttcatctggagggatgccaggtggagcctatttctgagaaaagccacagtggttgagcagttcagacagcacagacaggagcaacctagccctctgcagctcagacctctcctcttaattccttactcttccttggggttggctttccacagccctccagcctgaacagcaggttccagacaagtcaggacacccttgttttctctccctgatgctgcctggaactctgtcctgccccacctctaggagtagcagctccagccttgttcttgattctgctcatctggctcaccctcactgggcatctctagtggccaaagaaagtctccac

SEQ ID NO: 1297 - DNA, 371 bp, Homo sapiens
gccactatttgaagtctgaactttaaacagattcttggactggtggttcatatccatcagctcgttcaactttagcacctgtctcgtccccagtggcttttccagaactactgccttcaccatgaagctccatgagctttcccaattcaaacttgggcttcttcagcatttttacttttctaacgaagacatcatggagaggataaatagattggcaagccttttctatgtcttttccaatgctgtctggaatcaatttattgaccacttctttcaagtcatttgtctgcacctctcggatcatgatttccatcatcttcttccggatttggcggacctgttggtgctgagcataagagggcttccttatc

SEQ ID NO: 1298 - DNA, 508 bp, Homo sapiens
acagcctgtagccacagagaaaagttgcttgttcctgaaatgcagacacacctccaatccagagagcaagtcatctcgtggaggaagtggtagctgtaaaaattcaaatggaaaaggcatagagacgaagtcttgctttgttgcccatgctggtctcaaattcctgggctcaagtgatccttctacttagggatcccaaagagctgggatcacaggcgtgagccaccgcacctgaccacacaaagagttttgaaccaggaaggaacctggagaaattatgcagcagtggacaaggtgggtggcctactgaaaagactgaagagaccctcaagagaatctggtagccatcagagtcagagacatttagaatggcacaaacacagcaggaagggaagcagtgattctatcaggcaccaggagaaatatgatacacaggttaccccatgtcattctcacaataacctaatggaagttggcattattaaacccactttacagatgaggcacc

SEQ ID NO: 1299 - DNA, 1083 bp, Homo sapiens
ctggaatcctgtcttcccaactccgtgtttcctgatctatcagaagtgagattgctgagtcaaagagtgaagacagagagaattttgccaaattctttccatggtgattgtacaacaattttgcattcctgccaccaaagtatgagagtgtctattctccagagcttcattaacagaattatgttgtcaaagctttgaatttttaccaggaataggatatgagaagatgacagtctgcaacccagaagagaaccctcacagaacctgaccatgccggcaccctgatctcaggtttccagcctccagaactgtgagaactggcttccatgtgtaaagtgctctatggagaggcctgtgtggcaaggaactgggagtagcctccagatgacagccagtaaggaactgagaccctcagtccaccaacccatgaggaacccatgcaatgaccacatgagtcaaactttgagatgactgcagaccgagccagccccttgataagagctttgtgagaggatcagagccaaaggaccaggtaagttgtgccagattcctgacgcacagacactacaagatgataactgttgttcatttaagccactaaattggggtcatttgttatgcagcaatagatgagttttacaacaaatggatgactgagaaacaaccaccaacgccccatcatgcattgaagcctgtcctcatcatgtagttgaatacaatcaaatctgcccctccacacagctcaaccactttaccatacaggagcaatgttttgcatagacacacacacacacacacgcatgcatgcacacacacacacacattctgaaaggtactctccctttctctatttttgctaccttactaccccattcaggtagatagcacccaaaaatctcactgtgtcaggccagagtgccaggcccacttggaaaccaccccctggcctgtcactgagcccatcatcctcatgggccctcctgtccgtttctgtgtcaccactaaggccagagttaccaactgcccagtgatctcatcacagagactaagtgttaaggctaaggagctgcagcaagggtgggc

SEQ ID NO: 1300 - DNA, 948 bp, Homo sapiens
gtcacccttgatggagccttttttctcatccctccctggtctcaacttccaatccaagtcctattgattctccctcctaagatatgagaagatgacagtctgcaacccagaagagaaccctcacagaacctgaccatgccggcaccctgatctcaggtttccagcctccagaactgtgagaactggcttccatgtgtaaagtgctctatggagaggcctgtgtggcaaggaactgggagtagcctccagatgacagccagtaaggaactgagaccctcagtccaccaacccatgaggaacccatgcaatgaccacatgagtcaaactttgagatgactgcagaccgagccagccccttgataagagctttgtgagaggatcagagccaaaggaccaggtaagttgtgccagattcctgacgcacagacactacaagatgataactgttgttcatttaagccactaaattggggtcatttgttatgcagcaatagatgagttttacaacaaatggatgactgagaaacaaccaccaacgccccatcatgcattgaagcctgtcctcatcatgtagttgaatacaatcaaatctgcccctccacacagctcaaccactttaccatacaggagcaatgttttgcatagacacacacacacacacacgcatgcatgcacacacacacacacattctgaaaggtactctccctttctctatttttgctaccttactaccccattcaggtagatagcacccaaaaatctcactgtgtcaggccagagtgccaggcccacttggaaaccaccccctggcctgtcactgagcccatcatcctcatgggccctcctgtccgtttctgtgtcaccactaaggccagagttaccaactgcccagtgatctcatcacagagactaagtgttaaggctaaggagctgcagcaagggtgggc

SEQ ID NO: 1301 - DNA, 801 bp, Homo sapiens
gggggctgatacagagtttattgaattagatttttctatttacaactgagatcacatctacatactattttgctagtctacatgggtacattatttccaacaagcttaagacttaccatgaatgggctcattcatacaaaaacacactcacactaattcttttaaaacagtagtgcatacattatactcctcctataaagccaactttgattaaaaaccactagtttcaaagctcagtctctgattttgaagatgaaccaagatatacgccatatgatcctacaatctattttagtcattttgtacagctgctatcttattggactacagtaaatattttttaaaaggacaccaatgaggggcaccatctggtgttaaccttaaccagaaagctggtttcctcctcctccccgcaaaaacctttggccaagagttctccactgtgaagactgaaaggacctggtgacatttcggcatcagtcctgttaccacttggaggtaacagaagcaggctcgtgtcctcctttaattctaccacactacatgactcgcaattggttctgaaattagaacccaagctgctctgtccaacaccagtgtacatgtgctttaactaaatgaactccagaggccaacagcagcagacctgctcaattcaccttccaaatcagaacaagaccaaaaagctcaggcttgagttgtcaactatgcataggttccgccagtgatgaggagctcgtaagcaggatctctactccttctgcacaacacgatgcaagcacacagcatgcccagcagctg

SEQ ID NO: 1302 - DNA, 2579 bp, Homo sapiens
aggtcttctaagtggctttgttgtctttctgcaagtgaagtactcttgggtattgatggagagtggcctctaaggcctggtttctagatcactccaggatgaagtaggggttagctttatggagtggaactttgcccaggggttcactgagtggtcattgccaagcaggaagcaccttacttcatgcttgagccttgcttaggtgtgagattctgaccaagatacttgctctgcccagagcagtgagcacttatttgatcccagctggactggagggtcccttccagctctgcatttcagggttctgtctggtagacatcactaatacatgacacaccacagaagtttggagaatggaattgtatagtacccagtcttccagttagagttttctccccccacaaaagtgtgtgtgtgtgcgtgcatgtgagtgtttttatccctgtcagttttacattctggtgctcttagatttttattcttctcctccttctgctcttaatagctcagaaggaatcttagcttcttccgtctaaaaggattggagctgaagaatacatgctacagatgctcagaatctttctatgagactgctggtgacatgaacagagcaggaggacatggggccttggatgaccttgaattcctggctgtcttctgtggactcccatgcagattccagtttccagcatacccatggctttctgatggagaaggtcagtgaagccgcatcacttatgcagctccaggtgggggtcactcggctcaaggtggtggagttggaactcagacctatgtcaccgtgacaagccctggactccggtgcggctgggcctggggctacctgaagggagagcagagactcaggtgcccggtgagcaatggcagtgaggagaagcagagagcaacgccagcaagcaacgcctcctgcccctgcttttgctcttgtgtctcttgaccctgtgaggtccagcaaccatggggactgagcagcagttggacttgggggcagccgagcttctggaaaattttagcttgttattgtgaagacttgtggaatatcccaaagtgctggctttcggaaaagggtgcctacattttcttctgcacaggctctgctgaaggagtttgctgcactcttgaaaggacaggcaagctcaggtcctcatggctcgatctctgagcaggcctctaacccagtgaggacagcggtcaaccagtctccagctaacagcttcctgcagagacttccagcattgttagctaacatgcactcttctgaggccttcaacagctggaaactgtttcaggactatcttgccagctaagaagcggaatcccagttcttgttgccaggaagcttttaatggccaatggagaatgctgtcctcccttggtgaaagaattcccaaggaaatttgggaatcttttaggattcacttcaatggaatgtttcttgggacatgtgtcttcaggcactggaagccactcacggacaagaaggcacggatgaccccttgctcagcaatgtgggattagcctctttgggcagggcaatctctctgcccccagtggcttagacagctggctctgagacatagcagaaggtctcacaaatgttaggaaaagggggttgagcattattcctccatgtggaattatttttgtatttatccagaaagtgactcttttttggtctttgaaatcatctgtgatataattagaagatgtcagagcttcaatgtccatgtcactaacctccccactcggtacctgggaagtctgaggtccacagaaggaaatgtcttaatgagggtcacccaacaagttagggcaggagggatgcccccgcccagcctgcctcccataccctgccacctccaaccttgctgtctgtcatcttcctttaccaaggaagggctcctctgaagccatgatgatttggggccctttggcagcagacagcaaactattcatacctttggtttttctaaactggtggagacctgagaccagggttctggcttttccatgaggaccataatatgctcctattcctgctgttcccttcttttctattgcaaggagcatgaaatggagcactcctcttctgggggccatgggaaaggagccattcccagatgccgtgatgcgtgacttcagcaatctggctgaagtgactagaatgggccctgttgttctcggcagagcaggcttgggtcaggcagggcggctgttaagaggacacggccggcattgattctgggagtatcgtttcctccctcccccggcctcccaagcacacctgtgtgggaggtaccaggcagagggcccagtgtgctcctttcagtccccttgcctgtcccacctcactgaactcgcacaaagagcttcactttgaaccgaaaggtcaggggtgaccagacttttcgctaagctggttcaaagggaggagcctgggccgggtgagatagattttggcccttttctcagtgtgggagagtatctgtttgttcctgggcacaactacagtcatattcagaggagaaattgcggagatggcatagaagccgaagctg

SEQ ID NO: 1303 - DNA, 264 bp, Homo sapiens
cttggccaggtggggaccggcgcggatatgcctccgctgggcctgcaggcggcgagacttacttgggtagcgatagtagaattcgttctccatgtcgctcaagttcttgtgcgtcctctctgaccaccagtgggcgtcggcctcgaagtcgtagcgcacgaacaccccgaagagaatcaccataatcacctgcaggagcaggcagggcacatgagaaacaaggaatgtttgggacactgtcacacaacagagcggcctggggag

SEQ ID NO: 1304 - DNA, 674 bp, Homo sapiens
gaacaattgaaaagcatgtgccacttgagattctgcagagaaagataggtaatcaaggttgaagaactgaggcagggcaaacggttcaagggagggtcttcactcacttcttcatgctactgcagagtatgttgtccatacagcagtccaaaggctcacagataaacctcaggattcccaggggaagatggaaacagattagtgacagcagcagcctccatgaactgggcgctcctaggagtcaaacacgaagctaagccttgtctttgtctgcccatcaccatgtgtccttttcatgacagctgaccatgcaggaagggatttttttttttttacaaggtagaaactctggctcagagaggtcgatcacttgtctaaaagtcacccagctagagggtggcagatctgaagaagaaagcagcatgatctcagccgtgaagaggtttaacaagttggcttagtggagaagggcatgccacgagcagcttgagggaagatgtggaggaaagaaggtgagggcagggttcctcaacttcagcaccaatgacatttggggcctgatcaatctctgttttggggactgtcctgtgcgttagcagcacccctggcctctacccactggatgtgagtggtcaggagtatgaccatcccctcgttgtgacaacaaaaaaggt
